United States Patent 9,487,797 (GENOMIC PLANT SEQUENCES AND USES THEREOF) - sequence listing, part 15

SEQ ID NO: 34295 - DNA, 1501 bp, Oryza sativa
ttgaacatcttgagcctatatttgaacttaattatgttgcttaaaaaatattatgcattgataggattgcacttaatctgtttgtcccatctgcaaggcagattggcggacctacctaacttgttgcatttgacccttgccttgtaattgttataccatgttcccttgtaaccacctagttgcgcctcggtaatcgtgcactctacacgagtatcgacgatcgccttcaaacttaaaatctgagaaacatcttgggtaaaacttgggttttacaaaagacttggaaaacccgacacctgggtcggtgcttgcgaacctaaatgaatttccaaaatcgcggaccgggtaacgtaccgggtgtacggtttcccgctcttgcacttaaggaccgtttccttggaatttcatccgaacataagacaagtacgaccacatgggtggaatgggacacccctggctgagtaactagctaatcgggggagccatgatgtcaagagacatgtggattcaacggggtggtgtcggggaggacccccgggtttcctggcacagtatggtctgggacctaatctggtgttggtctggaacccctctcattggcatatggtgaacctgtgtcggctttcgaaatgccttgtcatgaaagccttaaggtctctagtcgtggccgttctgcacgggctggatgatccgggttagtaatgacgtgtgggtaaagtgtaccccctctgcagaggttattaaactgttcgaacagccgtgcccacggtcatgggcggatgtaaggtgattcctagcatagttttgtttgactactgcttgtgaaatttgctgatgtggtttgggattgatgtttggaaaatctgcggctgatgggatcagccaggcccgggtggccgtttaaaaaccgttggccgggtgccaaccttgatcaattcaaaagactgataccttgcacatactccgaccggacgagacgcactgtctcatccgtgtcgtttgagaagcactcacttagttgtttcagaaaagagtttaaataaaatcaattgcaaaaacaacagcctttccttgaagcctgcattaaacacttattccccatggcttgctgagtactcccgtactcacccttgctctatataaataatcccccccccccagttgctgaagaaaatgaagcggatcccgctgacgaggagttcttccaggagcaagccggctacgatgagttttagggtttcggcctagttcccaagtcgcgcctgtgatgtgtggtccaagtcttggcttccgcttcccttttgtaatgcagttgtgagctcaggatctgtccgcagcccaacataactgtactcctactctataataaagagatctctgttgctgtgatattctgtcttcctgtgataccagcactgtttcctgggactggtatcaattaataggttaatttggagcgtcacgggctagttccgctcgggactagttcgggacgtgacac

SEQ ID NO: 34296 - DNA, 358 bp, Oryza sativa
ttttggtatcccaagagccttctctaggagaagtggtcctggccatgtcgttgcagaccgaatttcttcgcctcgggttatccagggaccttggccttagttcactctgcgtgtaaagagtcggtttgtggcggacacgctgtgcgtttcacggctagcttttacatgggttggtgtgtcagagcatctttacaattggtgcaaatggggtcggtaaatctcggtggccattattggttccgcgaagatagtgctaggggttgccaactccatccgagggacagaaagagtgttttgatgggggagaggggggggggaatcccgagatatggttccccggtcttgattgcatgcgtga

SEQ ID NO: 34297 - DNA, 203 bp, Oryza sativa
cctaagatacatcaacataaatttgatagtcaggtggcaaaataattattccatagtccagtttatagctctgtttggatcagctctatttgcatttttaatgtaatagtgacttgcgaaaacaaatgaaaatgatgttgcatggaaatgacagatgcatagtggttctattactaatgctatgtaattgtgtcatgtgcagg

SEQ ID NO: 34298 - DNA, 523 bp, Oryza sativa
ggcccacatatcagtgagcagtactgtacatgcagtactgcaggggatctcaattgcatggttttgggtagagtgtgagtgacaaagttgctcgacttcaataggaggcggtggcatcctcatcacggctactcttgtaggtggaggcgtcggaagacggagcagcggtggacaatggtgcctccagtgcaggggtggaaccagacaggactaacagaaaggactgaacaaagtatataaaactatagctccttcttctaataaatatatgatagaaaattttagtgaaaacttaatggggcttccatggttataacgctgatagcaaaggctcgcgtccccgtcgtccccatggcagatccgccactgcctccatgttaattagaccgcagcagagactcctgcattgttgagatggagcaacagggtggagggaagggcaaggacatggttggccttgatgatggagcttgatctattatccgccgcttggatcatgtaacttcaaatgaggtactactga

SEQ ID NO: 34299 - DNA, 1501 bp, Oryza sativa
catcactacctagttaaattgataaatatataaagagctccgatcgatccacaatcattttcgtagaaataatatcgttttcatcatttaaggccccgttcttttcttgttttgctgttgcaagattattatttcctatcagcatgcttctcagattattaaatgtggtgttatttgaaaaactttttatataagagtttctttagataatctaaataaatctatttttttagtttgtaataattaatactcaattaatcatactctaatggcttgtctcgttttatggactaccgagcacatttgaactaagtctaagtcattaacttgcaatcaaggggtcaaacctattgagaacagggaacactctacttcgcatcggggaatccgagccgtccaaagcccagttatactataaacaaagtcgcatccacctcaccagtgattcctggattcctcctcactccactcaacgcccatcaacatggcctcggcgcctcgctcgccctccaacatatcctcttcctgctgctgttgctcatcgccgtggcagcatcttgtttttacttgcatgcttatagggacagcaaaaataaccacaaataaaatatcgaaccgaactgatcgagactgaaacagcttcaaacatagggttgttttggtttgaagccctacaaaaattttggtaatgccaaatcttgagcaagtttggcactaccaaaattttggtaaagttgtgttatttctaactctattgaattagtaagatttggccttaatccaaatagctaacaaatactattcaaaactaccaaataattggtagggtaataattggcttcaatccaaacatgcctataatcctaactcattcaattcaccccttcttcctggctttccttcctcctcgtcacaccgcatgccacccctccttccttgtgtggttgaaccacgccactccatgccccctttacttcaatggcaataggcgcccacatgtttctggcggcgacgctgcctccactccaatagcgacgggcgacaacggataccaacttggagcagaagcgtctacatacaataggattggggcctgcaaatccaacgccgccataaagaccactagcccaggtgccttcgacgagccgggtcggtctgccgctcttatggatcaacgtgccatgaattcttttagtttttttgaatggggataactaaagatttctatgatttgtttgtgattttttagtgaccagtgtgattatttccatctcagattttagttatgaccgaagatcaaaccaaaacggccgaaaccgaatagctcagtatttattactccctccatctacttttgatagtcatatttctaaatctgaaaaatttatttttgataggcatatttcaatccaacaacctattctcttaataactttcttagatttaatgcgtgattatccattcttccacacatgattggctacatgggcattgagaaata

SEQ ID NO: 34300 - DNA, 296 bp, Oryza sativa
atgcctgcagtcgactctagaggatccccagaaaaatggcatatgagaatacacattcggggaggatatggcacagggttttaaaagaaaaaccatcaaattaactcaactcgccccaaattttcgaggggagattttttttttcctttttaacgtttttacacctcatcatcatcaggcctttcccttccctttctcctttctcgttgtgtgggttctttctaggccctaggacaagccaagaagcggcggaggggaagggaggaaaagggcaccagccgcaccggccggcggaa

SEQ ID NO: 34301 - DNA, 1501 bp, Oryza sativa
agttcgttagagagagaggatcggagaaagaaggtagtgggtagtcatggactcggcccaatgacagtacacttttgtttttggcccattcaggccgtaggtgttctgtctcgttgataacagctatgtggcgtgtctagaaattggatttgtgtctcttttttttcttttcttttaactattttttcttatgtaaaattttctcaagacgacccagttttagaaaaatatacattagtctctagatttatctttctagacacgaagttaattaacctttgcggcgccatcatcccgtgcaacaccatctccttcctccacctccacttgtaacgccatcgcctcctccccttcctctacctccacgttgatgcgatgagagcgtggctggcaagtagggaatttgcaagcgtcaatgactacgtgtgggcagggaagagatgggaaagaggatgtgtgcatgggagcttgccgagggtgtggcggaagcagcaagacaaacgtcgacgacgccgttgttgtcgggacggagactaccagcggcgtggtgggtgaagtcacagggagtcgaggccgacaggacagggagatcgacgggctaagggccaacctctaggtggccgtgcagacaaaggagaagagcaggaaggcgtcggacgacctcaccgccgcactctccggctacgatactttaggggagaaggtaatgctcatgcgcgtccaggcagtcgaggacgaggcccacgcggcagggcaagagaaatgtcaaaatagagagagaagaagaagtttgtgtcgctgacacgtggggtccaccaatttttaatcttattttaaagctgaaatgccgtgacatgtggctcccacgttaacttagccgccacgtcagctaaaaccgggaacaatattaccttgcgaccaaatgtgatccggttttataagttgagggtcggatcatacctgctatgcaggggcgaattttaaactcgacgacaaattgaccgagtcccatcattctaagcccactaactctcctgaatctcccttgcggacttgcggttcgaacagaccaaagcttgggccctcgacttctagctttcgcagcctgcagtattggtaagccctatgggcttacagcccacgtgtcggcccaactcatggctgctggtgcccgtgggcttcatgctgcatcgagttcaaaagaaagggggaaaaaaaggaaaggaaatcgtaacactgccctaagcacgcctactttcaatgaaatctaatccctccgtcctataatataaggaattttgagtttttgtttgtatcgtttgatcactcgtcttatttaatttttttataaatataaaaaataaaaagttatgcttaaagtactgtatataataaaaaataaataataattttaaaaaaatttaaataagacgagtggtcaaatgttgcaagtaaaaactcaaaatcccttatattatgggacggagggagtagttatcta

SEQ ID NO: 34302 - DNA, 1501 bp, Oryza sativa
acattttgcaaatcagatttgccttaatcaataggttacacaagagctgagtttctaatgaaattcttccgaacttggtcgtaacacatgtggcgcggctatgtacgcagcggcagcacagggctcagacgcaacaaaaatgtaaaaaggacacggcgttggtgctaatccattctggtaggagtaccagattaatgaaaattccaaaccaggattttaagaattaagaatcaacaatacgatcacgacaacgttaacaagattctcacataaacttggcaaaacagatcattgtgcacagtgctgcttagctaaacagaacaaaatgccttaggtatataacttgctcaaaaaacaagtgatactggaaggacaagccatgggcgcttaacactgaattctgattctggatggctagaagctgcatgactcatttgagagggatgaaccgagaggagtgggtggcaccaataccgggcctaccgtgcttaaccggcttgtaggagatggagaactccgcaaggtagtgaccaatcatctcaggcttaatctcaacctggttgaaggtcttgccattgtagacaccgacgatgcttccgatcatctcagggacaatgatcatgttgcggaggtgggtcctcactggctctggcttctcgccagcaggggcatcctttttctgttcaagggcatttcaaaagaaaaatattgaggaaaatacaaattataacttttagttgtttgcaaggtaatgaaatcccactaactacaaatcaatactgaatcctacaatagagaagcttttagcaaacaagaaaaaaaaatagtacagacagttgatccattcctcagtaccagtgtatttcattccaaaacagcaataagtaacaaattaaaaggacaagctaatccacacatgtagcatcgcagattaaggaatgcaaaacatcaaatgcagcaaataaaatgcatttgacattagacattctactgtgattactgctggttcagattactttacacaacacacgttttggtagttagaaatattgaagtaatcagacaatctctacttagaacatattttgagaaaatgttgcaaggatagtaacatcttttgagaaaatgttgcgatggtagttttcaaagtgtgtacagatcggtcaaaaataagatctgcaaattaagtagttaaatacaccacatcacaacatgttaaacaagaaacatatcgatttcatttaacttcattacatgaaaggcattgacctattaaatgacatggaattgcatctgcccatcaacacaagtgacatgtcaacaacaaacacagcagtcaaaattcccatcattcaattccccaaaattagcaccttacactaaatttctatcatggcaaaaaaaaaaactaaatttccacaacatcctacaacactgaattccacagatccaacaccatgacagttttatcagggaccagaagtaactactaaaaggacta

SEQ ID NO: 34303 - DNA, 1501 bp, Oryza sativa
gatcaaccgcatttgttttagtagcattatagcacaaagcaaatataggaaaccaacagacctaatgctgccttacaagtagtttattcataacatcactataattagcgtgcatcctaaattcctaatatacatcaactggtcaagaaaagacatcataactgagtcagtaaaatatcatctaattcgagtagagaaacttggaaaaatccttatatttttagcagacaccacttagagaaaatgaagcttatgcttgggtattctattaagttcaggacttgaaattaattatttcctgtactccactaaacgatatattcactaccggtttgtcagtctttagacatcacttgcataaattcagaatggatatagagtcgcaaagcacatggaaattgaagtttctagctgacttttgttctatatgttcacgcaccaaaatttttcctcctagtgagtgaataatagtcaaataagactagcaacatggttgtgcaggttgcccagaaacgtaatctattctatccattagtcttctttgattgagcaaattagctaacggaatattgatttagagtgaaaggttggttcgcatcattttctaggagacatatttctactgtaagcattcagagaagacatggtctactattaatattgattgccatttgttttatgatgaccatgaatgaatattcaacttccaagtttgaggaagtaaggttcctagatacttgaaaagttcattgccgttcaaattctatcctgtatttcccctccattttgctttattatgaataaacagttgccacgtgtgcccattggtcctatatttaaccacatctccacgcccagcacctcaactagtaatagtttatgcagaccagtaacttctatagtcaactgacaatggactgaagtaatccaatgcaatagattgaccccataaaatatactatcaaaattgtaaaataacagtaacaggcaatatctcatccttgaaagttctgcattttgatcctgtcttcctgtcaagattgtctacacagagagagatttttaacatactgataatagataaccaaaccaatttcaacatttagcaagccaggaatatttccaatattccggcaaactagaaaatgacttgtgtccatggacttcctatggatcagaacaacatacttgtcagtttatccagagaccaattcaagatcagctaacaccaagcacagaatccattaactttactccccataatgaatcttcccataacagtcgttaatctaatctagtggtcactactgatgattttcatcaaatttggcagaactacacattaaaaacaaaaactcgctaagttgcctgaaagcattcttctgcattctatgccaggatcttggcgaagagaagtatcaagaacaacaaaaatggcatcatttgggatctcccttaaaaaaacacttcccttatctaccagcactaatttctgacaata

SEQ ID NO: 34304 - DNA, 290 bp, Oryza sativa
ttggttaatgaaggccagatcccgttcatcaagatgaaaatagcgcgccagttgcacgtcattaggttctgcagcataacaaccgtaattctgtttttggtcagaggttagaaagtcgacaggcatatcaggctccctacctgacagttattcattaacaattttgcaaccgtccgaaatattataaattatcgcacacataaaaacagtgctgttaatgtgtctattaaatcgattttttgttataacagacactgcttgtccgatatttgatttaggatacattttta

SEQ ID NO: 34305 - DNA, 1501 bp, Oryza sativa
cacttaccactgaatacataattaactatatgttaataaatcactacggtttatataaggccagacccagcccaatacattaaatatagtttccataaactccacgttatcaagaaagtaagtattagacactactttttcatacttcaatttaatgaagtactacttatttcatatgatgtcttggatattgtgaaaaaactatgtcttggatatttcttttttcctctctatttccttgtcatattattttttttattttagatgatagtttatttaatgcttcgtaggagtacattattctggttattgcattgaggctggcctaagtgctgccggtggtggccgttgcacgcgcggtgcgtggtagactggtagttgattgatcagctgatcggttgctgctgctggggcgcaccgggcgcacgcggacgcggtgtggtgtgagctcggcgggcgggatggggacggctctgtttggtgttgggtttttgttgtgtggattgcccgcgtcgtcgtacgggtctcaactacgaatctgaacgcctcgtcggcttcgccaaattcgcatgcctgcgcgtctctctctggctctgcaggtggccgtgttcggttgcatcactgtatagcagtcgcagcccccttttctaatcatggaatttaaatttactttgcatgagttgcgtgcgtgatgaaaacaacagctgtgggatggtgatgcgagtgtgtaatcgagaatattttttagggaaacgaatatgttgttctagcctgtgtttagttccacgttaaaattaaaagtttaaagaaattggaacgatgtaacgaaaaaattagaagttcgtgagtataaaaaagtttaatgtgacgaaaagtttgaagtttgaagaaaaaagttagaatctaaacatggccctacttttttatgaaaaaacataggataaacgtagatgtttataacatgcacacgtaaaatctatttgtatgaataccttcagaagactaggatcaacatattttaaaattcaagaagtcaccacatacatctcactagataagtacgtcaactaccactgaaagactaattagccgtaaaggcgtcgtgttacgtttaagatttgaacttgagtgagttgacttcaccaattcaatcagttgagctacgtttattttgcatgtgtttatagtatttgggtgtacactttttctctctaatatcttcacccgcgtggattgaatcttctcgtcagatatatactgatatggaccacaacaaactttattatcactatgttttacagagtttcataatctatttagctccatccttgtatacatcgaagttgtcggccagcccaaataattttgatgatcaatagccacaagcgcgagaataattgtgacgaaagtcaagagggaacatagattatagtgatatatattattcataggctcgtagcttaattcatgttttgttcgacgatttttgatattgtttact

SEQ ID NO: 34306 - DNA, 446 bp, Oryza sativa
atcaataaaccgaatggatacaccttgggcgtcaaactcttttattaactggatcatgtcagcagtatcgcgcccaaggcggtcaagtttcttcaccaagatgacgtcaccttcctccaccttcatcctcagcaagtccagccctttccgatcgcttgaactggccgatgccttgtcagtaaagatgcgatttgctttcacgcctgcgtctttgagtgcccgaacctgaatatcgagagattgctggctggttgatacccgtgcgtaaccaaaaagtcgcataaaaatgtatcctaaatcaaatatcggacaagcagtgtctgttataacaaaaaatcgatttaatagacacattaacagcactgtttttatgtgtgcgataatttataatatttcggacggttgcaaaattgttaatgaataactgtcaggtagggagcctgata

SEQ ID NO: 34307 - DNA, 1501 bp, Oryza sativa
acgggcgcggcggcggcgcggcgggaggtaggcgatgacaggtgggtcccacccgtcagcgagggtggcgggcgggcccgcctgtcagcggcgctcgcgcgggggaggccgatgggccgcgggggagaggagaaagagggagggagagaagtgggccgagccggcccaagaagggaaagggggggaaagaagacttcttttagggtttttctttttataaaccttttcaactttgtttatttcttctcaattattatttgtgctctgaaaattccactaaaatttgagggctccttttagaccaaggagaatttaacaaaaattctccgggtcacatttgaatttttcttgtacgtattttaaggtttgccaatttcttttcgaattttaattaattctattattccttttagaagatgatttttatttcgggatgaatttatcaggacgtgacaagattggactaaattacttcttagacataaaagtaaattcaataaagtctaaaagtaatttacatatattctaaaagtaacttaaaacaaaacgtaagtaactttgtcacgacattagaagtaaattcgttgtagggataaaatatgactttttagtaaattccataatttgtgctgattaatttaatttttagatagagtcatgtttttatctatacaacggatttacttcaaataacatgccaaagttatcttcgtttgttctaagttacttctataatatatataaattacttttagacttactgaatttacttttatagtttaagaagtaacttagtgaaatgtaaacgtaatttagacatatcataaaagtaatttgtgatttttcatcaaaatataatcatgtgagatcttgttgtaaagatttaattgcaataaacacaacggcgtaatcggattataaatcagataagtaatttaagagaaacttctctaagaaggaaaaaaatacatagatattgagtgtataagtagctttttttttttggaaagaaaggtgtctctctttagcaccatatagctagcactctcggtgtagtcgcgtcctgttaagatagttttagaagaatacactatgttagctttgggggcttttgaaattaacccgtgaagcactgttcccctaatgataaggctcgtgatagcgggcgactggtaatgtgtgcactttgaccaatctttttcggcaacatcaataaacggtgaccgatgcagcacggtagactcttgtggaactgaatgctacgccttagactaatctgcttcgtgtcatcaaagacttccaagtcaacagcatcacagtcaaggacatgaagtgttgctttttagctaaatttatttgcttggaaaactctagttacactgcttacatacagtgcacgcaccgcgcggagatagacacttgtaatatcatccgtgtcactacctagctcctgcatgctctgcttgggcgaactagctaagctagctgctacaccacacca

SEQ ID NO: 34308 - DNA, 220 bp, Oryza sativa
aagcttgttgaacattcttttaaagttgtgtagacaatgcactttttattctcacatttcctcttgaaaacactatgcttttgataattttatggacagctttacgtccaggaaacactttgctttgatatgatatattgcttaaataatccattatgcatgctgtgtataaatcatgaacacaaacttatgctttttgtcttcaaatgtttctattagg

SEQ ID NO: 34309 - DNA, 306 bp, Oryza sativa
attccagtcgagtccatgtttgtttttcagatcccttaaatattgcctcatttttatttttgacggttcataaaaccaacaagggaacaaatgaagcaagctagagaacaaagcatgccatcagcacccacaacacaacatgaacacgaacattagaccattggagtgttcagtgcctaacatgtaacagaagcttaacacaacacaactttccctgtcattttgtctgacattgcttggcaacttggcatcaggtaacagttaaatgggcttggtcctttgggacaatctgttctttgatccaca

SEQ ID NO: 34310 - DNA, 513 bp, Oryza sativa
attttggttgaaattagagatgatgtgactgaaaagttgtgtgtgtatgataggttgatgtgatggaaaaggaccgaagtttggatccaaactttggatctaaacacagccgtataatcatatagactcacaaagtcaacaaatacagccactggaagttccaccaacagctgcaattacccgtcaacaaacctttaaaaaagattatcaccagtcactccactaccaccacagagcttcaccatgtcaacttcacgagttgatttcaacatcaccaaaagaaaaaaaaacaagtcggaataaaatcagttgtggaaaatcaagggcatgcgggagccaaaaatgataaggaatacctttcgaagaaatagaacatggcaaaagtttcattggcactgctcagagcctcagacatcatgacaagcacagcatcaattcacaccgataaaacaagtgaccatttctaaagcacagccttctcattcacctccatctcatctccattacactgca

SEQ ID NO: 34311 - DNA, 156 bp, Oryza sativa
ggggcgtgcctacgttatactacccggtgtcctatctaaattacactatattaattaatatattagtcaataattagataattagtatgtattggaccttcggtaatttttgttctgggttcgccactggccaccaccgcctatgcttggcgcaga

SEQ ID NO: 34312 - DNA, 497 bp, Oryza sativa
ctgttgaagatactactacatctcaaaatataagtgtttagagttttaaagaagcttaaattgatcgataatataataattatgattagttaatatgagaaaactattatgtgaacatttaacaatagatggttgtttagttgagatgacaaaagcatgcactactacagaaccacatatcggtgccggttgggacattgaaagcggcaatgattagtccgccgacaccaatgtcaatcttaaaaaccggcaccaatataaaatcaatgagccaaaaaaaaacggctcctcgagccgacgcaggagccgatacttcgatccgatgaactccacatgaatccacatgatgaataagaacaacacatcaattctcattaataaatctcagatgaactcacatcggcacatcaatttcaagaacatcatctcacatgagcaacaaatgaactttaataagaacaaatcacaaatcacaaagagagagggagggggagaga

SEQ ID NO: 34313 - DNA, 412 bp, Oryza sativa
ccgtttgagtttattttttatacggttggttcctatgttctcctaagtgtgaaaaaaatatcaaaaaatgaaataaaaataaaaaaattacatctctatgtactgtttaacttatatgtcattttatgtggttatattttaaattagattaagtaatttcatatagtggtagagtgcattatgtttaacatgctgatcaaagggttttactaaaagagttatggtctaattttattgaaggtgcaaagtagactaagtggtatgctagatattttcagacttagctaagtggtagtttgagtttaaattttttttgtggttggttgtatcgtgatcctgagtgtgaaaaaacatccgaaaaaataaaataaaaatgacactgttgcaactctatatagggaaacaggaatgg

SEQ ID NO: 34314 - DNA, 1194 bp, Oryza sativa
taataatactgtgtagctctaggatcgtctttacaaaatggctttgggcaactaagtgacttttaaatgctgtttactgcaaaacctaacccctattattatccccttgtaccccccccttgcattaatcatgcatctgccggtgtggcttgctgagtactgtggttgtactcattcttgctcaatccttcccctcttcagtaagagaagctttggagaagatgtcttaggtggagtcctggcttataccccagttgagcgcctgtgaagatggagccgtaggcccgctagtccgctgctgtttatttttgattgtcaggccttaagtgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacaaatctaaaagtaacttatatatatatatgataaaagtaacttatgtatataataaaagtaatttacaaatataatttttttttcatcgtaagtgaagatttaattgtaacgaacataatagcgtaatcggattgtagatcagataagtaatttgagaggaaactttatttgaacaagaaaaaggcacccacgtgaactttatttgaaaggaaaaagacatccccgtggatggacatcatgacgacgtgcacagttagacggctctcagatgcgtcgtgctatagagctaaaccgagaacgctctcgaaatagatttcgcgatcttaatagtatacttcctccgtttcataatataagccattttaacattgtccatattcatatagatattaataaatctaaatatatatatgaatgtaaacaatgctagaaagttttacattattaaatggaaggaataataaatgatgtatactgcttatgcacgttcctataaaaaggcatcgccatgcatggtttggtgcctgagcgagagaaatggttaatccacatatagtaaattagttgtcagtgagctgaagcatgcacatatagtgtttgattattaaactaaactgggcaactgggtttgtgatatatcaacatgtactcatgtaattctggtagctagcaacatatctcaaattctcaatgtatttaatttgcaatataataatagctggaaga

SEQ ID NO: 34315 - DNA, 250 bp, Oryza sativa
  unsure (1)..(250): unsure at all n locations
gatgagttgatgcctctgttggaccncatcaacatggtgggaacacctgctgaaaaaaaggattgcccacctaaaacctgggctgggcatttggtatgtttgtttgttaaaacggataatatgccactgggcaagattgcaaaagataaaatgccactcaatacgttatcattagtatactttgccactttgagcagttttgagaccaaaataccctctaatgtgaacagaggtagggagaaaggaacga

SEQ ID NO: 34316 - DNA, 261 bp, Oryza sativa
ttgattatggcctgttacctgttattagacaccacatgtataatttggattcactgaatggtttgtgctacgtcttgttactgatgactgttaatcattatgttgctttttctacactgttagaaattttatgacatggcagttagcgtagtagacaagttggatcaatttattaatttaactttgcattagcagggtcattttcccttttgctaattattgttgccataccttctcactgtccaagtatcaacttttata

SEQ ID NO: 34317 - DNA, 447 bp, Oryza sativa
agggagttattggaggctccctgttgaccggttgaggtggggatcggaaagccacaagcgcgcgcgcgcgccgagccgagccggccggcccgagggcgtggggaggccgaggcgttgcgttgtgtctgcatctctctctgtctctctctcgatccttttgcaatggaccggaatccaaccccgcgagattgcctctgtaacgggcaggcaattcaatacgcattgatcgcgtcgttactgcggcaacgggcggattcctctcctgcgctattaggaaacagagacccccgatcagatctctacgctttctctccgattgctggttcttcctccttgcaccgcttgtgctgcttctgcttccccggttctgatcgcttgcgcacatgagagatcggaacgagcaagccctccgaaaccacacctcgcctgagatctgcaccgggtagg

SEQ ID NO: 34318 - DNA, 491 bp, Oryza sativa
tggttccaatttataagttctaactgattcaactgttgttagttgtaattgtcagattccctagtttttttgagttcccagttgaaatttgtgctggcctgcgattctattcagaagaagcaaaacagtcattaatttagacccatctgaatggagttctttagacacgagggaatgaaatgccattacttttgatacttctcttattcgtggtatacatggtatctttcacatgtaggatttgaaatttgaacttcaaatataagctggtttctccttgatgttgcacttaaaggtaataccaccattaaaagtgtccagtgctgtcatggaaaacttatggaagatataatcagtgttctattatcttagcctcatatctttggaatacatgaaggatttaacaaagtacagtcaatacagtttctaatccagtacaactgttatcttcttgagttcttgacatgattttgtatgtgttgcttgattat

SEQ ID NO: 34319 - DNA, 232 bp, Oryza sativa
aacttttatgaaatatgtaaaattatatgcctacataaaaatatatttaacaataaatcaaatgataggaaaagaattaataattacttaaattttttgagctcctggcgcgccccttccttcgccgatgtcgaggcaccacgcacccctcccagagagacgcgaccgctgaacttgccagtagcgtcgcgcaactgtcggcgcgcttgaatcgatttctttgagggagcca

SEQ ID NO: 34320 - DNA, 426 bp, Oryza sativa
ttgttggacaacggcgctagccactctggcgccccaaaaaggaccatttttggaataagtttttctaggggtctatttgcaaaataagtttttcaaaaggaccaaaatgtgaaaaatccaggaaccccctctccaataccgcaacaccaagacacccaagaggcagggggtactgttgacagtccttaaggctgtgtttagttcagcgcaaagtttggattttggttgaaattggagatgatgtgactgaaaagttgtgtgtgtatatgacatgttgatgtgatggaaaaggactgaagtttggatccaaactttggatctaaacacagcctaaataccaaatccgaccattaattcctgcatacaagcaattgaaataatacatcaaactttgtggtaatggttattactaatcatttccacagg

SEQ ID NO: 34321 - DNA, 1501 bp, Oryza sativa
gcatatcaaggttatggtcatttcctgctttcagtttttaagatgatcagataatataagtgggtcttaaataaagataatataagtgatgctcatgtgctgataaatattgttttcttatccatcgggcataattgccagtgttttgctggattttgacgatcaaatagcactagcatggatatgtgtggggctgtaaattggaaattgtaaaacttacagatgataaacaagaatggtactgcgagttgtataggagtagttgtttggccagtaagaaataatacctctacccatgcagaatgtttgattcctttgtgagctgaatgcgcagcgtcggccttgttgttcacaatgtctgccatcgtacttgtagaaataccaccagatcatggtctcagaagaattgaggattctttctgcactttctctgaacgtggataagacataaccggaaggatagtcgaggattctgtctgcacttgttgtgaacatggatgggatataaccggagtaataaaaagctggtatcggaatggggccatctgagatgacctcgcagtccaacggaagaagagacatagttacacgataagccaccaaataggagaagtgggtttggttgctaaggcaagagatggggccagcaatataatcgttatcggtggcagtgccagggacactagctagggcaaattctgttgaacagcttactagtgctgcatagtaggtatcgtatgtttggcaagggttctggtaccctgtgttgtaataaccatagcctggccctgttattaagtttggcctgatagatatggattttagaagtgggcagggagacggtgaggagtagttgtcttcgtctgcgagcgggacggcggtcaggagagcatgcttgtaatctatggcggtcaacttgtatggccttccaaggtatttgttatgtaggatggtatattggccagagcatgatagcttcatgcatggcacgccacatgacgatggtgtatttttggattcaagtttgaaagggaacctgatctcggggccatgctcgccgcacctcgacggcgggcagtagctgaagaaatccttgtcttcccacgctgacactgacgctgctgtgtgcaggttgagaagaaggctcaacaccaggagggttgctgcaagaaatcctctcatcctattttctgtatgcactgtgacaggcaggcgagatggagacgatccaacaagtaagcaaggcagggcaatgttgcgttgcgtcgagttaaaagatggacaccactataccacagtgtagtacccggccggaagctgcctgcagtctagtgaatcgcagcagcatccatcctgccgtgtggaaaaagacctataggtagatcttttgagggtttgcttggttagcttagctggacctgttatctgtctgggaaagggtttatttgtagaaaccctcaaacatctggcaaatgctcatttctcttaatggaaatggggg

SEQ ID NO: 34322 - DNA, 1501 bp, Oryza sativa
aaacaaggaaactaatcccttctttctaatcttagccattcccggtggcttcctcagctgtgcgctgggcgcgctctgtagcgcggcgcacgtcacgcgcgcgacggcgtctcgcgtacgtgcggccccacatgacaagtagatcctgctgaaagatgacctgctttagtgcattactgcgaaggtcatttttgttttggatcatagcaaaaatcaccgagttggataataccatagcatatgccattaacatggcccccgcatgtcattctcacatgtaatggtatttctaaccggtgcatctttatactactaatttttctgttaatatagtgatctcataaaaaagaagaattggaagcagaaatgaacacaagcatgatacactggcatggctgcacctgcaaaaaattactgaagaaacaaaacttacctgctatcacagatgcaatattccaattgtctgtagcagcagttcaaggttcgtacacagatactccctccatggctccatccataaatgtttgaggcgctttgacttttttaaacatatttgaccgttcgtcttattcaaaaatttaagtaattattaattcttttcctatcatttgattcattgttaaatatacttttatgtatacatatagttttacatatttcacaaaagtttttaaataagacgaacggtcaaacatgtttaaaatagtcaacagcgtcaaacatttagggaagaagggagtagtttagatagaagtaggtaatttggttgcttgtatggtacaattagagttgcaacgagatgctgcttgattgtttacttattttgatgggtgacaaggttaaatagatctgaggtgtgatagacagatgctttgcaacccctcatctgccttatcccaccctaataactcagtacttagcagttagcaccagcaagatgcttattgtatttgctgaacatgacgtagggagcatttctcatttacagatatattcatatagttaatacacataactggtcctcagaatctaaaacttaataagagcaaggtcaatagtatagctaactactggctccaaaacatctatagccaatctaatagcccattcatacaatagttaactataaaaatatactgtaccattaatacacggtcccacctctcatacacacataacatcttggagtccgtgttgcagccggctacaaatctgtagcccgctttcttctctctcttctcttttcttctcgatatatggttacagccggcttatagcctgctattgtacctgctcttaagcgcatcccgcctgggggtctggttccactaattgcactatagcaatcacttgtaaataaccataaatgttggggtttaccttttctttctaaaaaaaactacttttcctgcggtgtgcacacggaaagcttgtgtgcacaggatacgttcacttaatcaaaatatcaatcaaatctaaattctcttgtttggtatttgca

SEQ ID NO: 34323 - DNA, 452 bp, Oryza sativa
cttgtggaagggtcgacggcagcaatgtaggaatcgtagttagccagcagtttttcccgccggcgagcccctgcaaagttgcgcatttaccgtataaaggtcggtgtcagatgacaccgatgactttcggtaaaacctatgagaatttttacggtacaatatactatcattatatactaccaatatataaaagggtatattcggaacttaaaaaaaattgaataagggatttttagtaattcgtcagatctgatggggagcaggggcggatccaacgtgagtgcaggggggttcgagtccccctgcacccacaagatctatggatacccctggagcacccccttcaattttttcaccatgaatgataaattaaaggtccttatatggctggagattgaagaaactgtgtaattgagcactctcaattttttgtttctatatctgccccctga

SEQ ID NO: 34324 - DNA, 216 bp, Oryza sativa
cacctcaaatactctttccttaaaagaaaaaactagtacttacaattgcaccacagtgtagtccaatttcaacatttcggggagtttctctcggctgacactatttcgtccgaaatttacatagattttctttattttttaatatagtcaagctattcaaatttgataaatatttgattgcttattgtaatattttgaaccgaatttttttaaagg

SEQ ID NO: 34325 - DNA, 373 bp, Oryza sativa
aactagccatgtaagcgacatggcagcgaaaaccaccgtccaaaccgccatgggacctatattgcgccggttttgacagttgtgggatccgttatatctatttttttggttgaaggaccaaaatcggattcgttgatcagttaagggacctcaagtgaacttattcctaaatgatatgaaaagaaggcaggcgacctatcctaaatatagaaacggcccatcccaaactcgcctccactcccactgacccacactcctcacctcacctcgccctccaaatcgcccacacccctggaaccccattccacccacccacgcgcagccgcagcgacgagaggagaaacgagagagagaaaaagaagaaagagaaaaa

SEQ ID NO: 34326 - DNA, 1501 bp, Oryza sativa
gcaaatggaattaagaaatgagaaacacagtaaaaaacctgaaagtggtaccaaatagactaattagcagtcctaatgatatattataaaggggtatgcggattgggtggtaaaaaaagttaaggcacgcgaatttaatggtaaatagtctatattctcccgatttagtagaccacattttggcatcaaaccaaaatagaccctctcccagaatttgtaaatggctttgtggttcgtgatatcactgaacctgctgggtgaataaagtaaaaaaaaaaacccataaattggccttctgcaagatctcgtcgtcttgcccaaactatagccttcgatctttccatcaggaccgcatggggggagagcaggggcaagtatgaaatggagttcagattcagattctagaacagtctgaacatgcgacgacgacgatggcgatgtatctgaacaatctggtcctctccctctcctcccgggcgggcttccacgcggctgagtttcaggctcccaatctgcagctcctcccagaaccttactctgattgattggttcatcgtttccatggctccaatgaatgcaacgtgttgttcagattttctgaatcttgttctcaatccggagtacgtgctgtagcagcagcaatctgtccctgatctgagaattttagacactcgtagattcgctgatcaatcattccgttcccttcgagtggtctagattgagcttaatcatcctgctactcgaatcaaatcttcagcaagtgagagctagataattcagaagaaatcaacatattcttcgcgaaaaaaagaaataaccgatgaaaccacggtaattaggttcttcgaatcaccgggagagtaggaaaaaacgagctaaaatcccacataggaggaaacggttaaaaacggccactccgcgtctccgccgcgagactagctctcgccagtccacgtagcccaatccacaaccgccacgtgctccgacaatcccgcccgtccatcgccgcggccccggcctcatctcgaccactcgtttcctcccttcacaccagccacgtggcactctctcgagagctcccgcccgcctatataaacttgttcgcgctcggctcctcctcctcatcgacctccaccccacattgaataattatttttaataattttagtttttttttttgggctttagatatattcccaatccccaacctcccaataatccgatctctcccagttctgttcggatcaaggctgtgtcgatcccaaaaaagaaaaaaaaaacaatttccttttggggtggttcatctgttgatcacttctttgtttcccgcgttttgttggggattcgattttcgggttaagattttctacacgatgcccttgaacttggctcagagcgccgcgccggcagcgtgcttcgcgaccgccggtgatgaacggcgagctgcttcggtggtcgccatcccgtcgtcgtcgtcgtcggccacgacgagcctgagaat

SEQ ID NO: 34327 - DNA, 1501 bp, Oryza sativa
gatcggcaaagtgaggttaaatatagttttgatgtggctaagtgtgataagattttgattatcttttgcaagagaagcaaattagattacctaaaggccatgtcataccttctcaagaagcgtcgagcatattgtaaatggcataattctcattctcactctactaatgattgcaatgtgtttcgacgacaggttcaatcggccatagatgagggacgattgaaattcaccgatggctccaagatgaagtttgatcatgatccttttccggtgaatacaattaatttcaataataagaaggtgttgattcggccggagcaagccgaatctaccaagggaaagaaagtggtcattggtgagccaaggcctaagatgatggtgccaaagaagcaggagattggcgtttggaaggagaataagggtgaagcttcgacttctaaggcccctagaaagaccaaagtgacttttgatatgcttttggaaaagtatgagaggcaaggtggtgagagggatcacaacaaagggaaaagaccaagatcacctcctagggagcgatttggtcattcgccaagacggtcatgttcacctccatattttcatccacaagacatgtcatggggtccttatccaatgccgccgccgggttatccttatccttactttatgccagggggggcaacgccgccaatgtacaatcatatgccgccaatgagattcaaccaaggatggggaggaccacggaggccaattcatgagcgtttatcttcaccaaacaaaagccgattttatggtaaaaatcgggttaatgaagagaagagggaaggaaagcgcgtcaagatagaagagaggacttcggaggtgattaccatcaagataggatcccatgatgtgcctataccttccgaagatggagttggaaagtccccaagtaaaaagtccgaagccggttctagctcctcgcagtcggccggtctgaccaggccttctggccggtctgaccgcggccatgttgccggtccgaccgggccatctggccggtctgaccgccgatctgacgacggtctgaccgacgcctcaggccggtctgaccgtgtgtctaacgtcgatctaaccggcgcatatggccggtctgaccggcggtctgctgccggtctgaccggtttccagcgccggtttgacgggagagttgcaaaagccgatgtaagggcttcatcgtcttcaaacaaggttaataaaggacattatttacctcctggaacagagccgaatcctaggtggatgcctaaggatttgacggctacacaaaagagaaggttgcaacgtcttcgggcccaagaattaagggagaaaaaggccgaagagaaaagggataaaaggttcaatgagttgcgaccaccaccagtatggaggcctaaatccatagagaaggcaaaaccgattgatgaagaggagaaggaaggacaataggttgatgaaggtaaatcgtctccaaaggaggaca

SEQ ID NO: 34328 - DNA, 922 bp, Oryza sativa
ggctcgattacgtgtcttggagatcatcttgccgcgattttatctccttaccttgtttgtttttaggcttgttgctttgcttgcttgatggatttccgtcttatgtggttcatattatccaatacatgtttgatgttaggatatggggcttgaaggaactcatgttgttcatattatccaaaacttgtttgatgttaggatatgatgggactgtcagtgtgcttggcagctggacattagtaatcactgaattattgccattttgccaacttgctgcgtcatattactggagtcccacactgtaagttgcagaatcctttcagtttccacaaactagcatgccaaagatagtaatccgctcaaggtcgacgcttgtaaactcttatcgtttggagcagggaaattttcctatttcttgcaagaaatgaattacttcacaccatttgtagcagtgattcttttccctacttcttgtaaactctttagtttggagcagggaaattttcctatttcttgcaagaaatgaattacttcacaccatttgtagcagtgattcttttccctacttcttgcaagaaatgaacgacttcgtgtgaagttcatgtgaaattcgccaggcaagtttttagaggggagaccaaagacgtgaaggcaccaatgttttgtgacacaagagatatgtgtagattgcaaatcaataggcaaacttagctcctttataaaattcccaacaaacataaggttagggatctaccagaaagcaaaatctgccgacgtagaccctaaacacaaccgtggagtaattactcgtgcaattaacttagcttaatctccctctaggctctagtagtttcagtttcagtagtactgtagttttttcaccagctgaatctgacccacagcagcaacgaaccagagcgca

SEQ ID NO: 34329 - DNA, 185 bp, Oryza sativa
tgttcatccagttactgattttacatttagcagctgagctctttcattggtttaatctttagtggtataattcagtaacgctatctcagagcataagacagtctaccttttgcttttgatttttgaacatctctcaagaaaaaaaatgtcatataatctcaaagtaaataaaatatgtccgttcc

SEQ ID NO: 34330 - DNA, 174 bp, Oryza sativa
gtttgaggcaaattcgagatctggaagctgggtttctctttacaaataacactaaccctaccatcaaatcaagaaaggaggctttgaacaaatagcttgattgaagtatgaagtggctcggtgggcgacgatgacgggcgagctccggcgagggcctgggggcctgagcgacga

SEQ ID NO: 34331 - DNA, 1501 bp, Oryza sativa; identical to SEQ ID NO: 27540

SEQ ID NO: 34332 - DNA, 1501 bp, Oryza sativa
gcggaactcctcagtgcacctggatggctgcacatgctccacacggacatggatcctattcctgataatgcggttcccaacctaccaagagattaacaaacaatcagtaaaacagatacatgatttcaaaaattaaataatcccgaagactacatatccacatgactgaacattacacatgccgacagctaactacatatctatccaatttatctacaccaacagaatgtgtttagacggtagcatgttatatgattgaaacatataactacacatgcacacaggattaaatgaacaatcagaagtatatctttaaatgcacttctcataactacatcataaaaccaaacggttaaactttccacataaccgataacaatacaatcgacgtaaacttgaggattgatttgccactatcctacttggacgaatggaaacctagaaatgaaatgaaccaaagccacaatcacaatagctctacttcagtacacaacattctcaatacatttaaagagaaaacaaaatccaaatactaaagcacaaagtaaaatcgcacaaatgttaccagtaaatataaccagtaaaccatctagactacactatttatcagatcttacacaaccatgcaagagtatgcaatggcttcccattcctgcaactgcaaaaatgaaatttcatattggcacaactaaactacatgattccaaagtcacttggggcaaaaacatgacaccaagtcacttaagcgacacaaccacagatctatgacaaagaggcggcgccgccgccggggtgtttggggatcgggggttatacctgcttgttgatctcgacgccgatggcgcgcttggtgacgttccagacacggccggtgcggccgtggtagaacttgtgcggcatccccttgtgcacggcgccgatcaccttgacgtcgacgtgctcgccgatcttgtaggtgccgaggtaggtggtgagcgggatgtaccccttcttcctgacggccgcgcgaacaggtcgcgcgtccgcgcacgcagcccgtggcccgccggcatcctggcggctcctactcctgcttcccttcgcgcggcggcggcggcggcggcgggtgaagaggtggggtgagcgtgtgtgcggcgctagggttcgcgagggtttggagatagtgctgcattttatagttgcggtttaggcttaggtttgcgtcttgccgtggcggagttgggctgggctcgcaatgtgggccttttatggtccatgaaacaaagtctatagtacatcccgaattaaggcccatgagctgttcgtcttcgtctggctctcagccattctttctgtgcgatccaaatgaggggcttttctgcagaataaagttgcaaatgtgagggctcttctttcctttctttgtgtgtttttaagttataaagtgaacttgagggtgtgaaagaaatatatttgcatttttttgttgctgtactggcatcattgttagctcaatcctact

SEQ ID NO: 34333 - DNA, 1501 bp, Oryza sativa
aggcctcgcggcggcgggcggcgtgggagcaggcttttttttcttttttttagaatttatgattcggatctgtgtatttgatttgtgtgtgatgtgaatatgtgatgtattgtgatgaattttgtagaagttgtgatgtaattttttttaagattttgtgatgtatttggatatggccgatttggggatttgaggatttggggataatttatttgggattttgggatggggatggagtgaaattaatatattaaaaacacaatgaagaaaagaaaaaaaataatatatcaactggatctagctagcctagctctatctttagtaacaataaatggatttttactcctggttaattcactcgggactaaagatagtattctttagtcctgaattcgtagtggaaagttttccaaccgagactacaaagggttacgaaccgtgactaaaattccaatcgagactacgaagggttacgaaccgggactaaaaagcacttctccaccagtggaacactctctctgtcaaaaaaaaaaaaaagagacaaccctatgtccatatttaatgtactaggagggggtgagggggtgttttttttttttaaaggacggagggagttactgttagcacttgctagttactgttagcacctgcgcgtgtaatatttgcagagcacacataaatgtgttgttctcacgtgcgtaatccgcggacgtaaggcgtattagatttttacacggtatctaacatcatttattaattcctacaaaactgatattatgttaaaatacattgaaatagttctattccgattctatagtttttaacatgcggaaatgtagtactcatttaagtagtactagtagtcaacattttaatctataatactccatccgtttctaaatatttgacgccgttgacttttttattaaaaaaaattaagttattattaattcttttcctatcatttgattcattgttaaatatacttatatgtatacatatagtttttcatatttcataaaagtttttaataagacgaacgatcaaatatgtgctaaaagcctaaaagtcaacgattttggccgaaattttcgtttttctcaaattttaaaatatttgactaaaatatagtttttcatatttcataaaagtttttgaataagacgaacggtcaaatatatgctaaaagcctaaaagccaatatctcggccgaaattttcggtttctcaatttttgtgaatttagtcaaaatttggtcaagttcaattaaattgtccaaatttcagaaaatttcggcctaaaaatgggtgaaaatttcgccgaaatcgaaattggaaaccctggctaggggatgtactgattaatcgcaatattttttttttcaaaatttagttatcagcaacattaatttgaaatacctacagggcaacagactcccgcttcagttaaagagtgatggctgaaaccaagatccatgcaaacaagcaagcataagttgcca

SEQ ID NO: 34334 - DNA, 1501 bp, Oryza sativa
ccgctcgccgctcgctctcgccgtcggattcgtgctcgcgccgtgctcctctctctccgccgtcgccgtcgaccttcggctcgccgccgacgtcgctccggtctccctcccgactcggcgacacctccatccgcttcgccgtgttgccgccgaccccgtccgccgctccgcttcgtccgccgactgccggagcaccgtcgccctcggcatcccgaaccgcgccgtcgccttcctccgctctggttcgccgccgtcgtcgctccggtcttcctcccggctcggcgccacctccctcggcatcgccgcatcgccgtcgacctcgtccgcgcctccgtttcgctcgccgaccgtcggagcgccgtcgtcatcgtcatcccgagccgcgccgccgctttcctccactccggccgccgttctcgtcgtcgtcgttgtcccggggtgagccgaagaccgccgttcgctttccccccttctctccgctctctcgggcgccgctccgccgcgccggtggtcgccggcggtgaccatcggggcgcgggcgcgccgctcccgtcggccgtgccggcgaggccgccttcgggcgcgccctcgcggctgccaggtgggcccggccgtcatccgcccgcgcccgcgggtgcggctgacgcgcgggacccacggcgccgaccgccgccagccgcgtgcgcccggtccaccgtggaccgtggggctgacgcgtgggccccacttcccgtggacccggtccgcgcgcccgctccctcggctgacgcaataaatgagtttttaattaaaatttaaatgaagaaattcgcaaatatccatttaaagagcatataaacttcaaatggccatatcttggccatttgaactcggaattggaccgttcaagtctctaatttttccttaagaagtaaagaacccatttttgtgctttgtttctgctgttatgtggagtttagtagagtaaaagccttttcttttccgtcggtcgtgtagacgctgcagcttcggaagatccgctcttcgtggaagttgaagccgtcgtttgggaaagcgagcaaggcaagtcacatcacccttgagcatattgaatcccagtttataaaattattttgatttaaattattgcattatcgctttgtttaaattcccgcgttaccactgttttatttagccatgcctatttacctttgttatgacattattattgctattgttattattaccttgttcaccctaggaaaataaaaaccccaactagtgggtactctattcatggttccactagtataaatttaggtagatgcttcgctgaataattaggcaaccttaggtggttttataactttagactttgggaattctcatatcatttggacactatggaattgttggcttatgttggaattggacacacacctctcttcctctttcaaaacccctaaaacctgttttcggtggggtttgggtgcatgccagatgtgggaagtagcaccccggc

SEQ ID NO: 34335 - DNA, 1501 bp, Oryza sativa
attcataactttttcatgtgaactctaatgaagacaatctttatatcaaaattgtagctctagacgtgacctacaactttatagttgaaaagtttttgaattaaaactgtttagggtcccaaaatattggtgcatgtttatatattttgaaattttaattttaaaattacattttgggacaaaaaatgacttaaaataaaaaaaatcaactacaaagttgtagatcgcgtccaggactgtaagtttgatataaagtttatcttcattagaattcacatgaaaaagttataaattatttttaaatataaagcttttagacagttctatttgacccagatgatattcaaatacaagtttagggactggggtgacacaactgaataagttagagtatttaaacgagtgatctgcaaatttagggaccaggataatactgtcgaacaagtttgagaacctgaacagtcgatttgctagtttagggaccgagatgatacaacggtggaccggtgatggactttactctttctatattctaactgctcctaattgattatgcaactacaccatcttttatattggattctcggatgatattcatcctaatatccaatatccactcattagcagtttagcaccgagactttgagattaggccaagtcaaagcggatccatctgctcatcccggaaatgaatccaaccctctaaacccggaaaccctaaaccctctaagagcacgaatgcacgatgccatttccactcggtaaaaaaaaaagaaaaaaagaaaaaaaaaagagcaaagcaaagcaacggcttttcgcccatcggaaaaccaagcacgacgacgtataaaatccacgtttttgagcgcgagaaattaatttctctcggtattttcttctttcttctctctatactccagtactccaccctccaggagcagttagcttctccccctgctttctgctcctgacgcgagagcaagaagaagaaaaggccatggcggagaagagggcttcttcttgaggtgaggttggttgctcgcttctcttctcttctcttcctcctgctgccgattcggttggcgattttgctcgagacttttttttttcttcttctttgttgcgagtcttcgcgccgctttaatcgggagagcatttggagtctgacttggcttccactcgcgcgcggtttaatccccttttttttttctatttttttcttcacttctgatgatgatttcgtgctcttctccctcatcacgatttcttggcttgcaggcagctgcttcgctttcctcaccccccaaatcgcgccagaattcgatcttttccggcggcggctggtggagcgcaagatcgcgctgcgcgtttgatgggcaaggcgtgttcttggtggagtttcttgggagccgcctctcgtcctggatccgtggcggccggcgacatcctgggccggggagggtttctcggatccggttcttgctaatccgatcggaatccg

SEQ ID NO: 34336 - DNA, 1501 bp, Oryza sativa
atcctccaacaccatcgaagctcccgggcatgtggttgtcactaattcgtccgatgctggacaggacactatggttaacaataatgttgccggtaactatgttttactgccattatccaacagaactgaagctcccaggcatgtgattgtcaccatttcgctcgatgctggccagaacacagtggttgacgacaatggtgttagacagggattaacagacgaggaatccgatactaaaacgaagctgttggaaagaggtgttctgactgctgcctctgctactgcagcaatgctctctcctttcctgagaggagtgttcaatcaccaccaagaaggttactatattattcctgttctatttctagtgttggggttgattctggcatccactgccacatggctcgctcgtaggcactccgccaaggtcaggggcggatctacagttataagaccggtgtcaggcgacaccgacgacttttaacaaaacctatagcgaaactgtttattcatatgctacaacaccataatctaagtataattagcatactatgacaccaatagatgtgttctgacactaacgaatcgattttctagatccgccactggccaaggtggttgtccttcttgccctagttccacaggttcttgtggctggtgtgattacctctacatggtcttgacgaaggccttggccatgactcttgcggaactttggaagcatcattgatagatggtggaatcgtgagtgcatagatagggtccagggttacaattatacatgtgtatctgtgtgtaggtgattcagatggcctccttggttcttcccgacgtatctgtgtgttggtgagatgttttttttttcctttgagaaatgaaatatattcttttagaggtattgtacttaattaatttgtccgcaaaattgaagagcggacgtttcctttagataggcccaaatgccagcccaagcacgtgtttggggccgtatccaaattccaatacgaaaaagtacaccgaaggtccctcaacttgtcatcgggataaaaaaggttctcgaaccgcaaaaccagaaatacgaatacgagattccttacctatacaaaacctgggttttgacgccggttttggtttatgtggcggctgagttagcgtgggacccacatggtccccatatgtcaggtgtccacctcaccctatctctttcccctttctctttccttcctgatctctctctagcggatgaggagcggcgtcggcggccggcaggcgagcgcgcggcggccggcggatggggagcggcggccagtaggcggtggtggcggaggcggaggttgtggaggtggcagccccctagcggcgggtatggtggtcgtcggcgttggcgtgccccgcgcccgctcatcccaacggatcctctcctcctcgtcggcgtcgtcgtccccctctttcccgccggatcccgccgtggcgcggtggccggcgtcctcctcctccgccgccg

SEQ ID NO: 34337 - DNA, 1501 bp, Oryza sativa
acaggttgccttgacgaaatccatccaaccagacaccagcaacgaggaaatgacatcaggcaatgttgccggtaacaatgttttactgccattatccaacagaactgaagctcctactccgaggcatgtgattgtcactatttcgctcgatgctggccagaacacaatggttgacgacaatggtgttagacagggattaacagacgaggaatccgatactaaaacgaagctgttggaaagaggtgttctcacggctgcctctgctactgcagcaatgctctctcatttcctgaaaggagtattcaatcatcaccaagagggttactacatcatcctcgtcgtatttcttatgacggggttgattctggcaaccactgccacatggctcgcccgtaggcactccgccaaggtggttgtccttcttgcactagtcccacaggttcttgtggctggtgtgattacctcaacattttcttgacgaaggccttcgccctgactcttgcggtttgttccactttgaactttggaatcatcatcgtgagccaagtgcggatccagaattctaatagagggagagcttatatcctcctccccacgcacacacgctcttccttctctctcttcttcctcctttatcatcttctctcaataatgatctagcgaggtagaagaagacttgagtgatgagtcccaccagtatccacgttggatctgttcctgttgtgagtgtatagctacatctacaagggtcgagagttacaattatgcatgtgtatctatgtgttgatgaaaaatatatatttttgagaaatgaaatattttcttttcaaggcattattacttaatttgtccacaaaattgaagagcaaaaacgtttcctttagataggcccaaatgccagcccaagcacgtgtatggggccgtatccaaacaagacgcaactgggctacatgggccagatgggctaatatatctccatttgtcgacaaccctcgtacgcgtccgctcaacgcacgcgctcacacacgcggtggactcggtccagaaggatccggtgcacctaccttacccgagagacgccacctcaccgcaccccgtctcacagctgtccgggccccaccgcctccccggccccaccatccccctccccaaaattcgaaaaccattcggggaaaataaaaaccgctttgatgctaccgttacaactccactcaccgtcaccgacatgtggaccacccaacgtttcgggccccacctgtcagcgagctttctcccacgggtcattctctccctataaaggaggatacgtactagtactactagtctatctcacacgggaagtcgttcgagtcgtcgtcttcgtctccgttccgttgcgccgcctcgtcgtctcctcgcgccgccgccgccgccgccgccgcggggaagagctagccctagaggagaagtgggggtgagttgggagagaggagagggggcgagatgttccggtacgagaagg

SEQ ID NO: 34338 - DNA, 1501 bp, Oryza sativa
tgaaaaaaaaaagagaacatcagcacttcagcagggttgtacttgtaactaggcaatgctgtacaaatagatgactcaatttgacaattcagtaaatgctgcactgtaaatgctaatttcaaaatgactctaaattcaatttaccttggagatgagcctcgtgttgaggcccaggcgggcggctcctgtcagcgcgttcccggcgttgccacctccagacacctgcaacaatggcgaaacaccaagaaatcgccaggagcgaaacgtcaatcttttccccatgtttcttggtgaagaactaaagaagtggggggtttggtttggtgtggtgtgtcacctgcagctcgccgctgcggatcttgtcgtcgggccgcgggtacgcgtccaccgtggcgaggtagtccagcgtcaccagcccgcaacccagctgcaagaagaagaacacctcacgccaggagtcaggtcaggtcagaccaaccaaaggcagcgggagagcagagggcgcaaatcacagtagctcaccacgacgcggcctgcggcggcggggagcagcggccggcgccccggcggcgcagcggagaggagggagccgctgcggcggcgcgggagcagaggcggtgacgccgccggcgagcatcggaggaggagcggcatggtgagagcgagtgattaccgctcgctgctgccggtggagccgacgagagttgtttggtgggtagttggatggatcatggatggctcccgttgtcattgtcgcgtcgtcacctctgattgcgtcattccatttccatggattgctcgatcagttcagacattttcgagttgaagaaaaagtttagaaactttcacctcaaagaggggagaattccatctcaaagaaagaatttccgaaactttcagtgcctgtaatttttatttaccggcatccaaatcccaagaactgatgttcttatcagtgaagtttgcagacctatcttagacatgcatggttcttagaaaaactgaacacatatgtcgaaaattttttgggactcttgcctttttaatttcaagtaggattgagctaacaatgatgccagtacagcaacaaaaaaatgcaaatatatttctttcacaccctcaagttcactttataacttaaaaacacacaaagaaaggaaagaagagccctcacatttgcaactttattctgcagaaaagcccctcatttggatcgcacagaaagaatggctgagagccagacgaagacgaacagctcatgggccttaattcgggatgtactatagactttgtttcatggaccataaaaggcccacattgcgagcccagcccaactccgccacggcaagacgcaaacctaagcctaaaccgcaactataaaatgcagcactatctccaaaccctcgcgaaccctagcgccgcacacacgctcaccccacctcttcacccgccgccgccgccgccgccgcgcgaagggaagcaggagtaggagccgccagga

SEQ ID NO: 34339 - DNA, 1501 bp, Oryza sativa
gatgattacaaacgtaggggaatcacattgggaacgtcacccattcccgtacggcttacaagagtatatataagggataatagaaagacacctaataggactcttattaggaaactaatccgaatatattgtgggcccaaaattcggatcacatatttaacagaagccaccccttgccgaggagcagcgtgacctcggtgtcagcaacgacgatgaggtagtagtcgccgcctcgccggtgggctcaggggacgacgaatccaacgcgtacgtggcctcggcggtgttctagtggacgcccacagccgtgccggtggtggtagcgaggacctgctcccgcgcttcttgtgcagcacatggtgggcgcacctcgacgacggagagagcgcgtcgtcgaaggcgacggcgaggccggtggctccggcagcgttcggcgtccacgtgacccggatgaggagctccttcccggagtgcaacgaggcaccgtacaccgccgtggtcaccgcctgcagcttgcgatccagcgcgccgccgcgcccagagtcaccggcggcggcggcggcgatgccgaccgagctgtcgccgaagcacgacgactcccgtgtcgcctctggctttggtttttcttccggcgagattagctgctgcttgctgttgctgctactgcaataaaagagagagttgacgtgacacgctgacatgtggggtccacgtaggttccacgctgactcagccgccacgtaggctaaaatcggggtcaaaaccaccgagggatctaaagcgaatggttttattagttgagggacgtccggtatctggttttgcggtttgaggacgattttgtatctcgacgacaaagtgaaggaccttgggtgtactttttccttatatttgctcgtgaattgggccacatgtgaaccgtccgatcaatctatcgttcatgtgccgcgggggattaggtgggccatcgaagcaaggccttagatgggccatcctaacctgtggcccagcaatcatcatccccttctccctctctctctctctctcaaaaaaaacaaaagaaaagaaaagaaaaacatccctttctccttcctccgatccttgtcccccaccactcttcccggcgagagctccggttaatgcggcggtttgcgtccgccgccgcttttcgcctccgtctacagatgggtaagctgtcgtttcctcctgacatatgcgagagtgcgtgaccaagcctcgccgtcgcccgtaccgccatggcgcatctgttagagcaggttagcaaactagtcagctataaacatattttaaaaagataaaaaaagagagaagagcagcgggcagcacaaacttcaagacgtaacgtgtgtatgacatgtgagaccagatattaatagtataataagtaactattgtatgaattggctattgtattggttataaatgatttaaagttagtagtgggctatactattaaacttgctcttattgctactgtgtc

SEQ ID NO: 34340 - DNA, 1501 bp, Oryza sativa
tgaaaaaaatattttagtttttttattgatttttttaatgttgcatatggtctcttttgatgtttcaaccagtagttttataatgtttcagctagtgtacttatgatgtttcactatgtacggattaaatgttgtagtggattttgatattatgaaacgcgccgcattgcaacaaatcacccacatatttcagaaaccatctattaagcgatttcgttttattttttgtttcacaaaaaatgtttcatctagtgtacttacaatgtttcactatgtatagtctaatattgtagttaattagaacattcttttgcaacaaatcacccacatattttggaaaccctctatgacggagcttggggctcctcaccgggagaccgcgcagggccccctttgccggttcggccgggggcgctatgtgaggttcttcgccctcgatctaaggaatgtcagcgagaagaatcgcacaagacacgggcgacgtagacaggttcgggccgctgagaagcgtaacaccctactcctgtgttctgatggatctgtgtgtgaaggaatacagagagccggagagcgagagaccgttcaggctctagaacccctccctcctcttctcctttttctctttttttcctctctcttctctctctccttctcttaggcctgggcctcctttttatctggtcaggggtcaccacatgggcctcaagctgcctaagaaaagaaacattttttttacaatgagggctagtctacagccggaagtgacccctgacaagcacagcacacgccttctgctccgctcgtcagctctcccggtggacgcccgtttcaaccttcattcaatggccagcgactttcttgccatgcttgcgctgaagcctagaatggatctgaccgggactgacataccaactccaggagtcagcacgccagctccggctagagacgagagccaggaagctctcatcattccgacgggacggggcgaggcgtgcgacaggccgcctgttgccacctaacccgcgatctgaccagtctgtgaccggtcacataccgcgactggtcacggaccggataagcatgcgctgcgccgcattgaatacggcgtggcgcgcttgtctaacccgctataaatgcggttaggtgagcgccgctgtgctcacctaacccacacacgtggcgccaacaccacagggggtcggggcgccccaaccctcggggctgaaacgggagcggcccgacccctcggggagacagagggaggggtggccacgtgggtgatcgcggctacccaagcctctagtcacgatacccccggccccatgtcaccgacagtagcccccggcgttacgccagggcgaccgcccccctcgagggaggcgctcgggcgtgacgccactccttaggcccggtgacaggtggggccggtctccacaggcgggcagaaacccaacggtcgcaaatcgcgcgcatcggcaagggaaaaaccgaccgacaataa

SEQ ID NO: 34341 - DNA, 1501 bp, Oryza sativa
tgtgactgtgacaatcttcagagtttgtattttgacaaagatctatattttagcatctggtttgtttttctcacctattgttcataattgcaagagacacctttactaattctaaatgtatttatttttttcaaattatttataataactaatttgttgaagtgcagttatagttacatcagtgggatgtttgacgtacatttatcaattatcacttatgcccaacatattataatttctcaattgtaagaaaatatatcatgagtaggtttatgtacatgttataagattgttcatttgttaccaaacctatttcacaaaataacaaatgtaaatgaccataatttttgtgatggattaaggagttgtattgtagcaacatcattgcctaggcatacctatcaaataactctgaaaaatacaataaacaattaagaatcttaatctcacaaaaattaaaataaagtcagatataattgacaaaacataacgttgtttcattttcatgcacgtagatttcagttagtgttatataattatcaagtgatatttgaccataaaatataatatgaaattatttcaaagattatcataacattaattattatatgtcacacaaattatttgaaaaagtatttttatattaaattattatgtcggctccatgtgttgtaatgtatttagcactataatataactatgataagtcatcaacatttgattacaccttattataagttgactatataattaaaaataattttaagaaaatgagtgattaaacacatttagtttgtttttatattaaaatagtttaacctgcatatttatctttggagtaatgaattttattttatagtatagaaaatcctattctgaagaacatctatatttttttaaggttctaccaacttatatatgtatttttttagggctttatggcttcattatcgtatgtacatatgtttctttgttttttttttcaatcgaatatccggtacatagtttctctcatatacacatgacattaagaggaagcgggctaattatctaatgatctaaaataatgggtccattatttcaaatgaaagttgacagcagaattatagactgccacgtggcggtctaagagtgcttgtagaaacaccacatgatcatatttgtggagtaataaattttatttttatagtatagaaaatcctattttaaaaagaccgtctatttttctttctactgacgtacatatatttttaagattttattgcttttcttttcactcctacataagtacgtacctttttttaagtgaacaatatctaaagtttttttgtttgatggtttttttatcgtacttacgtactcttatacatgtattttttgggcgttatagatttattatcgtatgcacatatatttctttctttgttttgtttcaatcgaacatccgtaaacaatctctcgtatacacatgaaactaagagtaagcggactaatctaataa

SEQ ID NO: 34342 - DNA, 1501 bp, Oryza sativa
acaatctctggttatgtcactggagtaccaagtgaataccaactcatcaacaccgattactccattttctgtttccttaaaagttgagggtgcctggatgccattactaacaactttgcagtctggctgaagaacagacaatatgcataaggatgtatcaaataccactggcttgcgttgttactgaggcaagttattgggccaactacaccgtgctgatctcttggtaaatctcttgaacaacttactaagcttgcagcttccaatttttgaggtttgtacacatcagttgataaatttgtcgagatgagcttctgaagtgggcagtgaggtgtggaatctacaagcaggatgatggacatggcagcatgcttgtaagatattgcagtcaccttgcaggagcctagaactgggtgatacaggatggtgtcctgtccagaacatgataactccatgagaggtgtgccgcacgacggagattgtgatgcaaggcggagtgggaaccggacttttggtccatgtttgctgcactgatttggtggacaactcttgaagttgaagaagctctcggcatcccatgctgtggccgcatagatgagaagagatagtagcagcacaacaacaagaagtttagccatgtttctgtagtgctgttgaagattgaaggcacaaggagaaggccatgaatgtaactataatgaaatttactgggagtttatgctgtgcttgtcatgaactcatgatagcagcgtacttttggagcaatcccaaagtacaatgaaacttctgtggtcccatgttgcagtcctttttagtgtgactgcattcctggcgtcatcagaaaatgaagccgcacttccatgcaacggtgaactgttgttagtgttaaacttaaactgtgaatttgctggcagtggctagaagctattgtaaatgaccctctgcagcacagccctgtgtagtaaagatattgtgaagttcttcatagatagtttactccaatccatatccaattgtaaaagagttctccgaaagccttattctgcacactgatcttcctaattattttgtgacagatgatgggacggaccagcttcagtccaaatgtgcatctcgtcttcactctggaattccagatgaggtactccagttttatttgctctctccaaatttaccagaccacatgaattgaatcccatagttttcactgctttactgatactgatgctctaatggattgaggctggagacatgctctcttttgtcacatccaggctcgattgtttccttccccaagtcagtcaatgccatcactgtcatctgctctcagccatgtaattgttacccacccgtgtccatttgcaattgagatcctctgctgtattatccctatattgaaagtcactgacatgtgggctaagcatatagctagctagcttggacagcaggcccctctctattgtaataggcttgtttgcactgcctgtgaagctagctaccg

SEQ ID NO: 34343 - DNA, 1501 bp, Oryza sativa
tacatgagtttcatatcctatctgcctgtttgttgataattaaatattgttctgtattttttttcttttattcttatcatttcctttcttttggattcctcccctaaggttttctggagaaccacccctaaggttttctggagaaccaacaatgacttctgttctatggtaggttattttttcctaaaaagttctatttggtgtgttccaatgctgtttcgaccattagcataatttttgttgcagtaatcgtgttaagtcgtactgtttttcatgataggagatggaactctatcttgtcaagttgttgcttcctctaagcatctcacgttgcttccttaatgcattacatgtaacaaaaaaaaaagagaactattccaaatttcctgtggagtactcattctgcactgagccactgatagaataccatggaacttcctgcactttaaggatatactattgtacatcaatgacaaaatgccagttgattctattctttgcttaccgctaaacacacttttctaaagataaaaggaaaccaacaaactatttctaattgatagataactttccatgtcgcatcctccttgaattcggtcacttctggataagtttcctttaatagattaatttacttaaccgaatatagcaggaatccgactattggtgatgtgataattctctagcttaccaaatttcactgttaacacaatcaccgccttctcgtggacaaaatggcaagctcactggctagcgatgtcgccagagatggggatggagagaaatggataggggatgacgagtaggtccattttgtttttccatttctttatttttatgtctcattgatatgtgggcaccacatgggctccattattttttattattttgtgggctcaacatggaacccagtattttttttgtcacaccccgaatttctttcccaagcctaaattgaagttataaatggtctcaagaaaatacctgtgtaaagcaagagtaaaccttgataaattaatgcaaataataatcggaattggcatgtggaatttttcttgagttctacatgtcgaaatacgctaacaagatttttagtggaattttcagagctctagaaataattttaaccaattaaaattgagcataagcaatatttaaatccctgggaaaattctttttctttttctttcttttcctttctctttttctttgaatggccgccggcccattctccttccttcctcccctcccgctgggccggccgaaggccaaggcccagctaggccgcgcgagctggccgcccacctcctctcacccgggtcaccgacaggtggggcccacctgtcggacccgtctcccacctcgcgccgcgccgctgcgcccgcaaccgccgccgcgcccacgtctccacctcctccgggccacgtcggccacgcccgcgcatgcgccgcacctcccgcgcccactcccctctctctcccgcccgcgcccgcacacgaga

SEQ ID NO: 34344 - DNA, 1501 bp, Oryza sativa
tgtaattttcgaatttacatatgtaattttagtacttacatatgtaattttgagacttacattgtaaatacactaaaattacatatgtaatttagatacttacaatgtaaatatataccgactattttttataaaaaatatggcgccataaatatagctacatccctagatctaagcaagcatagcatgattagcgctcggctcactttgcgttttgcgacgaatggcttatttattatccgctcaatctaacgcgctcacaacctaaaaaaggggttaggagttttaaacaccgacccttaatccgcgcaatctagatcgcatcgaacggccagtaaatgaaatacccaaggaaggaaaggggttcgggggtgattcatgttggactctggcatgtcggcccatgacggaggaggattcacagcccggcccagatgttacaagcgaagtcagaatggaacaccaccagcaccactagatgggctcaaacgcccccgcggtggtgtacggccgcctacgccgcccgccgcccgccgccggtgagcttttcttctcttccgagttccgagttccgagctcccccttcctgcccgtttcctgtggttggagttggaggggtgcgttttctcatctcccccttcctgccctgccctagccgatctccccgtcgccatcaactcgcgggcttgccggccggcggcgccgatctccaccccgcgagcagcgtctcccggcgtcctgccgcatcctctccggtgcatggtttggttcgatttagtctcctcctccggtggccccgttcgttcgttcgttcgttcggcccccaaatcccaggccgcctcctccgctggcggcggccccttctccccggtggtcttcgcctcgcgcgacgacgacgcctgctctccggtggcctctgccttgcgccgcctcctgcgcgacgtacggttgctatactccttactatcgctgcgggttctgtttaatttggggcgatactacagatgcgcttagcttctcttgcaatacggtactccttgcctttgccttaacctaattatactaagcaatttgtttccgaaagaaattggggttcagctgaacccccccatgccccatgttacatcagtccttgcagtctttagtgattaaccatatggcccgcgaccgcttcagagtttagcctgctaaatatcctttagcaaatttcttatcacacctctattttgcatttctgtttagcaatctgttctttcatcggggtgttgagggatcaaattacatttcatagtttaacgaacgcaatttagtcttgattattaacagtccacaataatattactagtagactactagtgatagattgggcggggaatatctccattgaacgtttatagtgattaacaaaattattcaagactgatattggtataatttccatgttttcaacttgcaggaatttcgccattctgatataaattagtgcattgcatcagaaaaa

SEQ ID NO: 34345 - DNA, 399 bp, Oryza sativa
tgcaccccaagcccagcctaaaaccattttgagggttttgaatagagggggaggtgtgaatccaattccacaataatccaaccattccatagtgtccaggtgatatgaatattcccaaagtctagagttgtaaaaccacctaatgttgcctaattaaccagcgaagcatctacctaaaatcatactagtggtaccatgagtagagtgtccactagttggggttttgtttattctagggtgaacaaggtaataataacaatagcaatactaataaggtcataacaaaggtaaataggcatggctaaataaaacattgataacgcgggaatttaaataaagcgataatgtaaaaatttaaatcaaaataattttgtaaactgggattcaatatgttccagg

SEQ ID NO: 34346 - DNA, 1501 bp, Oryza sativa
ttgatgtaatatgaaccgtgtttttggcctccccagttgcaacaaagctctggttagtgatcatggggattaatttccaacatgtattattaattattaatttgtgctaccatgggaattaattatctattatctatctatctatctatctatctattatcttctattatctattatatactaaaagtccattaatcttcctataaacactcctaagccaccatgtggcgctcctacaaacgctcctagatcgccacgtggcattttataatcttaccgtcgattttcatttaaattggtgtacccgttattttagaccattagattagattagatctatttgctttgctttctgtcctgtgcataatgccatttataccgggaaaaaaattaccgtcggtatgtacttggaaaaaaaaataaaggtacgtttagttgatgttcctttaaaaaaaacgaacgtactttgtagttacgtacgataaaaaactataaaacagaaaaaaaaagaaactgttcacttgaaaaaatataaatatatatatatagacaaaaaaaaagaaaagagcctttgaatattttttaaatatgtttattgatgttttcctattaataatattttcatttattatcacatatttatgtacataggtagaaaaaaatagacattgatctttttaaaataaggattttccgtacaataaaaataaaatttattccatagatatgatcatgtggcgatcttacaagtacccttaccgccacatggtatgccaattttcatttaaaatgatggacccattttatagattattagattagtccgcttactcttagtttcatgtgtatacgagagattgtttacggatgttcgattgaaacaaaacaaagaaagaaatatatgtgcatacgataataaatctataacgcccaaaaaatacatgtataagagtacgtaagtacgataaaaaaaccatcaaacaaaaaaactttagatattgttcacttaaaaaaaggtacgtacttatgtaggagtgaaaagaaaagcaataaaatcttaaaaatatatgtacgtcagtagaaagaaaaatagacggtctttttaaaataggattttctatactataaaaataaaatttattactccacaaatatgatcatgtggtgtttctacaagcactcttagaccgccacgtggcagtctataattctgctgtcaactttcatttgaaataatggacccattattttagatcattagataattagcccgcttcctcttaatgtcatgtgtatatgagagaaactatgtaccggatattcgattgaaaaaaaaaacaaagaaacatatgtacatacgataatgaagccataaagccctaaaaaaatacatatataagttggtagaaccttaaaaaaatatagatgttcttcagaataggattttctatactataaaataaaattcattactccaaagataaatatgcaggttaaacta

SEQ ID NO: 34347 - DNA, 1501 bp, Oryza sativa
cgtctatcacactcatgactcatgaatggacatgactttcgacattgatatggtgattgttgtctcataagcaactgtacctcatactaaattttgtataccacttgtaaaggaaaaccttattttgtaagttgtgtgtgattaggttcactgtaattttgtgctcaaatccaaatattattgctcatatttgcaggcaataaagtggagatgcaagcagagaagcaatatcagacaaatgatgaaataaacaatgataagaccaaagagcaaaacttgaaggaagcttctctaaaggacatccaaaacaaggcctgtatagatcgtcagaacattaatggaacagagccccatctagctaactcttttaaagattctaggcctgcatcaccaggaacacaagcactaatgtgtgatgaaatggatactacattcggaaatgaggattatagaagtccatttgtggtgccttcacgtgatcaggatatttctgagctaaatgctgatcaagaaagaatagtattgacagggctgcgagattatcttcgtgtgcttatcacacgtggaaatataaacggtgagtgcaacttgcttacactgttattgtgaatttgtgatcctagatagcacatcgtgttcggtttgctaaaatgttaatttcacacatactttgccatggcataagagatcaaatattatgataaatttaaagactatcaaatctttgaaaaaataagcaaagctttcctggacagttagaatatatggacattgacttcaaaatttcattgatcactatggatgtttatgatgaaacgcagaaatattgttataaaatagctccatctgaaaattatataaggttaataattttccatgattgtatcttcttttgtcgttttcgtatagtcctcacatatcagtatattactagaaaatagcatttctaattctctagtgatttttttttctgcttttacctttattattggaatgtgttggttattagacctgcaatatctttaatttgattgcctttccaataaatctgagaacctaatggtcggtgccacagcaaccaaattctcgttagagacagcaatggaattggattcccggaggcatcatggagcaacaactgttttttcccaagacaaatctatgtcttccagttgtcgtgaaacccttggaaataatcaaacatctatgtcaaatgatgaacaaaaggaaaaaagtggaggttaagtagtagtattagatacacactgcactgtaaatgatcacctctgtacatggatggataagatagatagtataatcctcgttgcctaatttgggcaaccggcctttgtagaatcgatcattgttcattgagtgtagcaaagcaacactttcactgatgtgttgatcaattcaataaaaagtcaattgatttttttggtcttcgaaattgtctttctgggaattgtgaaaagccgatgtcactagtgtcgatggggga

SEQ ID NO: 34348 - DNA, 756 bp, Oryza sativa
ataacatatgggtctagtaacaaatcattaattgtcactttgtaaaagtggcaaatagagaaatatatcttgggagggggagggaagagggggaggagggagacgctgacaggtggtcccacgtggggctcatgttggcggctgttaagagccaaatttgtaccgccaatatctacataaaactcaaataatgaaacatctaacatagtgatatgattcatttctagcatattccacgagcgtccagaagttgggaggaattacagactaatgtgaaggagaattgacgttaagaaataccaacagcacactcatcacgtcagccaaaaccagccactataatgctgagagactaaagttgacatggtattgtgagttgagggatgggatatttctggtgtttcggtaaggggacgaatttcggattcaccatcaaatagagggacctaaagtgaacttattcagcctttttattttggaataagttcaccggaggtccctcaacttaacagcgagattttttgagttcccttaaccataaagccagaaatgtctacccctaaacttaatcaaaccgttcaccggaggtccctcggcggtattttttgcccggttttgctgacgtggcatcctagtcagcaaaaaaaataaaaaggtacgtggggcccacatgccagctacacatattttttttttcttctcttttcttctccttctcttctcttttctcttctctcctctctcttctccttcagg

SEQ ID NO: 34349 - DNA, 216 bp, Oryza sativa
gcgtagaaatctgcaagatttatatcttaagagaacaagctaaggtatgcttcgggcccggcctactcttgggcccgggctcaccttagttcgcatgagtcacgcactactcgaggatgatgagtgccaagacatacaaagcataaaggtgtaaactgaggtttgcctcaggcccggccttgtttcgggccccgagctcaccttggtccttatagg

SEQ ID NO: 34350 - DNA, 1501 bp, Oryza sativa
acctagtctgtaggttgaagaaatctctttatgggttgaagcagtcacccagacagtggtataagagatttgactctttcatgctttctcagaagtttagaagatccaattatgatagctgtgtttatcttaaagttgttgatggttcagctatatatttgcttctttatgtcgatgatatgttgattgctgcaaaagataaatcagagatagaaaagttgaaggcacaattgagtagtgaatttgagatgaaggatttgggtgcagcgaagaaaattctcggtatggaaattactagagaaagacattctggcaagttatatcttagtcagaaaggttatattgaaaaagttcatcatcgtttcaatatgcatgatgcaaaaccagtgagtactcctttagctgcacatttcagattatcttcagatttatgtccacagtcagattatgatattgagtacatgtttagagttccttattcaagttcagttggttcacttatgtatgccatggtatgttctcgtcctgacttatcacatgcattaagtgttgtcagtagatacatggctaatcctggcaaagagcattggaaagctgttcaatggattttcagatacctacgtggtacatctagtacttgtttgcagtttgggagatctagagatggacttgttggttatgtggattcagattttgctggagatttggataggagaaaatcgctcacaggttatgttttcactattggaggatgtgctattagttggaaggcaagtttgcaagcaacgtttgccttatctactactgaagcagagtaatggctatttctgaagcttgtaaagaagctatttggcttagaggtttgtacactgagctttgtggagttacgtcttgcattaatagattttgttccatgagagaacaaagcacattgatgtgagatatcactttattcgatgtgtgattgctgaaggtgatgtcaaagtatgcaagataagtactcatgataacccagctgatatgatgacaaagccagttcctgctactaagtttgagctttgctcaagcttggtgggtgttacagtatagtcctagagactatttggcgcgcggtgattttacctacatgaggtattttttggtgattgatgtttttatgcaacaagaggaaattcgtctcaaggtggagattgttaaatatgtgatccgaattttgggcccacaatatattcggattagtttcctagtatgagtcctattaggtgtctttctattatcccttatatatactcttgtaagccgtacgggaaggagtgacgtttccattgtgattcccctacgtttgtaatcatctcctctatagtgatcattgccggtcggcgtccgtggttttttcccgcaagggttttccacgtaaaatttatgtctccgttgtgcatctattttcataacagcttcttcctgcatgtgcaatgtgttactaacaaaaaagttcagcttc

SEQ ID NO: 34351 - DNA, 1501 bp, Oryza sativa
atcatcatgtccccaggtgaaacaaaccggctcgtcccgattcgcgcgctgctcgagtaatgtagcggtcttgaagatgccgctcattattgtcggtcggtttttcccttgccgatgcgcgcgatttgcgaccgttgggtttctgcccgcctgtggagaccggccccacctgtcaccgggcctaaggagtggcgtcacgcccgagcgcctccctcgaggggggcggtcgccctggcgtaacgccgggggctactgtcggtgacatggggccgggggtatcgtgactagaggcttgggtagccgcgatcacccacgtggccacccctccctctgtctccccgaggggtcgggccgctcccgtttcagccccgagggttggggcgccccgaccccctgtggtgttggcgccacgtgtgtgggttaggtgagcacagcggcgctcacctaaccgcatttatagcgggttagacaagcgcgccacgccgtattcaatgcggcgcagcgcatgcttatccggtccgtgaccagtcgcggtatgtgaccggtcacagactggtcagatcgcgggttaggtggcaacaggcggcctgtcgcacgcctcgccccgtcccgtcggaatgatgagagcttcctggctctcgtctctagccggagctggcgtgctgactcctggagttggtatgtcagtcccggtcagatccattctaggcttcagcgcaagcatggcaagaaagtcgctggccattgaatgaaggttgaaacgggcgtccaccgggagagctgacgagcggagcagaaggcgtgtgctgtgcttgtcaggggtcacttccggctgtagactagccctcattgtaaaaaaaatgtttcttttcttaggcagcttgaggcccatgtggtgacccctgaccagataaaaaggaggcccaggcctaagagaaggagagagagaagagagaggaaaaaaagagaaaaaggagaagaggagggaggggttctagagcctgaacggtctctcgctctccggctctctgtattccttcacacacagatccatcagaacacaggagtagggtgttacgcttctcagcggcccgaacctgtctacgtcgcccgtgtcttgtgcgattcttctcgctgacattccttagatcgagggcgaagaacctcacatagcgcccccggccgaaccggcaaagggggccctgcgcggtctcccggtgaggagccccaagctccgtcatagagggtttccaaaatatgtgggtgatttgttgcaaaagaatgttctaattaactacaatattagactatacatagtgaaacattgtaagtacactagatgaaacattttttgtgaaacaaaaaataaaacgaaatcgcttaatagatggtttctgaaatatgtgggtgatttgttgcaatgcggcgcgtttcataatatcaaaatccactacaacatttaatccgtacatagtgaaacatcataagtacactagctgaa

SEQ ID NO: 34352 - DNA, 424 bp, Oryza sativa
agaaatttatacaaattcatattcatgaatatgcaccattttggattctaaaacaaattaaggacatgagtacattgttggagttctaattacatgatcttaagctttagtctataaacaatcccttttgcttatgcggaaaaataattgatctactgacctgagttagaagccttaccgttcttctttcttcttcttccagagatgcctcacgaaccccttccagtgcctagatcgattgggcgattaattagggtttgagattagagagagagagagagtttggtcgtctgcctctttccttctctttctttatataggcgacactggtggggctcgggggttatctcaattagtttaggattctgttttctgtaccgatcacataaaaaacaaatttattcttagtttgtttcttgtcagg

SEQ ID NO: 34353 - DNA, 1501 bp, Oryza sativa
tcgccggcgaaaaggatgagttatgtttgagagatggccgcaggagaaaggttggcactgacgatgccgtcgtccttggacatggacgacgtgatgatctgcatccgctaccacaagtgcgagcacacacaggacggtcgacaaagcagctgcttccattctagtgtaggctaccaagctagctacttgttgctcgctcggccggctcctacttataagtagtacgacgtacgcgctaccaagaaggggaaaacagaaaattgagtatacgtcttagccattaacgcataattaattagatattaattattttaaattaaaaaaatagattaacgtggcttttaaataacaatattgtatatatattgttttcaaaaaaattacaacggttaatagtgcggaaaacatgcgcatgaaaaacaagtaattttttcaatctttcagctcggccgaacctttaaagttcgaatttatattaggtcgatcttatgctataggttgtgtccattacatatttcttatttatattaagtcgaccttatgcgaccatcgaactcgttcgtcgatcaaagaaaaggcagtgaaagccaaagccaaagtacagatcaagtggccaaagccaaaactctcggctcacagtgctaaaagcagtaactaaacaggctactcggtagtagaatatactaccctttttatttttttaatgatattgttgattttttataatgtttgattatttgttttattaaaaaatttattacaaatatgtaaaagtataagttaagattataatttcttcgataataaaagcaagtcataaaaaatatatttatatttttagtaaaatggatggacgagcggcgtctgctgtcttaaaaaatgaacatacttgcgtgttgcgaacttttgactgtagtactgtacgacaacaaagctcgcgcgcgtgaattagcatttctgcgtgcgccaggcctaatttccacacgggaattaaactttactggccggtttcttcaattcttcatatgttaatctctcatgagattggacatgagtggactggagcaagtctacgatgttcaaggtcagtcctaggccggcatgattttccaaagcaccccctccgtttcatagcttttaactttttttacctgtcaagctctttcatagctttaccttttttttttactagtcaaactctaatcaaatttatagaaaaatacgacaatatttttaatacaaaacaaacatattatcaaaatgtattaaatattagttgtaatgaaactaatttggtcttttagaatttatatgttgctaaatttttttataaatttaatcaaacttaaaaatgtttaattaggaaaaagtcaaagtgacttgtaatatgaaaaacgacttatatagcacgaaacaggaagaacatacagcgcattgttgcttacaatgaagcacacagttacactatcctgagcccacatatatatatccgccttcactt

SEQ ID NO: 34354 - DNA, 181 bp, Oryza sativa
ctgcagccccttagtaaaaggctctagttatttttcctgtttttttctttatcaatttgtattctcgagtattaatggtactatatttgatttatcttcttatcattgaaggtccattaagccacaaacttcatgcgtacatcggtgaaggtgcataagttgacgacagaagatgcaatga

SEQ ID NO: 34355 - DNA, 1501 bp, Oryza sativa
catcctccagtgtcgcagccgcagtagcagttcgccaattctctagaccacccagagctaaaggagtcattgccaggtatccacaggaaggctcaaggttctcagctaaataagatcccagaccagttagcacatagacgaaagaagagttgccgctccggcaagccacaggcctgtacatgacattgctgctattcatttcctgcgagcatttcacaaaggtagcgaaccaatccacatcaggggacaactggacttggacacggcggtgtgaatcttctccaagcctgtagttttcattataaggagtctgactccaccgaggaagagggcagttgttagctgaatccaagcttgcatcgaccacccagaagtactgatcactgtagttgatgtcagttaccaagtatgttgccttgtcgatctgaattgtagcattgctgtctgcacaagtcagctcatatgatggaacaccacattcagcggggtcgccttgacgacggaatgggaaatgcacatagctaagacgtccgcaggagaaagatgggcacttgcctctcccctgaacctgatctggtacaacaagtgcaagcacagagaaggcagccatggcctgcagggcagcagaacgacgaaacgcaccagccatcgctacggtagctagcttcacaggcagtgcaaacaagcctattacaatagagaggggcctgctgtccaagctagctagctatatgcttagcccacatgtcagtgactttcaatatagggataatacagcagaggatctcaattgcaaatggacacgggtgggtaacaattacatggctgagagcagatgacagtgatggcattgactgacttggggaaggaaacaatcgagcctggatgtgacaaaagagagcatgtctccagcctcaatccattagagcatcagtatcagtaaagcagtgaaaactatgggattcaattcatgtggtctggtaaatttggagagagcaaataaaactggagtacctcatctggaattccagagtgaagacgagatgcacatttggactgaagctggtccgtcccatcatctgtcacaaaataattaggaagatcagtgtgcagaataaggctttcggagaactcttttacaattggatatggattggagtaaactatctatgaagaacttcacaatatctttactacacagggctgtgctgcagagggtcatttacaatagcttctagccactgccagcaaattcacagtttaagtttaacactaacaacagttcaccgttgcatggaagtgcggcttcattttctgatgacgccaggaatgcagtcacactaaaaaggactgcaacatgggaccacagaagtttcattgtactttgggattgctccaaaagtacgctgctatcatgagttcatgacaagcacagcataaactcccagtaaatttcattatagttacattcatggccttctccttgtgccttcaatcttca

SEQ ID NO: 34356 - DNA, 1501 bp, Oryza sativa
ctttgtggcactttggaccaccctcaactattttatccatctacatccaacttatcatatgccaaataaatggtctttcatatagctgagagagttaattgacgagtacaagccgacatactcgagatcgttcatatgcttgagaagagagttgtgatggtccaaaatgaagcgaaggtaagattacccggaatgcatgaacctaacaggaatgcatatctattttccagacaagttaggatccttattggaaaaggaataatttttgaggagtttatacatatatagccctttgttccatgttgtccttcacctgttatgcttcctagtgatagatcagagatgccctctctcagtgacatgttgcgctagaatatatatatgggcgctggttgtcacatggcaggatgcttctcattccttctttggcccatctcctcctatacatgcgcaggcatgatgcatgcatacggttgcatgcacaaaccagttaagatcagagaatcccagcagtgtagtacatgcatacttgcgacgtcatatgctatatacctatactccactcggtgctagctaggttgaattgagatcgatcgatcagatatggggataaaaactgatagagctaagctagggcctggatgcagagagatgcagccatggccttctgttttgttttgttctcaagtgagatacgacgaacctgcatgctacaccataaacaggttcatccctgctgtagagaccaagtgtatgaacaaatagagcatgacgaaactacaatacagcgaaaaaggaaaacgtaactgaaatttgttatgtgtgattgtcacgtaccagaaatgacccttaaaatccagaaagtttgtggcactaacatcaggagcacaacaaaagggtgtggaagttgagttgcatgacggccgcatatcgagaagtaagaatcgatattagtaaaaatgacaaagatcctatatgctgtcggttctccactactgtcgctgcaataccacgatgtcatgcatgagccatggtacggcaaagcaaatttccaagataatgttatttggcattggtaaacttcactatcaagaatgtacagggaagactggccaaagtgttcagttttaagggattctttttagaaataatacttttttattagagtcgcaataatagaggttgacagacaaaaattgcaagtataacaccctatcgagcaatcgaactgtggttgttcgacggataaaaaataaaaactaagagagaaaaatcactgtgcgccactgtagcatgcaggacctatcaaacatccccagttcgataggccaccctgccatgctcttccatgtattttttttaagtggaccaacaaccctgtcgaacaacctgtcgaactgtggttgttcgacagggtataaaacttgcgattttagccaatcaatttatatttttgcaattttttattaaaccaccgggcagcggcacagttcgattgaat

SEQ ID NO: 34357 - DNA, 1501 bp, Oryza sativa
ttgcaacgaatattacaagagatttaaggcaaaagcaaaacttataaacttatagcatagttagttaactagcatggtggtccgcgcaatctgcgcggatagcatcattatattttctctcgtataatagcatatatgttttctcaatgtgttattcaaatatattaaaatggcaacatattttaaattttgtactaattttacgaaactactaatttgtaatattcatattgtatttttatatacgtgttagttattaactttttaatatcaaattttagttatttttaaattatattcctatatgtactctagactcatcttttaatatttctttttttaattctgaattttctgtaaattatatttctatatagactctatgctcttctttcaatattatttatttttatttctgaatttttattatttctaattgtatttctatgtggactctaaacttatctttcaatatttttaaatttttaatttcgaatttcagttacttctaaattgtattcctatatttgtattcctatattgaccttaaactcttcttcccatgtttatcttaatttcgaattttagttatttgtaaattgtatttttacacggactctaaactctactttttaattttattatgtttattccaaattttagttagttttaaattcctatatggactctatactctacttctaatattccttactttttaattcctaatttctattttttttcttaattgtatttctatatggactctatacttacttctaatattccttatttttaattccaaatttctattatttcctaattgtatttctatatggactctagtctcctcttctaatattccttattttttattccgaatttcagttatttcctaattgtatttctatatggactctggtctcctcttccaatattccttattttttaatttcgaatttcagttatttcctaactgtatttctatatggactctagtctcctcttcttatattccttaatttttaattctgaattccagttatttcctaattgtatttctatatggactctagtctcctcttctaatatttcttatttttttaattccgaatttcagctatttctaaattgtatttctatatggactctgccttttctttttctccgattaatgtgagaatttctaagccatgagagcgaacgtggaggctcccttttctattactttaataatataatagattaggcatataatacatccaaagaaaaacattaatgtgtgcatgagtacttcatgactttggatgcaaacccagacatcaccactaacatcgtcatttaaagtagtgtgtgtgtctatatatatatatatatatatcatacaccgtttaattattattctatgataaaatttaaactacagacttaaatttatttagaaaatgatggagtacatctctgtacattaacctctgctttctgcgacacgccgacacct

SEQ ID NO: 34358 - DNA, 1501 bp, Oryza sativa
atacataactaagctagtactcgtagaatacatgcatccatgcacacgcggagagatagcaggtgaagcagctagcagaaaccagcgaccgggcaaccaaccaacacgacgccagggtgatcgagcttgcaagccacatgctagctcatctcatctcatctcgcggctataataattctcctctgaataacttacttaaatttctagctctaattctaccatcctattaataaattgtttaatttaattaatcaggagccatccattcatgcatcagtgtcaaactgattagtaccactactactccagtattgttacctctcgcgccactggggtttgctccatcagctccctttatttttttaaaaaaaattatgccctcgatttgtttatgtcagttcattatcaaattgcgcaattgggggtgatccaaccatgaatttgggctggtttgtctgttaactccggccatgtgcgtgcatgctttgtctgaatcttccttacgtttgatgatccacctaatagtactaatctacaatcttgttgattaattaacctgtgcagtgaaaccagaggaaattccaagcagttagcctgtcgcttatctcactaacaggcgatcaagtgagttaattatcacaaggatactcaggcatactagtgaattaattatctcactaatcctgatgaattgttatcactacttgttgtcttgctcattagtcacaaggctacagtaagtaagagcaggccatgatactagcaactaatgtacatgttactagctgatataatcccatgttactcccggatcatccagataaactctcatcttggtcttaaccggccggtggttggatggatcgacccttttggtacattgacacatggctcgatcgatcgaccggtggatttcacttcaattcattaattaatcagtagctagccatttctaccagaatgcaagcttttacttgcaaggagggagaagggagaatctgaattccagtgggccgtcagcatcggtcacggttgattaaaaaccaagtgattctacggcagagataaactagatagtgccagtttaattactggcagcatttgaatgattggtgccctgcctgcagtagtactagtagagcaagtataatagtacagtctactcctagctctaattcatcaatagataatttaatagtcaattcatacaataattgcttattatactattaatatatggtcccacctatcatacacacaatgtgtcttggagtccgtgctatagctgactacagatctatagcccgctgcttttctctctcattgtttatctcattaaaatatgtttacagctgcctaatagcctactattggaactgatcgtagtaggagtaactttatttgtctgacagcacaaaggggcatgttgagcatgcagcaatcataatccgctccccctagggatcgatgcaggggacttgaatatcccataattgtcaga

SEQ ID NO: 34359 - DNA, 1501 bp, Oryza sativa
cactgggtggtttgttgcattgatcatctttataacttgataaagcaataagttaagcaagcattgttcatctttacaacatcaccctttttggatcaccacattccagctctcctgcttttgttatttacactaaagcaaaggatgatcaaagaagcaaacaattcagttttttttttttggaaaagcaagaaacttccttacttgtaagcattgcaatgccactgaaaagtaccagcagtttatggatgctaatgccatcactaatcatccaccagaagcaaatgcaatctactcctactcccccagaaaacaaacaacagagagccaggacagaaaggggcagctcctatctggccagcttttatttagctgttcttcttttggatttactatctttttattttctccagatgaaagcctgaaaacagtagtgagccctctctgtcctctactcaatcctcatcaacagctgccacccatgatttcattatctttttactttccccacattttatatagccactctcctccttaactcccctcctactctcctccattccttcactgccttcacttccctgctcagctcagcagctcaggtcagtctcctcagcattgtttcagctgcaatgccatgctcagaatctcttctcttaattttttggtttccatgagttccagtatgatgtttcatgggttggtcgtcttggaggcagccatttgtttagggcgcatttggatctgttcctcgcagttcttggcccgaggaaagaacagatctttgcgcctctcttgagcttggcgtctcttcttggtgctctgcgtttatgttccttcaggttgaagggaaatgctaatgcaaagcttagcacttaactgttcttggctcccaaattccagagatttggatgcttccagtggtgctgagatctgcaggatgtagtagtaggagtactgtttttgttcttgtgttagattatgtggtctcctgatttggttggtggcacctaacagttgaagtagtagtataatgcagttgtcaattcggactagatcgagtcttgaaagtgccccatcttgtgcatttgtctctcttggtgacagggaaagggccattaatttgtgctaaatttcagtaatctgaaaactctgctctaggagctagaaagatctgaacaataatgagcctggttaaaattctcaatgttcagaattaccacgaactgtagtaatctgaagcacaagaagttggttttctggcatttcagaatacagaacaacattacagatctcttgtatgttgatttgaacttaagtactctactaaatgtgttcagtaaacactgtagaattcacaagattaagagtaattctattcagcagttacagacttgtgctccagaaacgcatgacaaaaaaaattcagtgctgaatgcttcacttcactgttcttgcgtgacatcagggacttcgaggatgatggaatccaaagcagcca

SEQ ID NO: 34360 - DNA, 506 bp, Oryza sativa
atgccaactcaagccgtttgtggagattatggatatcccatacccacacggcatgtgtatccgactgggtatgtgatgccatgtatagatagaatatctttaaagggactcgggttaaattctaaacttgtatgacaaggaaatacccgggatcctagtcggctacaattgtatctaatctgtaactacctattccgttagggatatgggctttattttgtaatacggaccccttcccctatataaggaggggtccgggtgcctctaggggcacgattttgctcctagatcatacgatcaataatacactcggcggatcaatccccggacaggagtagggtattacttcttattaagaaggcctgaacctgtattaaattccttgtctctaaacccatccacttttccagcttgatagccacccccttttagtattgccgaaatcttgtttcgacagttggcgcgccaagtaggggtagcgtcaagttcttcgctgattagtgcga

SEQ ID NO: 34361 - DNA, 1501 bp, Oryza sativa
atacaatttaacatcatcttttgtcttgacctcacctctgaaaataaaaacgaagggagaaggaaaaaaaattgctgggtttccacggacaccgcaaagcgagatggtaggggataacatccgacgtggacgctcctgcgcccttggcttgcagattggctctgcttggactcaaccaaacctgtcatttttctcactcactcactaactcacaggccatacagctctatcgcctcagccagccagcaagcaaagcgaaaccggattattattatttctctcccctttctagctccaatttctactcaaacagtaggatcacctctgcagcttgcttaactaattatctctgatgcaaagctttcaacaaaaaagaaaaaagaaaaataatttctggtgcagctaacaccttatcagatacagggaaattaagcagacatctgataaaattgggacgataaacaggacatatacatgggattgacgaagccagattactgtgtatgagtagtcgttacacactgtcaaaatccgtgcgctttgttagcatgctatgccagtgatggctgcagctagagctagagcagagctaagtagcagctaagcaccactccatgaggcgagctacgagggcctcacgaacagaaggcaccggcaaggccccttatctgccacgtcggacgggtgtgggccccacgaaaggacaccatggctccctatatagccttcttcagcaccctatccatcctccctgcctcctccttcgcacgtattacgtgcgaaaaaaaaaatcatcagcacaagatcgaggaggctttatctgaacaaggtacacacatccatctccattagcgtcttctattagatcttcaatgatcgtaggtgtatgagtaaattcagtttagccatatggttggattttgtatgtgcaagaagaaattgaaacttagactaagttcagagaaattttgctttgttattgtctagagctagcaacttgaattttcaaaacagagagccagtagccgcatgaattgatttcttctggataagcacgagttaatctgccaagtaggatcagagcacgcactaatagtcgtttctttaattaaaaaaaaggaagaaaggactaatggtttccttggataagtgaaactgtccaaattgataacgtcttctgcgttattagtgacaactagtactagcaagtactcctgcctttgtttttctttcgagatagtagtgtactgttatgtctaactaaagccatgtattaattatatgtttgctatgttatatagtcggataattagagcaaaacaattaacaaaccgtatatagtacaactaagatagtaagatgagattatcactagtcatttttcaaagaacactttcagaaggttatattaggcaggagtttttattgctgtgggacgaataattattttttgtttgggcctgatgggcctttgtgtgtgtgtgtgtgggcagggagatgg

SEQ ID NO: 34362 - DNA, 374 bp, Oryza sativa
ctagttagcactggttttataagttgaggaacgcgttgtatctggttttgcggttcaaggacgattttgtaattcgacgacaagttgagggacctttggtgtacttgttcgtaaaagaaaagaaacaccggcccagtattgataatgaagcccagacggaccaacaggccaagcccatcttatcccaagaaaaaaaaggggaaaaattactcctttctaagcgaaggcctaggctaaagaacagagaagagacctgctcttgcgatccttctcactctcttcctccccgagtcgacggccggccaccgacttgggggaaaccaagccaccgccgccgcagccgccgtaccccaccctccctcccggcggccgcg

SEQ ID NO: 34363 - DNA, 809 bp, Oryza sativa
gggggggagagagaaatgggaaagaacacatcacatgcagcaggagcagctaggctttcagctcacctgtgtgggaaaattgtctctgtttcctcgcaccgatcgatcaacacctgctcgatcgctctcctcgatcagcttttgcttgccttgccaaaaaaaattgtctctgctacctcttgttgcactctaactagctgctgttgccgatcaagaagctggctatctgaatgcgtttgtttatgtaagtagggagcagctgcgaactaactctatatatctagtacaccttctgcatggacatggttgctccagaggaggaaaaggatgagcagattatgataggaggaagaagaagaaagttgctgcctgccttgcaccactgcaattatatggagagcacttcactgtactcctaaggcagagagatggcgcaattccggagtgctatataggtggaggtaaatggaagaacggaaggagggggatggagaaaaaaggatgcgtgcgtgggtcggtggaattcaattctagagctataagaggaggtgtatgtagtactactagtatatgtatatactgggggaggagttaagctgcaggcagagctcaaaaaaaatttcaaaaataataaaaatggaggattaaatatgggtgtgagaacgtgagggaaggtaagaaaccagcacagctttcaggctttcagctgggacttgagaggagacgaaaccaaaaaaaaaaaaaaaaagtggtatctgcttgctgggctatggctcctgggttttgaacgttggaggctagctaagcta

SEQ ID NO: 34364 - DNA, 293 bp, Oryza sativa
cctgcagcccaccgctcaacacacggcggtcagaccggcccactcggaggaaaccggtagacttacaaattttggcaatctttcctattttaatcctaggtgccaaatttgggtgtaaacaatcattattcttctgtgcatccttataaacaagattaaatctcctgcgatttagcctaggaccaaagaatgcaacagaataccccaaagatcatgaaggaaaagaatcgtctcatctcatcttgtggcctgtaaacacaattcaatcaccatgacccctatcttgggacaga

SEQ ID NO: 34365 - DNA, 1501 bp, Oryza sativa
taccaaacaaaacaagatgaggtatagtaactagtcatactaaaagcaaaacaagattaggtatagtagttcgttacactaaaatacaattaaaattgacaacctcataaatatgcatggaatatcattaagtagccatcaatccatgtgttgcacgagtttgtaactttatatcatcactagagaattatccagtctttttttttctttttttgggatgtttgcacggagtacaagcaaaatttgatgatttaacactctattcgttgccactcgagacgatgactgaatatgttagttgttgtacatattggttacatcatgcaagtctttaatttgaaattaaaataaaaagttaaaactaaattgagagcataggatgtatagacttcgtattcataattctaacattaaaattattaaaataataaaatacaattaataagtccatagtttttataaattgcattattattgacacacaaactttaaactactatttacggtaggtcatatcaacctgatgtatgaacatttttctggtgaatgtaagagttaattagggcagatacaaagacaattaataaacagacttttaagttgctgacatataagagaaatgaaaaaaaaagagagaaatatacttgttaaatgtgacaatggtcgtcgactctaggcgtttatagaggaaaactttagtatatatggatagagaaaaaaaaagaaagacatgtggtagaaaaaaaattgtgcattaattagtatagtcatttgtcctctcaaatgttgtaagagaatagcattttaatggaagtctatatcaggccatacctcagaaggtatccgttttagtacaagtatgatccaccaaattaatgattatatctttttaattaatgtgagagtattctccaaatgttcaattacacagatatatagactttctattctccagtcaataccaactcgccccgaatcgattcattttcaaaatatatagacaatgtagcaaacaacgtttataccgtattactcccttcttttcattcatattatttattatttagttgtttgactttttttcatagttaaaccttttaaagtataattaaatttatataaaaatatagtagtattttcaacacaaaacaaacaaattatcaaaatatattcaatgttagattcaataaaactattttaatatgttagtaatatttttctataaacttgatcaatcaaaacaaagtttgaatgaaaaaaagttaaacggcttaaaatatgaaacggaaggactagcacttaggaagtacttatctttttttagaaggctggaccagatttcagctatctgggccaattttactcaaccaggcccaaggcccatctcaatatccagtcgacgagtcagcagcagagacgcagagtgtcagcgcgtgcgtggactcatcgagaggagcaaagcaaagcgagcagctgagccccgacgaggtagggggagaga

SEQ ID NO: 34366 - DNA, 1501 bp, Oryza sativa
cttatatgtgctggttttaaattttagccttatgtgagatgtcggatagacgggaaaagcttcatatgtgtcggttttaaatgaaccgatacatataagggtgtccctattaggggttttgtagttgtgcgatctttctttcttttttttaataaggaacaagggcatcttttctttcagaatttcccgtaattatttggttaatgtatatattttcatttagaaaagaaatccaaccatatgggccgaatcaaatggcggaatgcacaagcaagcaaccatgtacatacgcacattacagctgacagcgtacagcatgctcaatcgcgaacccctggtggttttctttcggcctaacataaaacgcagcggcagcccatcgttctcgttgcctcgtcggccgaaagttccatgcttgtcgccgggggcaacccggcaaagccaccgcatttcgctcccacgcggtcacactgccaaatgcaccgtgccgaccttgacacctctgccccgcttttttttgattcccaaccgccgtccaccacctccaaactccaaagccctttgctctagctatttctttttgtaataatgaaatataatctaggtcgttactcaaatagttacgatcaattattacaccaattcaatcgaacacaaacatatcttaacaagttataaaaaatacactcattattcttgcataatgacactcaaaaataaataaattatccatattttcttattattttaaactctcgagttaagctgttatgtgtttataactcgacatgatatcagagttcaatgtctcgagttcaaatcctgattgttttttaataaaagttacaacctatttatattcactaaaacctcgacatgatatcaggcttaaggattctcgcgtgagaaagaatgttggaatataagtgaattgcatgtcttttcacatccgcttaaatttctattcatggtagaggttttagtgacccacgcgtgaacaaaggcagtgtttgtcaaatgggaaagggaaataatttcccacccatttttaaatcctaaccattcattctcccttttccatttaacccaaacccttcattcattttcctatcttaatcccacccctcatttcccattatctaaacacacccaaaagtgttagaaaccatgacacccccaactgacactaactccgtgtctccgcacatccttcattcgcccacaaatctcacgccaaaaaaaaaaaagaaaaagaaaaacacggcgaatcccgtgaaatcttcgcttcaattcgctcccaagcacacacgccccggcggcggcgcccgtagcatctctgatctctctcagcctttcaaaaaccatacgcgcgcacaaacgcgccatctctccatctcgccggcgtcgctataaaacgcggcgatcacgcttgcatctcactcacacaacaaaccacccccaagatcaagaacaacaacaacaacaacaacatttgtcaaga

SEQ ID NO: 34367 - DNA, 1501 bp, Oryza sativa
aagaaaatgggggaaaaggcatatggggctccaaagtttctgtctgttcttgcttgtaatgtggtgctcctggttaaaatgcttgtttatttataatccacaaagttgggggccacaaatcgtgccgaacatacttggtacagtgttgactgatttttgttgaaaacctaaattttgttgggaccaaatttaaaatattattctgaaaatgtagcaatttatgctggcaactgtttggtggtagttaaagcgagaagcctaaaacttcattgacttttcctgacaagggtttttctttaattaattggctggtgaacgagaaacatcaaactattcaatcatgttacctacatagttgtgctattgaaaatctggcttatttttgcaacagatatttatattccgcagaaacaattggagatgacttgatgaaggagatttcagaggttttatattgcaagaagagccaaggtgctaagctgttcaggcgccattgccgccgaggacatcccagtattagcaatttgcatcagagttatcttttgtaaaaccaaccctggctaatgtaaactaatgtaatgcaatggagctttcaactctggtagaaatttcattgtttgcttgtaaagtttatcaaaaaattgcatggtggacagactcaactctcaagcacctctagattgatcaaggttggagaaaacttattttctggagcatgtcgatgatcaaagttgaaagagcttacaacatgagatgaactctcaaatatcccatttgcttgttggggagatggtcacgatgaattataggaagatcaatatatacgattttatttgggaaagatacaaaccattcctttgtgacatgatcacatcgatactacaatcacgttttatagataaaattaagaaaatctaatactgaaaaccacacacgtaacaatcaataggagtaactttccaatgattagtttaaaaatacatcatggatcaagctagattaccactacgacgccacacaaacaccacccttttttgtccatcggacacttgtaaacagtaaacctcaccaaacttggtacatttgtttttctgcatcctttggcagctgaccaacaaaactaagcatccccacgacgtcacctttttatttactgtagaattatctgactagactggaatatgagatttctcatttctttacaagacaacccagaataatgctaagtagcccaatcaccagtacgaatgccagcgagaagcctccttgatgttgactggcttgacgccttgcaagctcctgcatatttatgcccaccaacatggggttgacaaagatgatcactaacatattattttcagtgagttcaacaaaataagaaggcatttcttccacagtggaccttaactaaagttttaacatgctaatgtaatatatttgctcctattattcagacaagatcgatggaaaaaatagaaaaataatcagctccatcgtaagc

SEQ ID NO: 34368 - DNA, 785 bp, Oryza sativa
cttgcttttgaaatacgaattgacagggtaaattggtgcttgttgggcgtttggcactggctaaaccttcgatttagtcatttagaccttgtggcatcattgtcacggccctgtgaattgcattcttatcttccatgatagggatgagatcagctcctgaaatggcttgtccctgcttagtggtaacgcagagacaaaaaggagttcctaacgtagaatggttttttttactgttattgtctatctgcaattaaccattcaccctagatgctttgataactaaaaagtgcgaaactgccattgctcgtaggtttatcaaggggaagtttctggaggcttttgtcttctatttttgtttcctgtcaagtgtcaatatgtctctgccctttttgactgaaatgtgttcttgccaaaatactcctggctggcataggttaagctgttacccggtcctcattctccttccacattggtagcttgacagccccatcttttcgcttatgcttatgcttacgacttttttttacttaaaatctatacagcttattagtaacccaaaaaataatttatggataaaacttttatatacgtgtctttagttgttattttgtaaataaactatgatagaaaacccacaaaattgagttttaaaattcaaaatgttattagcataaacataagcaaaacggttgggctgtgaaatatcaacccatgcctgtccaatttgttcgaggctgactgatagtttcaattgcacttttttttctgcatcaatcttttgcagg

SEQ ID NO: 34369 - DNA, 1501 bp, Oryza sativa
ctccttcaacgaggccgccgcctggtggtccacgagcagtccaatgacgtcggtcagaggagagcctgcaccgcatgaagtcattatgcgatccaggagcaaaaataaaagggtcgtcgaatacactcacgttgattgcaacttcacgctcagccttctccttctcgcaaagggggacggggacattgctcgccgttgtcaggccactgatcatcaattggccgacgcgacgctccacggtttcgctgttcatacctgtagaccgagaaccagaattcggtaagtcaggagaaacatgcacataaggaagtcaaattaaatacaagaaaaataccccgaggagaaacccgggtcgcgtcctccggcccagaatagtcaaaggctgggtgggctcgagcctggagtggctggatccgcctaccaatgaagtcggcagcgacttcataccccgacaaaccccgtactcggaggtcatcgatggcatcaatgaaggactgaagagaaggggtcaagacgggtttggcggtccaagacggaatcttgtctggttgttcctcaggaacaacaaagattggatctgaatcctctatctgaagatagaaccacctcgcctgccacttgctacgagaagaagggcactggaaggggatatagcgcaacttcaggccatcccaaagtcggaaaccaacgcatccagataccctggtggattctatccgacgcaactcgtagtagaagcgaaagaggtcgagaaacggctctaccccaatgtaggcctcacaaagatgcgaaaagatactgaggaaggcgatggaattggggttcaaatggagcaaagaaagaccgtagaaattcaaaacgagcaggagaaactcagaaggccgggggagaataccacagagaatatagtcctcaaccgcaaccatacggcctagaacaggttcaggttcagtacctcctggttccctctccatggtcccgcgaccgaggagagcgccctcctcttgcaacttcttcagggacgcactagtggaagtggacttgtcgaggtccattgccgccggagatcgccggagaagagaccgagataagcagactagggtttgtgcggagccggagaaaacgaagaacgcttggaggctgaagagtttttttacaacaggcagacttcaaaatggatccccaaaatccccttaaatagacgcatttccgatggtgcgaattccaaggaaaggagagagatggtcgccggaaatttcttggtccgttacgcgcggcagtttttcggacttcaatttaaattcactcatgaccgttgagcttcacatggtgttgtcgattactccctatatctacggtcctcacaccgagaacgacaacaacctcgacatcagaagtcgtgatcggttacacgagttcatttaagcagaagtaaggggctactgtcagggttacgggtaaggtataccctctacccttcgatatacgtcacatatcggta

SEQ ID NO: 34370 - DNA, 1501 bp, Oryza sativa
cgtttcatcagtaaaatctatcacggagctaagcgtggcgcgcaaccctaagccagccagcacttcgagccgatcgaattgaaagttgcgacgcggagatggggccatggggggaggaagcggagcagcgccctgtacctgggggtcctggtacttgtcggggtggtagatttgcgcgtactggcggtaagcccgccgaatttcctccccgaaggcgtccggcgagaggtggagcagcgcgtagagctccctcccgtcctccggcttcggcgtcgactccatccccccgtgcgacggcggcggcggcggcggcggcggcttcctccccctctctgctttgctccgcgcggcgatgcgggttttttcggaagcgagggtttatgtggattttttttgaacatattttttgttcactgctcatcctgatttggtcttaatgatgttcttcttctacttccgccgcaaggctcacgttccgtgtactaagagcaaaggcgtacacgtagagcgacgtagtcatgtgtagaatttgccttctgggcgcacttgtgtaatcattcagaccgcactgggccaattttttttatctgtcaattgggccgaaggaaagtaaagagctgcgaaatgttcgattgtgttagcgagctgatcgtgaaacgattagtgcatgattaattattaagttgtcccgtgttttactgcgggatatatgttagataatagaaaaatgatttggattaaaatattattaaaataatgatttagcatgtgtatgtttagttttagaatgaaataaattgtagatataattaatgtatgcttgtatggaaaggtttgtgtgcttataatgaattgatgtagcatgcttgtatgtaaattttaggattactaataaatattatgcttgtatattaaattttaggtgtttaatgagtattaactttataaaaagaaaatattagaagctaacagatagaatttttattaaatcttttaaacaaattatgcatacaaagttttgcatgaaacattgtttagcagttcgcgaaaatagatattagaagctaacagatagaatttttattaatcttttaaataaattatgcatacaaagttttgtatgaaacattgtttagcagttcgcgaaaattaacgccagacaaacaatcaaacgggcccaagtctcttgttagtcttgtactcttgttctgtacatggttgggcctatcaataccgggctaccgggcttccaaacaagaacgatttaggcctcggcttggcccaaacttctgagaggaaaggaccacgacgagacgacgaggcccgggtgcaaaactatcgggcttccacgggtaactagtacagtaggactagaattttttttattaaaagttttacaaaaataattttccattttaaaaattgacggaagtagtcgcctaccgctctctgggaaaaatcgccctcccagagggcggcgaaaatgacgtggcagccggct

SEQ ID NO: 34371 - DNA, 1501 bp, Oryza sativa
gtatagtttctctatacgttttctctactaacaattaatagcatatgaatgaagaccattccttcctgtactgccttggaaaatcctttaagaaaaagcaaagcaagtctctcttctttatgtgtagtatttgattaactagcaccatgcccaagacactatatatatactcccttgcagggaaagttgtagattgtcctgatcagggccctgtttggaagattagctcaaggctaattttgagagctaatgtttagtcataaattggtaggctaaacattagcctagggtggtatgtttggatccatggactaattcaaggctaaaaggtggagagagagtagaaagagaggagagagaaggagagaaagagctgtttttttatggtccccacacaaaattagccccattagcaccccttggaggggctaatgttttgaagggggctaattcacattagctcaaaattagcccacctatttggatccttgagggctaatttgaggctaaaagatgagggctaaacattagcccatggaatcaaacagggcccagctatggtatgcaagaaatctcaaccaaatgttctccaaatgttcatggtcattcattgtaggcattatgcagagagtaggcttggaagacacccggaatggaagttacaccacctgtttggctgtgctgactggatggttatatatggcctaagcgtcttgtctaggattaacagggagtgtcccgaccattcctgtggctgcggaagacagtattctacggtggtattagtgaaatgaagtgagggagaaaggaagacgataggtttcagcagtaattgattatagatctatacttggggaagctgaagaaccgatcgattgggctctatacggaagctgaagaactcattctgagatgatgtattttagagtattatttatggcaaaatagtgatgatacaatttgtattaaaaaatatacccctaattgtagttaattcgggtttactaatagcagtctcattccaatagttgtttattaaaagtgcacaaacggttgtttctttatagtatgatcgattaatgcgatgtacacaacagtattgctaattcgtgtgcgcgccccagcaacatcatctgcgcttcctcccccacgccttttttcccgttgtttcccttttttttcccgcttttttccgattatttatttaatcttttagcacacgtgttttttcaaatattttgagttgaaagtttttaaattttaacttgaaaatttctaaatcttaacttaaaaattttcaaatttggacttgaaagttttcaaatccgagtagaaagttttcaaatcttgagttaaaagatttcaaatctgagttgaaagttttcaaatctcgagttgaaagttttcaaatatgggttgaaaattttcaaatttgagatgaaaaattgaaagttttcaaaatttgacttaaaaaattcaaatttcgatttaaacgttttca

SEQ ID NO: 34372 - DNA, 1253 bp, Oryza sativa
ctgcaaaatgtgtatttttgaataaatgatgcttcaagatttttttttcttttgggaaacagtttcactagggaaacattggtccttacacaagctaagactagcaagcaattgtactttgttaagtaccaagggaatttactgagaccttcacaataacctcaggcctcaggtcccataggctgtggcctgtggcagaccttagccttcaatatccttgatgctactgaacgcctagcttattgatggctcccaagcctaaataaattatttgctacctggaaagcaaagataataatttaaatgacaatgttttatgtgactaactaattaaactagacttgcttcatgtcaagattataaattacttccatctgaatatagcatgcagtgtctgaatttggccaaaagtttcttcaaccaagggatgtgaccgggaataatcatccttccatatatagtccacattaacttcttctgtgatctcctccatgactccatcctaatacctcaggtcatctgtttgatccgtctggtctagtatgtgtgactctatgtgatcagctcctcagtggtcagatcatgtagactagcaaatggcaatgggccggtatcttgttatatatctcctctcagtggttaggtgtagtggcttaattttctttataatccttggttgacaccataacaggtattagggattagttttgatctcctaacttttgtggaataattttttatgttcaatacaatttttgaaataaagcagggctttgtattttttttaataatgaaatatcatttcggtcaattattaaaaaattgcccaaaatcgttctcacaacggttagttcacaaatacactgtaaaataagattaagtaagtacaaactaatgaacaccaacaaaagataaatcagaagtaactttattatggtatatttgaatattctagcatccacacacatcctagaagattcaactgcaatgcagtgggggtaaggtgacacaacgaactgatttatcaatgactgtcattacatggtgtcttggtatctatctatctatctattatatactaaaaatctattaaacttcctacaaacattcttaaccccacggtctcctcttacaaacgttcctaagttgccaagtggcagtctaaatctaaccgttgattttcctattatatacttgtcagggttacgggtatggtataccctctacctttcgatatacgtcacatatcggta

SEQ ID NO: 34373 - DNA, 1501 bp, Oryza sativa
tttacacctctggatctaaacaccctcataaattaaccttttcacacgaatctacacatgctatgtttaattttatgtataaaaattagcttattttagaacaggcagagtatgtgctgtatatacctcatagatccatgtgtacatgataggcgtatatacttccattttgttgtacgaagttcctctcggaagtcggaacaagcttgacatcttgtgccctcttttctggcccttcagcctatggtccccgggattgattccgtcgccttgccaattgccaagcagtgaagcaaagcacaattccttgcccctttttttgtttccttttgcgtttgtgcaattctgcaagtccatacattgaaatataagtttttgttcatgaatttgaattgatatattaccacgtctgcattctgatctcgtttggttgtctgtgtccccgtgtgttgcaattggctaaattattttgttgatatgccaaaacatgtcctaccaaaatacttttagtagttgaatagtgcacatgtggttttggtttgcaaccaaatcattggcattgccaatttccaatttgatagtttctagattgtactaaatgtttggttccaaattagttttgctgaccaacgaacctaggccgtgttctttgcaatactattccaacttcaataactcatttgtcacacgcacatttctcaaactatcaaacgtaatttgtttctatgaagttttataaaaatattgttttaaaaatcatattaatatgtatatatatatatatatataagttttttaattgatacttaattaatcgtgtcaataggttgttttgttttgcgtgttacgaggaaaggcttccaaccttaaccaaataacataaccctaaagataaagaccacaagtcttcattcgcttccagaaccttcttgcatctaatctgcgatgtgcagttgaaccttccaaaattcatcctgtaattaagttgaaccttcttgcatctaatttgcgattttttctattttgcaaagatgctattcgaatgacagttttagtgatatttttgtaatttttcagtggcagttttacaataacgatttaaagcagtggtaaatttataattgccccttacaagaattatagtattcactattcccatacagtactagaccatagagatgatggttttcttaatttaaaccgactccaagcctctccactcctccagaaccttccaaaatataaaaaccataaccaaccgactgacatgtgggcccgacgactcgtcaagtcgtccatctcccaactcccccgctggttcgagcccctggtagaacgttcgagaacccccatctcccccttatatatcgcccccttcttccccatctttctccaatcgaatcgcacacgccacgcgagctccctctcctaaagccctaaccctagcctccaagtcgtcgtcctccggaagcttccggcctccgccgccgccgcagcgcca

SEQ ID NO: 34374 - DNA, 1501 bp, Oryza sativa
atgcaaaacacttctccaccggagctaggtttttgggcccatgtggtaaccccttgagatataaaaggaggtccaggcctagaaaaagggaggagggatcgaggacgatccattggacactctagagcagtctctagccacggatgatcaacaccacattttactccaacaaagagatcttataatccttcactcaaggagcatagcacaggagtagggtattacgcttcttagcggcccgaacctatataaatccttttggtctcatcatctttgaggggctcgaccccctcaacacaaacactgcttcgctcaccgaatcctcaaatctcacccgctgcctccggctgaacttacaaaggagggtctcatgaccttccgctagagaggatcactcctcgacaaaaccaactagcaatttctcctctagatgggttcaatccagcaccagatacacaatgcaacatgaaatccgagccaagttggttgaaatatagggattgcgaagaacaagaaaacaacaggtcaactggtacctgggtagaggattatatacgccggcggtagctcagccacatcgtagccggcctcctccacaacttgaagccacaccaacgaattggattcgcgcagatcggcacagccgggcgatcgatcggcggactagaggcgatctatcgtatcgtaggacgtccgacgctatcgatgagatcaataggcccaataggcccattgccgtgaggcacccgcacctctttgctcagtttgtgcgagttttctttgttctgttttggccatgaactcttcaagtttgtctaattctgatcctctacttctaaaccgtttaatgatgagcaatgaacgatgggagaaagaaacagagcgactctgtttctagtcttcaggtcagaaggagagtaaggcagatttgcagagagttgaacatgatattgcgaattgtgacgggctgatgatgtacttagtacattttcatggacatggcaggcccaagttttattaccactagcagccgaacaatatctaaagaggatttgattcgttattgtattcatgactcctcttaaatctactgtagtttcttctcaagcagttgagccccgtgaaaaatcactcatactaaggtggagtactagaacacaagatgaagatttgaatgttcatcatccgcacacggtacatctatggtgtggctgtgggtagtaagacgataaataatctccattctgaaccctcgtttgtcagaattagtttgcattatgttctttcttttgtctttatattattgtactgatccggcacaacagtagatttcccattcataatctgcacgacagtacagcaatgttcaagtgcccactggtccagcacattattaggtgcccaactgcccagcagaagccgcaaattgagttgtcagtaatcagcagtagcgcatagttataccagaggtagccagatcacaagaagaaagaaaaagttc

SEQ ID NO: 34375 - DNA, 1501 bp, Oryza sativa
tggtattgtgctggacacactgttgactttcgtctctatgattatctctgataccgatcggagcattgcacctcttccttcgatcaatgggcattgtgaaggtagcaagttgtgcgcctacagaagagcgggcttacagctgtggagacgaggacattacacaagaggagaaaatgctgcttcagagatttcctattcatgaatccgatgactatgaacatgaagaggtcaattgtgagcttgcaaagtctggagatcagatctgtagtgtcccttatgggctttatgatttgcctgaattgaatgatattctttctttggagacatggaacttatgtctaacagaagatgatagattccgtctagcagcctatctcccagacatggaccaacatgatttctttgtaacaatgaaggagctgtttagtggcagtgacctgttctttgggagtccagtgaagagcttcttccacagattgaatggtgggttttattctccagaagtttcccaggctagagaattactgatgatctttgaaagacgaagatattatcattttctgaagtcccatcatgatggcatgattttcaagtttgcatccatggacaaggtaggaggacgatgtggggcgagtactggtcttcagggtaaggttaacagttggaatgacagaagacatgaagatcccctcacaggtgttgacataagcggttctcctttcaatagaagtctatcaattgccaatgaggttaaagatgcaacccttccacctttgaagcgaaccaaacgtatggatgggacagtaaccactcattgttcagccaagcgcaagggaatagtctacagagacaaatcaatggaaatgagctcattgaagagtcctgtctttcatgttcctggtgagcttactacatgtattagattgcccaaaggtgtgctgaaaataaagaccgattgtgcttccctcattgatcacaatgaaggaattcatcgtacaccagaaccgatgctagcagaccaactgggaatacaggtctccagcttaccttgcgcttctgcactggatgttcatggttttgcgatgaattcagcttattactaccacataaacacaagcaagagtactttgagaaatctacatgtgcgtccctaccaaagagaaggcacacttgatacttaccctcactcagttgaaagtccgtttggagtgcaaattatggttccagaggagcttaaaaggggttactattctcgaatgccgaattccttccatcagtcaacaaccaaacatagtccggaatattgcaatgaagcaccccacgagaagaaccttttgaagaactttggtcaacaaaatgccgtaattcctgaaagttctcctgatccatttacaaggaatactgattgtcatcaaacaaatggatacatgacgcatggtctgaaaactgctgaaagtatttctgaggtgttgacccttggtacagacaccgctggccctta

SEQ ID NO: 34376 - DNA, 1501 bp, Oryza sativa
  unsure (1)..(1501): unsure at all n locations
gattggccttgccccagtctgtttatagaaggggtggtattgtgtttacaaggtcttctccacgttcagttggtcttaaaatccaataggacactagaaatcctggtttcaaccaagaaaatatggtaaatatctaaactgaactcgaactctagagtttgttagtcggtctactctatagctaagattggctcgtcattatgctgaaggtcggtttggccaaccttatttacaaagtcggtttagccttgtatagaaggtttgggcttgttactaaatttaaccaaaccttatcataatatcagtttagggttcgcgggaggctcccactccctggcggtgcccctcccaccgtcggcggaggcgagcgccgcgaagtcggcaacaccgccggagccgccgcgggcagagaagaggttgatgtggccaccgtctgagtcgttggcggcgggggacaggtctgccggatccgcggggtactccttgtcgtcggtgggcggccaaggagggagggacgccgtccgcgaggataacgtttccgtgaactaagatcaaaggcgtaaagataaaaatacgtaatcatgtgaagaatacgtattattagcgggcatgcccaatgcaggctgggccaatatcatttttctgcaagatttggcccgcatgagcatgaaccaagtttggcccgcattatacgtgcaggcctaattaaatcgatctgtgaccttttatttggaagagtaagttcacaataggttcctcaacttaacagcgagattttttaaggtcccttaaccataaaatcagaaatatctacccctaaactctcataaaccgtgcactcaaagtcctatcgtagtatatatgggtgatttcactgacgttgcatcctagtcagaaaaaaaatttgaaaaaaatacgtggaacctacatatcagctgcacatttttgttttcttttcttttcttctctttctcttctcttctctccggcggagagcggagcgacgatggcgagcacggatgcggnaggctggcggcaagcgagcgcggcagcggtcgacgagtggcgggcagagcggcggagggtgagcacggcagcagccggccgcctttcccctcccccatctggccatctcccgtcgaccaactctccctctcccgtcctctccacgcgtcgcgctggtgggagagggggaaccggtggtgtagaagaagggggagcgccattttcgggcgactagctggcttggcgctgccgagggctggctcgaggaggccatcgccaatgagcttctcagctcgctgccgccagcctagactgtcccgcgggagaggagggagacgatgccgcccgaccgctgttgaaccaatatgagccactcttgtgcatgctttatgccgctgcgcccaacggttggaccaccgctgtcgtcgccaccatgggccaactccgaagactcgtccccacactctgccgtggcgatcgatggcgcaccaccagt

SEQ ID NO: 34377 - DNA, 377 bp, Oryza sativa
ttcgttgctggcaacgcgaaaaaattgggaggcgcgtggcgcgcccccgcggcggcggcggcggcgcgcgctcggctcgcctctcatcgcgcgcggcgcgcactggcggcgccgaggaaaccctagcgccgcatccgcctcctatatattggacctgcacctcgcgccgcgccgcgccggaggcagagacaaccactcttctcctgacacctctcgccgccgcgtctctctctcgctctctctccgacacagaagaggagcagcgcaatgccgcgttccgccgtcgccgccggacaactgctctcgctcgggtgggtaactgggtatatgatcttggatgggttcttggatcgttcgttcttgcttggtttcttgga

SEQ ID NO: 34378 - DNA, 1501 bp, Oryza sativa
atgtagacacataggagttgttaatttgcatgttcaaagcattgtttactgggatccacttggttttggtatttattttacgatttgttaacgattaaattagcaattttcaataatgtggttgggtagggcagtttgaccgggaccattttgacatctctgctttggtgggaatcccgaggcaaagacgaatcctagtctagtctgtcagtgtagaagaaagaagatggctgggctcaccggcgatcgccggtgccggacaccggctgcagccggtggagtcgccgtgtcggtggccgacggccgcatcggtgcccggaacataggtatcaccaacacctgatgagctgtttgctgctgctgctactgaagaaataatttgatttattcggtgtagttttgtgactttgtgtagcagtagtatatactcctccctgtctgccataccccatatcaccgacaactccatcgtcaccctttcccatatggcctccataattttcaacaaaaaaatgcagaattataaaaacctagtaaattaatttatatcatgttgaaaatactacactctgatagaaattaattgaatcatgttcataaatttacgttgccgtgaagaaatttatatgcaatcaagttaatcttatgatatgaataacccattggaaattgttgctttggacgagtaaaaagggaaaataccaatgcaaggaaggtatttggactagctaaaaagaggaagatgttcactccctaactaacaatgcaaactgtagagagaaatcccaacaataatatgggagagctacatattagtatatactatattgtttacatatattcttctatgaaaagtttgttgcaaatgctccttagtgggctcccctaactgaattttatgtgctatttggtccaataccagtgattgtttctgttttttttttcttcttttataaattggtcttttttcgatcatatgtgcagtgatacatactttgaagttttcctttcttttttaggagaacaaaagtagtacggtatgaccgatgttgtcttatttttctttccattttccaaagtgataaaatggacataaagactagagattccccacttgcaaaaaaaattaaaaagaataattcagattctccacatctttgcacgctcataaactataaaaattagttagtcatcacttggtctagaatacggagcttagtctttggcgcacatgcaaccaacgtgatcccatgtttaatttcctttattttttcccatcttttcatttcccttttactttacgttttttaaactaaaccatttgtttgatggttgagcatgcaattccagcatccaattgacaaatcccatcacctaattatgcagctgctaaaacagtagaattactattatatatttgccataataatgatgcaacgacgtatcttagaagcaagattaccagcacggcaaaacactatagtactaccttcaaaaaaaa

SEQ ID NO: 34379 - DNA, 1068 bp, Oryza sativa
cccttttcgccggctggggagctttgcccctgcgcacacttgtcacgctcacgcactgaacaagcgaagcagccacacccacccacgcacgcacaaacagacgcagacagacacacacggtcatcacacacgcgcgcagctacaaaaacgcaccaaccgcaaccggcgagcgcgcgacgcgagtcgagagacgggagagcagtgcagtgcagtgcagtgccgcctcgtcttccttccctccctcctcatactctctctcctcccggtcttctcctcccccgcccaaagcggagcgcggcggttatatatatatatatatatacagcacttcctcctccttcctcgccgcacgtcgccctccgacttcgcctcgtcagccgtcgtcaccgcccccacccggtgagctccatcgccaatctcatcctctctctctctctctctgcttccagttccttcattctgtgtgcctaattgggtggccggatccatgcggaattccgagctcactcggtgtgctgctgttcttgcatgtatcggtgtttggggattgatctgggtgcgggagctgtaggggagtgaattgcgtttttcggcagtttcttttcttctttttgggggagtccttactggtaggattgattagctcgtgttatttcggtgaaaatgttttttttccctttttcaaggatattcagaattagtccgttcttgttcctgatgaacatacggccgttttagttacaatgctgttgatcccaattggaacggggagattagtcaaatctatctggcctcgcttggattagaggtgtagatttcataatcagttttggcctggtctcttttattgctctgaatttttttcaggttcagaccaacaaaaaaaaaaggcattgcattatggttgcagtgttgtgtactgcctctttgacttgttttggattgatgcatttctttatatcagatgcaaattaacggtcgagttagacaatttttttatagtaaggagttcttggagattcttctccttccagggccatgatactaatacagtagtagtatcttcca

SEQ ID NO: 34380 - DNA, 1501 bp, Oryza sativa
ggattatggccattaatcaaacaatcaaagtcatattgtatcattttgcaatcatgtcacgcaattccccttttcgttttcagatagcgagtccaaaatattctgaatgtagttgagcaaaaagaaatatgataaaaacactgaacatttgcgtacactgatctccttcttagtttgaggcgcaaaaacagtatcccccttaacaccagttataatataaaggcggactctttgctgccacattgaaacttcaatataatcttccaattttaaaagcttcgaaacatcacacccagtttcctctagaacctgcattgttatgtaaataaatgtcacttacatagactagtaatgcaataagcaaagggaagtgcaaaacatggaaactagttcacgaaagctaagacgtgatcactgcatgtctttaaaaaaaattatgcacaggaccagctgacaatatttagctaaccaatgctaagctttttttgttcctttttaaacatgagataggcaatgcaattcatttttagagaagaaacaacaaatggtgtatgcaatggattaaaatgcaaacactaaatgaaaacagtaagtgttggagcatggtagaatatctagaactttgatatttgaattgtagaaaaaagcatcttgatgatctagagaaatgtaaaactattgttcagtgacttatacaaatttctatcctttataagtctaatttaattgataaaactgcaaagaacaacatcgattcagcccagaagtttacttctctaacagcacatgtatgatcttcttcatctttactcctctttccacgaggaaaactccagctggcgctagacttccatcccttcacaagcaagcactgcacagaaggagaaaaagtgaatgaaacttggggtgtgagtatgtgatgacaaagtgaaaaagaatgcgcgaattgaggtctacaagggttaaagatccaaagatgtaatttttatttgtgcctagtgcattgcagtatagagcttgaaactatacgcattgaagcgactatacaataaaccatctacaaggtatttgcagcaacagacaaaataccagaattactttagcattgtttccaagctgccacacccacacattgtgcaacataagcagctactcagctaaacttaatctaggtagaaagtaatatggtacaaggtgatcggggtaggggtgtagttaccttctcgtaggtgtcatcgaggatgatggcgccgcagacagggacacggaacttatagtgagtgaaatccttgtaaatgtcatcaaggtgcgcgcggtatggcctgagcgcagcacagctattgaacactgcacacatacaccaccacaacaacaataacggtgtcagcgatcaaaccaacggcggaagcgccaccgatgaatccaaggtggagttcggccggagcttactgagcgtagtgaagtccttgaaggagagcgacttgagggaggggttgtgctc

SEQ ID NO: 34381 - DNA, 1501 bp, Oryza sativa
  unsure (1)..(1501): unsure at all n locations
ggtgaccacgtcacggaggctctcgttgctgtgctcgccgctcgcagcgaagcgcaacaggaagtcgtcactgcgcgccaacccggccaccactctctccctgcgctccccgacgatccgctcggcgaagccgtggatcgtggcgagcacctcctgcaaccgcctcttgggctccatgttgaacagcctcttgaagcaccaccgcgacttgaccggcgacatgaaccggtccatcacggcgttctgcgcgtcgttgaacgcgcgcatgaactccgcgctctggggcgaggccatgctttcctcgcgcgaggcatgccgggtcctcgtcgaaggcgacatggcagatgttgtcgaacgcaaagcactccagcacgtcctgcacgtccagcatccggccgtcgcgctccgcccgctccagcagcggcagcagcctctcgacgacctcgaacctgacggtgtcgaccacaaagttcctcaacgagcgcttgttgaacttgtagctggcggccttctgctgccacagccactgctcgccgtcggagttgaagatgccatggccgaggaagtccacgagcatggacacggcgagctcgcccttggggtagttaccgaagttagtctttagcgtatactcgacattggccgggttggcggtgatgacgccgccggtgaggccgagcgccttgaacgacatggtgtgcgtggggctccgcttcatgacttttggtgtacgagaactggtggtgcgccatcgatcgccacggcagagtgtggggacgagtcttcggagttggcccatggtggcgacgacagcggtggtccaaccgttgggcgcagcggcataaagcatgcacaagagtggctcatattggttcaacagcggtcgggcggcatcgtctccctcctctcccgcgggacagtctaggctggcggcagcgagctgagaagctcattggcgatggcctcctcgagccagccctcggcagcgccaagccagctagtcgcccgaaaatggcgctcccccttcttctacaccaccggttccccctctcccaccagcgcgacgcgtggagaggacgggagagggagagttggtcgacgggagatggccagatgggggaggggaaaggcggccggctgctgccgtgctcaccctccgccgctctgcccgccactcgtcgaccgctgccgcgctcgcttgccgccagcctnccgcatccgtgctcgccatcgtcgctccgctctccgccggagagaagagaagagaaagagaagaaaagaaaagaaaacaaaaatgtgcagctgatatgtaggttccacgtatttttttcaaattttttttctgactaggatgcaacgtcagtgaaatcacccatatatactacgataggactttgagtgcacggtttatgagagtttaggggtagatatttctgattttatggttaagggaccttaaaaaatctcgctgttaagttgaggaacctattgtgaacttact

SEQ ID NO: 34382 - DNA, 1186 bp, Oryza sativa
tgtggcatgccacgtgaacgtggcgtgtccttttttttttcttcctttcttctgcttggagaagaaggagaagaaaaggaggggaaaaaagaaaaggaaattttttaaatgtccgtgtggcatgccacatcagcaccacgtaggattctgaaaggactgtggtgatttgggacctagataacacactatgacaagttctaggatttgtatatgtattttaagagtttagggatttagatgacacatccctataaatttaatgaccgcccatgcacttcactctttaactatttatccctttacttgtctttttttaataaatgactgtcgtacccttctaaacatatgtttggttattcatcttatttaaaaattttatgtaaatgtataaaatatactccctccatcctaaaatataacaacttctagctcataaggtttatcccaaaatataaaacttattcaccaacattttcttctcaacctatcacaacattctcccatttatttttatatactttcttaataccctagttaaaccttaaaaatccttatattctgggactgattgagtaaatcatgcttaaagtaatttgagtgataaaacaactcacaacaaaataaattataattacgtagttttttcaataagacaaatggtcaaacgtgtggcaaaatgttaacggtgtcatctattaaaaaacagagttaatataacaattagtaataatttatcatctggacccatacgtcattgagaaacagagataacaagtagttaagtgtcccgctgggcggccttggtgagttggtggtgattatatactcatccggaccaagaggaagcaaccaagcgatcaggtgataccacccgatctgcttctcttttttccttttctttgcctttttatgcgtcacatatttatcctatctaggagtggatggtggacagtaagctcgtggctcattagctcgctcgcctcgtgacgagctcggctcggctcgtttgatttcctaacgagccaagctagcattttatctcgttagagataacgagccagctcgagatgactcacgagcgagtcttaacgagtcaggactgcaatagacaacagcaagggcccagcccaaaacaacagctgaacaacaaaaccctaggcgcaccgcatttctctctgtctctagc

SEQ ID NO: 34383 - DNA, 1501 bp, Oryza sativa
gttcatcaatgagcagttcccaatttgacagcatgtagccaagctactgctaccagtactgtcctcttcgtaagtctttccaccatttttaatggctgacgacggtggtaaaatatattttaccactagtacttaagatagtagtgattcattggattccaaaagaaaaataaacggtttgaatcaatttatgttaccaatagagaacattatagttgtcggtaagaaattcccatgcatctaccaacctcatcttttctcttatgcatatacttatcagttaaaatttaaattttcaaccttaaatttatagttgattttaggattttttttattgaagtttatctttcagcctttgcttttagatcgctaagaacacatatataaaagttttattcttaaattatctttgtttgtaaatatgttgtcaaacaatggggccgtatatactccctctgtcccattataagtacagccataagtttccgtgcctaatgttcaaccgtccgtcttatttgaaaattatgaaaaaaatttaaaagttaagtcacgcataaaatactatttatattttaccatctaataacaataaaaatactaatcataaaaatatttcaaataagaagaatgatcaaagttaggtgctaaaaccctgtcacgccccgaactagtcccgaccagcactagcccgtgacgctccaaattaacctgttaatcgataccagtcccaggaaacagtgctgatatcacagggagacagaatatcacagcaacagaggtctctttattatagagtagatgtacagtcatgttgggctgcggacagatcccgagctcacaactgcatcacaaaaggaaagcggaagccaggacttggaccaatcaacacaggcgcgacttgggaactaggccgaaaccctaaaactcatcgtagccggcttgctcctggaagaactcctcatcagcaggatccgcttcatcttcttcagcaactgggggggattatttatatagagcaagggtgagtacgggagtactcagcaagccatgggaagtaagtgtttaatgcaggcttcaaggaaaggctggtgtttttttgcaattaattttatttgaactcttttctgaaacaactaagtgagtgcttctcaaacgacacggatgagacagtgcgtctcgtccggtcggagtatgtgcaatgtatcagtctttagaatttaaacaaggttggcacccggccaacagctttttcaacggccacccgggccaacaacttttcaaacggccacccgggccaacaacttttcaaacggccacccgggcctagctgatcccatcagctgcagatttttcaaacaccgaaccccttttcacacagcaatttcacaagcagtagtcaaaccaaactacgctaggaatcacctcacatccgcccatgaccgtgggcacggctattcgaacagtttgttaacctctgcagagggggtacactttacccaca

SEQ ID NO: 34384 - DNA, 1501 bp, Oryza sativa
gccaaatttggtaaatacataagaatgccaaattttggtaaggtttattttggttacaatctgaacagacctgatgatttaatatgcttatatgttgagccctataacatactgttgatagaaaacacgatgcctgggagatctgcttaactccagtgcaggtccaaagctcgccttcgaatgtatgagcgtgccagttgatttgatcatgtaatcaacaagaaatagagacagaattcgtggttaaatctataaatgatagccgatcggctaggtaccgatgacatatcatttatctttgagccgatgtcatatatgaatcgatcggcggttataaataggtggtaaggaactaaatctattcgatcggctgtagatattaatgatatatagttcttatattaatatatacttaaatcaagtgattgggatagatcggtcaccatgccaagacagtataaatcacttagatcgaaatatatattaataacaggattatatatgtttatagcatagccgatcagatagatctagcgtgtatcggctaatactccgatactactctatatcaagatattaaaacaggtataatgtattaaacagaagcttaatatatttagattgcgacgatatcttgacacaaaggacggatttaacatgtcattgaagcatatagatcgaatatggttaaatcaaataagatcggctgaaactccgatactaccctaatcggcaaccagagtacaggctagagattgatattctaagcacgacttaatagatcaaactcaactgatgcagcattaagtatgaaaagaagagcaatatctagacaatcaagccgctggatgttttataaagtggtagatatcttatataatctaagacaacgtcgctatttaacctaatcggctgccttctatcaacagatgttaaccgattgtaggttagatgacgatattgccaaagattatataagatatataataacttgacgaattatacagacaagattagtgtcataaagatggaagcactaatcccgagaacacaagccgtcataacaagttttacctcttgttgaagatcgaaaccgatgcagctcaacccgaaagcaaaaactcgtcgaagtaaaactaaagcaaaaaggtggcgatgcgccgaaattgtattgaacgtgtatgttaaaaattacatagggctcggggtctatttatacccgagaattacaagatatgtctataccgaacacgaccactatctctaacaaactctaagataccataagtcattgcggcagacttttgcccaaacatatctctaaggaagttacataaaacatcctaattaatagatacaattgccttctcatgactctatccatatgcggcaatcatcttgaagcacctcaattcaacccaatgtcatacaccagattatactgtcagaatcggctgcatcagctcacctagtccgactcagacccagccgatcctaatcg

SEQ ID NO: 34385 - DNA, 1501 bp, Oryza sativa
aggtccctctacttgtcaccgagtcacagaatcgtccctcagccacaaaccagatatatgacatccctcaacttataaaaaccgtttactctagatccttcaatggttttgaccctaatttcattctacgtggctgctgagtcagtgtagaacccacatgttagcatgccacatcagcaccctcactcttccccctccactcccttcatcctcctctctctctcttctcttctcttctctggcaagccagtcggcgaggcaggagaggaggaggcggcgggcgatgaagcggcagcggctgcgatgcgacagaaggtgagggcgagcgctgtgtcgccgccgccggcgaagtgggcgccacagcgttgggctcggaggcagaggcagaggtgggggctaggagccgtggcggtagccgcggaggtggaggcgaggcccggcaccatggagctggactcggagccctggcttgctcccgcaccacatctccctttctccgcgtgctcgctatcaacctcctcacctccttcctcttcgcgcgcgctcgccgccagacagaggcatcgtcatcgttgttgggcggcttgtcattgtttcactgctatatccaacaatgtcagttgtccaattttctcttctctctagggcatctggcgacggacgggggtagcagccagtgacgggaaagggaagacacgtgtggcatgaccgcatgaccacagatgccgcgacggcctaggtgacggcgagcacacacttcgtgaggtacgcgtagcgactccatccagtacattgctgcgacaacaatatcaatggaggctcccgttaggagcacgcaacggtaggggaccttggagccctcagccgtgagcgcgtcgacgatgaacggcaccaatacaagcaaaaatagaagcaaagggacaaaaacaattcctatttatttttcaaaaatagaagatagtggcatttggacgaagtccgtagttgagagtggcattctaattaactctaaatgagtgaattgcactttgtgccatattttattaccaaagtttcactttggaccaccctgtacacaatcctttcactttggactaggtaactttacctttgttgtataatggaccaccctaattcttttcgctagtgatgtctagcgtttcttttgacaaatgtatggcatgcatataggtacaaaagtttgctggcacgtcgttaacaacttcatcaaagtcatcgaagaattgaaaatgtggtttggggtggtttattgtacaataaagataaagttacctaatccgatccaaagtgaaaagattagataaaaagtagtctaaagtgaacctttaaccataaaacatggcccaaagtgaaattaactcctaaatgttaatgttataaatacgaagtggtatttttggcaaagtttcgatgaaaatagaatgccaattttgtccaaatttcccaggtaccgcggtaagtgaaacctgctccgtgataa

SEQ ID NO: 34386 - DNA, 1075 bp, Oryza sativa
  unsure (1)..(1075): unsure at all n locations
cgatggtgtacaaagagaattatgtggacagatgggggtggtgttagacgacaagaggggggttgtataatagagattttttcccccaacgggagggggggacgagcgggggaacaccacgggggtgggaaccttcctagggagtaggtgaggggggtgaacgtacgatacggaggagccccagaaacccgttagtgtacacgtgtttggggaagaaggaatctaacccgatccgtggccaagagatatttggggagtgtggaacgtgcaagatagggaaataggttctatgcagctatatgtctgtctagtttggcgaaagataaggaagcagcgcgtaaattgttgtatgtgctaataggggatagggctgaggccggcccggataaataggggccgatattccccgcaggtccgaggtgaggtgtaaaaaaaggtctagctattgactggctgttaagcataggagtgactgtcgagcgaattcaagagaaagaatgctgtggggtccgtcgggtattgcgcatgttgaagtgcggggggacggcctgcaaatgggtggcgagggngcatggggttttggagngggcccccttaccgccctgggggagggcgatttttgcctcccccttataaagcccagtccctcctctgtgaaatttcattatattcactaaaaatccaaaaaaaacgaaagagagagagaggggagggcagcagaaggggagcggcgaagccctgctggttcgctcaattcatcacaggtatgctcccatacatcttttgcatttgtactaatatgttatgtttgagtatatatgttgcgtcttagttttagttccatatattttagcacatctgtagcacacagcacatatgtgtagatccatagcatagaatataatagtatgaattcagacatagacagtagtgttaattgtaagatgtagtttagtttgatctggagaatgtaacgtaattttagaaatttagagaacaatattgtagagaatgtaacttagggcgtagtacagaaatgcgaggttaacgcagttattgttttcatcaggcacaa

SEQ ID NO: 34387 - DNA, 180 bp, Oryza sativa
tgtcagtcactgagtcacactcacagtgccactgatccgccatgagctgggtcaagctgagctgcaggaggagtgcagataagagaatccgccttgctttcctcgccgcgcgcattctcgtcgtttcccaaggaagcttcctttcttttcttcttctccggtcagtcgcaatgtggcggg

SEQ ID NO: 34388 - DNA, 1501 bp, Oryza sativa
ttctatgactatttgctcacttattctttttttttctccccttcatctcttctctctctctggcccttgcttttttgctcctggtttgggacttccggacttgggatactattttgggacatgttttaaggttcagctctataaaggtgtcattctgcttccctggactggatgtatcaaacattcgtttaacacctgcaagggcaatacaaacttaaaccacaggtttttttcctttatgattttttagataaattaaaagcatcatttgtacttcatccgtcccataaaaaaccaatttagtaatgaatgtgacacatcctaatataataaattcggacatatgtctgttcagattcattatactaagatatgtcatattcagttttatattcgtttgtttagaccaaggaagtaagtaactagtatacccaacaaatgacattggaatgaactagtggtaagaatacactacagcaactcgccaattatatcagtaaatgcttgtgcccatcaacggcgacacgaggaaatcagtgacgagaaaaaaaagcaccagcaattaaacaggaaaggcaaaaaaaaacaaaagaaattgacacactcctctttttttcccctttaatcatcgggagaataaaaagaaggaaacaaaacggaacacacccgaaaataagttgagaggcagaggaggcagacagcagcagataggcagacaaagcaagccagagatctagctccgcttgtcggaaagaagtagtagagcctctctcacaaaaaaaaaagaaataaagaaataaaaaatcgagcaagaaaaatcacaagaaactcttctttctctttttttttggcttaattacagtttttttgtgtgttttttcccttacacatactgtgccagtggccagtgtacagcgccaccacccacaggccacaggccacagcttggcaggttgggctttgagccgagctgagctgaggtctccacttacttcttcactgctcgccatcatctccttctttccaagcccttcttctttcttttttccccctcgccataggcgccctgtgctttgctcgctcgctgcttttctctttcttaaaaggctgctccctcactcacaactccctctctctctctctctctctctctctctctctctctcctcacctcttcttgttcttcttctctctctcttgtcactcatcatcatcactcttcagcttgcttggttggttggtggagcttgggagttgaggtcaaatagccatcgatacacactcctctttcttttctctcttcatttctttctttacatcgtctctttcttgatttcccaatctactaagctcctactagctctgtgctctgctgcttcctcccatccatggcggcggttgccagcgacccacctacctacaagtagcttaagctcaagctcagctcagatcggagaggggtggtagaggtagtagcagtagttgagagagagagtgagga

SEQ ID NO: 34389 - DNA, 1501 bp, Oryza sativa
aattcattagaaaatgttgaataatatgttactaaattgttgtaaacaggaggaaaaaggttcacttacgctacaattatatctcctttcttacaaaaggcaggaatcacactgaagatggttgatatcccataggagtacaagattgaatcttgcgttcccaggaactttgcaattttagtctcacagtcaaggtgaacatctgaaaacaacaaaatggctaagttcctcccctgaatttgcattaggcttttggccacaagatacaaagtattgaatataagttgtaacagaacattacgaaccaatcgttccataaaagccacgaggtccgcatgatccaacgccatatttctccaccgaaccaatacaggaatcctgcaatttccttacatcactcaaatgttctaaaagagtactaaagaatattagcaaaagcatgaggttcttacgagtatcttttcattgccaatcaaaccaaggtagtttgctgacgcaaagtttacaacttcttttccatcaacaattgtatgcggtccagcagcactgatcaaacaatagaatatcagtattcaatcctctcggtcttggtacaaagatagtggggaaccatagctataattgtgtgaactctaaatcatagtttggttgtaattctagaactaacaagctctggagatcaacacccatattccatgctcactaggtcatagtatcatagtataagtgtacaacaatgcttatataccgacttccctaatccttactaaatgaaatggctacaaactgaacccatgcaatcttttttttttaaaaaaaaaagaaagaaagaagtacattgcaacatagagcctttggtgaagcacataaaacactttactggtgacatgaaggactaattagaaatgtctactttgttgggaggggatggggcttgagaattgagacgaacctttctaatgtaggagcctcaatccgagctccctccttgatgggtgggcagagaggctctggttgccactcatcacagagctcatcaacctcctgttgagccaaaaaaaaaacacctgattaacacaattgatgaagcattaagaaatggaaaggaacagaaaaaactactaattccaaattattgagcaaagtgtagctcaccctctcagtgagtggcttctttggaggcttgtagctcttcctggagagctggaagagtattgcggcaatgagaagcccttcgacgaccaagtgccctgaaaatcacagaatcagcgcatagcgcataatttaaatgaaacacgatacaactccagaatttcttagctgctggagaaaataaatatcatttaccatcgatatgaatcccaaagacaacagcacgagcaagcggggcattgaacatagcagaaacccgcgcaagtgctgcagcagtcgcgttcgcgactggcaacaccatctccatactcgagagcagtttcccttttctcccaagattaacaaactc

SEQ ID NO: 34390 - DNA, 748 bp, Oryza sativa
ggactctcatttccttttctaattttggattttattttatttttatttctaattttgattaatcggggtatgggggttcttatatggaaacttctttcaatattgcttgtttttaattccgaatttcaactatttttaaattgtattcctacttggactctcccttccttttctaattttggatttattttatttttattttgaattttgattaatctcgtattgggttcttacatggaaatatctttcaatattgcttatttttaattccaaatttcatctatttttaaattgtatttctacttggactctctttttttcctaattttagattttattttatttttatttcgaattttgattaatctcgtattgggttcttatatggaaacttcttttaatattgcttatttttaattccgaatttcagctacttttagattgtatttctacttggactctccttttcttttttttctttttctctgattaatgagggaatttctaacccccacagcgaacgtggtgcctccttttaaagttgttttaatcatataatagatagattcagctatttctaaattgtatttctatatggactctgccttttctttttctccgattaatgtgagaatttctagaccatgagagcgaaggtggaggcttctttttctattcctttaataatataatagatacgtgtactcctatactgctaaattaaaacgatgtgctaatgatatttagt

SEQ ID NO: 34391 - DNA, 365 bp, Oryza sativa
aaaaaagatcaaacttttgacagtataatccaatgcacgagatttcttatatctttcgtttgtttcccggctctttcttgtgtatatactgctccatccgttttatattataactagttaatcattttcttcaagttttattaagtttataaaaaatataacagcatttataacacaaaacacatgcattatcaaaatatatttaatgttacatctaatgaagctaatttgatgttgtagatgttgttaaatttttctgtaaattttaccaaatataaaatagtttgattaaagaaaaaaaattaaaatgacatataatatgaggtagtatcaaatttctcatgtgttggttggtttgtttcagg

SEQ ID NO: 34392 - DNA, 377 bp, Oryza sativa
atccgcgtcatccctagccctagccaactaccttaggacgggaaaaccgccccagcaagccgccgctccgccacagctcccatgtgcgcgcgttccgtcgcccccattcgcgcccaatgaataaaacggagcctcctgccacagctagagttagaacgcacagactttaggctttaggtacgatgatggagccacataaccttaatggaggaggagatcaaaccttatccgcgtcatccacctcattgctcttatccgatcaccattagtactccagctcgcctaggcatgtgctggtgatcttatccccatagtttgcttgcatcctaagcgaagccctcaacaaaatcctcatccctctcagccttcttctcgta

SEQ ID NO: 34393 - DNA, 1501 bp, Oryza sativa
acggtaaaaagatttatacaacatgcctgcatgcatgcgtaaatcctgcttaggcacgcatgcattcgtcgtgggccttgttggctagtccagttgataagaacgaacgagacgggtaccaatcgtggcaggttttcattacgcatgcagatcaggtgtcgatcgcacaaggaatgcatgaagatgcagatatataatccctacatatcctctcctcgttcgtcataaaaaccaaatatggataagctgtttaatcgtaatcacgacaacaccgcaccacaaaacaacaaaatggcggcattaattccatatatattcgtcgacgaggccatcggatcgctcgagctcgatgcgatcaaaacgatcctatctgaaaattaaacgagccaacaacgagacagtgctaccatttgttcactgtttcgcaaaaaataaaaataaaaaatagtgaactttgtgtttgatcacagtttgtaaaaccaagggggattaattgagcttaaacaaagaagagacggtagtccatttcctctcctctttacctttttccctttcaaaaagcaatataatcatgggcagaatggaaagatggccaggtccaacgctgcagatgtgtataacatgcggacactgtagtggcacagtatcctcgtcatcacgctccaaggaggccacgtttcatgggccccaataattcgctgttctttgggccccaccgaccatacagacacttgtcccgtgcttacatcggtttctgcacttgtttatcccaaaaaattagaacaaaaaacatccattggcctgcccaaacaaccaaacccaacccgtccactgctcccgttttataatcccctcaacaaataaatacaaatctccaaactttaaaagaaagacattattaggagtaagacaacataatacacttcatccatcttggggagattttttttagtagataatatccatctggggagatgcgtatctcatttttattttgctcaaatttatttccttgttaaatcatgagtcggtagtaataactaataaagcttattaatccctatgctaatgcgtaattaaatggaaaatagagaaggaaaaaatacgagacgatacacatcaccaggtaggtccgctaggtgcgaaagagtatgtagcctagtgattataatgccctgagtagccttccaaaatcctgagtttaaatttttataagagctaatttcatattgaattgttaagtggctaagttctcaatttaaaatgattacttatatcccggttaagtttagagatcggtttaaaaataccattctctaagaaaagaaaagggttcgctaggagccaaagaaaaaaaaggcgaggcggatattccatttcgtctccttggccgctgcgtttcccggctgcatttataggcgaggcggccgcggcgtcggagaccagcggagacagaagaaggggggagaagagaatcgcggagatagcatgagcagcggcg

SEQ ID NO: 34394 - DNA, 602 bp, Oryza sativa
aaactatccgctccgttttcatccctagtggcgatgatgtgctggttgcactgttaacaaatgatgattttggcatcgttttcgctttgaacgctggcaggcggcggaggaagaccggctacaccagattcaaatgaaactaaaaaaaattgtataaataatataccagtcgacagtgaaacattcgtattgacatcgtcaatttaaagatatgccggtcaaatagtttggatgtgttcctaacggtagggcgtgcttgtgtctttatatgggtgagtgtacgcggttatcaacgtttgcgttcatattatgttttttttaagaaaaggaaaatgaataaactatactatattagtaatagtgttcgaatcagggtgaaccgttccagagccaaaaaatggaatatcaactattgtctcggagttaatgaaaattgtttcaaaacaatagaccctcgacaatattcgaacatcttttaattaaaaaaccagtttattttttaaaaaaattaatcgaaaaatcaaactgtcggtttgtgttccggtttttggcaaaccgagctgttcctgacggtaggcggtgcgtagtacgtatcgatcagc

SEQ ID NO: 34395 - DNA, 1501 bp, Oryza sativa
cgtggcgtgggcgcggcgcggcgcggctcggctcgcgcgcgcaagcgaagccatcgcggaatagcgcgtccacagcgaaaaccactggattggtgagcgggattcgatgccaccacccacccgatcggcgcgcgaagccgtcggtcgctgttgcgggcggcatgggcgggtggcgcccgcgtgaacggcacgagggaaccgggcgctcccaccacaccacacgaatgtttgtccatgcacgcagcgggcgcatggatgcaggggctctgtcagggaccccatgccacacgtgaaacggatcctcctcctctcctctcctctgaactgtcctggctggctgctgctttcacgtcaggcgccagttgcgtttgagccgctcgatcggaaagctggaaggtgagcccgagctacggtcgggggaaaccttatccaccgatgggccctttatcctgtattaattcgatccttctaatccggcagattttgctctgtttaatcataccgaaactccatccagggcgcttggaatttcgttctcgtcttcgtcttacccgtccatgactcgatcaaatcgcgcctaccgcctagcgactcatgcatggttgggtccagggcaattcagcgtggagagctcatcagcctgcatctgcaagcccggacctatgccatttgatgattagtgctaggttggtgcttgccctttggagccgtgtgcatcatgggcaggtgtcccctaagctgactgacctgatactaccccgtttctctaccggcaccatcattgggtacctggaaaaaggacgctgaaaccctggagtccaaacactcaaaaccacaccatttttttggttcttgcttttggtacactactgctgctagtacgatttctacaacatttcctactcttttgtaattattctcagtccagcacacctgttaggtatagtcatttgcaattagggcagtccacagatgcgtctgagattgtgttcaaacccttgattatactataggtttatccgtgaatagtttgttagtcaaaagattcggggtgtgattattggtctcccttaagatggcatgcctagatcagtccaaagtaccaggactgataataatattagtaggccaaatctagcctaattcttctaattgagaacatgctgaaccttgtctggagtgaaattacttgattaacagtcgttcttcaggagtagttgtagtacatgactaggtcatttcttaactaagaagcgatataacatcccaattagtgagttggagtatatttctgagccgatcatcatggccccagatgtccttgtatcttttggcgaggcgcacttttaagctaaagattgggacttgctctaacagaaaaattgacacatcctcttttggaatcttttcccactggaacggcttaaagactactactggtcttgttggtagatgaagactgaacctgatggctgcaatgaaaagaataagaggaaaacaa

SEQ ID NO: 34396 - DNA, 1501 bp, Oryza sativa
caccctcaggcgcctggaagcgcaaacctacagactctttcgaacgtaacgcatagtgtatgagaccatgatcgagccactttattttcaaccctatctctccgacttaaaaaaattttcaatcctaactatatgtgtctaggttcgtagttacgagttgattttttatggaaagtagtactaattagagcagatcgaggaccatgaataacatgcagccctgctctagctttctgaattacgaagtatatgccagacctgagatttatcacacccagccgatcttagggctgcttctacgttagcacaatcggctccaaggatgaaaggccccttaactcactcatttaccaggcggatcccaccacggcaagccacctgcttctgcttcttcagccgatgcacagcctctgatcagcttccaagatgaaagcagtaactttccctcctgattgcgaaccacaatgcccacactcccttccttggtttgttgcacaaaagcaccatctacatttacctttacccatcctgggccacacatgacatgtcggagagaagggagagagagaggggggcaggaagaagaaagagatagaggatgacatgtgggtctcataattttttttagtgataaataggacccacatatatgtttttaactctaatgtcaccaaagtgccacatccgcagaccaagtcaacactgctacgtgaacaccacatcattgaacttgtcctccgaaaccatcgagggagtcaaattacaccggtattaatagttggagggtctagatatccggtcctgcggttcaaggatacgaatcagattccgtcactagttaagggactaacagtgaacttattcctttcctttttctgttagggccgtagtctaccagcctggtccggcccacctccaccctgggccgtgcctgggcttaggccacggcaacatagccgtcctacgttgaacccatgcaaactgacaaatctattctattttactttatttttttatttttcataaaaaaaaagatagccaaagctgaccatgagctccgccgcgccgccgatgcggaatcgcggatgcggtccacccgcagatctccgaccatcagcccaacccacggtttccccgccctccacaccccaacctcgtccgctccgtcgccgacgacgactgcctcctaccccatgtatataacccccgccactcctctcgatgttgaggtaaatcgagtgagtccgcaagtcgttcgcgattcttgatcgagatctgtcagggtgataaaggtaacggtctttcggctgtgtcttaggattagatccaactgtttctgtgcttggaacagttgcagagaaactgtagtttcttggatcagtttgtcgagtttgttttggtggatttagcatctcgttcttttgtttttttgtacaggtttagaacggtgctgagtttgttaatcttgggagaaaagggaaactgctctcgagtatggaga

SEQ ID NO: 34397 - DNA, 1501 bp, Oryza sativa
gacaatcaaggtgttcgaggtgtcagctacatgcagtattctgttacgaccgtgctgccattcgacatgtcccgatcgatcttgcagcaagaacttgaactcgatcgatctttctgctggcaattcctggacagatcagaagtggggatgattcattacgagattatacacggagaatggaaggattcgcgtgatgggattcaccttcttcactgtccacacgtggtcttcggaccaatccagagcagccgccttcgccggattccagagaccgagcgccgcgacgtcgccgacgacgaggaagcgctgcccgaacgcgcaccgcttttgcagcacgaatttgacgtgcactgtcttcgtaggaactggagggtagaatatatcatgagctgtttaagagaatcgcatcgtcttgtgattttgtaatttttgagtggagctcaccgtcatcaggaggtgggagtgtcttggtggagccggtctcctcgtcggcgtcaacctggaccgagtgatcaacgcagtgagacggcttcagcgacgggatcaccgaatcggagcgagccagcgtctcgtgtaccgcggcgccatctcccagggacgacgacaagggttgcgccgtgatgaggggctccccgagcgacgcgacgagcagcggcctccgtcgcgcggtggtggcgggcgccggggaggcagcaacgccacccgcgcgcgtcgtgctgctgtcactgccaccgcgacgcgccggcgcgcgcagcccgccgcctcggcacaccacggccgcggcggtttccatcaaagcggaacgcctgcacgggagctgcacagtggacaccacaccaccgagagttgcttgacgcggcacggatgcattcgcgctccgggcgggcctttttcagcagggtgggacgagggaatcgcgcgcacggcagtgtgtgtggccgtggtgacaaggcggttagcgcccgcggggccctcctgtccccgttctcctagctgccctggtctcgcgtcggatccgcgcgcgccgagtgtttcgcatccgtctgcccctgccgttcgttgcgttgcgacttgcgacgcccgctgccgtggactggatccgccacggcagcgaagccgtgcgggcgaccgggccgtccgggagtgccaactgagactagctctgcacagcactgcacaggtgtggacttgtggtgggttaatagatgatgaagtgctatatatgttaaaaaaaagttatatactcccttcgtttctaaatatttgacgccgttgacttttttaattatgtttgatcgttcgtcttatttaaaaaaaattacgtaattattaatctttttcctatcatttgattcgtgtgtatatatatatatatatatatagttttacatatttcacaaaagtttttgaataagatgaacagtcaaacatatgctaaaaagttaacggtgttaaacatttagaaatggagtgagtatatattttttttaaaaaaatgaag

SEQ ID NO: 34398 - DNA, 356 bp, Oryza sativa
cataaattaaaaaaagtgtgaggatgccccccaccaaagagggggggaaaaacaaacaaaaaaaaaaaaacttataaaaggggggtttttccggcgaagtaaacaggtccagtaggaacaggttttttttcattaaagtttaaccaaaaacatttttcccttttaaaaattacggaaagtagtaaccacacgctttgtgggaagattcgccctcacaaaaggcgatgaaaataatgtgtaatccggctgttcgctatcgggagaagaccgtaaacgaattttgcaggcgagatccatgcacgccttcgggtaggcctattttaaactgtccaggggaccgcctgcaaatgggcggc

SEQ ID NO: 34399 - DNA, 1501 bp, Oryza sativa
agtccgatgtcacgagcaggtggcattgggactttggagctgtgagctgcacaaccctctttctctcccccccccccctctctctctctctctcattttctccggtttccttgttactgaggaggcttctctagttctctctaactctcccttgttctctagctgctggtctgcaatggacgagctaggccagacagaaggttggggtggaagctgaggaagagtttactcatctttccctcattgtgctcctgcagtccctctacgcctgagcgcttcttgtcctgttaattgctgtgcaggtgagccggcaacatcgatgatgcagcagcgacgatagcccaacagtggggactggtcctctttttctttttactaaacttatctagattcttctttgccccaagttttttttcttaccatttatcttatcctatggctacgatactttctccctatattgtcgtcgtttgaatcagacggtcattattttgttgcttgcgtggctcatcctcgtttcatattgagatttaccattcatttgttaagattattctaggacgccacaatatacaaacttgtataaaaagtcatcgaaagttgtcatgtttatcaatttatgcgtgatcgaaatcctggatgatcatgagtgaatacgtggtacaccgagctcaaaccaggtgcccctacagtttcacgtacaagaagcgaattccagctaaaatttcactatgtttcatattttaagttattttattgctagggataatgttgcacattgtattattcagatgtttcaatcaatattttgtggtgtctcactaatttatctataaatgttgcatgtggtattttacgaatgttttagtaaataatttttaatgtttcaatagttataactcgatgtttcatatgtaatataaaaatgtttcaattaggaaaaaaatattcatgcaatttttttattataaatataatcatgtgcgatgttgttataaagatttaattgaaaaaatataatgacataatcaaataaaagataagataaataatttagaagaaaaaataatttaaagttttgctaattgccccctccatcattttaatatgaagtatgaactaaaaatgagtgattagatagaagagagaggttgtgcaaggctgagcatgcaaactcgtgcatgcttaaggagggagggagacctggagctgcatgctaggtaacagaaaggagggaccaaagctaatcgcagtataagaaaaattggtctttcaatttctagtttcatctaaataattagagcatcatatccgaaaacggcgcttagcctaacaaaactaatactcgccatgcgtccatccccgagcccgtttcacgctcgcgtggttccgcgatcccgaaggcgctccatccatggctttcccgtctccgcccataaataccacccaccatagcaccgagctacatcattcacaaataactaacacccatcagcaacaa

SEQ ID NO: 34400 - DNA, 246 bp, Oryza sativa
ccgaagagggaggaatcggccgcggagatctcggccgccattgatgacgccggcgaggattgcgggcgcgatttcggacgaatccgagggagagagagagggaaaaacgggggaaacgggagagggaatcacggggagtgatttccccctctttattgcgcgcggggacggcgggatgcggcggattcggcggcggcggcggcgctagggcacgggcgggcggcgggcgcggcgcgaggagggaga

SEQ ID NO: 34401 - DNA, 1342 bp, Oryza sativa
cggaaaaatatttttttatggaaataaaaccttttgtttgtgtgttattatactatactcttacactactccctccacccataaaaaaaatacatttttcagttttaaatacaacgtttgactcatcatcttattttaaaaattattattattattattattatattattattatattattattattatgataaaacataaatagtactttatatatgatgactgatttttttataaaaaaattaaataagacagacgatcatgttggaaaaaaaaatctaaagtgagttattcatagggacggaaggagtacatatttttatcgatgtatttatgggtaaacttcttttgaaatattcagaggtaaactaccgcgaaatactattctaccaatgtaaatgttgaaaaggcgtacgaccttcaccgatcagctaatgtgtggatatagtcatgtttaaagagagatagatggttttgcatagtcatggataaaagttattttgaaaaaggtttacacttttgatgattcttagtagacgtatctagagatgttaaccgtacaaaaggtattgctttgacaaaatagttgtacattttcttgttctaccttgacactcgtactcttcaagtttcagtttgacttgcagaagaaattgggctgttttgttttattctatttctttttttctgaaataattctctgacttgttgtacataattactaaatatctttgtgtatactcaattttaatggtgtgatcctaaagattcttcagcatttcaccattaactggtccacattcctaacctatttaagatacttctgcccaatttttctctttgtactactatacgtcttctgtagttggtggccgtttaattctcaactaaatggaggatagctatttttcgtccatttacgggattattttttaaacatatgctctttctttagacccattttatttttttgcgtaataatttttttttccaattcaattgtattcagcccaattttcgctcaggctccgccactagtaacaagttgaaattaagctcacaaccaacccaaattcaatgaacaaaaacgacaagaaaaaaagggacaaaacacctgatacctcacgtttttgtcatgtgatattactgtagcagtggtaaccaattgccacacatgaatcaaattaagattgagtctctatataaatatatactcatgcaaatggcatatagcatcactgtgtttaattgtcctgaaaataagcacactaccaaattataatgttcagcaaaattaatgacaccctcttctttctttctttatttttttttctcttttagt

SEQ ID NO: 34402 - DNA, 1076 bp, Oryza sativa
acaacattgtcctcacaggagcaaatgcagtgccggttgtgtcttcaagtgttacagctcagccaccagtttcaaagcagtagtagttttctttaaagccttagaataattatcggagttatggaataagatagactgcagtttacctatgcctttttctttctagccgttccgaatctcgggacgagattctttgtaaggggggtagatttgtcacatcctgatttttgtttcaggacttataaattatttaataaattattattagaatttatattaaatgttcactaatttacaagtgaagttaaatgtgggaaataaaatttcttaaatataaagcatggatggatttaatttttattaaattctccatggttaattatactctctggaattttctcggatttttcggagctcagttcctaattttaatcatacaaagagcagttcagcaattatttaaatattaaattaatcattaaatggtctaattataattttgttaagtacttttagtgtccaagtattttcaggatttttcttcaaattatttgagcattggaagtatttttaacaattgaaagatcatttaagtgattattttaattggaaaaagtttttaaatccttccctaagtcgttgggccgattccggcccaacatctctctctctctcccgcgcagcccaatcggcccagctgcagcagccggcctcccctcttctctctctccaaagtctgttttatctccctctctctcagtcggcccaagcaagaaaaaaaggaagctcaggagaagtctgttttgcctccctgctacagtgtcgtccctaaccttcagcctgcagtctggacagagcccgagctgcgcgccgcgtcgcctttccgcctccaaatccgctccaatccgaccccgtttcttccggatttttgaggggttttgatcctctcatcctcctctatcttttcccccaagaatcggagcaaatcgttgggtattttatccgaatcaaactcgttttcgagtttatctctaaaaccgagtttttgattttccggcttcgattcctctcgtttg

SEQ ID NO: 34403 - DNA, 383 bp, Oryza sativa
taaagatccccgggggtgccctttttattgcggggaaattatctgccaaggtggaaatatagtttttcattctttccaagccacccaaaatatgcttagttaccccatcaccagtcgaattccagcaagaagctcctttaatgtggagtgctttaagccctggcaggttctggaatattaatgcccgccacaatggggtggccaaagatgttcactaccatataatttccagtaggtcaacaaaaataagaaggcatttcttcccaatggaccttaaattagagttttaacatgctaatgtaatatatttgctcctattattcagacaagatcgatggaaaaaatagaaaaataatcagctccatcgtaagcaaagtgcataa

SEQ ID NO: 34404 - DNA, 167 bp, Oryza sativa
acaacattgtcctcacaggagcaaatgcagtgccggttgtgtcttcaagtgttacagctcagccaccagtttcaaagcagtagtagttttctttaaagccttagaataattatcggagttatggaataagatagactgcagtttacctatgcctttttctttctagc

SEQ ID NO: 34405 - DNA, 1501 bp, Oryza sativa
ttcctctccccgtgtcttccttcaaaaagtctagtttgcgaatgtgacgtgccagagttccattttcctcttgacagcatgttgaagggttgagcctgagtgggttgatggaccattatgttttttatgctttccttactcattattacttccatttattttcttaccaattttatgacccaaaagtagcatactagtaacttaaatatttatttttgtacaaattataatttatgataaaatgcttcgtagcataaagtttccgggtataaagtttttattccatcataaggtgtcctagtataaagttgttattccaccatgaaatttccaggtataaagcttttatcccatcataaagtctatgagtagaaagttgtatagctttggtagatatttgtttgtgtataaattgccaaaaatatttagagcactatagaaagtttggagtaaatgtagggagatatatttcatttaaaatgctacaatacgatagaaatatggtttggttaaaaaatacagtaagtatctttacaagtaaatttgtacatatcacaattgtcctaatttcactagcgaaaatggatagaatgtgtggttctcttctaggggcatcgtaagcgaacatttagctggctagtcacactagccatagtaggctacctcacaaccaccagcatactcatttcattaaaaaaaggctacttaggagtagatgtgatacaatctaatgtaacgaatctagacacaatctagtataactaatctggataaagtaataatactagattgtatcacattttctcatatattgatttttttagaaacagggacttagagggagtatagtgtggttccctgatccctagcttcccaacactgatcctccgtgacgcggaggttggtatgactggtggccgcaaaatctgtggtttgttgtgatgcggtcgggcacccactgggtaggatgcggttcttgtagatcctcatttgatgggacattagtcgactaatttaattgtccttcagaagaccctttattaggccaaacgtgtcactttgatggtcgtttgtggaccgatcgaccttgacgctctaatatgccttagtggacccaacaatagtaggcaaaaaagtggcgctctgataggccattagttgattgaggatttttttttggattgcttgaaaacttccgcccgttttttttttttgcctctaaaactttaagatttgtggccatcggattgtattaagatttgtgcataaaggaaaaaaaatgctgaaacagaattttcacataggtcacacgtaagatctcggtactagacaaccaaaccataattgaatacaagttttatataagttatatcatagttatagtgtagttacagtgttgttacagtgcagttgtagtgtagtttcactaaaaaaacttgtaacagttttttagatactccctattatttttaaggaattgaatttcacgttgacaatccct

SEQ ID NO: 34406 - DNA, 1188 bp, Oryza sativa
cggcgcttgagattcgactactattggcgaattcgagctcggtacccaaccaatagcactaatgcacggctgcgccaaacttattcttcttcttaaagagagctgtggccctgtttagatgggactaaaacttttaagtccctatcacatcggatgtttgaaaattaattataaatattaaacgtagattattaataaaacccatccataatcttggactaatttgcgagacgaatctaatgagcctaattaatccatgattagcctatgtgatgctacagtaaacattctctaattatagattaattaggcttaaaaaatttgtctcgtgaattagcttttatttatgtaattagttttgtaagtagtctatatttaatactctaaattagtgtctaaagacagggactaaagttaagtccctggatgtaaacaccaccttattcttcttcttaatgagtattttattaagaacataggaagttttgcctctcaaggaaacgttccctcattttttatgtcacctaaaagtcatcatttttctaaaacaaaacttgacaagttagatcaatatatatgtgatatattaattactcgcaaacatatgcaagttccaattcaacttatacaaattgaaacaaaaataataaataattatcaataatgcacagtattcagagttatatttgggtttttttttaacttttgttgttgaatttgaacttatggagtgataggtttaagtgttactccctccgtcccaaaatataagcattttagcatagtgacaaatcaaatatttttaactttaaaattttaatagaaaaaataaaaaaataatcatgtaaaattgatgttactacatttatcaataagcaaactatcataatatgcaattctttttgtttaaaacatcttacttttatagatattgttgatcaaagtagcatcttgtagatcgtgtcagggtataaaaatgcttatattttagatggagggagtaattattttatcattttcctttcttaaatttaaacttatggaatggcgggcataaaacggggaaaaacacatcctaattaattaattttcacaatctagccaaaagcattcttgtgagtgtgaattaatgaaggagggtaattatgttactaatcaaatgtcaaccttgtttatttgtcctatagg

SEQ ID NO: 34407 - DNA, 1501 bp, Oryza sativa
tcacgacatcaccgtcaccaccgacgtacttgacaagcactgcaaagtagttggggttggagcccttctcaacgtggaaggtgaccttagtctcaccagggtacttgcagcggacgcgacgaaactgcatatcgataattcccgccttgcggagttcctcatccttgccttccttagccatggcaccaaaagcatggccggagaggtcgaagtggtaggcggcgataggctcagtgttcatgtcggtgatgtggatgatgacgggcttgtcggagcaggcctctggcttggaacacttgacctcaaagcaggagccgcagcccttgccatccttgaagatagggtcattgccacatgagttcatgccgaggaagggagccttgtcaatgtccttgtacccacaagcgccgccgttgtcgtcggggccggcaccctttggcttgccgtaccaggtacccctagcttccagccactgtttgccgtaggccgcagtgatgttggggccaggcggcaccttgggcggcccacatgacactgcagacaccatggccgctgccacgacacaggccagaaggagacaagaggatgccattgttgctgatgggtgttagttatttgtgaatgatgtagctcggtgctatggtgggtggtatttatgggcggagacgggaaagccatggatggagcgccttcgggatcgcggaaccacgcgagcgtgaaacgggctcggggatggacgcatggcgagtattagttttgttaggctaagcgccgttttcggatatgatgctctaattatttagatgaaactagaaattgaaagaccaatttttcttatactgcgattagctttggtccctcctttctgttacctagcatgcagctccaggtctccctccctccttaagcatgcacgagtttgcatgctcagccttgcacaacctctctcttctatctaatcactcatttttagttcatacttcatattaaaatgatggagggggcaattagcaaaactttaaattattttttcttctaaattatttatcttatcttttatttgattatgtcattatattttttcaattaaatctttataacaacatcgcacatgattatatttataataaaaaaattgcatgaatatttttttcctaattgaaacatttttatattacatatgaaacatcgagttataactattgaaacattaaaaattatttactaaaacattcgtaaaataccacatgcaacatttatagataaattagtgagacaccacaaaatattgattgaaacatctgaataatacaatgtgcaacattatccctagcaataaaataacttaaaatatgaaacatagtgaaattttagctggaattcgcttcttgtacgtgaaactgtaggggcacctggtttgagctcggtgtaccacgtattcactcatgatcatccaggatttcgatcacgcataaattgataaacatgacaactttcgatg

SEQ ID NO: 34408 - DNA, 1501 bp, Oryza sativa
aattcaacttatacaaattgaaacaaaaataataaataattatcaataatgcacagtattcagagttatatttgggtttttttttaacttttgttgttgaatttgaacttatggagtgataggtttaagtgttactccctccgtcccaaaatataagcattttagcatagtgacaaatcaaatatttttaactttaaaattttaatagaaaaaataaaaaaataatcatgtaaaattgatgttactacatttatcaataagcaaactatcataatatgcaattctttttgtttaaaacatcttacttttatagatattgttgatcaaagtagcatcttgtagatcgtgtcagggtataaaaatgcttatattttagatggagggagtaattattttatcattttcctttcttaaatttaaacttatggaatggcgggcataaaacggggaaaaacacatcctaattaattaattttcacaatctagccaaaagcattcttgtgagtgtgaattaatgaaggagggtaattatgttactaatcaaatgtcaaccttgtttatttgtcctataggatcatcagagaaaggatgggctactaaaggaagggctttatgcagcggcagctgctgctgcggcggcggccaacatgggtgttgcaccgtactaagcccagctagaataattagtgagaagttagttactatctaccaagtctagctagctcatcaattaactagtgtgttcttcctatcaagctatctagggcttcctgatcatctctcttgttattaatgaagtgtactgtctctgtgcgttggtttcacctaggtataatctgatcatctagctagctaattgagcttcttctgctactagtcattttgctctatctgatatctgtgctgttttttttctctagcagttgatctgatcaaatcttcatcaattcctttcatttctaccctctttccaccctcatgccaaaacagtgaatattgtttgattgtagtcagggtttacaaaaccgcgtggttaattactatgcggttatcgcagttaccatgcatggtaactttaaatttttgaaaccacgatatttcgcgcggttaccacggggtccggtaaccgcgccaaaaacagtaagagtgtatcgtacaaaaaaaaattaaaaaccactagcgaaaaccggaccatggcgatttttctggttttagcaaaattaagccattgcctatgctagtgaaatctgacctttttcttcaaaaatttaaaatccaattaattattttaatttaactagaaaacctacgattttgtgttacaaagccagcccgggatacaacgatggagctaggatttagatatggaagggggccaaaagtattgaaggggagtactattatttaacttgttgattataattgattagattattctacgtaaaaaaatgttggagggagcctggcctctagtcgtccctctatctctccatctctattt

SEQ ID NO: 34409 - DNA, 208 bp, Oryza sativa
catatatgctattatatgagagaaaatataatgatgctagccacgcaatctgtgcgggccaccatactagttagtgtattaaatctgcacgtcgcacctcgtagctggcgttaaatagaggatggttaatttgcctatgattaaagaataactcccgtgtgtaagggggcaaaatatgttttgattgttaaaacaacacataaacagt

SEQ ID NO: 34410 - DNA, 1501 bp, Oryza sativa
gaagctgattttaaggtttttcatcgaagtttattttttagccttttagatcgctaagaacacgtatataaaagttttatttacaaattagtttttatttgcatatataccgtttcgcttatacttaaaatcagccaaacaatggctctgatggagtaggggggaaaagttatggactcatcaattacccaaaagtatttataagtcgtaacggtttagtaatgaataaaaaaaattatatgtaaaaaatttatatattttttatcataaaagctaatataaaaaaaataagttgaaagtatttactttcaacttaaagttttaaaactattttaatgttctaaaattcaaattttgattttggcttattcttttcgggtaacctatgggatggttagacaaacaatagttttgaccttcagtgttggtggtttcaaagtgttggattttgtaggttattctctgcccacctagctattgttacaagggggttagttacagttgtttattaaattgaactaaggtaaaatgagaactacacaattagttggttgctagttatgaggttatgttttacgcatgataaagaagccatgtaaagtggtgaagcatacaataaatagtgtgagggaatatagaaataatgaggaatgagtcgtttatattggtagtatctcctgctttaacagcctattcattggatcttgatccatggttttactggaaatgatcgaaaattatcatgtcctatatttggagatagtagttgtgctcagtggcgaatctaccatggggcggcagggtctcgagcctccgacccctcactaccaacgttttaaccatggaagtctctatttaagtcccgctaaaattttctgtcatacatctattaaaaaggttatataattttgtatagtttattcaacctttcctttctggatcttcacctggttgttctatatacaatgtgctgcttcgtactatagttaataacttcaattgaagactcaacatctcaaattgattcactaaacaaatcctaggatatcctctcttccagtaccgattgcattgataagttaatatcaaagataatgccgtttagcattaattccttgaagcagctaaattcatcacaatagcatgttaccttacctagcgtagaaagtggatactcgttgatacggtggtcttgttaattaaatttctcactttggcaaaaaaaaatccatacaaaaatgaatatgaacaccaataatttgaggacctggcttttttgaagcctaattagtcctgctaacagaaaaaccacctttgattccctatttgctagaaatttaaccaccgagaaagattttgtacataactaatcgagctaaccgatatttcataatatttttatcgacccatacataaaaaccgatatacatctgacaatcaaaacttacatgtacacatcgccaaccatctcaaggagatatcacttcctccctccatttca

SEQ ID NO: 34411 - DNA, 1501 bp, Oryza sativa
cgagtatccactttctacgctaggtaaggtaacatgctattgtgatgaatttagctgcttcaaggaattaatgctaaacggcattatctttgatattaacttatcaatgcaatcggtactggaagagaggatatcctaggatttgtttagtgaatcaatttgagatgttgagtcttcaattgaagttattaactatagtacgaagcagcacattgtatatagaacaaccaggtgaagatccagaaaggaaaggttgaataaactatacaaaattatataacctttttaatagatgtatgacagaaaattttagcgggacttaaatagagacttccatggttaaaacgttggtagtgaggggtcggaggctcgagaccctgccgccccatggtagattcgccactgagcacaactactatctccaaatataggacatgataattttcgatcatttccagtaaaaccatggatcaagatccaatgaataggctgttaaagcaggagatactaccaatataaacgactcattcctcattatttctatattccctcacactatttattgtatgcttcaccactttacatggcttctttatcatgcgtaaaacataacctcataactagcaaccaactaattgtgtagttctcattttaccttagttcaatttaataaacaactgtaactaacccccttgtaacaatagctaggtgggcagagaataacctacaaaatccaacactttgaaaccaccaacactgaaggtcaaaactattgtttgtctaaccatcccataggttacccgaaaagaataagccaaaatcaaaatttgaattttagaacattaaaatagttttaaaactttaagttgaaagtaaatactttcaacttattttttttatattagcttttatgataaaaaatatataaattttttacatataattttttttattcattactaaaccgttacgacttataaatacttttgggtaattgatgagtccataacttttcccccctactccatcagagccattgtttggctgattttaagtataagcgaaacggtatatatgcaaataaaaactaatttgtaaataaaacttttatatacgtgttcttagcgatctaaaaggctaaaaaataaacttcgatgaaaaaccttaaaatcagcttcaaatttaaggttaaaaatttaaattttacctgataagtataagtataagcgaaaatataagcccgcataaaccggtaagcagggagtacttggaaagtcaggggtacagacgtaagaccacaataaaacgaggggctaaccatcaaaacaacccttcccccctctctctctctcacacggcctcatccatccatccccacctgagctcccaccggagaaaaccacaaaaccacccacccaaaaaaaccaaccccctccgcgatccccatttcaaaataaccccgccgcctccgccgccgccgccgacgaggaggggtcaccga

SEQ ID NO: 34412 - DNA, 160 bp, Oryza sativa
ccaaagccggaagctttccagatgatgaagaggatgatcggcctcgcacagattttgtttcataattagtaaccttaacccaaaaactgagacatgactatatgggacactaaggtatgaagtacataaacttttttttcatcttgattttttttttagc

SEQ ID NO: 34413 - DNA, 1501 bp, Oryza sativa
tcaaatcccaaccattatattgctgtaaatcagtaatatgacactagataattaagaagaagaagctggggcacatgcatccaaaagctagctagggaataataagctcagtagattagcacatacactaacctcatcattttggggatgaaaaagatgagctaatttccaaacacatcacaagctcgaataaactagctatggctgatgcgtagctctaggcgtttgcacccgtttcaattcaaatcacagatctgaattcgagcgcacattcttcgatcggctcaagttgcaatgtcttcacgctagtgtcgatcgagtgatgaagatcgatctccctgatctctcgatcgtgcgcacaaaagaaaatgatttgagtaatgccataattaaagatcaattggtagatgttggatatacttcaacacacacacacacatgaagtaaatttacaaagttacatgaaaaaattattcaaactgataacaacaaagtaaagtcatatgtaataacaaaactacagttagaaagaaataaaattacaccctgcatacattagaaatatatactaaacaacatagaattacaattattttgggacggaggtagtacagctttagatgattgaaaacttccaaattttcagacgtttgaaatcccagagataccctaaatttcataaataatgtaccatgtatgtcaggatatagacggttacttttttttgtgtagtgctggagaaatcgaaaaccaaagtgtagctggcaaattaagaggctaggatacaagggctggcactatagaacgtgcatgcagatgcaggaacaaacaagtggtcaggtcagggcggtgcgtggctgcatgcattgcactgtcatgagcacgatgacccaatccttacaactcaaaagctctgcttcccctcatggccatgtccagcttgatcttggctttttcttcaccccatttatgcctctttgttctttaactatgcaaataaatcaatttccataggaaaaaaataaacaagactaatcaatttttggatccaatgtaaaatagtagtgcatcatgtaatcaatgtgagcttgtaggagtgtatgtacagctttgttctccaagattcccagcatagattagagactcgtttaatcatgctctaactcgtaaatttaacttcaaaagttagatatagagctttacttctctagatcattttataagagcatgccagcttattccgctttctttttatgtggagctgaaacgttttaatcgtactttagcttcagaagaaatgaagcttaagttggcctgagctgtgtcaaacaggcctagctagcaaaaaggccgatcagtttttgattagtgaatgggagcagtatttttgatccggtcacgcagggccacaaattaaagctggattaattgcttttaattaatcgcagtagttcatctcgaaaataattgaattagttgggaccattttggcctcgaaacc

SEQ ID NO: 34414 - DNA, 1501 bp, Oryza sativa
attacagcaatcaatacatgatcttaacatataatgtgttaatagacctgttgtttttaacagcatgctaacaaaggatcctaggatccaaataataaaatttaacatacaatgtgttactagaaaaacagtaattcaatgttttgggctgacaatgcaaaccatgattaaccttgtaaggaggacaaagtatctctgtcatttgggaatacttattctgaaaagagaagattttagctgaaaggaaaacctctgtagtatgtctagtctaatgtagaataatgaagtgaatttcctcggactaaaaattcaaactgtgaacacctcaacaagtatttcagaaggtcaacaatctacattgatttcccttaacttagagaacataaacagaaagggagttaaagttacagaaacagcagatgaaagataagtacaacagctggctcaaaggaataggggtaatccccttgtaccttctgattttatcatcctgatgatttgtttcaatgcaaaccccacctaatgctgtttttatctgaagattttgaaacattagagtttagaatcagtactcatttgttgacaagagaaaaatgctcgcggaataaatttagctgcacggcattatctacagatgcaatcaaagtgtgctcttaaatcttaccacacattttacaagatgtgttcttaaatgtattcttgtaaaatgtaatacatggtgtcaccaaaattgctctcggaataaatttcaacagcacagtactttagcgagatacaataaaaatgtaacacaagaagatgctatctcaaaatacattcaaattgtacagtattgacacttatgcattcaaaatgcaatacatcttttctcacccagaaaagatgtcaggaggatacattaaactgtaatgtactctacagggatgcaataaagatgtaatacaaaataagaaataaaaagacatctaagaaacgttcaaatatgctttggttttcgttttctgccaaacatcacaaggatgagatcggaagcctcgatactttggatcatatcacataacatctcgccgtctcaagaacaaattaagcagcactaaaattcgtaaacgaacaaaggatgagatcggaagcctcgatacttggaatcatatatcaacaatctcgccgtctcaaaacagattaggcagcatgagattcgtaaacgaacacagtgcacacacgaaaacgttcatcgtgatcagcaacaaaaacattcagaattagcactcgaaacccatgcctagaatcaaaacattcagaattagcactcgaaacccatgcctagaaccggatctaggccgctaccgctactatatcgatatagaaacaacagcagaagagtagtaaacggttgtgcagagatctagaggggtgggaaggggagagggtaagatgagctcagtttgttgatgggaacgtggttgcgagtgacgtacaccaatacaccatagcctcgagaaga

SEQ ID NO: 34415 - DNA, 1501 bp, Oryza sativa
ttccccttctccgaccggaccgcgctcctcaggtcagcagctgtgcatctgctgcaccttgatatcatgtttgatcgaaagccgattccttttatttcgtttaatctttgcatatatattgttttctcggtgatgtttgttaggttttcgtgatttcatctttgcatttgaaggtctgaacactctttgatagatccatcgcagggcagggcaggacgcgcaatccactgcggtcgcatctgtttgctggaggtactcttccttccttgctcgtatctgctagatttagggtcgctagttttttttgtctttgtcttttaactaaaaactaagattcccctttcttctctgtttctaatttaccccttgattttctccccctccctccctggcatggcagacccaaacttttaggcgtcgagactccatcccagtctgacttcctgctccgaccgcgcgcctcaaggttaatcgcttgtttacttgtgcttcgacttcatcctgtatgatcgaaagtcagtttccttttcttctgcttacatttgctatctgcgttattcattaggaagctttatctcggctcggctggctacatcttctgtttgctgctgctgcttattggaggtactcttccttccttcatcctaactcctgcaaacaatacaccctttcttgtactacctcttatctgcaactaatttcccattctctttttcatcctttgacggcccggtcgcttcagctggaacttgggagttgctgatcgactctgaagatgggcctgtcgcgtcgggctaagaatctcatcgtcgacgtccccttccaaggcgccaaatggctacgctgcgtcgatctggcaggccagctgttcggtaacaccgctacaccaccaccaccaacaacaatcgcacatggatcagagtcagcagctgtgcaagaagactacacctctcagacactggtgtccgactcctgtaatcccaagaagaaggcagcaggcttaaagatggagaggattcggcttcccagacccatcctcaagttccgacctgctctaaacgaggcatgtaggattgattgcttcccttttgtggatcacaagatgttctgggtggatcacttggggcgccctttcctctttgaagcagagacacggctgatggacatgttgccctgtctccacaagcccaagtcgatgcccttttctgtgtttgtacccaacgccgatgctgacaatgactatgaacaccaccgccctggcagcagtctttttgttatggagaggattcccaagccagaggtcaactcaagcacacagtggagcgatcagtttgaggcctttgtctactgcaagcacaagcggacatcgaccaacttctccaagacctggcagtggcaactcctcccgccgccgccgtacgttcgtgaacctaagtactggcacagctgcagccgcccagagatcagctcctacacatcgctcaccgtcaatggtgacccc

SEQ ID NO: 34416 - DNA, 455 bp, Oryza sativa
cattagcatgtactagtgtataatagaaataggataatggccttggattttatttgtccgaatgctgtttgcagtgtagctttatattttgttgctggacacttaatagttgtatatttgctctctttgaccaatagcaacatgatacaagccagtctcttctattgaaatgtatgcgcatcttgactaccgatgtagcattgtgcatcaatttagcactcgaactacagggtaaggtagcatgtaaaaaatgcgtaaaaagtgcgcaacttcaactcattatttttgttggctgaattccatagctgaagcatctagttgacaattgattcatgcttgtgttgttcatattgtatggtttctctgtatgctctcttgatgtttaactgctttgttaccccttctagtccatgctcaatcaattgttgattcttgtacttctgtgcttctgcagg

SEQ ID NO: 34417 - DNA, 756 bp, Oryza sativa
ttcctgcaccccataaatatgatttttttaaacaactttcgtatagaaactttttacaaaacacacaccatttagtagtttgaaaaacgtgcgcgcggaacacaggggagaggagttgggaacctcttatgccgaacacaccaagcctgtaaaaggtgttgatcactttatcagaaattcagatcccatgttaaccaaactcaagagagcctactccttccgttatataatgatcattatatatatttatacacaaagaaaaagaataatttaaactgtattaatcaagacacactatacacatacttctacaatacatgtatcgattaaaacaccatatcatttatactatagcatgcacatattctcccatcttgcattaattgtatttcgatagaatccgtatccatgtgattatatgatgatcaatttgagaaatatttgatttcattatatgatgattagtttctgaaggagaaagtaataacataatacccacacctaccacatactatgtcatttatcactcaaaagaaaattaccttttgcttttactttcgggggcgctgatcgatcggatgcatgcgtgatcaagctggccgccggacactccctgtacgtttcacctcgcgatctgcagagttcaaacttcaaagtgcaagaataagtcctacgttacccggtcgagcggggacgcataccatggccaacgctaagatgtgacacgtacctctagcctctcccacgcggacgcga

SEQ ID NO: 34418 - DNA, 1501 bp, Oryza sativa
gctaatattttagtaatacatgtgtctaatagataaaatattgatagtaaactaaatattaccgatttattattttaaaatgccaatattctcgtaggttacgatatttcagcttcaaaccggttctgaatatccttgtacgtgatatttacttcttccattccaaaaaggcaaaatttgctacaggacacttaaaaaacgtgtaattagccgtgggacaccgcaaaaatatgaattggctgtaagacgtcgcaaaagagtgataattagcaactagacactagagacattattttattatttttagtggaaacgaagagagaaacaattaaaaaagaccagattgccctacgtgcgcccaggatgtcagtctctcctctattttctttcctcttcctcccgacgattgttcttcccgtccgacgacgcatccccggcgcagctcgcgcagctcggcgttcccggagcagtcgggcgtcgccgcggcagccagcggcgtcggcagcggcgtcgttggtggcgagccgtgccggccggccgctccccacggctctcaggcagagcggcggtgacccccgccacacgccctgcatcgccagcgtggacaccggctgcgtgtatgcccacgcatctgtgtcctcgcaccagcccagctccagcgtccccgctgccgttgccgccgccgcgtcatctgccgcccgcctcaccacgcagcgccccgtcagcgggtggaacagcacggtgtacggtctcgcgtcgtcgtagccaggccctgcatgcatcgcatcgccggcgaccccatcggttagaaacgcgacgttcgtgcacgacattgagccggtcaccgaagaagacattgccgtcatcgtcggcgcagcaccacccgggctagctcacgctgttctccccgaggctgtctggccctgaacgactcgatcagcatgaggtcaaggaaccccgggttgttcgcctcgacgccggcgaccgcgtcggcgaggccgtgggcgagtagcgagcgccgccgcgaacgtcgcaggtgggggcgaacaggacaacagcagcgtgcgacatgccattctggttctgccgggtgaggcggagggggccggcgtacgcagcgccgacggagagagtgcgcagcacaacgaggaggctggagagggagtgctcgcggccaggggcattttagtacttttaacgctctttctctctccattttcaccggaaataataaaataatgtctccagtgtccagtagccaattaccactcttttgcgatatcctacagccaattcacgtttttgcggtgtcccacggctaattacatgttttttgagtgtcctgtagcaaattttgccttccaaaaaaaactcaattcttaggtttctatgtctaacgtttgaccgtccgtcttatttgaaaaaaaatatgaaaaaatttaaaaaaataagtcatgcataaaatattatttatgctttatcatctagcaataataaatat

SEQ ID NO: 34419 - DNA, 797 bp, Oryza sativa
ttttaagcatgacataaatatgttcatatttacacaaaaaatttgaataaaacgaatagtcaaacgttggtcgaaaagtcaatggcgtcatacattaaaatacggagtgagtagtatttttttttctttcagtagagtatctccagttcctttttagggcaaaacttgcctcttcaaaaagtagcaccctaaaacaaaaaccttactaaaatacttactccaaaacttttttctcgttgatatatgccattttacatttccatgactctaatgaccgaatgaggagagcagtagggtgcttgtgcagagtatatatggcccagagaaacgggtgaaatctgggcctaattgtttgagcggtagttgagcccacctggcccaaattgttttcctttcgagagagcctgagggctacaacttgatgggccgaaaccgacattaatccagcagcccagtactattttgtggatgggcttatgggcccaaaccgtcgtctctcgaacgaaccgacctgagcttagcttatgtcgtcatcttttagagttagggctcgcctcgattcgttccgcgagaaaatccagtccctcccatcccatcgccgccttttccttttcctccaaatccaacctcctcttctcccccttctccggcgcggcggcggcggtatcaccggaggcgccgaccctccctcggctcgccaaaaggtaacccccagctatccctctcctcctcctcccgcttctcctcccgcttccgcacgaaaaaaccaactgaaaaaccctatcgatctgcagcca

SEQ ID NO: 34420 - DNA, 737 bp, Oryza sativa
catattttcccatacaacactaagtggtttgagttacctcataatcaatgaaaaagataaccattgatatttaatgtctattggatggttatggtgacgcatgaaaatgatccaatggctcttgttttgtggtgatgtggctcaatacatgtttagcttttggtgccaactaaaaaggatgtgagattgatgcattctaattaatcaacatatcgtattccaattctaattaatcaacatatcgtattccaaactgcagtggcaagaagacattcaaggaggtggttaactgtctccagattcgtaaggtgtaattgatattagtcattttgccataccctccttgatggcaatctgtccttcgtccatatgaggtttttaagcacaagccaagtgaaaaatcttgctttatattttgaaggtactcatctaccctatagttgaacaaatagttttactcgttactcattcatcatatcacacatccaacggtcaataacatcttaatccaacagctcacatcgccccacgtctccccctcttccttccacagtacgcacgcatccctctccccgtctccccgcaaatcacgccgcgagcgcccctctcctcactcagcccgcgcccgcgctcccctaaccctaatccccctccaccctctccgctcctgacccctgcggccccgctgcgcagatcgccatcgcctctcggcagccgcactatccccaaaatcacgt

SEQ ID NO: 34421 - DNA, 1501 bp, Oryza sativa
gcagcagcggcaacgctggtccgtcgcgaggatgagggagctccggcgctatggtggtccgtcggcgctggttgagcgccgcagcggctccggcagtagggggaaccaccgcggcgccgtcgggggcagtcccgggcggggctcctgcggatgagggatgcattggtgtgcggtggtctggcggtagaggcgtaacagcggcggcgctggtccgtcggtgggcacgggtgcggtggtggtcggcgttggtccggcgttgcggcggtgcgctggtccatcgatcgcgacaagcgagagaggacacgcgcggcggagtcatcgcagcggggttttgcccggcggagtcaccgtgtccacatgggggcgaaatcggtggaataactggacggatgagattacatgagagggcagatggacagtagagattgatccggatgatttggccggtaggattggagaggggcaactcttttttatattagtatagatatagatatatcttattttaccccacatttctttgatttcttattttgagttatgtatatcattttatatttgtattaatgcaaagtaatgtcaaatttaaccaaataaattgttattaatgacgattaaatttgattatatcagaaatttcaggcataccaaatgtgtacttaataaaattatctcagttttttttcttgtagttcaatttgattatgaacatgtctaattcacaaatagaaacctcatgcaatactgaatagtcaacagaccagaaattgtcatttgattggttcagttttttatgttctattcacacctttagcctttttttttccctcgaaaacagcaggggaaggctccttctgcattttctatttaaaagatccatacctttagcctttaagcctttagcagttgtagttcaatgtgagccacctttatcgtttagcatccatagctcaaagatcctgcacaaaggggtgctgtcatattcccatttatcattattttacccataaattcgtaactatacattgcgttagtacgatgatgggtggcgatgtcatcatttgatcatgatctatctctcgaggttttggttataacaagaataagcagcaatcgttaaatacgacaactgagaagaccatacatacatgaccccaacaggcttcattgctatagtgcatggatttcttaccacattgcaccatagcgaatgcaattaaaattaaaggaaataattggatttcagtttatctcatcatttgtggcaattttagcaagaatgttaccatttgaatattgcagagctgcggccatccttaacagtgaggacatcatctgaatcttgcagccttgcaagcagccataacaacgaggataaaacttaatggatggcttaacctgaaagcggatgcaaacagcagcaatggaagccaatcctctccttaatctgctatacatcctaacccatgagtaactcaatgggaccaaggcaagatggtgg

SEQ ID NO: 34422 - DNA, 1501 bp, Oryza sativa
cttatgttatttttttagcacttctattcagggtgaagacatcctttggagcaagcattagtgtcggatcttatgtgattgaatatttgcctgatacttttacctttcgactgagacattttactgcttatgtgattgaataagtagatgtgtagggacagttcttatcagatctgtcaaaccttgtgaattgtgatgatgctattgatgttcagatgggcaagcgattaattctgtgtatatgtgtgctagtgagtatgattaattatgcgtatgggtgctaatgtctatgattaactagatgggtaccccgcgcgttgctgtggaagaattatgtaataatatagacttaatatcggttgagcagtaagaaggagaatcggttatggaatatattcagagatttcgtaatgtccgcagccgatgttatagtttgagtctaagtgatgagcaactagcatatcttgcattccaagggctatcaacacctatcaaggataaattattttgccacgagttcgacagcttagctcatctaatgcagacagtaagtaagatcaattttggagttattaagactagactgaagataatattgaagcatgagctctcgtactccaattttttttttttggagggggggcctgtgttaacaatgaaatttggtaagccttgaagacgtcatcagcctaaaatcaatatcggcttcagagttttggaatcggccgatgagaattatcaagtcgccaatagtcggattcttgctatattcggttaagaaaactaatctattaaaggaagcttagccagaagtgaccgagttcaagaaggatgctgaatgcggcatggcaagttatctattaattaggcagtatttgttagtttccttttatctttaggaaagtgtgtttagtgtcccataaggactttatgttttactttatatttaggaaagtttctttcttgtccaataaggactagtacctacccatgggtataaatatgtacacctggggtgattgtaaactatctccacaatcaatacaaattcggcacatcgccatcctttttactgaggtttttacttatcatccgacggaacttgacacttaacgcagggctgcatcggctttcgatctccgacatagggggcaagtcctacgttgcgccggtcctaacaattttattggctacattggcatcgttcaaggctgcatcgcttcgacctcttggattgctcaggtttagttgatatatttgcctacctatttatcatatatattagttaatctagtttggtagcttgatttacttgtaacgactgatattcattttagggtttatgccggtatcggctaagtcgctttcccaaattagattagctaaggtatctaccaccctgaaaatcagtcaagggcttgattgtctagatattgtgtttcatacttagtgctgcatcagtacattcgacctactaagtcgtatttagaaccataatctc

SEQ ID NO: 34423 - DNA, 1501 bp, Oryza sativa
accctctccacagcaatgggggaagtttttctctcttttctcttgttcgttcctaagcttaagtacgaacccagatagggagattgacctccatcataagtatgcgccttcaatgctaagtagctgaccctaggagagcttggcacgagcacggtgctgacgctagctaggtatagaagaaccaggaccaaagtgaatcatttggtaaatataaccagtccaatatgaaaatgttgctttaccctggttcaggctaccacaatggtctcataaggggatctaatacgcaatttactcatttctaaattagtttttagagcatattttataaaataagttttatatgaggaccataatgtcaaaaatcgcgatggaacctcggtcatgctgaataggggaggatggaaacaaaggctttctttcatctacctacctcaagtccttcaaataaatctatctattgtcatgtcactccgtatgacaactgacttcactttcaggccagtgaaattaggcaggcataaaaggagaagaaataaaagaaaaggcttctttgcttccaacaaatctactttccccaaatgattagctatttgactgagaaatgaaggcagagatgcgcagccgacagctagtatgcgatggacaaatcttgcttagtactaattgtactatatgcacccaaaagtacacattttctccacatgattgctgtattatttaacaagagattctacaaacctatgatgaaacaccatgtacagtacaacctcttccaattataccacatgttaatttaacaagacgcactcataacaggaaaattaatttatgcctttaatactaattaatacgagtaacttactgatatgttacaacgggcctgtataattagaaatgggctgggagtgaggaaagcaactaatacagccagttttttttattaatcaattgcttggttttttttggtgaagacaatggttgggtgctaatatatatatggggagcagcgaatgggctttaaattaatagagatataatggtggttttttaaacatcaccataatattatatgctactcattccttccaaaaatctgatacctatttctttttcatcaaaaccaagaagcaattaactcactcaccatgtggcaaaaataatgaacatgcaaccaataagtactaaaatggcttcttggtttctggtcaacaatttaatttagcacatagtgactccaaatatgactcagatttttagagaaaccaaagaataaaataggtctcagatttttggaaggaggaagtactatgctagtctggttatgaccatgaaaacatactatctctaaagtcaaacttttaaaatgaaaaaaaaacacgcattcttttaatatcgtaagctcttccagttatatgtgcaaatatttacgataggagttaaaattgtatttccgagctgtacagatacataaaaaattaaaaatgacatgttaaaatta

SEQ ID NO: 34424 - DNA, 1501 bp, Oryza sativa
gtctggtcctcacctcccaacccgtgctagtgtgaattggaatcagcgagagcgtgctggcgacggtagcgagggtgggcacgcggcgaccgcggtgagggtgtggggacacccgataaagtcatggtgcccccacgaatacgtaactgtccaagatgttcagttacgcatgaaatgatataaaagcataagcttcggttatacattacttaagtcacttagttcacaacacaacataaatacaaaccattacataaatgacctataaagccttattaactgctagactccaccacaggaattgcttgggcatagaatgacctagaaaccataattgtcccactctaacgggtcaacaggatctccacaatcatcttcctcctcatgatctgaacccatttatgagtacaacaggtactcagcaagacatgcctatgatagcaaatacaataattgcaatataaaacatgcattattaagagccggaaggtttaaactctaaccttaacatttatttcatagagcctatcttaataaacatttgatataaacaacactattgaatatttaatttaaacgataataacgagcataaaattaatataaatgtcacttataaataacttgaataaaacatcaagcaataaataaattaaccatattaattaataaccatttagtttaacttgtgcccataatctggaatcatccatagacacatcaccattaattgggagcacggcgtattcgaatactctacgactctgcagcgtctgcctagctttacccacacgatactcacagctagccgggctgaaaagtaacaaggcgtaatattgctccatatctctcccttctgcctagtaagttaaaggatgctcgggtcattgctcggagtgatccggtccgaggtgtgtaccaacctacctccgcatccacttaccattgttcgttactcgatgggtagcccagaacttgatgggcccatagggcagttctgaactctcgggcccatcgagcccacatatataaatcacataaacataaaccatgtcactttgcttcacacacttgaaagctaatggccaatacatcgaaaggcctgcataagttcaatcaattggagcaatatacggccaggttcgacaaatcgatcgtgtggatgggcgaaactatgtcattcttattggcacaagagggttgattattatatcaattttaaataagaaataaccataaatatatccatatatccattacgaccataaacaggtccataaaaccaaacacatgaactccatcatgtgtaccacccgctcacaagcggttgttaacgaccaaatttggtaatgccatgggccggattcaaagttagagtcgaagccgatttggagaaattccgttcgagaaagcagaatacgcatcagttacaagtagcatcggctaccacatgaatcggctataggcggtatcggctgccacatatcggctaagcgctaga

SEQ ID NO: 34425 - DNA, 1501 bp, Oryza sativa
atacttgctgtagtatggcatggacgggagggagacggaggttggcgtcgggattgggaggaatcggaatggaagctgtgtgtccatcgagtcatggaccatcatgtttgtgtagccgcgggggcattatcggtggaagagccgggccgatgtcgcgggattcggtcccgccaacgtccgaccggtgggcccgatcccccgcacgtgcgacctccgtatgggcaattgcaattcatggcgcgcgaaatgaccttcctgcccctcctccttactgacctcaacgcctgcgagcgaattcgcgtcgcgattgaaccaaccgactgagagtctgagagagtgaggggggcctgcgacggtgggcctaccaccggtggtgggcccggggtgcacgtgatgcggcagggccgggaggggagtgaagccgtgaagtggcggccccggcggcggtggtggtcaaagtggtgcccccgttgttgctctgtacaccgctttgtgccgcggtgcatggtggcccatggccttgccctttccctacctttctcatctcctcagtccaggggcggatctagaaaaaaatagtagtgggagctgaataaactacatcagcataagtcgaacctccagtccccacatcctatggatctatgggaaaaaaatttagtgggggcttaggggggtctccactgtcccgggagcggtagtggagtctcaagacccctccgcccccgttgtaaatccgcccctgcctcagtcctcatcttatttggactattatactcctatcaataaatatagacatttgtaagttgtttagtagagatgtttgcttttttaaaacaaaggataaatggggtgggtggttaatggtaaggtaagacgaaattcaaataagaggtgattgatgaataagttttactttggaatgcttatatatttgtgaacgaactttagatacttcgaatacttatatctatgaatagagggagtagctttctcggtttggtttggtcctatttcttcctcacacacgtagccagattctactccttctctctatgccaaaaattattctgcttatgttggtatccgtgaaagggcatatagcctagtggttgcagtgagctgaataacactccaaggtcccgagttaaaatctccataggagcgaatttcagattgggttatttgagaactaagtttcttgttcaataggctaagttcctaatttaaaaaaagactgcatatatctggttgggcccaacccgtctctctgcatgctctacgcacagccaatttgaaactgcatgcatacatcattaacggggctaatctcgggagaaacagaacaaatttgaacatgcgccttctattgtgggacaccggtagaaatatttagcgccctctaaactgggacggagggagtatttattttccatggggacatctcactgttccatttcttctcatggtgatatctcacgcgatctgtttttgcttcctt

SEQ ID NO: 34426 - DNA, 318 bp, Oryza sativa
ttcctgcagccccatcgtttggcatatttagtaccagagcacttccgatgcatttcttcgtattaatgcgatatacagtttgcttgcttttacactttctgggtttgtttctaatctcataaaaaaatatgcatgatattagttggagtgctatgggatcagcagcttttagtttcagaatttttctacctgctaccctagtcaagctactacacaattatgatatggggcgggctgattcatgacatatgcccattcttcatttgccatgtggatggtagatacaaatttatttgtacgtgtctttcttttaccagc

SEQ ID NO: 34427 - DNA, 1501 bp, Oryza sativa
gtgccatagtcggtaggcggtgttggcatggcacacgcaacaggaggaggggtgagttgacgagtgttggcgtgcaacgatctaaccactacgactagcgattatttagagcaaatttaatagtgtagcaaactactagctctaaatcatatgtagtcaatctaatagcccatttatatagtagttactaaattggtactacatcattaacatattaacatatggtctcatttctcatacacataacgttttagagtccgtgttatagctggctataagtctgtagtctgtttttttctctcttatcttattaatatcagcttatagctgatttatagtctgctatcgtatatgcgaggtggaagaagagtgtgtggcggcaatgtgccgtgggatgcgaatggaatggaatggcgttggggtcttggggagaagtggaagcagttgggccatgttgggctgtagtcgtggactgctgggctgctagtttcccgaattttttttatttatactttttttattaaaatatttacaaaaataatttgttgtttcgaaaatttacaaatctaatcgcctgccgccctttgggagggcgatttttaaaaatcgcccttccacagggcggcaagggacctaaatgtaaattttccagcataacttgttagctctataattttacaatttaaaattatattatataaagtcagatgaaataaaactttatatcaaaattgtagagctcaaggagatctacaactttgtagttaataactttttcatttaagatgttttagatatccaaatattcgttacaaaatataaaacacattttaaaaaatctcagatctacatttcaaacgacattggatggagataaactttatataaagttgtagatcttgatgagatctataactttgtagtttatcacttttccatttaaaatcatttggagtatcgaataagcattattagtttttaagcaattaaaaccggtgggaagggtttgaacacaaataaaaattttgtatttaggtcccttgccgccctttgagagggcgatttttaaaaatcgcccttcttaagggcggcaggcaattagatttgtaaattttcgaaacaaaaaattatttttgtaaatatgttaataaaaaaatgtataaataaaaaaaattcctagtttccctggatcattcggcttgggaaaaagtacaccgaaggtccctcaacttgtcatcgaattacaaaatcgtccttaaacagcaaaaccggatacaacacatcccccaacttacaaaaccagtgtagactaggtccctcggtggttttgactccagttttgtccgacgtggcagctgactcagcgtgggacccaggtgggtcccacatgttagccccttcttcccctcccctctctttctccctcttcttttctttctctctctttgctgctcagttcggcaagcgggagtccggcagtggcgatgggagacgaggcgac

SEQ ID NO: 34428 - DNA, 715 bp, Oryza sativa
ttttttagctttatgtatattatttcctttagagttttgttccatctatggttgttctctcttttttagttccattggtttctttcttgtattctaggattatataaattaatttatctattcaagtagcatggtgaaaatattagaaaatcagcaacataagaacaattttgatacagtatttcagcaaatctaagaagtaggagtataaatatgagaatcaatgaactttaagaagataattggtaagcacatattgttattacaatccttcacctctatttacattattctttacttttatgtgcattcaactgacattcatgtcagtattattacgtgtctatgtataacttcttaactttattgttgaatattccttactgcatcctggttgttcatggatctatatactgtatggttctggtagttgaagctggcaaaactgactacatgagcattatgcgtttaccatgaaccttactatgccaattctggaactgtttactgtggtatagatgcagtttacgtagaaatgctttggcaggattgctgctgcttacatgatctgtgaagtaggctgaatgtcttcagattgcttattccagtgcatagctcttgcatcttattctgtgaattaccatgtactatctgaagttgtgaattgatctgcatagagtgtttgcctttattttatagatgccttcttggagac

SEQ ID NO: 34429 - DNA, 455 bp, Oryza sativa
tccacacaaatgatttaaaaaaattgctaggacaaagttgcacaagattggaacatgaatatcaaggtgtaggtctatttcatagagattgaagcaaagggggaaactacccttaacccaagaattgaaatagaccgatttgagagaatgcacaagagggagagtgatttaccggttgaaggagttgaatcacaccaagaaactaccctctattggtgaaaacctaagaacacctcttccttcacctagggttccaagccatggatcacaaactcaataaaactcaaacaaatccatggaatagagagaggaagaggaggagattcacttacggtgtaaccggagtgattttgacggttgaaccggatggatttggtggagggaggtggctagggtttgggaaaagagagaggaggagttttttcgagttggagaagagaagagatgagatggga

SEQ ID NO: 34430 - DNA, 1501 bp, Oryza sativa
ttatcttcttaaaatatgtttgcagctggcttataacctgctattatacctactctaaaatataataaattttagccttcaacatatgtgattatgaatagagatataaaaaaattggtaagaattagtactgtatattcaaaatctaaaagtttttgtatcttgtaatggagaattacatggtaaatcaccccaattaccttactctcatcctcacaatcactcaaaaaaaacagggtaaatacgtgctgcgagtggcaaggccaagaacagagaacgcatttgattaatgatgattagtactaatagattagcagcgggaggtagagatccctcgagacagtaggggattaggacctaattaacccctaccgccacctacgactacttttttactgtttattattatttactactattgttattataatttactcctactagtactagtcttttcctctttagttgcctgtcccttctccagttctccctcatttcgctttggcttcctcctcgaccaaaagcgcacacaacacaagcaagaaagagtgagagacaagcatgcatacattagattagtgatgatacaagtagccgccaagagcattttagtggaggagtattgagtgtgagggaacctcctgctcccccaattcaatgtcctcctcctcctcctcttgctccccttccacttcctgggaaaaagcctcttgatctcccactctctctcaccctctccgcttccagccgacttccgccctgcaggtaaaggtaagttcatcttcttgatcctacctttggattcaccttgggttggcggctgatgcggtaatgctactgtttcggtatcttaagatgcgattttttcgggctgaatgaatgtggctagttcgtctacggcgaagaatcttcgcttgttgcagaaacaaaagattcttcatttccggctgaataatttctccagtttgcctcaacaaccaaaaccccttgcttttaggtgtcttgttcaattttcaccattttaggttgccaactatttctcttgtttgtttcttgagatctgttatccatttgcctcgtttgttattctgaacggagatataaaaatttcctatctggagcatatagaatggaagcatctagagttggtaggggctcatcatcttcttagttcgcttttcctttccctttgttggtatggtattctcttttgcctcccacgagaacaaagcgatgtgacatgtgcttctcatctatttttttccccaattcagatcgccttttctttttctttttcccattctcctcttctttttgacttaagatgcacatacctgacttatgtttcttcttgtgaggtcaggattttagaggatttaacaccatttgcgtccttttgttcatctagttgcagtgcatttcgttccatttattctgttcgactagtacaaattgtggagcttaatctttcaccttgtgtccacatgttaggtttcagcaa

SEQ ID NO: 34431 - DNA, 1501 bp, Oryza sativa
gaatcatcctgatccactaggatatctttgtaattcgagttactgattgtcccagaaatgtgccccagaaaacactggtgctaagagtttaagcttagactttatttttatccttttaaaagactactgcactacagacaaaataaacaaagtggtgttcttgaagatagttaggtgccaaaaatttattgcttgtttatctgaccaacataaagttcatcaatattcagcatatgatcttacgcatcaaagtgatgtcagttgaactgttgagctgactaccccaattggtgtgctgataaatgttctatactctgttcctaacttgttttgattttgctgactaaatattagataatggacagcttggctgaaatgatcatgtaaataggagttggcaaagaagatgtaaataggagttggcaaagaagagaagattctgacactaaggccttgttcggttcggaagggattgaagaggattggaggggattgagagtgaataattccattctacaataggtgtggaacaaatcccctccaatccttttctcatggggattaaccgaacatggcctacagggttcttgagttatgattactagtattaccactggtactacatagtcctgaactcctgatgtataaaaacaagggtaattaaaaaacaaatcctgaagtatatgtggagcagaaaaatacatatacctgaaaatagacacatgaaaggatggcaacacagctaatcgcatgatgtaaaaccgtgacagataatgtttattgggcagtgcgatacaacaagatccacagggagggaccaaacaaatcaagctgcttggaatctcccacgcgttggggtcgttcgattagtttagacgcccagataactgtcgcatcgaatcgaaatatcaaacggaaatcggactgcgagtagaagaggagcgatcgactcaccgtgcgtgcttaaggagggaggaagcgaatgccctagcgacgggggagagatcacccaaactcctcctcactctcactctctctccgcctcgccaatgcgcgcggcggcgacgaatgtctcagaaaccctgtggaattccccattttccaaatcacgcaactgttgtagctgtagctgcggaaaatcttaaacttactttcctaaaaaaaaagcctcaaaaagggtgatttggaattccccaaacctgaaactaatttttcttaaaaaaaatatctcacgttttgtcagtaatctgaggataaaaagacctacatacatataggtaggtctaaattgttgaaggaacatgtatatagtcatacgttaagttgcatcttatggatttcatgagactttctctggtatagacttatatgtatgcgcctatgctatgattcatatgcatttgtgatggctatttcagccatattttgttcaaacttttgtatgaaacaaactcgtgcaaaaactgatactaaaattatcaacggaaggacagtacttgag

SEQ ID NO: 34432 - DNA, 1501 bp, Oryza sativa
ttccgaaggctccccgtgtgccaccccttcttgttcagaaatttcatccccatggctgatacccgctcttctctccctccttccctctcaacctcgaaaccctaaccctagaaatccccgcggcggctttgccctcttcctcctcctcctccgcgacgcgtcggcttcgaaacgagagagaagagaagaaaggagggagatagccgccgcctcgagccctcgaggagacgacgaccaggggttggttgatttgtgggacgagatgtagggtggggcccaccacgtcagtggcagtagatgaagtatatgcgctttcatagaaggaaagcgtattatgttggattttaatacgttttccagggatgaaagcgcatttgaagggaaacagggggatgtttggtttttttttttttgaccgatttcgctggtcgtatttgcgatccgcgcaggtttcatatacaagacaattaaattttccttttttttaacttaaaaaatacccgtacgttgcaacgggtgaaaggttattttaatcgtattattgttagattgttttgtctaaaaagtatgtgtttttttattttgatagtattgatatttaatttgaaatccttattgggatgatggccatatcatgtatcttactttcttataacgtggcaagaattctcaagcaattaggagtccgactcacatatcaagttagcatattaaaatgatttcttatacgactctttatgtatttaaaaaaataaacttaaaaaccgactcaaaatacggacgacgtagtatcgatgaaaacattttcaatttatttttataatagtaaagaagataaagatagaaatagagattgcaaattttagttaaccatgtgctcagttttacattgatttttattttaatatccttataatcactattacgaacttcacttgttctaaatcgatcactgatgtggatgctatgtccatccatgagtttgattacgattgggtttcacaccggtgccttgcatggtttccatcgttggtagagtctcacagttttaaaaagcccttgtccgttttaacaaaatgtctgtgtccgattccatacaaaatatgatccatgaacttaaaaaacgactcaaacacagacgacgcactaaaattttagcaaaaatatcttcaatttttataatagtagagatagagataataggtaaccagctacaaggtttacaatacatccgattgcaattaacaatcgaaaggatgatgagaagacataaagacggtttgaatagaagaactgatatgaaatttacatagtttgacagaagcataattcaagggtgattcaaaagagagagatttgataatttaacacttcttaaattgggcttcgattatttgacatcttggccatctacaaagattctgaagaaaaggtgttcggttgtaaggatgatcaaccaagttggcagacaaggtgcaaaattaggaagcttttatacttg

SEQ ID NO: 34433 - DNA, 235 bp, Oryza sativa
aggtataataataataacggaattggtgatgacgggcgggcacagagaagaatgaattcggggaaatagaggcacagagatgagtcaattggagggaacaacaacaaactaagaattcaattcattgaggttgagggagtaggagatgagattcatcagatccctaagtaactagcagcggggggtgattaattcccgaagcctaagccgtaatcaagtgatttgggggtggaga

SEQ ID NO: 34434 - DNA, 241 bp, Oryza sativa
aagcaaatacacttgactcttggctaaacaaccctctaacacactagatggatgaacacaaagctcaagtgagtgtgagagaggtgcaaagagtgtatgcaattgaattgggtgccaagagagcccccttgctgctggtgggggagtatttatactcccacccaccaaaactagccgttgggggtgaaatcccccaactttgtgctctgccggtctgaccggaggtatgtggccggtcaga

SEQ ID NO: 34435 - DNA, 181 bp, Oryza sativa
tggcttccagccacttgtcgccgtagcttgtcgtgatgttggggcccggtggcaccttgggtggcccgcaggagacggcggacaccatagccgccaccacaacacaggcgagtagaagggaggaggatgccattgctgcaatataatgttattgctggtggatgatacagctgaacgccaa

SEQ ID NO: 34436 - DNA, 1501 bp, Oryza sativa
aaatttatagaaaaaaaatattttcaacccaaaacaaatttattataaaaatatatttaattattgatttaatgaaactaatttggtattataaatattatagtttgactttgatcaaaatcaaaacgtcttgtaaactaaaacggaggtagtagtatttccttcatttcataatacaagttgttttaactttttttaattaaacttcttttaaattttataaaatttatagaaaatataggactggtttggttttaggcctaaattaggcttaccaatatttggcaatttcaatagtgtttagtgtctatttagtttgaagccaaattttggcatgcctaagaaaataggccatttcaatagtgaatttaggctattttgacttcaatccaaacacaactttgccttaccaaaattagtcatgccaaaacttaccaaaatttggcactgacaaaaatttggtaaggcctatttaggccacaaaccaaaccaactcataataatacttttaacacaaaacaaatatattatcgaaatatattcaattttaagtttgataaagtttgaaactaatttgatcaaacttgataattttttactaggaagaaaatcaaacaacttataacatgaaacgaaaggagtagtttagaatcaactagatataagtttaatattaaaactaaattatataaatatatgagttataaggttatctttaattttctttttctatcgcttcttcacatgatagctagtacattatattaaccatgtaaagagcgggctcttacatgatagctaatacttttctcttttttttcctctcctccatatataagtttatagcatactattaaacttgctttaagaatttgtttctctattttttttagcttttactctctcgttctctaccacgctttccaaactgttaaacgatactacatttctctataaaaattgaaaaattgctagagaaaaacatattaattaatttaatttctaattttttaagttaaacttaattagtcatgtgctaataattcgcattgttttgcctgcatggagaaaaatatcccaaccattccaaatgaacgtagccttatccaccttagctaagatacctaacggtttaaaattgatttgagatgttttttttatcatagcttattttttactagtgttaactttgaatcattatgaaaataaattgctttggtttacaccattcattttctccatggtttattagccgtatgcctgtaggatcgagatatcgactagagggggggtgaataggcgatttaaaactaaataacacctaatcaaatctaacctaagttgctaggcttggtgagagtgaactctaactaagcaactaagttatgtttagcaaacctagggtgatagtggctcaattatatctctagaaaagtaaatcacgctcctatgtcaatgttttgcaatcctagggtgatatgatctcaagtgtgtctctaga

SEQ ID NO: 34437 - DNA, 227 bp, Oryza sativa
tactgtcagtggcggtctgaccggccgagagcctgcggtctgaccggccgaggaccgtcggtctgaccggccgtgagccgttggtctgaccgacttggggcttgcggtctgaccggccttggctctcggtctgaccgcccctgacagacagcactcctccttctcccacttcactatgtggcttctaaaattgttgcttatccatcctttgctccttgtttttcagc

SEQ ID NO: 34438 - DNA, 1501 bp, Oryza sativa; identical to SEQ ID NO: 34424

SEQ ID NO: 34439 - DNA, 1501 bp, Oryza sativa
acttcccttccagttctttcttattgaatacatgttgtgcaagtgcatccttcaggatccacctgaggatatcctccaactccttcactggcaaaaaaaaaagctcttgcaggctctgcattacaggatcagctttcaccactctcccaaaaaaaaactgaacactttcctcatggcactggaaaccttctctcaattagtcacctcatcagggattacatcggtactcgatctcatcaaacacgctgtcttgtcagcagcttcgacagcataacgaagctgtcaaagccaagattgcaggccagggatgagctcaaccttgccatcctcagcagcagacaaccaggctctcaatctgtgaactggactcatccagtttctcgagcttacttttcatgtctttggaccaggatatctggtccttgccataatcggatgtggcgtcgatgatcaggtgcgaagatggtttcctagaaagcaataatggtgactggcctttgattaatgccaatggctcttctaaacatatagactaaacttgcagagcgaagaacaacctactcatttttcaaatctcagcatatgcctttgattaatgtcatgatgtcacatgctgagattcacagcaacaaacatgagtggttaatacttaatacatcacaatctttttcacaaatcatgatgtcaatcgaggtgctatcatagtactgtatgccaaattgtgtgcaaagaacaagaaatacaggagagatgagttagggtgtgtttagttctttgggcgtaaagttttaaaagtatacggacacacgtttgaagtattaaacgtagactaataacaaaacaaattacagattccgtctgtaaactgcgatacgaatttattaagcctaattaatccgtcattaacaaatatttactgtagcatcacactgtccaatcatgacgtaattaggctcaaaagatttgtttcgcaatttacatttaaactgtgtaattgttttgttcccacatttaattccccatacatgtgtccaaacatttaatgtaacgtttttggccaaaatttttttaggatctaggccttacatagaaaaaacccttaaatgatggctatagtgtagtaaccgcaatctgctagaaaataccaatttgcatcgatgccctaacaactaatttgaccaccagcgatacataaattgcaagttgggcaaagcgcccaaaataactaagcacagcgatcaacttgggccttgatgggccgtagacgaagaaggcccgctagttcatgacacttcgcggtgggttgcgcctccacgcacgcacgcagccgtggaactctctcctccctctcctcctcacctacgcatcccgcgcccatggccgccgccgccgccgccgcctccacgccgccgtgctgagcccacccccgagagacctagctcacgccgaggacgctaccactccggcgcgggcggcggcctcgggatcggggcggatcaga

SEQ ID NO: 34440 - DNA, 627 bp, Oryza sativa
gatgagagcaagaaagaaagaaagaaagaaagaaagaaagaaagaaagaggagagaggttaatttgttacttagaaaggaaaggctccaaggatgactcgggaccacaattatactgccaacacctggttgccatcatcacccttcaccccatatgcccctttcccatttttcctatttttattttaccatttttggttgcgcctgtacgatctttcttgtggtacaccgtaaaccgctagtttttatcgtaaataaggcgccgcagtttatggttttctctcaagagacgctgtcacaatttttatatagtagtggatgatggctatagtcatcctaattttgtagtcattttctttttctcttagttcagtaaatcctagcttgtaaggcttagagacggaaagatggtctggaaaataccttacacatgtatagagataacactttggtgatgagttaaaatcaagtggagcggcgctacaccataccaatatacaataccaagcaaccttattttatatatgataatcttcaactaattcattgttatttattttgtttaccacaaaacaaattttaaaaggttaactgttgtgataattaattaaggcaactagacaagaca

SEQ ID NO: 34441 - DNA, 1501 bp, Oryza sativa
ggatagagctccaaatcagacgtccgatttccttaaaaataatcgagtgatcaaatgtcgggtgaaacattaagaccggtttagttcctaatttttttttaagtatcacataggatatacagacacacattcaaagtattaaatcttgtataataacaaaataaattacagattctaccaggaaactgcgagacgaaattattaagcctaattaattcgtcattagcaaatatttactgtagcaccacattgtcaaatcatggcgtaattaggtttaaaagattcgtctcgtaatttcctagcgaaatatgtttgtttgtttttctacttttaatactccatgtatgtgtttaaacattcaatatgaccgggtaaaaatttttattttgagaactaaacagaaaaaatcaatcactgaaacattgaatcactgtaccggagctgcgtgaattgcgtgagccagattagcaaattcgaatgcggaaaatcccttttatctcaagtgccctagggagcgcctgcgacggtgtggtaagcctcctcgcgctacaggttgccacccgccgcctccttgtttgcctgctacttctagtgcctttctcgtcggctatagaggtttttttcatctgaagtaagggaatgtttggttgatgtctaaccttgccataactaagtttatgttagttgtggcatggtggcacaaatgtggtttagaaatagttggccataagtgtggcatatttagctctaaatttgagagcatgacatgtgggttccaatgttaagaaagtgtggcataacacaattgcggcagcgaaccaaatacattgctaaaaaactatggcatggctaaagtgtggcaaccaaccaaacagcctctaagaccggtacagatccacgcgaaccaatttgaagaaagcagtgattcatgtgtgatctctactacattatcgaggattcataacactagtaatctaatcagtaaagaaagccttcttttgctttcacgaatatctctacaaaaaattgagtcatactgaataattaaatttcagagttcagatgcggagatgccgctcaaaacgatatctatcacacacagtaattttgcatcttggatgtagttctcagttgaagaatcctgcacccaaaaggatccatggctgcacaccgtaggtagctaattatgctgctctcatctcctactatcaaattattgattcccattccaatgcatgactgaaacttgtgcagaacttggacacaaaattctagtgttacagacgaaagaattcgatgcatgcgttactctatcggagcttgaacctgccgccgcgccgcgcgtgctcgttccgactccgactccgactccgactcggactcggactcgagttgttaaccaagacggaatcggatcggatgccacccatcctccataaatcaacccaagagcagtacacggccgagcattgagttaacagcaaattaaagcagagagaga

SEQ ID NO: 34442 - DNA, 1501 bp, Oryza sativa
tagcgcataattaaagtatgtattataaattttaaaaatactatataatcttttttacagaaaatatatagtttagcaatccagtaaacatgctaatgaaaaaggaggaagttatttagaactcagccaaagccatttatcttttctagaacctctactacctacaattgcctgaactatctgcttttttttcccccgaaagtaaattgagctacaataacactccattctcctaacaaaagcaccaaaaatgtttcatatacataagcagcaaacaccatttgtctcatgttcctgccatttttacatctgaggatgctgctttggcaacctgcccatcagctgctggctagctgctgcaccagcattcccagactgtggcagcaagttcaccttcatctcacctctcggcagcacaagccctgggtacccctgcatcgccggcacggcgatcgccggagacggcgccggagttgcaatgctacgaggcagcattccaaaggagaaaccagctgctgctgcaccaaactgctctgctggtctgtgaccagctgagccatagccaaactgagcaaggctaccaccaccaccaccttgtgccggttcaggtctccggtgaagaagaccattggtagcctgtggtgcagcggctgagcctgagcttgggtggccactgttcctggcagctggaacttcatggttgtgctttccttcatacgtcgtgatgacggatttcagatcatgcgatgatcgctccacatgcttgcgcaccgagcaacccggatgagtgcacttgtagtagctcctgcaaatacaaaatggagttttttagataatgcgagtaatttccggtctttgtaccaactatggatgcacacatatggacagagaaatgttccttcgatgacagtgtcatattgtgaagctaaacatttacttttgtagtgaaggattagaggaactgcaaagaatttgttccaaaagagaaaaatggcattagaattgaccttggatttgggtttcctttgacaactttctgcccatacttgcgccaacggtaaccatcatcaaggatgtcaacctcacttgtggtctgaacaacaacgcgaggctcccggatagctcttgacgccacagctcctatgtcgatggcgttggtgctagtgctagtagcggcataaacatccatctttctgaaatgaataaaattgaaggaaaacaatcagctactcaaagtgaagattggttcattgagtgattagtgactaaggctagccaaccttctcttgtgttcaacatagtcatcgttcgcatcaaagcccagagaaagcggggcacgatgcgttaccctatcatcctcttcattggagagcgtcgatgagatatccacagcttcttgtttgtccataacagatttttcagcatgttctgttgtcgtaagagaagcagacagttttgtcagaacttcactaccgacatcttggaggtgtccatttgcggc

SEQ ID NO: 34443 - DNA, 553 bp, Oryza sativa
tgatgagatctataactttgtagtttatcacttttccatttaaaatcatttggagtatcgaataagcattattagtttttaagcaattaaaaccggtgggaagggtttgaacacaaataaaaattttgtatttaggtcccttgccgccctttgagagggcgatttttaaaaatcgcccttcttaagggcggcaggcaattagatttgtaaattttcgaaacaaaaaattatttttgtaaatattttaataaaaaaagtataaataaaaaaaattcgagccgaggcgtcaccctagttttgcggtggaggggtacgaattagactgggtcaatagttgagggagttgcaatgacttcattctaacgggcctgcacgtatgctacagttgtgcgtaaggaagctacagtccagttctggcccagcccagcccatgtagaagaatagaaggtgacatctttccttcctccctcgcgggcggaggcgctcacacgcaaaaaccctaaaaccccagtctacccttccttccccgccgccggcagccgggacatcacca

SEQ ID NO: 34444 - DNA, 1304 bp, Oryza sativa
agtttttacaactaaacaagttttcaaatttgcttcactagaattgaaatcaaccaaataaagatttccatatctaaaacctttgaacacacaagacttgtcaagaaggctagaaacaatgacttcttgtgggaagaaggcacatgacaagccaagatcacaaatttgagcaaccgaaagcaaattgaaatttagagatttaataagagagacattttcaattgacaaatcattagagatagcaattttacctaacccaattacctttcctttgctattgtctccaaatgtcactttctcttgttcattccctcctacttcaaatgtggtgaacatagccctatcaccgatcatgtgttgagtgcatccactatcaagcacccaatggctcccatcggtccggtagttcacctacaaaagaagatcaagttcttttaggtacccaaacttgtttgggtccttggaggttagagaccaaagctttgggcatccaaatggcattgtttttaccaccgagtatagggaaacccacatatctagcaacaatgctaccatcatgagcctttgtaagcatataatgagaatcaaacatgcatgtcttaggaggcttacctccggggcaatcactcaccaaatgcccaacctcacgacacttggagcaatacttaccatttctcttgacaaaacgagtggcatggtgagaaggtttcttacccttctttggaatgaatccaagtccctccttgttaaggatgcaccgttgctcactcaaaatcttgtcaagagtgttcttacccttgaagcatctctccaaactcttgttgagcttagccacttgctccttaagctcattgttctcaacagcaagtgaggcatcacaaatagaaacacaagagctagaactagagcaagggctaggcatatccataagatcatcacaagaggtagaaatgctagatgatgcaacatgagcaatatggcaagtagcactatcatcaagcaaatcacaagatatgccaacattaatgtgagctccatgttgagtagtggaaaggaggttgtcatgagcttccttaaacttctcatgagaaatggtgagtctctcatgagaggtctttagctcctcatacaagaccttcaaagaagcatgatccttctttagggccttgaacttgacaatctccttctcactataagcatggagctcctcaaacatactcacaagctcatcataggaaacatcatcacaatcatcatcactctcactatcactaagagatgttaccttagaggagccctttgcc

SEQ ID NO: 34445 - DNA, 1501 bp, Oryza sativa
tgatggatgcccttatcaactaccactaaatgccatggcgccgagctgaagagcccgctcacatcaagctgcaccacaaccatgaggtggcggagctcctctctagccgcgtcacgtgagctacacaccactctttggtgcccccttctcctctcggtggcaatgaggtagccaatagcaatggtgataacgacctcagtgccttcgtgagctgcacgatggcacccaccatcccagcagcttccacgcactcctcgggacactcgaacataagcatcccccatgccctaggtatggatgagctaccgcgtggcgtccaagacttttatggtggaggtgggagggggacgcaaaggagcttgcggatgcagcggccgttatggaaagtccttgggcttgccaacggccatggactggtcaagctacgaggacaaaaagataaagatgatgtgacttttctatgcggtgtgcaacggccatggtgctaggtagacatcggccatgggggttgcgccagagcgacaaaaccgaggcaacaaaggaggtgaaggttgctaccttcccacactcgagcccatcatcagctcatcaccaatgagcaagccggagttaggagataagcttgaaaaggagagtcagcggcaattttattcgaaatattccctccatccacaagagttagatttatttcatatttgagttttttcaaataagttatttttatttgtagtctttatgaatttaagatttaaatgaagaggtaaattaaatgcttgatcataactcgatgagttattttaactagtaatatacccgtgctaaacgctacggtgcaactctatttgtctttaataatttttaaaattttcatgtttagcaaaaaatattattatattaactgtgcatttgagctttaattcaatttatatcatacatcaaatatattgcaagtaaaatattagaataggatataccaatatatttgtgccccatgtcataatgcataataatatgatattaaagatatatgataatgcatatatctgtgccttaagatatatgataaacgtgacagatcaaaggcacttaggttgagtattgcatataagtatttataatgggtattttagttgttaatgggccattacaggatttggaccatacacataagtttgacatctagcagtcctttactcctttatcatgactgaataggcaacataatagcaaattagcgatactggtttcttatgttaattatatttgctttttttttatacgctttcatgttcataaatcaatattcatgtgattggtcagctctttaaattaatggagccctgaagcaaataaaatgtgttcgatctaaagcaaaagaattacatgtgtttgatctaaagcaaaagagttacagaaatcaatagtgctacacaacgtcagaaaattggccgacctaatttatttatgtgagatctaaaccacaattggtgtgtgatgtctc

SEQ ID NO: 34446 - DNA, 1501 bp, Oryza sativa
ccatgctcatcaactccgacatgtcaagaatgacacccgcaagcctcttggggaagatcaacaccaatgacatgtacaagctgaagaagaaggagatggaggaagcctcaccctccaagaagtgcattgctctccaagccgaagttgaagacaagagcaagagcaaggtgaatgaagtcaatgaggacttggaggaagagatggtccttcttgctagaaggttcaatgatctcttaggaaggagaaaggagagaggaaggggctccaactccaataggagaagaaatagaagacccaacaagactctctccaacttgaggtgttttgagtgtggtgagaagggacactttgcttccaagtgcccttccaaggatgatgatggagacaagtcatccaagaagaagagtggaggctacaagctcatgaagaagcttaagaaggaagggaagaagattgaggctttcatcggggaatgggactcaaatgaggagagctccgcctcatccgggtccgaggaagaaggtggtgatgatgcaagctccaagaagaagaagatggccgttgttgccatcaagaaggctccatcactcttcgctccactttgtctcatggcaaagggctcctctaaggtaacatctcttagtgatagtgagagtgatgatgattgtgatgatgtttcctatgatgagcttgtgagtatgtttgaggagctccatgcttatagtgagaaggagattgtcaagttcaaggccctaaagaaggatcatgcttctttgaaggtcttgtatgaggagctaaagacctctcatgagagactcaccatttctcatgagaagtttaaggaagctcatgacaacctcctttccactactcaacatggagctcacattaatgttggcatatcttgtgatttgcttgatgatagtgctacttgccatattgctcatgttgcatcatctagcatttctacctcttgtgatgatcttatggatatgcctagcccttgctctagttctagctcttgtgtttctatttgtgatgcctcacttgctgttgagaacaatgagcttaaggagcaagtggctaagctcaacaagagtttggagagatgcttcaagggtaagaacactcttgacaagattttgagtgagcaacggtgcatccttaacaaggagggacttggattcattccaaagaagggtaagaaaccttctcaccatgccactcgttttgtcaagagaaatggtaagtattgctccaagtgtcgtgaggttgggcatttggtgagtgattgccccggaggtaagcctcctaagacatgcatgtttgattctcattatatgcttacaaaggctcatgatggtagcattgttgctagatatgtgggtttccctatactcggtggtaaaaacaatgccatttggatgcccaaagctttggtctctaacctccaaggacccaaacaagtttgggtacctaaaagaacttgatcttcttttgt

SEQ ID NO: 34447 - DNA, 421 bp, Oryza sativa
attttactaagctgattgatctttttcttttaatttcctcctgatgcagtataagattcttatgagctggtcggctgtggttttccctcaattctggtgctactaagatgggtcaggagctcaccacaaacaagcctctcacaaccctcttaccaacggatgaaatagcaaccgcctaccatttctccctcctcctctcacctgtcgtctccttttgggactgcatcttccgcaagataagatactcattcagacctgagtgggtgtagcatcctgcactgcctgtttctttttagcgctagccagtgctttgctttctggcctggatcactccaaacaatgaactttgaagcttttgctttcccgtaattacaattacagtcactagtggagtttagctgaaaatagtacatagttgtca

SEQ ID NO: 34448 - DNA, 1375 bp, Oryza sativa
gagtcacctcctgtgacagtgaatgaattattgaaggaagcacaaatcaacgctggccttctccatttttggctcttctgtctctacttttttttttctcttttacaatagaaatatagtacactaccaccattcacgcacatggaaaaaggggaaattttattattttttcattctatttatcccataatataagatattttagtgtgctacttatcgcatccatcaactttaatttaaatttttactacctacagtatatattttaacaccaatctacccactcaagcacaaccaaatctcatttaatagggtattctagtctttcttgctatcattaatctactaaaagggaataatcccttatattagggtatatacaatgatgtttaatatccgttgccatgatgtaaatttgatgacgtcgaagagagaaggggaaaatgaaatatggttgctccgcataacaacaactcagagttgattcttagtatttattaaaggaaattttattgcattagagatggagaaaagaaaagaaggatataaaaaatattttggtgcattaatggttactcatatatattagagagcttgttatctgaacaataagagtatatttctctaagtgatgtgtactgtattaactaagagctcgtatggggcggagggagtactatctacttcatacttgatccctccgtcccaaattagatatcgctttcgcttagctttttttcttgtaacgtttgaccattcgttttatttaaaaatttaatgcaaatataaaaaatgataagtcatacttaaaatatttttagtaataaaacaagtcacaaacaaaattaattataattccataatcttttgaataagacgaatggtcaaacgttacaaacaaaaacttgaaatatcaagtattttggaactgagttagtataaagaatgggcacacgactattgtagtatataggatgctcctcttgcgaagaactgtagtatcctatcatcaaatcgtgtagtaatatttagaaataataaaatagcacgacttaataattttgaaattgtaattactaattatcgagttgcattcaagtttgcaattgtaccctttattatgtttcgataattttaaattttggaaccagtaaaaactgagttttgtattctttgtacgtacagattaaatgggatacagtaaatatttcctataacgtgcagattaaatgggatattacatggtccacgatcataatacgtttcatctcatcaacgccagttctttccgattgacacgaagctctaaaaaaatgcttaattactagtagaactataaatggacagttaatattgaatcttgaatcgtcctagc

SEQ ID NO: 34449 - DNA, 1501 bp, Oryza sativa
tacacagtgtgtggtcatcaccctccaatgcacataaaacaaggtcttactagcctattttatcaccaaacccccactttgaaagcactgtttcagatgtgaatcaccctttgctttgctgaatctactcctacatggtgaatactcctaatatagggagcatgcatcaattgtagtggcatgcaacaacactcctatcaggatgtgcacaaagtataatgtgcatacttctcccgtccaaaaagatttaaattgtctagatttatctttagaatttaaatcattttggacaaaggaggtacatcttaagatgagacttaaacggaatattggactcaaatggacatgaagaaaaactcttattgtcttcacgttgtcttatcagccacgatcaaaatttaaattttaaacttacatttagagttaattttaaggttttctattatagtttattttttcagctataacctttaaacaggtaagaacacatatataaaaattttcctaataaaagtgttttatatagtttatttttttccacctgctttggcattgctgctgcagttgagctgtactgttttggtgggttggtttttggccttggcttgcatctcaccattggaaatggtgctggtcttcttcatcacttcaccttgcagttgtgtgccactagcactagcactagtagtagctccacattcacttgctccttttgatgccacactcacacatttatttatttttagggtttgtggtggtcatatgaagggaggaagagggcccttaaactgaacctgtactttgcttgtcatgaaggggcctccacccttcatttcctcctcctaggacaaagatcacaggaggtgggatagttatagttatacccgtcccattcaatggcttgagtgggaaaagctggcctcttttttaaattccaaatccggctccagtctctccttgccattttttttcttggttcttgaagctaaagcccctcatcagcaagtggttctgcatttctgcagaaaacaattgatattatcagtggtttttctgtggcattggattcctgaaggataccttaccagtaagtttttttttctctcttgaaacttctttctttacacatttttttggatgcaaatggaatcaagttgagaatcaatcagagaatctgcaggttattagaacagttctttgtgttctttgtttttttttaatcagatgtgattactccatgtctccatttgctctctttcatcgattttgtgacaaaaatctgttgttttgtttccctttctcccccaaatcttttgataggaacatgaggagcacaagatcatgcagtgcattggagattgcttgccaaggtttgtgatttggtggtagccatggaggaagagaaggaggctgggagctttcttgatgtgcccaaggatatccccattgccgccaccaagtcgctcaccatccgcaccaatggcggattcagcagcagctc

SEQ ID NO: 34450 - DNA, 1501 bp, Oryza sativa
cgcgttcttcttcctcctcttcctcctccagcccggcgagcagctcggacacgttgatcgtctcgatcttgacaaactcctcggcggccaccgccgccgccgtggtgctctgatcggcggcgtccttggccctgctcgccgccgccgacgccgacgaggtggacgtgcggaggagggccaagaactgatcgccgttgctcttcttgggggtggacaggatgatctcctcgatcaggttgctccccttgaatccatggctcaccaccttctcctggaagctccctgatttgctcaggatcttggacgacacgcaccccatcgatctctcccaagctcaaaccaatctgatcaacgccgcaaaatgtaaaaaaaaaaatgttcagaaacaaactgatgatctcaactagggaataagatgagtttttttttttttggtacctgatgaaactgctagtcagagttcagaaacccaggctcttgttggcttgctcagttgctgaattttcaccgggcaatgtgcaaatttgtatcaggagctaagcagcagtagattggtctcctaggggattaggggcagctgattaacacaagaacacatgcagagcactgtgccaagatccaatcatggcataatcaatggttagaatatgagatgaaaaataggatagagaattccaagcagaagagagatcgtggttatagagtcaacaaatggtttttaatttaagatagatcaagaatttgggactgactgactgtgagatgcacaccacaccaacccctgtttgaacatccagtagtcctcggttttggtggttaattgcatctttgccataaaattctatggctttctacaccttctattagaaggctctcttcgtcctagattgtgacttgtgagcctcataaatgtgtcggttttgggttccatgctggaaaaaatcgtgcacataatacgtatgtctactccaaagttgcgatgtttgacacaaaacctgaaactgaaagctttgcagtagtagcagacttacaatcccgttgaaaatcggtttggatttcatcaaatctgatcttttcagatagggtcgaaaatataaacaaaccattataaaaatactgagatttaaattttgacaagctttataaaggtttcattggtttttgtcaatttatcaacgttttttttaaaaaaaaacctgaagatactgcttgtgagcagcttttaattccttaccaaagttgtgaaccttggtaaccggtaagaaaacacataaaaacggtaggaataatcgtttggatagagcataggaaaaacacatgaatcataaggaatatataagacaggatttttctaagagattaaagcccatgttagaatttttcccaaaatttctatgtttcgagtcaattcaaagaaagtttataggatatttattatagctattcctatgattcaaacaatcacgtaggaaaattttctgtagaatcggatttctcagaa

SEQ ID NO: 34451 - DNA, 1501 bp, Oryza sativa
tttcaaaaaaaaagcacagtttactattgacttggtttcagtttcagacttccaggagccaaataaataaatagatacataaaagtaagaaagaaagaaagaaaaaaacaaagaagaataaagaaaatacagatggacacatatgactgttgctatcaatagaagtgtagccatcttgtcatcattattgtccatgtaatcaagattagacgacagtagggtggtgtttatcagcttaattaatccttaagaggagcagtgtgagtaatcttgtctgtacctgagctaatgaggacaaagagcagcatataagttaaatcaccttttgacaaaaaggctatgccagaggaggacattgtatatgtataatgggaaaaaaaattcacaatccagaatccaagaaaagatataccaaaaggtctctcccttgctgaaagaagtttgaaaagtggatgaagactgaagggatgatagttctagtggttgttcaatataaaacttgaaatttttgtttttagaaaaatgaaacttggtcaatatagagaaataatttcttgatgacacttcaatttttttttacaaaaatgaccccaaactgtgctggatatacaccgttgctccgtatccagtaaagggacttcagcctaccaaaaaaaaaacatatatattcatgtggcctgttgggttagtattgtcaaccggatctgattaactaaacaatatttattccagttttaagattctttggcacttgcagatacaaaagagagacaattttgtactgttgtaccacatgcatcttgtgccctcatctcactctttgttcatgctctgtcaatataggtatttagagccatagtgcctctcaattcaactttataaattaaagcacaaaacaactaattagaaacaaaaaatgctactcatttatccaaatcccttagaatatggaaatatatgactcttggattaatcatcatttatctcattccgttgttaaaaccaaatcacataatcttttttagaaaatactggtggtagctgtgaatctgccaccccaccgcccacctactcctaatcccattgtattatttacaaattaatccttaaaattcttaatataaaagacaatcaaattcaaaatgaatgaatagctgcatacaaaatcatatgtattatttatttatttattttacacggtattataatactttttattcattaattataaagctcagtagtacatagaagaatatacactcttattttttttaaccttgagtaatttcccctatcataggattccattatccaaaagaagaaacaccatgatagcaatcagttagactaacaccccaaccaaaccccactttggcactttataaaatactaaaacaaatactttttttcttcattttcaaccccaaatctccaagttaacaagaccatacaaatcatatgatactccactcaacaagtgagaagagacctcaaggagtag

SEQ ID NO: 34452 - DNA, 1501 bp, Oryza sativa
ttgttaacacttttatacatgttataataaaaaataatggtcaaaattattttttagagaccgtgcccttatccaaaacgataagtattatcaacccagagggagtaaacgatatgttttttttaagtactagtgaaccgctccgttttccgggaaaggggcagcaacgaagacagccgctcgaacggatgcatccggctcggccggctggctaagcttcggagcgatccggtcgttttcgggctcggccgactggctccgcgcgctcgttttcgcgtcgacttggaaagatttggtcgctagctgttgaccgagcgatgtcgctggcacgtttgctggcttgtgggaatattattgactcgcaagtcgcaatggagggcgttggttttgagccacaaaagtcatgtaaatattcaaattgtttgtgtacataagttggtgtgtactgctccatatattattgcatccggtagacgactttccacgcaggtttgtatgattggagtgtacatgtcttcatgctatgcgcctaacagctgctggtacaagtagacacatgagttaacatgaccattttatttacaaccggaagttgaaccggatgataataaaatcgagcaagacaaaagtagtgcggcctttttcgccttcataccgtcttgtttcaagcaattttcagtagttaacacttgaaataacttgaagcaatgctcatgcagcaataacctaagtaatcttttcatattatttaccgaatcattaaaatggattatttattctgctcttcaaaaaaaatatgttttctcaaaaaaaaactttcttcttttgtttgttcagaccacttgtttttattttttttttaaaaatacctaattgaattgttcctatattcaagtagaaaatctacgatagtaaactgaataatgtaaatcaaacagaaaacatgaaaacaaaatatctagaccgctaaaaagaataccagcacttgtttttttctctatctcgaaagataaagaaaaggagaaaataccaatagtagtaactgttcagtttggcgcctctgttctgatgtgcactacgcctctagccaccgagacaggaagccaacaagacacatggcgtgcgacgttacgtgaaatccaccctgatctctcggctcgaccgcgcgcgcgcggcgcgcgagatcaaaggcagcaacggtagcggtcacaaatcacagatcgctttgagctcgattgatcgagataaggctgtggcccgatcgaaaagctcgctgcacaccatggaccccggccgggctttgagtggtcgatcacacatatcactagctgcatacatatatatcacacacaccaccctttaattcccaatctaatctactatcatgctccttttgctaatagattattgcatgcctaacaatgaccgctacacacaaattaaagcagagaaacagatagctagctagcttagctagcagctccaaaaaaggggcaatgac

SEQ ID NO: 34453 - DNA, 1501 bp, Oryza sativa
tggggataaactaaacacggcagtagtcgggtggctaagcggtgcctacctcgcctagcacctctttttagaaacacacacatattatgtagtcaacagtactctcctgtttcaaaaaatgtatgtctagattattttataggatttgagtttttttagacaaagggagtacttcctccgtacctgtaaaggaagtcgttttgtacagcgacacgatctccaaaacacaactttgacttcttgtttctataaaaatatttattgaaaagttatatatgtatacttttatgaaagtatttttcaagataaatctattcatataatttttacattttcaaacttaacaactttagagttattcatgatttatattcctaaggtttggcttaaacattatcctaaacgactttctttacgagtacgaaggaagtatatatcattataatttgcacctacttgttataaacgtaaatattgtgatttgccactcgaatgacggttctagttgcatttttgcaattttctagtggtagttttgcaataacgattcaaagtagtggtaaatttacaattgcccctaatttttagaccttgattggcttctttcaggctgctcaagtgattggattttctctaacagccctttcccatatggagctgattttttgggatagtttggaatatcccattattcaaacatgcccttagtatctcctgttcgtgcaggtagtacatcgtatctgctccgtgagttggtttcgtgcgcatcaattacactgtactccttctatagtacaagaggagattcttttttcagaacaagctcaaattctaatacaagtaggatgatacccaaggtccgatacaaggagggtggcgatactgctgaatctacatgtctattctccacaaagaagccaatcaaggtttggacttaggaatctcctcaactaccatcattaaaaagacaaagtgggcataaagaacacgaaaaactcaagtcatgtatcaggcctatttattttcttttccttcaggacaaaccaagacatgccacatctatgaagagaagaaaagttttaagtaaaaactaaggaagaaaaggcgcatcacgccacacacaaccatatcccgtgggccatcttgcgagaaatggctgcctccggcgttgactcggaggctttggctaccctgctcccctcgccatttcattggccgtttcgtggccatccatcacgaactcgatcgattcccctcttcgagcccgtaccaattattagctagtttaactcgtacgatgaatcacgccgaaacacaatataaatggtggagtcggctcgctgtcaaacgcgcgggagctcgcgccacttgtaatttttcgcgtctcctctcgtccggcacagcacaggagcgcggacttgaagacctcaagtagcgattcgtccgtgcggcgcggcgcaagaagggaagggaaggggactaggggagggcgagatggcgg

SEQ ID NO: 34454 - DNA, 1501 bp, Oryza sativa
cactcgctgtcgtgaattatgataggccatctgtcacccaccaattcacttactgcacaattttatcagatgaagcagcatgatcaccaacctaaacatcacaggatcgaactaagtagtaactaaatacatccagaccaaaccaacagtacacaaacatacatcgaattacttccgttttaacttttaagaccagtcaaacgaaattgcgtcgtttccaccaaacaatcacatcgcggaggagaggaaaggggagcgacctaaacggcgccggaattgatccatccccaaccatcaaccagccacagccaagcctccgaaccgcgagcaaaaggccagtagtagtagagagcaagtgactagggctagggctaagctttacctgcgccttggacgactggccgaagatggcgttggcgaggttcccgaaggggttggacgacgacgccccgtccggcgcgcagttgccctgcccggtgatgaggtgccgcatcgccatctccgccgccgccgccggcgagaggcgttccggtcgaggtcgaggtcgaggagagagagaggagtcgtgcagcgtcgcggtggctttgtgggaggggagtagtagcggtaagcagttggaccccgataagaccaggacacgtgaaagatcgtgctactccatatacgtatggctggtttggttggttgagaataccttttctttttccttcaaataattttaattttaatttaattttatctttgtttgtttttttctcgcggtgaaaacttttgttttttaaatttagtttctatacgatgcgagaagggtggagacaatcgattagttttaaattcgtttcgttaagttccacgaaattgtgaccgaattttctgagagtctcctaccactgaataggagactttgtactgtgtctcacagaaataaattttgtccggttaagttccacgaacttcccgtagaatatcagagattcgatattgggtgatctttttatattgtagattgtaaatttgtcctcatgaattttgacattttgtttattctatttgatcactcatcttattcaaaacatttttacaaatataaaaaacgaaaaaatatgcttaaaatacattgaataataaagtaagtcaaaaataaaataaataaataataataattattttttaaaataagacgaatagttaaatagtaagatatgggtacgaaatttccgagggagtgagcggaatacactgtaccagcacaaggatttcctctaagcccatgggggcccaagtaagcccaattggcccaacacgagacgcatacgtacaacaaagcccgagaaggaaacctaagcacaacccaaaaccctcccctctctctctcgcctcaccaccgccgtcgtcgtcgccgccgccgcaaccctcgccgccggcgctaggctcgcgactccgacgatgtcggcgccatccgaccccgccgtggccacccacccgcaggcgggcgccgccg

SEQ ID NO: 34455 - DNA, 1501 bp, Oryza sativa
ccgccgcgatgacggtgagcgcgatggcgtcgaacgcggcgcagagcttgcggatggcgccgagggagagcatctgatccgccccgatcccgaggccgccgcccgcgccggagtggtagcgtcctcggcgtgagctaggtctctcgggggtgggctcagcacggcggcgtggaggcggcggcggcggcggcggccatgggcgcgggatgcgtaggtgaggaggagagggaggagagagttccacggctgcgtgcgtgcgtggaggcgcaacccaccgcgaagtgtcatgaactagcgggccttcttcgtctacggcccatcaaggcccaagttgatcgctgtgcttagttattttgggcgctttgcccaacttgcaatttatgtatcgctggtggtcaaattagttgttagggcatcgatgcaaattggtattttctagcagattgcggttactacactatagccatcatttaagggttttttctatgtaaggcctagatcctaaaaaaattttggccaaaaacgttacattaaatgtttggacacatgtatggggaattaaatgtgggaacaaaacaattacacagtttaaatgtaaattgcgaaacaaatcttttgagcctaattacgtcatgattggacagtgtgatgctacagtaaatatttgttaatgacggattaattaggcttaataaattcgtatcgcagtttacagacggaatctgtaatttgttttgttattagtctacgtttaatacttcaaacgtgtgtccgtatacttttaaaactttacgcccaaagaactaaacacaccctaactcatctctcctgtatttcttgttctttgcacacaatttggcatacagtactatgatagcacctcgattgacatcatgatttgtgaaaaagattgtgatgtattaagtattaaccactcatgtttgttgctgtgaatctcagcatgtgacatcatgacattaatcaaaggcatatgctgagatttgaaaaatgagtaggttgttcttcgctctgcaagtttagtctatatgtttagaagagccattggcattaatcaaaggccagtcaccattattgctttctaggaaaccatcttcgcacctgatcatcgacgccacatccgattatggcaaggaccagatatcctggtccaaagacatgaaaagtaagctcgagaaactggatgagtccagttcacagattgagagcctggttgtctgctgctgaggatggcaaggttgagctcatccctggcctgcaatcttggctttgacagcttcgttatgctgtcgaagctgctgacaagacagcgtgtttgatgagatcgagtaccgatgtaatccctgatgaggtgactaattgagagaaggtttccagtgccatgaggaaagtgttcagtttttttttgggagagtggtgaaagctgatcctgtaatgcagagcctgcaagagcttttttttttgccagtgaaggagttggagg

SEQ ID NO: 34456 - DNA, 1501 bp, Oryza sativa
ccgagagatcagggtggatttcacgtaacgtcgcacgccatgtgtcttgttggcttcctgtctcggtggctagaggcgtagtgcacatcagaacagaggcgccaaactgaacagttactactattggtattttctccttttctttatctttcgagatagagaaaaaaacaagtgctggtattctttttagcggtctagatattttgttttcatgttttctgtttgatttacattattcagtttactatcgtagattttctacttgaatataggaacaattcaattaggtatttttaaaaaaaaaataaaaacaagtggtctgaacaaacaaaagaagaaagtttttttttgagaaaacatattttttttgaagagcagaataaataatccattttaatgattcggtaaataatatgaaaagattacttaggttattgctgcatgagcattgcttcaagttatttcaagtgttaactactgaaaattgcttgaaacaagacggtatgaaggcgaaaaaggccgcactacttttgtcttgctcgattttattatcatccggttcaacttccggttgtaaataaaatggtcatgttaactcatgtgtctacttgtaccagcagctgttaggcgcatagcatgaagacatgtacactccaatcatacaaacctgcgtggaaagtcgtctaccggatgcaataatatatggagcagtacacaccaacttatgtacacaaacaatttgaatatttacatgacttttgtggctcaaaaccaacgccctccattgcgacttgcgagtcaataatattcccacaagccagcaaacgtgccagcgacatcgctcggtcaacagctagcgaccaaatctttccaagtcgacgcgaaaacgagcgcgcggagccagtcggccgagcccgaaaacgaccggatcgctccgaagcttagccagccggccgagccggatgcatccgttcgagcggctgtcttcgttgctgcccctttcccggaaaacggagcggttcactagtacttaaaaaaaacatatcgtttactccctctgggttgataatacttatcgttttggataagggcacggtctctaaaaaataattttgaccattattttttattataacatgtataaaagtgttaacaaatatatgattttattaaagtactttttaagactaatctatacatgttattatcatgtttgaaagataaatattttaaaaataattcataatcaaagattctaaaatttgacttcactcttgtctaaaacgacaagtattattagcccggagaaaatagtagtttgaaaagcgtgagcgcgaaaaacgagagcggggagttggtaaccaggggaaatgaactaggatggactcctccgttttcatattgtaggtctttttaacttgtttttttaaacatttttagttcgagtaagattatgaaaaaaattagtaacatcagttttattaaaaatatattttcataa

SEQ ID NO: 34457 - DNA, 1501 bp, Oryza sativa
atgagatacttcacatcttgttaacatttatcgtcaatctttcattgtaaaattgtggggaagaaatggcctatctcagataattctattgtgtcaatttttctatgtgattgcttatatctagcaaactgacttaacctttcatttcaaatgatttaatctataggacgaaaattcagattgccgaagaaaaattcaggctgacaggacaccatgtcaactgctattgtttgctgcacaatcaacgaaatttttggctgattctactaaatttctgtttggtataggtaatttcttccataatgattaccccttacaaatagtgcaaatgtatacttcgtgggtcaatcttcgcactgttgtagaatctgatgtttaaaattgcctgcatccggtttacaaatcaagaaaaaaaattgccctgattactgtgccaaccatattttctttgagggattgaccaatctttttcttggaaaagcttaaccctgttccaaacgtaatactgcaaaattttgctcaatttcacatgcacaccacagtgtagtcatgcattaatgattttgatttcacggtgtgacatgcacatcacattgtggacaagtacattgacagaccagcattttgatttcacatatattcttccctgttaaagcccggtcatcctaatcgatctgggatctaagaattagatggtatatgcagtacctttagtttttcttgcaattgactctaaattcttatgacgttcagttcatataaataactatatcctacagaatagatgaacctatttttctttctctagggcaaataactgaagagtgttggtatttgagttaaccactttttacgaacctaacctgctgcagttccacaaccatggatttaaatagattgttcatgtagttcctattttttcttgtatcctacgttcacagatcatttattaaattttccttgtatcctacgtttacagtgttgcatgaatcaggaaaaatctgattgaaggatctaatatttgaggactcctgctctgctgttgactacttcactccagttattcaaggtatcaaagttactctaaaacagtattaaacattatgttttgcattgttgaaaataaacaaatgttcactgtgcattattaaaaagtatgttttgcattgtgtctttgctttaatttgaataaagaaatgttcaccatgtaccgagctggactgaaattacttgaatggatcatcaccacccttgtctgaagtaaacagtacctacaacagataatgctaattgcgaatcattcttggcaattgactgcatttgtaattgattgttaattaattttaggcgcactatactgcaaatcatgtcagctttcctgagcatttgtaatgatcaatgattaaaacaaattattattattatttatcttcgtagcagcaagcttgagatattattggcaaatcatatccaaatctctgtcaattacgctttcatgcag

SEQ ID NO: 34458 - DNA, 209 bp, Oryza sativa
tttcagtgtagatatgcttctgagcgatgggttcaatgatgtagaatatatttctctcattttgcgtagtattgattactccatttcttgtgtaaggtgggcattggaggcacattaaagatattaccaagtcttgtttagtttattcaatttactacgatagtattatagtatctctcttctttaatgattaacttttcctctcttac

SEQ ID NO: 34459 - DNA, 1501 bp, Oryza sativa
tctccgatgaagcaaccgagaaggaaacatgatttagtattgtcactactgtgttttggctttagaataaaataacatttcttgtgaattacacaagaaaattcagtaaacaatgtcgttcaggcctattcagtactgcttgtgaaatgcacaaccaaattcgatgaaactttgttgttatgatgcctattcagtattgcttgtgattgagttgatttctgggacctatacaaatgtgctctacctcctgttgaactactatgtatttgtttggcacggttggatgcatagcaatgttcctttatatttgttttccatgtctttttatataaggagacatcacacaccaattgtggtttagatctcacataaataaattaggtcggccaattttctgacgttgtgtagcactattgatttctgtaactcttttgctttagatcaaacacatgtaattcttttgctttagatcgaacacattttatttgcttcagggctccattaatttaaagagctgaccaatcacatgaatattgatttatgaacatgaaagcgtataaaaaaaaagcaaatataattaacataagaaaccagtatcgctaatttgctattatgttgcctattcagtcatgataaaggagtaaaggactgctagatgtcaaacttatgtgtatggtccaaatcctgtaatggcccattaacaactaaaatacccattataaatacttatatgcaatactcaacctaagtgcctttgatctgtcacgtttatcatatatcttaaggcacagatatatgcattatcatatatctttaatatcatattattatgcattatgacatggggcacaaatatattggtatatcctattctaatattttacttgcaatatatttgatgtatgatataaattgaattaaagctcaaatgcacagttaatataataatattttttgctaaacatgaaaattttaaaaattattaaagacaaatagagttgcaccgtagcgtttagcacgggtatattactagttaaaataactcatcgagttatgatcaagcatttaatttacctcttcatttaaatcttaaattcataaagactacaaataaaaataacttatttgaaaaaactcaaatatgaaataaatctaactcttgtggatggagggaatatttcgaataaaattgccgctgactctccttttcaagcttatctcctaactccggcttgctcattggtgatgagctgatgatgggctcgagtgtgggaaggtagcaaccttcacctcctttgttgcctcggttttgtcgctctggcgcaacccccatggccgatgtctacctagcaccatggccgttgcacaccgcatagaaaagtcacatcatctttatctttttgtcctcgtagcttgaccagtccatggccgttggcaagcccaaggactttccataacggccgctgcatccgcaagctcctttgcgtccccctcccacctc

SEQ ID NO: 34460 - DNA, 1501 bp, Oryza sativa
atctttagtcccgggtatttgaaccgggactaaagatagcgatctttagttccgaattggtagtaccgatttgaaaatcgggactaaaaagcacttctccaccagtgcaatttttttcccaaaaacattatatcgaatctttggacatatgcatgaagtattaaatatagatttagaaaaacttaattgcatagttagggaagaaatcgcgagacgaatcttgagtctaattagtctatgattagccataagtgctacagtaacccacatgtgctaatgatggattaattaggcttaaaagattcgtttcacggtttctagacgagttatgaaattagttttttcatttatgtctaaaaacccgttttgatctccgatcaaacattcgatgcgacatcaaaaattttgttttcgcaaactaaatagtcccgcgaaggattacggccggagtgatctcatggctactagtaattgactacccgtctacccgcccgctctctgcacaaatcaccgcacgtttttgctgcggcgccacctggtacgttttcaatccgtggccccccgttgccattcagcgcgcgacacgcccccatctccgtgcgaaaaggcggaccggccccacgccaccgcttgcaaaactggccggcagtggcacacccaagttttgactcctcgacgtacgtcggcgcaacatctgttggactccaaccaccttttttgcgccgcgagatggcgagagaggcgcagcctcgaacgaagattctaacgaagattctcgcggaggcggggattctgtgttctcgatacggagtccacggaattcggttcccttttgctgcttggtttggtccctgattcctttcgccggcaggatgtccaatgcgcgcgggttgcttcctgcagatcccattgccacccgcacgcactgttcaccactcatacacatgtgatttggacgcatacccatggaacgaccaatatgtggttaactaatgctagaaccaaatctaacagtagcataattcaaatcacgtacgattgctcgctgttttgaaaggtatttggggtgttttaaactttgtaattgacgaatctgtgggtcgcaactaggcttgcggagtgctttttattttcctcataaaggcaggcatgcgcacctgatagccaacagcgagaggaatactgtatgagatcgtttggctcctttcccttttgctactacttgcatatcaaattattaagcactactccattcatctaccagagttacccatattacttttgtcatcaagactaaggagaaattaaatcatcttagatagtacaaaatcaaggagtgaatgtaaacatacaaccgataagtatttagatgactcattaggttctcatcaaatatttaatttatttcttcatttaagtcttaaatgcataaaaactacaaataaaaacaacttgtttggaaaaatttaaatgtgaaatatgtctaatttttatggataga

SEQ ID NO: 34461 - DNA, 1501 bp, Oryza sativa
tcttggggaggcttaattgttgctatcgccctccgcttcaggtgtccatttgaattcttcgtcgtttctttcgtatttaattgccatttgctgatttgcctctttatttcggtgggttttatggtaataaaggtgtggttcctttatcatcaaatttgaggtgttctgggttttctttggttcttttttggagcactggatttgtgtgctcttgtaaatcaaatagagtttgtggtttggttcgtattttacacaatcgagttgtgtttttattttagtttgtatcgaaatatttgcatacttgtttctagttccttcaggcttcagttctcttcattattataaaaaaaaatttggtcctttcgtccataatttttttcacaattccatttttgaatgtatgagcttgaattatgtgacttttcagtttgagcttgggattgtcaccttttcatggacgggaccaacaaccatggagcactgatggacgattggatgcttccctcacccagtccaagaacactcatgtcgagtttcttgaacgaagaattcagctccggtcccttttcagacattttctgtgataatggcagtaacaaacatcaggatggacttgggaagagcaaagctttcatcgattcaagccgggaagaaactgctcagctagcaaaaaagtttgaatcaaacctttttggtgccaaccagaaatcaagctcaaatggctgtctgtcagagaggatggctgcaaggacaggttttggtgtcctgaaaattgatacatctcgtgtcggttattctacaccgattcggtctccggtgacgatcccgcccggtgtgagtccaagggaacttcttgagtcgccggtttttcttccgaacgccattgtaagtgacttcctcacctcaatcagtatttgctctgtgtaatgttcagttactctactcatgtggtttatatggaggatatatttgtcagtaaatggtgaaatctaaaccaagatacctattataaaaaatattctaacgcaagatacagcatctttaatttctcttatgtctctgcagcttcgtataattagtggaattttggagaagaaagtgactatatatgttgatgactgattaatcttaatgtcatggttttgatttatgcaggcacaaccttctcctaccactggcaaactgccatttttgatgcatagtaatgttaaaccatcgatccctaaaaaaactgaagatgaaacacgccatgatcgtgtattcttctttcaacccattttgggatctaagccaccaacttgtccagttgcagagaaggtagttttctcaaacaatgttgttctattccctatttactgcaaatctgtaatcactgctcgcctgctcggcgcagtttgttttactgttccagcaaatctgacgagcaaaatcaaattatcagtgttttttatgcattggtctgatgatatttatacttttcagggtttcagtgttaatcatc

SEQ ID NO: 34462 - DNA, 1501 bp, Oryza sativa
ggccttagtttgcagtggtacaaaacgagtacaaaacactttggttctatcatccacgtaaaggcactggacccatcaattatccaccaaatatcaaaaaccaattatcttatataccaattgttaattacaaattaacaaccaaaacacactaatgtccaattttcacatgcttggctttataaattagtaagaatgcaagatgtaattagcaataagaataataattaagattgatttaacgaatgatgccatacgtcggccccgaacgaccactagtgtccaactaacatcagaaccattcttgagcatgatgatttaaatgaagactgtaatttaaacttttgctagtcttatgctatacctccgtttcaatatataagacggatcttatcttttggatattacgtttcgtcattcattttattttaaaaaatatgtaattgttgtttattttgttgtggcttattttattattaaaggcattttaagtataatttatatttatatatttacactatttttttaataagacgaatgataaaacgttaggttcaaaagccaataacatcttttttttaacaacggagtaattacattagcgacttcgatataattaaatccatcgttcgcctctttattcctcaaataatgtaccattcatgctgccatgcacaaacactcaaatctgtacgtatagaccacaggtttttgaattttggtgtactttgtttcttcttgaaacatacggaaggatcgttaatccatcttttgatcagtaaacagtacaaacggtacagccaaccaagcacagccaggaaattaaactgcctgttaactggatgaattcatggagatgtttctgtacgtcttgcagtataaatgatcattcaattctaaagtgttttgaaattataggccctgtttggaagattagcccagggctaattttaagagctaatgtttagtcatgaattggtaggctaaacattagtctaaggtggcatgtttggatccatgggctaattcaagactaaaatgtggagagagagagagagtagaaagagaggagagagaaggagagagggctacctttttatggtacctgtgcaaaattagtcccattagcaccccttggaggggctaatgttttgaggggggctaattcactgtagccaaaaattagtatacatgtttggattcttgagggctaattcatgacttaaaagtgggggctaatgtttagcccatgaaaccaaacagggccatagttagcaggagcactttttaagctcttgggaaagaaaaacaacggctcacaactcaccagctccaatgatagctgagatggcatgcactttatcccaaaacacggtgattagttgggtgctcctctttaatatttttcatgtgaacagtgcgtccggccgttccaagtttccaactggttaattatattaaatttcggccagatcatatcaagcaagagcatttttctagg

SEQ ID NO: 34463 - DNA, 1501 bp, Oryza sativa
tccacagtttctgagaatctgtagttacagattctgaaaaatgaactaagaagtcagaagctggaaaagctgggtttcagagcttttccagattctcagaagctggctaccaaacagctgcttatcagaatctaaaacttccacaaataggcccatagtgtagtcatggttagaagcaaacgagcagcaagtccaaagaacaagtaggcaaaggtccaaactcaagcatgccggctgggccaaaggccctcttgtttcttcaactcatttgctttacactttgaaaaatacattttctaaaattcttgaactttattttttagactttatatcacttattttaagttatttgttaaatttattttttaaaattattaacttattcctataattaaattgataatccactcaataatcgaatgtctcatttgatttaactgtttagcttaacggttccctcggttaggtttttttggcacatttttgaggtactaaacaatgtgtgtttcgtataaaagctttatgtatagattttccatttaaaaaatcaaacaatattttgttttaagtatataatagttagtacataactaatcaagcgcttgtccatctgccattggtccactactatctcagccttccatctatttccatcctcattggcccctactcacctccgttctaacttcggttccagaaattgatagttgtcatcacaatgccgaaaaagacaaagagccaccaatgctagttagaagaatgtgatttgcatagttgttgtcgtgatgagctactacccaccgcctcttttctgcctagcttccctctctattcagaggttgaagatgataccttagattcaggtgactaaaatttgttcaaagtttagtcaatttatatctaataaaagtgtagattaatatgaaaaaaaccatctagataaacacttcaaatacaagttgcatctatagttgtttccataaaaaaatgattagaaatgactttgtgttggagcgagtgttttctgttagtcagatttagtatttccaatacagatttttttcatgtcttaccagctccaatcttgaagaggctgctacagatcagacgtccgatatttagcagaaaatcgaatgcagtccgtgcaaacaaaactatcacagggaatctgcaagcctataagctaccctcctgcatatttacatgcaatttctctctccttcttctctaccaataaaatttaaactatttttccttctaaattacttatccgttttaccatccaatttcaccattatgttcgttacaattaaatctttacaataatatctcatttgattatatttatgataaaatttataaatataattatattactaattgaaacatctttatattgtacgtgaaacaacaacttataagtattgaaacattagaaaatattcatcaaaacatcccaaacaacatgtgcaacatttataaatgaattagtgaaacatta

SEQ ID NO: 34464 - DNA, 1501 bp, Oryza sativa
ccaccaacgacgacgcgagatcgctggccgtccgatgagcatcggacggcggagatgaagcccgtcgacacggcggagtgagcctcccgccacacggtcgacttttcccgtcttgcccgttctctcgcggcgctgcctgccttctctttttttccaccgatgactcagcagcctatggagtatggacccgtacactgcaaaatacccatggtttgggcataaacaccggtaatgccactgccaatagcacacagaaaactggagctttaccaatacttgtgccgtctcttttggaacaaatgattttttttatggaatttctgagaaatccgattctacagaaaattttcctacgtgattgtttgaatcataggaatagctataataaatatcctataaactttctttgaattgactcgaaacatagaaattttgggaaaaattctaacatgggctttaatctcttagaaaaatcctgtcttatatattccttatgattcatgtgtttttcctatgctctatccaaacgattattcctaccgtttttatgtgttttcttaccggttaccaaggttcacaactttggtaaggaattaaaagctgctcacaagcagtatcttcaggtttttttttaaaaaaaacgttgataaattgacaaaaaccaatgaaacctttataaagcttgtcaaaatttaaatctcagtatttttataatggtttgtttatattttcgaccctatctgaaaagatcagatttgatgaaatccaaaccgattttcaacgggattgtaagtctgctactactgcaaagctttcagtttcaggttttgtgtcaaacatcgcaactttggagtagacatacgtattatgtgcacgattttttccagcatggaacccaaaaccgacacatttatgaggctcacaagtcacaatctaggacgaagagagccttctaatagaaggtgtagaaagccatagaattttatggcaaagatgcaattaaccaccaaaaccgaggactactggatgttcaaacaggggttggtgtggtgtgcatctcacagtcagtcagtcccaaattcttgatctatcttaaattaaaaaccatttgttgactctataaccacgatctctcttctgcttggaattctctatcctatttttcatctcatattctaaccattgattatgccatgattggatcttggcacagtgctctgcatgtgttcttgtgttaatcagctgcccctaatcccctaggagaccaatctactgctgcttagctcctgatacaaatttgcacattgcccggtgaaaattcagcaactgagcaagccaacaagagcctgggtttctgaactctgactagcagtttcatcaggtaccaaaaaaaaaaaaactcatcttattccctagttgagatcatcagtttgtttctgaacatttttttttttacattttgcggcgttgatcagattggtttgagcttgggagagatcga

SEQ ID NO: 34465 - DNA, 1501 bp, Oryza sativa
tcgcctacaacaccctcttcgcacttatcgtcaccaccgcaatgctccaccaattgaacagcctcttatagctcgcagctctgctgcacctatgctatatacagctaaccggcctaaactgccggtcttcaacatggctaggaaagacaaatattactccctccgtttcaggttataagatgttttgactttggtcaaagtcaaactgcttcaaatttaaacaagtttatagaaaaaatagtaatattttcgacccaaaataaatttattataaaaatatatttaattattaatttaataaaactaatttagtattataaatattactatatttgtctataaatttagtcaaatttgaagtagtttgattttgatcaaagtcaaaacatattataacctgaaacggagggagtagcatttatgctaatgcaaaatgagatttacaatggctttgtttataccataaaaaaatccaaggttttttagcactacaacttacacatacacaataggatctactagtacatgcattatgcatacctaaatatgtagtacttcctctgtcccacaatatagcaacctatgataaaactcatgtccatatttgtagttctagaataggtcttagaggttcctacactgtgggacggagccacggagtatgtacttatcccctccctgacatgttttctatttttcggtggccacgtgacattggcaaggagagggtagtggccagtgggcgaagccaaggctaccaaagaatgtagcaggcacaaattagtgtgtgtagcactagctcttctctgttgccgtaatgcagaggatccatgcctgtcaaaaaggttgtacacgaataaaattgtgaagttttgagtccgttgacaattttttatgtttacgatactggacggcctttggcttaaaatcctagtagtactagatggactttctcatacttgcattacaatgtacaataaaaattttcctcgtttgggttctcgacggattttctttttatttttggtttccaaagtatgacttttttcgtgatcttaacgtattagcgattctctgccgactgcccggcctggtcgcgggagcgagcgcgcgggagattctcccgccgtggcacgcgcgacgtgccgcgtgcgcacaggccgcactgtccctttcgcccgcgcgtcatacggtgtccacccggtccgcgagcgcgcttgcttcttcttctctatatatggagtacgcagttcagcttcagcagtagaagcgcaaaaggcaaaaccagagcccgctcacctgctgagaaacaccgcgcagaggcagagacaaacaacgtacggccgtgtagaactgtagatcgtatcgtccgagtcccccaagagtttcaggccatcaacccgtagtttggcgctcccttggttttacctgcaagacaaaagagctagcgaccgaatcgttcgacggcagaggcgtcatgggggcgccgagcagggaggat

SEQ ID NO: 34466 - DNA, 1501 bp, Oryza sativa
ctcgatctcccatacagtcccgacaacgatcaagcagctagactgcgagcggaagtaaactcctgtcatcgcgccatttcccccagccgaactcacaaaagggggtctcacgaccacctactagagaggatcgctcctcgacaatatctatctagattcattaacatcaatatgaatgtgggaaatgctaaaatgacttacattgtgaaacggagggagtatgatattcatagaacctattgggatataaatgttcgaaaaatgatgtattatgtatatttactgaaacttacatcaagaaagaaaagaataaagaatttaaaaaagaaaacaaattactgatcgaaattttgatgatttcgatcggaatttcgccaaaaccgaccggttttcgagaacttgccggcaaactcaaggatttgtattcaaattttggtttatgaaatttgttcggaatttaccggttttccaccggatttcaaaaatttcgaattccaccggtgtccgaaacgaaagagcatgtcggaatcgtataccctggctacaaaccaaaccaaccttgtttgccgaattggatttcagcacagttggtgtcccgttttgattcttgaggcccatgatgtagcaaatactactgctaccagaggagaaaaccgtcaaaccggcatagctcctctcaaaaaaaaaaaaggaggggaaaaagaatcacgacatatagctggtagctccggtccaaactccaaacccgcccgtctcctcttcggccgtctttgctcgaccggagcggagcgcagcgcaggccaacggcgtggacgacgcgcgccccctctggatcgccgctcccccgcgcgccacagcttccatccggcgactgcaaggccgcccaagccaagaggttattattcgtcttccgctccatgattccctttttttttccctgaagatgattcgctggatgctttagtagtttctacctcgctgtttattggatccgttcaattcgtctcctccttgggacgaaattctcgcgtatgtggttattgggacgaaattcttccgagtattccctcaaaaaaaaaacttccgagtagcctagggtttggggaaccttttccacgatttttatcatcgtgtcgattagttctttaggtattagaccgtccattcaccgattcgaggtgcacatattttgtacttgcaaaatagggttaaatcatggttcgacaagactgttagcctgaagatgcaaaatacctgtttaagttgtgctatttgtgttcaacacagttcctttatagtaaggaatatatagcatatctgatgtaaggcttcaatgtggggctaaattctatgtaatagtgtgtattatgttcttataatctcttgagttcgatggaagagcttgaccgtgcaaatgtattgcattgtgaatcttacacctactctatgtcctcagggtttctttgcaagctttagccgctcgacgttcattgacagaaca

SEQ ID NO: 34467 - DNA, 1501 bp, Oryza sativa
tacggagtaacgcctgcggtatgaatattcagagtttcagacaactttaacaccttctagtaaaagtgcaacagttcagatagaaataacctttggaaaagtgcgcccaaagcaacaaatttgcacaaaatcagtacagataatcgggacataaaacgacaaaatgaagggcctatcattgaacagcggtaagaaaaggatatcttccctccttttatctccagtgaccagtaggatagacatccggtccatccggacattggtcgagcacaccaggcctactgctgccaatgttattactatcaggtccctctgcgacaactatttcaaagatgacgggtataacaatctttgtcttaagcggttgacactgacagcgacgtaatatgtacatgtgatctatatagtacatcttcaaggcacagctagaaataatcattgaatggcaacaaggacaagaactatatagaatacaaacggtgggtcctttcgtaattcaatcagatacgtccacagaaggcagaaccacttttgcctgaagaaaaacagaacttaattaattaagattattagaaccactattattcaggaatctaataatacactcaccatgcattgcatgtagtacgcatctcgcaatatagtgtgggatatcggtgccagggcaacacgtgtctacattaactcatctctcttcgccgcaacatatattggcttggctctggtccagcatgatgacagaaatatataagcacagctcaccaaccctgagtagatatcttttagattgataaggtaaccagataaataagtagactaaaaatattcacgaacacgtatatcaccttgcatcattgcgctgtcatgacggcgtcttctagctatcttcggtcatcatgataaaaatttcacataactacgtatgttttttttatcaaactgacagcagactatatttaagcaattatattacaaaacaacagatttagagtttaaatcctactccctccggttttattttaattgatgttttggataatgacacggtctacaagatatatgtttgaccttatttttctattataatatgtataataaacaaatacatgtttacttttattatagtgctttaaaagataaatctatatatattgttctagttcctttaatctaaatatttttaaagttattgatggtcaaagttataaaagtttgaactcaaccttgtccaaaacgtcaattaatatagaaccggagggagtagtattattttgtgaaaattttgttagtaatccttacttttatgacatatcattttaaatctataatttcatgatgtagtttgtaatagtttggtcaaaatatatgtagttttgtgaaatttactttaatatttataaatgtagtgttagtaatcgattttcccaatcctttggtcttggttatgtttaactagactaaaaattataaaatcagatatgctacttcacattcgatacaa

SEQ ID NO: 34468 - DNA, 1501 bp, Oryza sativa
attatttttattctttatgatacagctcgttagtttacgccgatttcaactttccatagcttttcatatgccgtgcaatggaagaagtatgatggaaaaaatgttaagttaaactttttaaaagcttaaccattttataaaaaaatatatagcaacactatagcataaaattagtttcattacgtctaatgttgaacaattttttatattttttattgtgcattgaaaatattgttatattttctataaattaaattaaacataaaaaattaatttaaaaaagttaaaatgacttatagtatgaaataggggcagtatttgtcaacctcccagtttggtgcttatacgtaaatatgttatactactagaaaaaccgcgtggctttgccacgcatggtacccctttatttgaaaggaaaatataggatttttttattctgtataggaacaatatttttttctatagaaattttttctatatgattttttgaaccaaaggattattgaaaactattaaatcctatcaaatttctaaggaatgcccaaattcatattagattttgagatttttaccatgaggtctgacggagcgtggggctcctcaccgggagaccgcgcaggcccccctttgccggttcggccgggggccctgggtgaggttctaagctcctagtctgtggaaagttcgcgagattggaaaaagcacaagacacgggcgatgtatacaggttcgggccgctgagaagcgtaataccctactcctgtgttttggtggatctatgtatgaagaagctacaaaagagctggagaaccagagagctcttaccctctccctctctgatcgttctggatcccaaaaaaaaatcatcccctttctaagtgggcaaggtcctccttttatacctcaaggggataccacatgcaccatctctctcttttttgtggggacttatcctatcttttcataaacagacggagacttgtatggttgccgtccgaatgaccttctgatgggacggcccatacctacctccacttccgccggaagcaggcgcgacgtgggaacatggctgtctgctgacgacatgaccagtgtcagaccggtcacaaatcggtcattcttgtccaccacgtgtcagttcatcaatctgcatgtttgcccctcttcatacaatgtcttgcttgtaatggttaggatgaagcctggtatatatctgaccgggaccaacgtgccatctccaggagctaacacgccggctccggctagggacgagtgcttggaggctctcatcctgacgggatggggcgaggcgtgcgtcagaccgcctgtcgccacctaacccacgatctgatcggtctgtgactggtcactgaccggataaacgagcgcgctgcactgcgttacatgcggcgtgacgcgctcgtccaaaccgcaataaatgtggttaggtgagccccgctatgctcacctaccccatatacgcggcgcaaaacccacaagg

SEQ ID NO: 34469 - DNA, 1501 bp, Oryza sativa
ctcgcaatttacatacaaactgtgtaattggttttttttcccgtccacatttaatgctccatacatgtgtctaaacatttgatgtgttggaatttttgaaaatttaaaataaactaaacacggcctcactttgattgtcatatttcaaaaaatcagattttaaaatttgatcatcacattttaaagtgaatggagggagtaatacaaaatcaaaaaaagactaaaataccactatttttatcaaatctcaatttaattattcttccttttatttactcctagtgaatttatctcatactttcacaaactccgatttgagacaaaagagaagagcaaaaaataaataaatttactctaggacgaaagcagtacaatttattactacatccgtctaatatattagcaaaatcttttatattttaggatgggtatagtatcgtattgaagttgatcattgcaaaactgacatatggatctcactttttctagggtccatgcctgactcctacagtcctacgcaggagttgcatccggcgtggtttgcaccgggagactagtttttgttttctgcatattggggaatctccttttctgttgaattgtactactgcggaccagcttagaaccgtgtgggaaaataggaaatgcttgtggaacaatcaggttggattggatttatgggtggattgggatcaaggataaatactctgtgaataaattttggacaaaaaaattggtatcagcattagtaataaacaaccaagcatgtatgttaaacaactttccgttggctgcttcaactgatatgtacaaactactagtagcattcagtgggagtaagtatgtatgcatatatatatatatatagttcactcttatcatatttcataagatttctcatgagctgtaatcaggcatggggtactgatgattatatcttcgtaccccaacttctataaaaaaaaattacggttacatagacaactagacaagcacaacccgtgaacacattagtacttattcactcacctgaactggacaccctctacctcttttacatgatttatgtgctagtactacagagaccgcaacaatggtaccagcatttatcatgccatcgatcctgccattgatcataatggagcaatacaaggacatgatatgcttaaagtgtgaagaagatgcaaaggacaatgaataaacaagaattatagagttgtatgcactctagggttcaaaatctcggcgaaatttgagcatctagagccggctcaaaatgcgcatctcgaatggttttattcaaagtttattggagttcattgaaattttgctaaaattcgttcaaaattaacgaaaaatcacttgtagttggcattagattatttttatttttatagtttgtataaccggtgaataaatggtctccagtactaatcaaatattatgatcagaaagtgtagtgaaaaaagaagatgcaggaatatgtgagaaaaaggaactg

SEQ ID NO: 34470 - DNA, 1501 bp, Oryza sativa
tgaaaaataggaaggtcattcacagcagataattaaatagtgaaagaatgtactatggaccgaaaatatagctaatctgccattgcacatggaaaaaacaagggtaacaaagggaagcctaaccacttagtagaaaatagtcattatgagaaaaaaaaaacttacccctttctctgctgcagacaaaatgaggtttggccagagttcactttccataagaagtatcaaatttggtttccagtatccaatgaaactttctattgcatcaggacagtcaaggggtgcaaactacacacatatgtatttcagttatgtaaaacaacaataagctaccgtagatgtatatagggcatatcaaacatttaaactatccttctgttagcctattcgtgattcccttcatctaaacaagttccatctgttcccaaaactttgcttgatctgtgtctgtactatcgaatattaccaccttaaaggtttaatattacgaaaccttactatcatagttcaacgagtataatatgaccttagtttaagggatacatataatgaacagacaatatctatctgccttgacacagttcgaacctaaaatgtccttttttttcaagaacagtccatcagtaaaaatttgttgtgcatacgccatttctcagaaaactaaaccggccgtcacgacagggatctgaaagtacaagagcaatttccgagctcacctgatatatgacaccatccgggagcaagtctttcatcacttcgctgcattgaaatcaaaacaaccgaaatagaatatggccacattacacggaaatgagagagccaggcaactcgtatttgcggtaatgggggaagcttacaaggatgagagggtagtagtggtgaggaggatggggagaccagggtggaggcgggcgcagtggcgtacgaccgggagcgcggccatcccctcgccgagggatacggcgtggaaccacacgagcggcgagcccggacgaggccgcgccaccgacggcctgcccagccgctcgggccaacgcgacgggtgctccagtcctcgtagccgccgccatagaagcgccgccggcgccgccgcgcggctcgccgccctgtacagctcgtacagcgcccggccgccgcgcgccgccgacgccggcgtgcgggccgtccgcatcgagcctggcccgtccaacgactcacggcctgggtcgctttgggcttttgttagcggcgcgtgaggtcgcgtgctttcagtaccgagcccaacttacctctcgtttatacgccttcgatataagaaagcgtctccggtgttgagtctctccgtattcatagacagaacacacatttctgagcgaaactcaggctatatttctgcctcgattgatttatgcttatgcatataagataaaaattaaagtttaaaactcaattttggcgttgattttgttattttctcgttgtagtttattttacagtatttttttttaaatcactaaagaca

SEQ ID NO: 34471 - DNA, 1501 bp, Oryza sativa
attgcataggtcatccacatcttaaaagcttggattcaacattttcaactagaatagtagtgtggacaaatatatatgtgggcctttagttctgaaaaaaagggcctatccgggcctgccatttggcccatatcccttgttatcatctccaactgggcccatgacatagttgtgacaaggaaaaatgtgggcctttagttcagaaaaggcgggctttcgctttctgcaagaggcccgtttgaaatgttgaaatttcttactaagtcatttttttattcaatgaaattataaattccaatctttagtttgacagctctcagccgtatcttatttttacctaagttcagcattaagcaaaccttacagaagctgaaactggaaagtctaaacacattaaaagccaatattgttttgatgaaataattataataacaaactctaatgctaaatctctatctatgttcccgagaatttgcatagggtaagtccattcgaaacgttggtttttttttacatattttaatctattttatctgaaatggtttagggctggtttaaaatggaatattgaccaaaatactgtagtggattatctacgcggttatagatataaatctaatattttgataaataaacataaaaataacttaatataggcgtaacaggccctcacgaaaaagaaacctattctgatttcaccgcgtagccaagcaagcatcaggctctcttagccagtcttagggcaagtataatagtaggctataagctggctaaaagttaaggtggagaagagaagagagaagaagtgggctgtaaacttacagtcggcttggaaacaagatctaagaaactctgtgagagagacaagtggaccctatattaattgtaaagagctaactattatatgggtagactgagagaatgctacaaagaaccttatagccaacagatcggttgtattattagccttgctcttagaatagatacaatagcaggctataagctagctataaacatattttaaagagataaaagaatagagagaagagctagctgcaatacggactccaagacataatgtatgtatgatatgtagtatcaggtattactagtatatagtaaccaaatattgtataaattagctattatatgactatagataatttagagttagtaattggctatactgttaaacttctcttagcatacagcagtagcacccgagctaactgaaaaacatcagcccctcagccgtcatcctatctcaccaaaaatttcaaaacacacgccgcacaatcgtgacaacgccataacgtccactggcgccgcgggccccacactgcaaaatctccgcctccccttccccacgcatggattagtacgcgtccagctcactcactgcttgcttccgccaccccgcaccgcttccccctcccctcctaatcaccaccaccgctcaccggcggtgacctccccccctcctcccccgcctgcgccatgt

SEQ ID NO: 34472 - DNA, 282 bp, Oryza sativa
tcgggcataaaaatggttaaaaattcctcaaagtggcatttcatccggttggcaacgtacttagtgatattttatccggtgcatcttattaagtgtcatttcatcaaaaccccacgtatagagtggtatattctccgttttctcagaaagatcgatgagaagatgccatttcaattcgaggtggacatccaaaccaaaagcaaagctctctcattccaaacgggaaagaaaaaaccaatgcactcttccttcaaacgtcgactctgcaaatactaggatttg

SEQ ID NO: 34473 - DNA, 552 bp, Oryza sativa
tgtttaattacaaggatcttgatccaaaccatgtttaggggctaagtggatagattatttcccactgctcctatctaggtttattaaccataaccactctttaagggtagaccaagcagttctcagtgcttattgggtacagttcacaaacacatgctttggggttagtcaaatcaacttccatcctttccatcatcagttgtgatgatttattttgggagctccgctgtatgctactgcaatgtcctaacctgcctaacgtcgatctgaaataactcaaatttaatacactataaggccctttttaaaaattttgaacccatgggtgagccaaaaaagagcatatattttatagtttctttgatgcaccttatgactaaatggaatacttgatattttacttcaacaaatatgatattaatttctctgtatcagtagttggagtcatttttcttgcctgcagccattatcttttgtatttctgaaggcctatgttttattcaggttatcctcttcaaattatagttgtaatgttcatattggattcacatc

SEQ ID NO: 34474 - DNA, 1501 bp, Oryza sativa
atcttgaagtggatctgaaggttagaatcacttgatttttcctctaaaatcgtgcgcacgatgtatagatttgtttgatacgtacgtacagacttgatttccgtttccttttaatttgtggaactatgatcgtcactgtaaagttttactcttaacctatcagagaaacaaaaaaaaatttgtttctaggcactattccaagatctagcaatgcatcggaggaatcagaatactagtatagtagatgctacgcagacatatatttccattcggaggatgagattaattgtggcattggcatgttcagacttcagaacattgtcgcttgcctgtactgatggatgatcgttgttgctatgttggagagagttcacaatcacaatgtacacgttgttggtgtgagcgtaaggcatggattacttctgatactgaacagtgaaattgatgatcatagtgacgtctctttttctctagaatggtgcaaaacattttcttcaggattcctggtagctggcttgctgctcgtggcaaacgtttcaattgactggcagagctactgctgacgtttcagaaaacaaaaggaagaactttctgcacgaaaaatatacatccaacattgctgcaatccgatagatggtgacatgaaaagcctaaactggatagatggtgacatgaaaagcctaaactggagaaatgcttctacttgacttaaatctgatgagctgggcgattatataaatcattctgaagaaaacttgcgctgtcgtagcgcttgaaattcggccgaagattgcagatcctttacacgcagtgatcagaagctggattctatataattccctttttcatcttctgtctgaattcgtccgtgtaggcgacatttgatcatgcagtgcagagcatatatagcaggggcgcagtctgaatttcgtaatgccttttttttgtgacatgctccttccttatatttacaccttagtaatattaatacgtgacattatcagggcaagcagaatacagatcttatcttatagagaaatctcgaaagaaaaaaaaggcctatagagaaatctcctctataggctttttttaggcaatcgtccttagagaggcagcgcatgcagtgtacattatatgcaaaagagaagagagaagagagaaaggattagaaaagagaagaaaataagatatgcagctgacatgtgggtcacatgtgctttgtttattttttttttgctgactaggatgccacgtcagtgaaaccacctatatatactgcctagggatcttgagtgaacggttttgtatagtttaggggtggagatttctggttttgtggttaagggaccttaaaaaaatctcgctgttaagttgagggacctccggtgaacttattccatattgggaacagcatcgtcagaccttggttgcatatgggccgaggccaacattatccagggcccaaggccgattaaacatctacctagacttggaggcccaa

SEQ ID NO: 34475 - DNA, 1501 bp, Oryza sativa
aaataacaaattttcatcttatatatatccttggtcggcctttgtgtgagctaacttaggtgaaaccgtgactcacacgtcaatgtgtgtactacactaataatagcaataatcagagtgatctagatcattagagaatcaacatacatgtgtgtatatatacgtcgccgtacgggatgtacatcttgccttttttttttttgaaaccaaaaaccttgactactagaagctgaccatatgctatgccatgcaaagttagctcgattgattagagagcttgatttgagttcattcatgagtacaataaattgagtgagacaggcttcgtacatatagtacgtacttgagctttgccggttaattattactaggaccacagtttaattcgagtgatcttgcactttttgcacagcggattgattgatcaatcgattagtctataatgctatatatatgcaacggcatatcacatatttatatgcatgctgcatgcatgactaactgaagaactgatggtttttcacttcagatcgaaaagctgtgatcgacctcttgatctatgtggatggaacttatctgcagtcaaattgaacatagggacgacagagaccatctccatgtcatttcaaaattagggctcaatgggaacaatcagagtactacttgattaataattacataataaatggagaaagggcccaactggagtgatgattgagccctgatgatgccgggagaagaagccaaatcaagatgactcaaaagatgaaaaggaccaccaagtgtataatcaattatgtagtactcctactttcctcctctcctttctcccacgaaaaagttggtcatgtcctcatcgttgtaggctacgaattgctaagctcaccaagtaacatgtactgctagctagctagtcacatacaagttaagtcgtcggttgatatcaaactagcccgtggtatgtatatttgtgtgaacttagtcgtatctttgaaattacccaatccctggatattcttttagttgagatacatatcttgccttgatgtcacaaacatatcgttattactatacctataagccaaccatcaccgaaagatacatgtctgatgttgacatgaagtatcgtacaaatacaaaattaagacatgtgaagtgttgtttagctcgaagaatgccttttgagtcaaccgggaaacacacattagacaataatctcaccagagttgaaacttcgttttcaattatactaaaacttatcgtgttgaatcgatatgtgacaatatacacatggcctattgtacgtagagtcgcattcgtatattttacaatcttcatatggaaacctgttgaaataaacagccatagtcacattcttgtagatggaagattacttcaccgatctagcttgagaaagactcggagtcttatcagctagcaccacaagttggtggactagccagccaaggtttgagcctcattatctcttaataaacatcaa

SEQ ID NO: 34476 - DNA, 1501 bp, Oryza sativa
aacacaaagataaaaatataacagttaacattaccattctagtaaacaaaagggtatgtctggcctatatacacacaatatcaccatgaatgaaacaatgtggtctatgtaatcacgtctactttgatccagttatacatcaagaccatgtccagcgaaggaagcttgcatatttagaaggtacgtgggcaaatacaaacatttatattaataattatgtaaacaagtgcaaatagagtgtttgcaaaaaaaaaagtgcaagtagaattgcttaaaaaaattctgatgatttaatggaacaaattatataaacaaagacaatatccaccttagcacacaataacagagaagtacaggtcctatgaaccacgggctaagaacataaattacatgactaaaacaattgtcaatagcaaatatggtttctagtatgtgttccaacattaatgaaaacatacatctccatttaaaattagtgcagtgtttcaaagacaaggaaaacagcgtaaacaccatgttagtgaagaaaaatcttgtgtaatgaagaaaaacaagtacatttagtgcttaacaaatattaccttgcatccttcaaccattgaagacttattacggcccttggagcagtagttaactcccaaagatgacgatatggatctctgcagcaaagaaatcttatgagatgcactaaaattcccaaatttacaaaacaaaaacagtagaaaacaacagcaaatccaaggcggctgtgacaggtagtgatttaaccataacaatcaatatatctattagacaaacatactgcagcttctagaacaagtttcttagcgcccattgaaaaattaaagaaaaaaaccgtatatcgcactggattcataaagaaactcctactgacatcattggtccatgtgataataacatattctgcatatcgtgcctatcttttgtttgttaactcggaatttttaccattaggaaacaaacagaaacaaatatgaatggttcagaaattggtgggtgccacgaattcagagaggaagggggagagactaccctcaatgttaagacctctgaggacccatacataatattagaaattcatgcaggataggagagtagtttgaaagatgctttaaacattgcttcagttcacaacaaggccaacacctaccttaaatcccagaatttcagaccatcctctccagcagtgacaaaggtattcacgttttccttactgacagaatgacaagagtcaaaactcaaaaattatcttttggaatagaccagaagtaacagtacaactggctacctcacagatggtgcccacgacacggttctgatgggagcagattcagcagttacacacataaaaggttttgaacctgtttatcaacagaacgcatgatttagttttgtttgcaaacagaacagaataagaaatgcgaagatttgggaactccagtaacttgcttttaaaccaataaagcagttctacagtcag

SEQ ID NO: 34477 - DNA, 402 bp, Oryza sativa
ttggatcgcacgtatcagatcgacgagtcacccacggtcgggcgaaccgcaatacaatggattctgcctctggccgggattgagatcctctgtagtcgagtgcaccttaccttaattagatttatcactaacatgtgagttcgatgagttctgggtccacatgtcagtaacaaagcatcggctctatatgttagtgataaaggcgtcgactgtagagtatctgatactgatccctctggctgcgccagcggggttgcccggccggttggcctgccatgaaaaagctcagatcggtcgagtagctagtcgtcgtcggaggttcaatggcaatgctagctaggtagctggtgtgagattcaggtaggattaacagtgtccagcagcagatcaggcgtaacatca

SEQ ID NO: 34478 - DNA, 1501 bp, Oryza sativa
gaatgcatatgttgttggagtagcaaatatctagatgattcatgctaccttctttttttagagagaagatgttggaaacctttgcagttttccgttctgatgctatccggtcagtttctctgatgctgcctgccggagtagtatctttttatctaatgcacaagtgcttaacatggattcccttctcgttgaaactagaatgtgtaattgctccactctatgccaggaaactaggaaagttgtatgtcttgggctatgatgtttgttctagatgagatgctagctaacatgtagtatcatcatatctgtaccgatcaaatagagagcagtcaaaccccaaagacaatctactgaagatggtgattcactatttcttgatgcagtcatacaggggttgtatgtccagtcagtttcatgcagcataaccttttcaggtttgcatgccaatggtgttctgtgctgattaacttcctgagccactgagtcccctaagatatgctgtcaaatgtttgattaaactggccgagttaccagatcatttcctctccgcaataatctctgcattgtgaacatctcttctggcagcagatgtcctccacaatagaatctgtgaacctgccatcaacagcatccttcaaatcatccatgcccattgacaattactcgcaaggaacgggggagatctaagaaaattgttagaatagatgtcgaatatactaattctatttggttacagttggatttaaagttgtaataggtggtagggggtagaggtagagtcggactctataacctagcaactctcttaaatagagaggcatggagatgatggtggtgtggccatggacttgtagcggctaggagttatatgggttgaggagcgcccataatcaaaaccccaggacataagcttcggctaaacctcgttaacaaatattgtgtgttcttgtgtcgttatctgacgtgtcttgggtgatcattgattgaagcgatcgagaagattagtcgtcgttccgctatatcgactacttcctccgtttcataatgtaagccattttagcattgcccatatttatatagatgttaatgtgagcaatgctagaatgacttgcattataaaacggagggagtaacttttatatataaaaaaggtctctacgagctgcaaacatcctaattcaatcatttccatttgagttttcagatataccaacacaaagtgctttgctggctctgcagagctgaagccgacgacaagccactccgaacagttaaaaaaacattacggtaccttatgcatctgcattaaagttttaaataatataaataattatacgtgtgtctaaaagttcatagtgttatctattagaaaacggagtgttctaaagttaagagcgttatctcttataaaacggaggaatacaactttttcaggttcaggcagtgtccaacatggcgtgtccaacatggtagtagcgccattccacacgcctgtatataa

SEQ ID NO: 34479 - DNA, 1501 bp, Oryza sativa
gcagcagccagggtcggtaccaccaccacgacatgggtagaaacaattgggacgacattggtagaagggtaaattgtaaccatactattataattttgtaaaatttaagatatgacatcctgacccacatgtcattgactcatgtggatcctacatgtcattgagataccgatgacatatctcaaactttgaaaaattataatggcatggttccaaacttggtagaaacaccacggtttcacaatttccgaaccggggtaaaaaaaacccactcaatttttcggtaagtttagaaataccaaagtgaattttaatttgtttatagaatttgtttgggttttatcgtgtttttttttcagcatatcaaccgattacgcaaaatccgatgataccgcctgtgagcggattttgatccgctatctgttgtatcgtgaaccctgttggaaacatttggaggtgttctgctcctctcgccccgacgacgtgtcaaagctgttgctcctgcctctcctgccacacacgcagacgcaggcagtgcaggcccgagactgagaggctgtttggttgctaccctgagcaacatgcctgagtatttttcatgcctgaggataggctgagcttgcttacaaaagttacctgaccaggtatggcttaaatttaagatagtgtttggttaaagccctgagaacatgctatctgaaaaagtgctctcttttttctagtagctctcacgcatagagcttagctccaactgatggcaccagattttagtggaggaggaagcagacggccaccggatctgcaaggtggagcagccccttagtcgctgccgccgcagccatggatggatcgatggggattgttttctcctcctaaccctacggtggtacagtgaggaggagaagtggtagaagagaggtgattctactcaggcatgttgggggaaatgccatggcttgctcaggcaacctttttgctacgcctgactcaggcaagtttcgtcaagcaagattcctcaggctaaaattcttagggtagcaaccaaacacgtctcagacagattataggcttgggctcaggccaggctggtttgctcaggtagcaaccaaagaggctctgcctgcctgcctgtgcctcgctctctcttctttcgcagtgcataaaaagcaatcaaaaacagggtagatgctggccatcaggccatatccctccgtcccaaaaaaaaaatataaaccctgattttcgtgcccaacatttgaccgtccgtcttatttgaaaaaattatgaagaaaattaaaaagacaagtcacacataaaatattaatcatgttttatcatctaacaacaatgaaaatacgaattataaaaaaatttcatataagacggatagtcaaagttggacatggaaactcagggtttgcctatttttaggaaggagggagtatattacttgtactgctgcattctctgctcagagcctcagtaacaaacagattacaga

SEQ ID NO: 34480 - DNA, 1501 bp, Oryza sativa
ttttcaaagcaaaatagttgttcagttttgagtttcagaactattttcaggaatatacagtgtaagattgtctaactttccaaggcacattgccaagaacagttaacaagattgagttgaaatttatatcgaagtaatacttgctacatgctaacctctgtgtctgcaaattcaacagctgagtgagcaggaagatctgatcgtctggatgagaatagcagcactgccaacattcagaaagctgtacgggagaatcgacatggatctgcaggccggtgaccgtgtagaggtgacgatgcagaacaactacaactcgtacagcttcaacggcaagaagtcgctggtgctgtccaccgccgggtggctcggagggaagaacgccttcctcggccgcgcctacgccatcgtcggcttggcctgcttcctgctggcactgctgctcgcattgctctacttcgtcttccccatgtcagtatctgcaactgcagaattaaaccctcagttcttcatccccttcatgaaatgttcatggattcttatattggtatgatgagattgcgagatgatagatgcagtagtgctgacgttcttgtgttaatgtgttggttttcaggagagaggagcatctgtcgctgcactacactcctgctcgacttgtacgatgattgagcagttgggcatggaatgttatggatctttttggaccatggattttgggaatcatttcttagttgttctgtatatatacgataaatgttagacaggctatactactactatgtgtacatatgtgttatctgtaaggctgtaattgaacttgcttgtgatgtactagttcaaacttcaaacatgttcttttaggaatacatgattcagacatggttgctgaaagaattttttaatacagtgagtgctgtgcaaagtgcaaatttgggagttccaggtgccccatttgttaaagacaccacatgaagatgattgttaagtggaagtatagaactgaaactttcattgctgaagttgatatgcatagagataaagacaaccacaactagagcaaaactgaaagttcacttttttataccttttcctatgataagtactccatctgtctcataaaaaacccaacctgatattagatgtgacatattctattactattaatttaaacatatgtttcttcgaatttattgtattagaatatgtcactcttttctgtgggataaatggagtatacatctaccaagtgcaaagattatactatctggggttgctgagaaagcaggggcatttttgtaacttggcattgccgtgtgccgccaaaccaaatgcacacctcactggcactgagcgcacttcactaggcgagaaagagattatcactgttgtttttttcgttttcttgcttgcggcaagcaaagcaaagctaagctaagccagccgaacaatggagaaggccgctggattcctctcctccctcctcggcggcggcgaggaggtg

SEQ ID NO: 34481 - DNA, 374 bp, Oryza sativa
ttcatgtatcctgccatggaggagggcagcagctacctgcgtccgttgcatttcttctccatcttcgttgcattcgcttccttctcacaatgtggtatgctcgtaattccccatgctcttcatcccaattcttgtctgtattttgtggtgatttaaatttggatcatgttcattgttaagcacaaccaaggcttaactacgtcgtgttcagatactctgaccgtcaaaagaatatatatccttcaataagctagtctagtgccacaaattggtttttttttttgacggtttttttctcaagcatcaaattcgttgacccctataagctgacaatcaaatgatttgttggttgaacaggagcaagagtgttaagg

SEQ ID NO: 34482 - DNA, 345 bp, Oryza sativa
cctctctgctcagagcctcagacatgccccagcatgctgtgacaagcctgggccacggccgagccctgcatagcggtttttctgtcgcgctcgtccacaatctaaacgccttgttgaaaaaaatatcaacaaaagccaaaatttgaaattttaaacttaattttaaaaaaaatttaacataatttttttagcgttagcttttaaatcgctacgaacaaatatataaaagttttaactataaattaagttttatttcctaataaaccgttttgatttattaggtaacatgggttaccctgaacttttgatatagagtactcctgtttactccatcgtcaatgcaga

SEQ ID NO: 34483 - DNA, 343 bp, Oryza sativa
attcctgcagcccaaaaaagaaaataaaaagaaagaaaaaaccggggaccacgaccccaaaagcgctgccacccaccaccggccgcggccactctttcccctcctccgatccgtcgcttcgcccgttcgccggggccacgcgcgcgcaccggaggaggaggaggccgtgacttgagtgaggttttctcctctcttttttttaccgcggcgagttgttactgtttcaccgcgcctccctcccctcctcccccgccttttccatttcgagctcgcctccctcccgtcccctccgtgcttgcttcctcccctcccccacctcacccacctgcccgtggaggcggtg

SEQ ID NO: 34484 - DNA, 1501 bp, Oryza sativa
gaagagagatgatgtatttattaatgatcactttaagaaaacatgggttgtagaatgtagtttttattgtgatgtcttattgatatggcaccatagacactgcttatggacactatgggttgggactgtccttatagagctagccgaaagacccatggacgtttctcggtcatgccattttaaacaattcaattctttgctaaaattgataaatatatggtaccatttattttgttaccaaatatacaagaaacatcatatttaatatatcctaccaaaaccgtgcatgctagtctacaggaatgcatacatatgggtacactggatatgagggaagaatgcatatatgtgggtacactaggcatgagggagctcaccaggaagcagcccgaggcagagaagctccaagcgtctccggtgatggtgagtggcatgccggcatcagaggtgacaatgacaccaaggacattccaatctggtacatgcacaccaaaaacatcgaatgcaggaggtggaatatcccctaaggttgtcactgctgcaggtaattgacatccaccgattgcggaggatttggcgccggtagcatttgaccggagttaaaaaaaggcgctgccgatctccttgatcggtccacggttgaaggagtttcatgagacgtttccttcctagatgctaggtgaatctcctggcgaagtgacttgatcagggatagtgtgaggtcgttggaacgttggcacgataccatagctacgctctacaccgtgctagcgtcacatgatcagggatagtgtgaggttgttggaacgttggcacgataccatagctacgctctacaccgcgctagcgacgaggtcatgttcctgggacttggcaagaaaaaaaagagagggttagtgcagctaggcaggatagacggcactggtaacggtatgatttatatcccgcctagcctactcgagctcaccgaacactgccattgtcttcctaggcggctggatgcctgaaatagtgtgagtgtgagaatgacatgagtggaaggagcaacgacaattttacaatagtaatgtagcgaaatccactttttaaaggtattttaacgaaacctgtttttgaggacgacataatatcaatctcctcgtcaccgagccacccgcagaaaactcaagaagggcagcggatcctcggccaccaccacgtactctcttcataaaaaaaaacttagccttacaatagaacaaatctggataaaaaaagaccctttctagtataatgaatttgaacaatgtccagtttcattgtataaaaatatcacctctaaataggttaagttttttcttttttttacggagagagtattccacgactagaggtggccaaatgggccgggccaaacgggcggcccggggcacggccgaacctgtagcaggcacggcccggcacggcctgctacagtaacgggccgtgccggcacggcacgagtagccgtgccgtgcttggg

SEQ ID NO: 34485 - DNA, 461 bp, Oryza sativa
cacaaatccccttcaaaattctcgcaaaaatcggtacaaccgaggtggaatcgggtagaaatcccaccttcccgcggagaaattattggaaaaaacgaagccgcgcgaggctctgctcaaaacccaagaaggcttgaagaatcccccaagaagaggtcaaaggaaggaggggacaggaagggaacaaacacgggtggtcggaacgacggaacaggtggtggaagaatctctcgggacgctgcgtgcgatgcgtggaaccaaatcaacgaacaaaccgcaaggccaaatcagccagccaaagaaactcaaaattcttgagacgagacgcgaacgtgaagaagaggaaagcgtggggggattattttggaatttgatgatgcgtgcgtgcgctgggttttccgggtatacggcatcgggtcggcgggcgcgtgtggtggcagcggcgggagggggcgccgatg

SEQ ID NO: 34486 - DNA, 1393 bp, Oryza sativa
tctttcagcttactctcaataatctggattataataattccaagtctggattatagttatgggctttttaaattcaaatttcaggatgctaagtggaatttcaacaaagtttaggattttttggactttcagcagaaccgttctgattttttttttttaaatttcaggatattttaggcaataacgtcttacaatcgtgtgatgtgctctttgtagaggtgtagtaatacgaatgtttcctgtctcgtgagtcgtggctcaactgttcatgcatgttaaaaaaatattagagaaaggtctataaaatacatttatatcaaatcttaagtccaaacttaatttcttttaaaaataaaacaatttttaggtgaatagtgttgtgttactatttatctaaactttgtctttttttactccataataaagttgagtttaaacttaaaatttgatgtgaatgtatttaatgcttacacctatttctaatagctttctcatgaattcacggggtttttacgggtttttaagttttcaccggatgtatccccttaaaatattttacagttagtctcatatgtccccttaaaatatatccacagagaatctaaaaatcaacacatcatccacccacaccaactcccgatgattcttgctcaaggaagactggaagagctcgagaaatattccgtgtactaccatggttaattaattatggctgtgtttagatccaaagtttggatccaaacttcagtcattttccatcatatcaacctgtcacacacaatttttcagtcacatcatctctaatttcaaccaaaatctaaactttacgctgaactaaacacagcctatataaactaaattatggctatgttaaaataggcagcagcatttcctagatgcccgcccttgcacgagagatacagacaaaagagaagcccacgcaactgaaacgacctcccgagactgcaaggccgctgacggcaagctttggttcactcgggcgacagctttgacggtgttgcacatcttaatccttctcatccattaaaatccattattaatttaggccctgttattttctccaacaaaagttgaattaacttttggatactcatggcatgcttttcaaactgcaaaacggtatgtttcgtgcgaaaactttctatatgaaagttgttctaaaatatcagattaatccaattttcaagtttataataattaaaactcaattaatcacacgttattaccacctcgttttgcgtgaaaaacttaaccttcatcttcaggacattcaaacaccaccttaattgtactagagtagatcaatggataccgtagattggtctgtgtaactgtgtttattgtagccccgactcccgagtcatcatcacca

SEQ ID NO: 34487 - DNA, 1501 bp, Oryza sativa
tagcactggtgaaactgtactcctaaatcataattcctaacctgcttgtcaaagtcagtgaaattgtacacagcaagcaccacccctgagctcgcaaggcttccacatgtcaagtgagggaacttgagcctgaaccatgcactaagagcacccgagtacgataccccgaagacgaaccaaggattgtcaaaccccgatgatcgattgtacctagcattcaagatttcctacaaaagcaacaaaaccacacagagagagagagagagagagagagatcagaaaatcacgtgctaaatagtttatccccatttgaaacgcaggggaatttcacatgaatttgaccataaacagttcgatttacacgggaatagggagatttttcatgcatttcgtcgatctgaatcctgacctggtaatgctggcggaaggcgaccaggtcgaacagtgcctgcttggacgacaggaacctcaggttctccgtggtgaggctctcgaacggggagctcttgccgtagtaccggtgctccggcgtcaccacggcggcgccgaacttcttggaaaggacctacacggcggaggaaccccaacaaatcagcagaaatggcatcggcaaccgtcgatgggtttgcgatgtctcacggccaggtagtcgttggggatgccgttgcaggaggactcgccgcagatgcgcaggaacaccgggccgccgccggcgtggtagtcggcgaactcgtagtaccgctgcttgaactggcggtggtcctgcacgccgccggcgacatcagcgcgagggcgctaaacccaaagaacttttttgtttctcgcgacattacatatcagcccctgatattaaaactaatacaatccatgccctcgacgagtgaacaagccagagccactcagggatcgttttgagaaacagttttaatccagggggttttagagtaaaacaaaactaattcctccgaggaggaagacgaggaagaagacgactcacggtgggggagaagtggtcgaggcgctggtccatccaccgctcctccgtcgtcaggtgccggccggcggcgccaccgccggcggcgatcggctcggcgccgcgcgcgaggaggaggaggacgacggcgacggcgaggaggtggtggtggtggtggtggtggtggtggaggaaggcgacgcgaggacgagaccccatcgactccgtggctgagagactcttgttcgagtgttttgtttggccgagacgaggactcgactctcgaggagtactacagctattatactattatagtggacttttattattcttaggattaggaaaaaggaacaaaacgatgatttctaagagggggaaaaaatgaaaattaaacacaggatctgaacttgttgacgacaaattaagagttgagcagttacactgtacccgctccattgcgaaatgtaaaaagttttagttttatactaagtcaaattattcaaaaattaattaagtttagtttataga

SEQ ID NO: 34488 - DNA, 1501 bp, Oryza sativa
cggcagctgcgctcgctagcgacgaacggggagtagactagcggagaggagctgggcatcggcggcggggagtggtcgcgtcgtggccaccctagcagcgagcttgcacctgcataccggcgacgaaccccgagcctgcgcacccagtggcgacctcgcgtccgcatctaggcggcgccgtcgctccgccacaacgcccggccggagaggacaagaaacaaagaagaaaagcaaaaggaaagaaaagaaaagaaaagcggcggcatcggcgccatggaaactggtcatgcatccgctccacacgctgatgcaccgcagcaccgactgcccatgacgctagccgctcggcctggatgcgccgccgccacacggtcgcgccatgacgagcgaattgccggagcaacaagaaacaaagaagagaagaaatgatgagcgaatttcaccactcatactatgcagtttgtaccgggcagagatggtcatcaaatgcactaaaaaaatgaagcaaattgagctcaaaatgaagtggtagatctcaccctatcgatcagcaccgggagaccagccgccgaaacatacggctcgatgagcttcgcggaggagagccgcaccccgacgctctcgagcagcggcaccacgccgcggccgtgcctactcttcgccttccccatgtagtacaccttcctcccgaacccgagcccggccatctccacctcgcggcccgccccaaccccggagctccacgactcccagagcccgagctcgtcgagctcgcggacgccgtcggcgagcatggcggcgtaccccggggcgcgcgcggcgatggaagccgcatcagccggggaggccccgtgctctcggaggagctccgcgacggcgcgctcggcctccagcgcgtcacaggaacgcgaggtggaggcagtctcggcatcggcgggggatgcgcaggcagcgacggggtcgcggcggcgcgggagaggacgcggagaggacgtcggtcgccggccgcactggcgccgatccagccaaccgtcacgcctccctggccgcatcgccgtccgcgccgcgccaggtcgccgcgctgccccgtgcccagcctcgccagccgccgccatccgccgtgcccgcgcaaggttggcccactgcgcacgaccgcccgtagccgaccaccgcgccgcccgctgccgtgcgctctcccgcatcaccgccgccgcacggctacctctctccgtcgcaacgcgctgccctgccgccttggcccgacccacgtcgatgagccacaccggggtgaagggaaaggacgggggggagagagagcgctacacactgacatgtgggtcccaccacgctgagtcagcttgtcaaccaggtcaacaatgccacgtcggaaaaaccaccaagggaggaggtgatttgctctggttttagagatgaaggaggagttatacccgtttttccagttaaggtatgctattcacacaaacgcaagagatgagggagg

SEQ ID NO: 34489 - DNA, 400 bp, Oryza sativa
acttgcatatgtaattagtatgtaattttcgaatttacatatgtaattttagtacttacatatgtaattttgagacttacattgtaaatacactaaaattacatatgtaatttagggacttaaaatgtaaatacatgccgactatttttcgatgaaaaatatggcgccataaatatagctacactaaaaaattttgcctaaaaacgtcacatcgaattttttgacacatatatggagcattaaatatagataaaaaaactaattgcacagtttgcacggaaatcacgagacgaatcttttgagcctaattagtccatgattagccataagtgctacaataacccacatgtgctaatgacggattaattaggcttaataaattcgtctcgcggtttccagg

SEQ ID NO: 34490 - DNA, 980 bp, Oryza sativa
tgttaatcctacctgaatctcacaccagctacctagctagcattgccattgaacctccgacgacgactagctactcgaccgatctgagctttttcatggcaggccaaccggccgggcaaccccgctggcgcagccagagggatcagtatcagatactctacagtcgacgcctttatcactaacatatagagccgatgctttgttactgacatgtggacccagaactcatcgaactcacatgttagtgataaatctaattaaggtaaggtgcactcgactacagaggatctcaatcccggccagaggcagaatccattgtattgccgtcgccgccgtggtgctcgtcgatctgatacgtgcgatccaatataatccgccacccaagccgcgtacatacctttgggctttagctatggaacaaattaagctctcaaagctgctgcttatacatttccggttgcgttataaaaggccactcctaactaatgaccatctatccttcgaatataagaatgatgagggcaactcccaaacagcagaaactaaagaagaaaaattaaatgattttctgtgaaaataccacagtacatagataagtatgcatccatgtgaaataattaattagcagctctccggtaattaaagaattcttgtggcgaaatagagtcgtcggatcgatcatcaatcaaatcatttgccgtttagagacacgttccatcaatcaagcatcaaaacctaactcaaataggagtatatatatgacatatccttgtcgaccaaaagaaaaaccgacctaactcgatcaggttcaggtacatactaagtactacagtactcctacaccacttccattaccattagcgcgccgaccaaccgtacaaatatatattcccaatcaatcaatgaatatcgatcgagttcgatatataaaaaatccgatcgatatatatataaatctatcgaccggtccatctcaaagg

SEQ ID NO: 34491 - DNA, 215 bp, Oryza sativa
atattctggcatgatttgattgacgagtttgaattttatccagttgtctcttgccagtaaggtttcgagtatatatattccggattatcggtccttggtggctgataccggaatttacctgataaacatttaaattcatttttttatggaggataaaaatcagtttgttttcttttcatggacctacctggttacctggcccatctggacccagc

SEQ ID NO: 34492 - DNA, 227 bp, Oryza sativa
cgaacgcgaggtgggcgaagaagcggaggccgcgagacgctgatttgtgggcccgtcctcgccacgtcagccaaccttggtggcaattggctggaaaatttacgtatagattacgaccgataccagtaaataagcaatagatccagcaacagaagcagagttctcaagcacaagcatacctttcaatactggatgaatctttaacaagtatgaacagaaacacacga

SEQ ID NO: 34493 - DNA, 155 bp, Oryza sativa
ctccgtccactgcgcgcagcccgatcactttctcatcgtcttcgctaactccggtgacatggacctcgcgctctcgcgttccccgatcccggctcccccctaccagctgattctacgaccatggacccggcttgtgatggctacctccttctcca

SEQ ID NO: 34494 - DNA, 245 bp, Oryza sativa
ggcgaattcgagctcggtaccctgcagtacattcaacaggtgctgacagacatgttgggcattagcactgcaagctccattcagttgcccattgaggtgaagagtaccgtgattgatgccctcgttgggatcctcatgcccaggcccaaccatgacagtgtcgtgttgtccagtggatcaacatcgctagccaagaatggcttgcaggacaagttcataaggcagtacgcttcgacaagttacca

SEQ ID NO: 34495 - DNA, 243 bp, Oryza sativa
ttttgataaagttgccaaaaaagtggctacatttagtttgctgccaaattttggtaactatataagaaatcatgtcaaaattttagcaagttggtaaggtttttttgttaataccaaaatttttttttgaaaggaagttaataccaaaattcggtaaggttttttttcatcaaagtgaacaagctctttctctttcatttttccttcctttcttttacaacttcttttcttaatcttggtagg

SEQ ID NO: 34496 - DNA, 1501 bp, Oryza sativa; identical to SEQ ID NO: 19643

SEQ ID NO: 34497 - DNA, 1501 bp, Oryza sativa
caagagactgctgaagtgaatgattgatgttgtcccataagcaacttccgaaaagaaaaacaagctacagcaagacgctactctcctaaatctttaaaaacccccagcttcttttcagatcacgacctactctttaatcaaggcaaagaggatgcccgccactcggctctaactctggaacacacgcacatctctttttcgggaatacgctagatgcgtatttttgcattaagaggaataaaacagttctttacaaacacacgcgcatctctctccttccaaaccatcccgcagattagcagcacaagagtgtcgaaagcgccctgtagctggtccttccaaacatcaaggcaaaggcactgttattttctcaaatatatcttttaaaaatcttttttctctttatttttaactctaccaaggaagttaattaattaccaaggacaaaggttacgatatttaaagcttttgggttcaagtcgctggtggctggatgactggatggatccccactctccagcaatggcggcaaggttgtacttcccctatcctagcagcgatgacgtccgccacgaagtgagaaggaagccgagcgcggccggcgatggagcggccaaggaagccggcggcgacagctgcggcgccggccggatctggagacgtcggcggcagcggcggctcgggttcttcctgcaatggcggcgactgacagcaacgttctgtctgcttctttcgatccaggtaactcaaatttcaaggatctgtagccatatttctcagaatacttcaattctccatataagcgtattgatccccaaaaggaatttcagaaaaaaaaaagtggttagcttgtcagctgattccttgcacatccatcaaccatggtaggaaaacattttctgaatgtttcctccctgtccatgacattttcactagtgttgcagtcagacaagttgaaaataaaagttgacttggaattaactagaagcaaagccttgaattttgacccagagaaaaaaaaaacaaggactatccatgccagctgcaccacaagcacttctcaaatttcaacagttttaacatgttgagtttcataatgaagaagtttgccatttcttttgttcatgttcgtcaggtcctttctttttgtcacatttgtagaaatagaaggccattgcagtgtctagaacgcggaattggtcaactaaaaattcatgtgactgtgaaacttgacgagaaaccagtggtgctgaaccaatctgtagaactttctttactgctttcatcgtcaccgctatgtggacagtctgtatggttattatattgttgcaaaatgtacaaaacagatacttgaatccaaacggttcacattaaaaagcatatctaggttgggatactggactatgtggagcattcaaagtgtgtttttgtaaccacagtataagagtatgtggcagccttaattcctactctgcttcacctgatcctttaaaatttttca

SEQ ID NO: 34498 - DNA, 1501 bp, Oryza sativa; identical to SEQ ID NO: 19649

SEQ ID NO: 34499 - DNA, 1501 bp, Oryza sativa; identical to SEQ ID NO: 19650

SEQ ID NO: 34500 - DNA, 181 bp, Oryza sativa
ttacaacaagttaattaaatctgtataggtcaataattgcttggaggaattagttattgacgaaatatgtaaaagtctatagaaaggtgtagtctccctgtatttggtcaacactggtcagaaaatacaagaaaaaatatcatgcacaacgaaagtctcgctttatagtagattcagtact

SEQ ID NO: 34501 - DNA, 171 bp, Oryza sativa
tacatagaatactccattttgctaccctatacttctttttatgttcatcacattgccagaaaaatcttcttgagaatacctttagttatttcaaaaggttaaactacttgcacaaaaaaagtcagattcagcacttctgataatagagcaattttacggtccttgaggagg

SEQ ID NO: 34502 - DNA, 374 bp, Oryza sativa
ttcagcgtataatagtcgggtctttatagtggccaagattgtaattttagacatggattattaaacgagctatatattttgggaggccgttgatatatattgtagaagtaccagacgctatattatagggtggccatctggaagcgtgatataaattttgttacaggtgattaccaactggacagatagcgatttcatctttttttttctctcgaggaaaaaaagatggatctttattgattagcaaattaacgaagatacagaaaatggttgccaataccatgtttcaaattaaattcttatatgtattaaatgtactcactccgtccaaaatgaatcaactaggatgtgacacccggattggttgtcctagg

SEQ ID NO: 34503 - DNA, 884 bp, Oryza sativa
caatgactcgatgtcatcatgttaattatcatcgcagttgagttacaaacctttcaccatgttaattatcatcattgtaagtcgcaggcacgtctgctgtgctgccgtgcgtggtggcaaaacaccttcaaattaaaactgaacacgagagagattatcttctaaattggctttcatatttttaagaataggatcgttctattaaatggcacattctccagactcttaaaacagtactctctctgtttaaaaaaaaattaaactagaaatagatggaactatctagaacaacgaatcaggtcagtcgatccgtttctaagttattttttctgagacggagggagtacgtgtgattaagtaaaaaacttaattttatatatgaatttcttatcaaactgttttaaatccattataaattttataatactctctccgtttcataatgtaagactttctagcattatccacattcatataaatattaatgaatctaaatatatatgtctgtatataaaaatccaaatcctacgcatgcttatgtctggaaacagagagagtatatatatttttgtttactagttttgtgccttacgtattaatcttgtttcattgttttctgcttttcgtgatagatagtaatttttaatctattgttatatggtaattagaccataagttttacatgacatgtagctaaagatgaatgtataaacacccacgaatgtgtcgtcccaacaaacactgaatggacaaaggctgaggatattagttgcatgtttgtgtacaatttgtatgaacaaatcaatattcatttactagtggaacatcatgtgcgtaaaatatggataccaaaatttaatcccttgaggtaaaaccatacacct

SEQ ID NO: 34504 - DNA, 1501 bp, Oryza sativa
ggagggagagatcagcttgtctgctgtgagtctttcattggttaacgagtccgttgggatcttttatggccttctaatatatggtcatgtgctaattaagctacactagtttgtagccaataattcaataactgaaataattcaacaaatttgccatgcattatggtgtcgcgtcactgcatactcagctaacaggttttgttgtagtgtggtgtctcagcttgcttttttgctatggcttttaacctctgctatatctgatacttgactattactttcctggcttcctaatcctgtaaaagatttatatttagtaatctataataaaagattggacttttatatctcaggcatgtggaaatggacagaaccaaaaatggcagcctgtcgaggctgcgctgttctgtatacaagccattgctaagtcagtctcagttgaagagaatgaaatactaccacaggtatgtatatcattttgggtgtattttaatgtttttacttatgcatcatttgctatttaactgatggttaagatcgctgtgtggttactttctactgtgcttagtgcgtaaatttaccaccatagctttatactggatgctggtcatgaaatgtgttgctgttatttgaaggtcatgtcactgcttcccagctttcctcatcaagaacagttgctgcaaacaggtatgtttcagtttaattgaaagttcataactcataagtccttgtttgcagctcactgctttgaattttatactgtgactgggattcaggtttcactgtaagacagtagctcattgacactggttgagatttagagttctgacaagttagggctgtttgttcctagataccaggatttatgataattttattttggcattgttgtacttgccctaaaccaaatattatgtttcccaatagtttcagattcgtttgtgtcttcatatgttttccctttgttgtggatggtagttattctattgaagtttgcggtctgaaatgccaattggttcttccctagccttgttatgagttatgacgatgattggagctcaaatgtacttgaaactgcagtttgttcactcgttggagcattttcaaaatggattgaagccgcaccatctgaactgttgatactaccacctctggttgatattctcaacaagggtatgagtacatcagaggaaacagctgcagctgcttctgtggcattcaagtatatatgtgaaggtatgacttgagtattcccataccttaacagaatctctgttatttgtgttcatatattttttttcaaaattttgatattcttgagctatttcctgtaactgaaatggtttgtgtggccttgttagtccttgtagtttaacatttgtagttgtgatgtactgtagtgtccatgagatattcgtctatttccttgctggttgaatcttaacataaaattgccttgttacaactaactctgtacctaaattgtctccttgtctatgacaga

SEQ ID NO: 34505 - DNA, 224 bp, Oryza sativa
ccgtgctatttttttaggaaaatactgtgccattttattcaacaatttccgttgctcatgttaccaatatataaaactgtaaaaaatgtgacataattatcgtttgtgatatgttaaaattttcgttacaataaatttatacttaatcattacttaacatcatttcaccctatgtgatgtgaaatcaattaatccctactttatttcacgttgcaactcacaga

SEQ ID NO: 34506 - DNA, 1501 bp, Oryza sativa
ctgatggtgggttgtattagatctggttattatggtcgcttgatctggttttcgggggactgattttgcttagtttgtgatagttgactcgagtttgtgttaagtctgtgcatgaggttttagtgggggtttagtggagatccatgtgtatttcttttgatctgtaggggtttgagtggtttgaaatggatcatggtgtcgatttgatgagtgggagtgtgggtttccatagttagaggtgggaggttagtcttataggttaaaagggtttagaagggtttacctattaatctgttaatcaaatgatccgatgggagctagtcacagttgtgagcttggttctcaaagacatacactgataacttgagatgtttgtcttgaaacatgcatttaatttagtttagctctggagggtgtgtcccttcaatttggccccacaaaactgtttgggatcgggtttgtattccgtcaagttctggcatgtcttatcccagctcaggattcaactgcaaaaattatcatgcatccatatagtgatagtgactttgatccaaaattccgtcgtagattctccatctgggatttggcaggatatcttggcatttaaacatttaaatctaaataattaaattgcattgcacatgcttaataagtgggattagcaccaaattgtagggtactaataaggaaaaggctatgcatactaactttttcttactaaattcttattactaacactgatatgtcatgctatgagtgcgtctaaattttttataacttccatctactaaaatcaaatggttgagatgattgttagtaaaagtttagtaagaaaaatttagtatgtgtagcagtgctcgtgctaaaaattgatctacacaagttggggttcttaaaccaagatataaatggtttttgtttatccatctcattctaatctcttgtctagtgtgatccatagttagaattgctaaattgctataaatattttctttcaacagctgaaaactatcactgtcttgttaacttaaactagtttgccttcattgttatgaaagcttcatttttctgatgtatgcttatgccagatgggaacctagctggcaattaattgaattagttagttcaatctgatgtggtgtgcacttcacaaacacttttgtaatgtggtctgaggtcctcttgtacgtggaaaggggtgctttgttctccacttaggagctcgggcattggaaatgtaactgattgttggttagtacactctgaatcccactcttagccaggttggatcaggtgaagccctgaggaggggccactagctttcttttgggtgctttcacgaatgatgataataggtgatatggtaatcagcatgaaaacaaatgtatttttttatgctcatctggaaatgtagcagtatttgaaagctgatggtttgcacttcatatggaatgcaataccattgttgcttgtgtgtcttaagaaatttgcacccaggggc

SEQ ID NO: 34507 - DNA, 570 bp, Oryza sativa
cttttcaaactgtagaacattagttctttcatgaatgttcctgcaacctatgtaatccccatcaaaccaataaagtattactgctaaaactctaaattaggtgacttctttggacctacaatagtaaagcacatttggattaatgcaagttgctagtatgcatctgcctttttcatagtacaatccgagttaatttttttacaagcattatgaaaatagtactgaacatgtatgtacatgtcattaatatggagacacttctcaattgatcatctgttaggtcggaaatctggacagaataaaatcattgccaatttctactaacaaaaagaacctagccaattaataacttgataacttcagttttgaaattcgataccttaataatcaatagtgccttcttccattttctttttgttttcattagtttgcagtttaacacctgttaattgcatttgtgtcaataacctaataatacttatgtttttctataacataaccttcaatattgccataatagaacattatgccacaatttattgacacattatttcctttcatttcactgct

SEQ ID NO: 34508 - DNA, 303 bp, Oryza sativa
ttcgtccttttttctcaacaaatctgtatttggtgtggaattctaaactaaatatatttgcctttgataaaccaaaattttgaactaaatttcgaactgaactatttacgtgtggattgcaaactgaaattttgtactaaatttcgtttggtcccaatacaatgtgaaatagctaaaaaaaatactcactacgttttatattactcgtcttgacttttttgttggtcaatttttttaaactagcaaaatgaacatgctttcatctaaattccatgattttcgcttccactcatattctaaaga

SEQ ID NO: 34509 - DNA, 1501 bp, Oryza sativa
accaatcgacaataattaatcaatgaactataattatatactccatctgtactcgtaaaggaagtcgttttcgacagtgacacggtttccaaaacacaactctgatttattatttctataaaaatatttattgaaaagtgatatatgtatacttttatgaaagtatttttctttttttttcttacataaaaaaataaaagtattttttaagataaatctattcatataatttttacattttcaaactcaataactttagagttattcaagatttatattttcaaggtttgatttaaacattgttctaaacgatttcttttacgagtacggagggagtatatatataattgattgattgatgtatactccaagccaataagtaggagtatatctgcatcattgtgtacttgcatgccccctgattggggtttcagaagacgcaaatgtaacgggtgtaaattactagtatatcaattgtatgtactgtacatgattggcgaggttagctgatggagaagaatggatagataggccgggtggctaggctgattgattattgattgggaaataaattaagtttgttcatgtcgtagtctcctcgtgtttatttgctaccttaattattaattattagtcgtatggtagtgtaaagaactgcctaattagcatgcagctaatcatcgtctgcttgttcattcaatttcattatttatttattcgattacatacaaggcatacgcatgctcttttttcggtttaattgatttcttactcagatcaacatgaatcttgtttatgtcaagtaagtatttatttagaacaaaggtataaatccaaacagtaattttcatgtgtatttagaatatatttttttgtgtaatggccagcgtatgacatgcgtggatttatccaactgctaagggtcttaattccaattttatcacccaaaaaagttatatactcataatattggtgtaatatgataaaatcatgtagcgcaggggcaaagccaagcctatataaattagggcccgttttttcttagaccaaaagctagtcaatatggaactattcaacagtttaaaatttacataagaacttgttatatatatatatatatatatatatatatatatatatatatatatatatatatatatatatatatataatattaagcgcttgcacattttttggctctactccatagcgtgcaaattatcataaatgacggaaaactgagctgccaatgaataacccccggctaacactaccagagagtgggagactaccgtgtacctcagttggttaccgagagtgttatatggaacacgataacatttaaagtataccgtgtgtgaacaaggaaaaactcgggaagtggctaaaaatgccgtgtgacgaattgagaaacacggtaaagcgtgggacccacagtttctgccgttacgtgcgcggaataattggtctggcgcgcgggatcgccgttggcgcaggcgga

SEQ ID NO: 34510 - DNA, 1501 bp, Oryza sativa
taataagctgatcatccgttggcatctcgcctgctgtaccacacacaacagcacactccaccacactctgcccccaccgacgaaacgccgtgccaaaatcagacctcaccgtcgccatcgccgtcgcctctccggccgtgtgcccacaaaattattgatcccctgtggccatggcgacgcgagagacgacggacggcgagagcctagctaggccgtcgacggcgagctctctctcactcgctcgcggtcatggctgccgctatagctagctgtgcattgctgacttgctgcaggcagtggtgccctttctgaaaggtgtctcctggcattttgcgcggtactctgtctcaagataatgcagctaagctaagctgctatctgcctctcactgccgtgaccaatcgacaataattaatcaatgaactataattatatactccatctgtactcgtaaaggaagtcgttttcgacagtgacacggtttccaaaacacaactctgatttattatttctataaaaatatttattgaaaagtgatatatgtatacttttatgaaagtatttttctttttttttcttacataaaaaaataaaagtattttttaagataaatctattcatataatttttacattttcaaactcaataactttagagttattcaagatttatattttcaaggtttgatttaaacattgttctaaacgatttcttttacgagtacggagggagtatatatataattgattgattgatgtatactccaagccaataagtaggagtatatctgcatcattgtgtacttgcatgccccctgattggggtttcagaagacgcaaatgtaacgggtgtaaattactagtatatcaattgtatgtactgtacatgattggcgaggttagctgatggagaagaatggatagataggccgggtggctaggctgattgattattgattgggaaataaattaagtttgttcatgtcgtagtctcctcgtgtttatttgctaccttaattattaattattagtcgtatggtagtgtaaagaactgcctaattagcatgcagctaatcatcgtctgcttgttcattcaatttcattatttatttattcgattacatacaaggcatacgcatgctcttttttcggtttaattgatttcttactcagatcaacatgaatcttgtttatgtcaagtaagtatttatttagaacaaaggtataaatccaaacagtaattttcatgtgtatttagaatatatttttttgtgtaatggccagcgtatgacatgcgtggatttatccaactgctaagggtcttaattccaattttatcacccaaaaaagttatatactcataatattggtgtaatatgataaaatcatgtagcgcaggggcaaagccaagcctatataaattagggcccgttttttcttagaccaaaagctagtcaatatggaactattcaacagtttaaaatttacataagaacttgtta

SEQ ID NO: 34511 - DNA, 1157 bp, Oryza sativa
cccaatactttctctatctgtaaatatattattatgtatactgaggcagcctgcatccttgccatccgtaaatttctttactaatgactaattagacttgctaatgatcaattaggtggggctggcgcaccagccagccccaacggtggatccgccactgattttatgcatatcaataaaaaatcaaatagattaaaatactcccactttatcaaatttcaatgcaattattctctactttatctactcctaatgcatttatcctctacttacaaactctggtgcaatgattcttgaaaaataaacttattttagaacaaacggaaggaacgaaaaaacttagtcttagacagagggagtatataatagtggcttattccattatatacaacatattttttataggcttactcatctatgtagttcttttaatcttttatatgatataggtccaacacctaggtaccaggcactggatcttattgaataccgtatggtaacaagtatgacacattataggaagcaggtctgaaacctatggttactagattgctaggtctggtacttatcggtatcaagtttagtatccagtatcatatctcatttgatactggtgtttgaatctcctcaagatgaagattaagtatttcacgtaaaatgaggtgataataacgtgtgattaattgagttttaattattacaaacttgaaaatggattaatctaatattttagaacaactttcatatataaagtttttacacgaaacacaccgtttagtaatttgaaaagcgtgccacgagtatccaaattttaatccactcctttaagaagaaacgaacgggacctcgatatattatgggtaccagatctaatacgtatgagtataacactatattacctgttcatacaaaacagaagcaaatttgatcaccaatatgcacgcatggagtaggcatcatcaaaaagttacacaaagtaccatgtttgattatattccatccacctatcgaaagctaaagacataaaagctaaaacatggagcaatctttaaggcagggcctagctgcagccctatggtgcagtccagcaaggcttctagcaaaccttgctagcatggtcgtggctacctcgtcgaagaagcgctgacgcacaaagg

SEQ ID NO: 34512 - DNA, 251 bp, Oryza sativa
atatagcatatggctccatctactatggtctatcttgctagggctctagcaaagctagcttagctagcttccttaagatggctagctccaatgaggtgttttcaaacatgcgcatgctttgctctccatccaatccagtcgatcgatcgatcgatccaatcatggagctagacccatcaatcattgtgcccatttccctttctttgatgtgtccgttttgattcgatattggccatatcacctcttatagc

SEQ ID NO: 34513 - DNA, 1501 bp, Oryza sativa
agcgacctcggaaggatctccaaagactcggagtccgttgtctttacggttacacatacagtatacttttttagttttcttcaaaaagaagaagaaaaataaataattccaaggaaaaacttagtaaatttacacctttacccttagggaaatcttgtaaaatttaaatttgcaaaaagtttaactgaatttaacaatattttgcaacattcggaacttgtccttaattatgaatgtaaaaaacattttataaaaatatgtttaaatttcacttatatttgttccaggtttaatttcttttgtttgattttttcttttggtaattctcattatgtgcagtgcacccgaaatcttttattaccacaatttgggatggcttttgcattttgcaaaatatgtataagttcaaccattttttttcaaatttaaattttgcatggtggtccaagagtaaattcatctattacaaaattttctctctccatcacaaaatggtcggagtgtcttttatgaaataaccacagataaagtgtggtggaggaaacaccacaaatctagagtgtactgtagcaaaaaatttcaaacttttaaagtataattaagtttactaaaaaaatatatttaagaaaatacttatactaaacagcagcacaatatgttgagagcaaattgaatgagagatgaaattaacaatcggccatctattttttattgttttatccttttgctttcctgtttatcagttcatatctcaaaaataaacatgagttctatctcgaaatttagcatgatgtctaataccacacatgctatattgagtgtcttttcttgatttacgaacatttattctgtgatttacatggggtaaataatcaatatggtcctcgaacttttgctcaaaatcaatttagtcattgacacatatcatattatctaaacacgtcctcaaagtttgtcatggcttgtcaccatgcatttaccgcccggataatcgcagcggagaaaaggatcatctagtgtgaatagttcaaagtgatgttgtttctaatgcaaaatgtttttcgtagcattttatgacggttcatcagacaacgagggacctcacgtcatatatatgtttttgttcttataaatccaactacattcctctttgaaaatataaaaattctttactgaataagaattaacactactatatcggaagattaaccataaagataattttctacggtccctactatcaaagctagaggaatctagctaatcaatcaattagaaacgtttgtgctgtgcacacaggcgttgcgaaaagaacttaaacacggtgatttgacaagaacactgacagctaattaaatgtcaacttcgaacacacaaggcaggtccatgatcaaacatgcaatcaggaaagaaagcaccgctggaactatcaaattaatgaatcaacaagtagaatataccaaactgttcagaacttattgctaacctgggagctcgaagg

SEQ ID NO: 34514 - DNA, 1501 bp, Oryza sativa
cagccacgatgtcggcaaaagactctactactttacaaactactgcttcatttttttaggttcgacattatggaagcgagatctattaccagcacagccagataaatttcgtaatagtcaggaccaaacaccacaccttaattcctaccactaacggaatgaactgggttaggtttgctccaagctgaaaagaaatctagtagtattaaaattacatcgtgcgaccaaggccgaagggtagaacagagtacgttccaatcccacctggagcaggtcagaactggtggtggaaacttcacaacgaagtcagcagtaaggggaaaaaattaaaaaaaataaggaaaataaggagagaagagaagcaaacctatgtggccaatgaaggcggtgtcgacgagcgaggcgaccgggtcagccatgagggcgagcgcgccgggcaccgcaatccccatgatctccctcccgagctcgtcccacctgaacgccaacctgcaacaggacccccaagaaaataaaaactcagagataaatagatggaaagggaaaaaaatcgatagaccgatgactcggttaacaacctggcgtcccggaggaagacgctaaccgggtggtggtggcggtggccgggcacggcgtcgttcatggcggcgtcggcggaggagctgcggtcgaggaggctctccccattcatcagaccaagaggaggaggaggagggggaaggggcgtgcggcgcccgcgagaaagggaggagaaggacgtgccgggaatcgaatccggcggggggccctcctgccggcgctggtgctttggaggacacggtggaaggcatgtacgcggtgcgcttttattcgttgggggacggaacggaacggaaaggagagagggtggactggtggaggaagggagacggacgggaagcgccgggctcagttggcgcctgccgtgggtaggggaggtgagaccggtcgcatcggcaaagcagagacttcgttgggggctttttttttattattaagagtaaatttcacttaattataggtactgcgttctaaattgcataaaactataggattttgttatcttataaaaagaattctatgcaaattaatcactagagagataagccatgtggcacgtccctattcacggaatcggtttccacgcaaaataacaggcgaacatacttgcaacgggagagatcgagaaaagaaaaaaaagaacgctatgttgcgctcatacgagggcctggcattcagctgggccttgcatacatgcatgggcctgatgagggctcggatataaccatgactaccttatgtattaatcaaataaatgtgcatatgttctacattagatttacttgttatatatttggacaaacgttgctacataatgagttttgtgtgttttcgtttgcagaggtacttgcttgggcgaaagaaaagagaccgaacgtaactaatgcatagatgattaaagaagttgattggggaccaaacc

SEQ ID NO: 34515 - DNA, 1501 bp, Oryza sativa
  unsure (1)..(1501): unsure at all n locations
tatctgcccagtggcatctgtcaaatggtaagaataattgtcaaacatcgtttgatatttaattcatgaatgcacaccaacttttactaatggaataaataacactacaaaaattggtgtagattattccaggttattaaagacatacttaaggatttaaatcacaagaccatcaacatctcttacaattttttttgtcaaattcattagttacaggaaatgttttgagtaattctgctaaacccttgaagtgcaactgtacacaaaaggagatgctatcattaggatgtaattctaattaaagtttataaattaagtgaagaaaaaaacataattagacagctgctaatacagaaatcagaattacattaggtaacaactggaatgatgcttcattttttttcacatagttggcaaagttaattgtacgtcatgttcctagtatcactaaaatagaatctggtctaacatgatggatgatacactatttaaagatggaaaatgacacataccaaaaagaatcttactgactctttagaacttatatggcatgatgtacttgtatcttgatttttcataactaccaactgagtaaataaattaatggttaagatatttgtttgtaagagttttataagaaacttttagtacgtatagcactgatcttaaagtatatttagagaactccatcctgaaatataatctgcatcatttgcttggagggttcttgcagtcaactgaaacacagaaatcacatgcatggcctcatttatttgttatgtggggaattcccttccgccggcgcaagcagcaagctgggcttggtgccggacgagctacagggccgggcggcatggctgtttagtgctgctgcttatccctttatcttagcaacattagttgaagtttgttaagttgttttatcccttccttttagcgtcattagttggattgtaaggctattaagagccggagtgtttaaggttaatggcaagcaagaattaatccaatctatctctatctgatcctctgttcctctctggttgttctctgttccagtgttgcttctccatctctatcccttgtgtgtgtgtgtgttttggagccacgaatcgtagctcctaacatcttggtatcagtctccaccgatcctccgcttccatttctgccatggccggcgctaacgacgacgtttggcgccaacgcttcgacgacatgatgcgccggctggaggagctcagcggcctgatcaccgacatcgaccagcagcaacgtacccagaccttggccatcaaccgcttggagaatggcgcccgcgctccctcttctcgcttcgacgacctgagcgacgtcggcgatcgcaatgggggccgctttgcccatcacaacgtcggccgcggcgaccgctacggtcgcggcggcgatggctttcatgggcatggacgtccgggcggccaccgnnnnnnnnnnnnnnnnnnnnntcctccacgctaccacaagt

SEQ ID NO: 34516 - DNA, 1501 bp, Oryza sativa
atgcaaagcgttttctcgggttcgcgcacatccctttagctcctgcacaggcttcagtaaaaatgccataactttttcttggaaaatgatattgaggtggggtttgatgcattggaaattagatttgtccctctttccaaccatgtatgcatgcaacccgtcttttgactggctgggtcgcacaagccttggaagttgagcctttgcagcgtaaaccatcttcttgttggcgtagacagctactggttgggcatgaactgattcctcctcgacgtaacccttgtcgtcctcaacataacctatccttcttggcgtagtgatgatatcctcgggcgtaaaccttagcaatacaaaggtagagcatttaggtagtataaaattctcactaaaatttgggttaagttgagcaaagagcgagttcacctcttgttgtattttcctagcatggctgcgcataattggaccatgatatgcttgatcgttcttggtgaaatgtaatccatcaacttgatttacgtcatcttcattttcttcatgtgatgtatgacgtaaaccatcacccttgtttacgtcaagtgtagctgggatatgctcatcaaggagcatccttagttagcaggcaagttaagggtctagcaactaaagtgaaatgtttaatcaagcgccgatagaaccttgcacgagctaggaagctatttactcctttaacattggtaggatgtggaagctgttgaatgacttctatttttgttctatccacctctaccccctttcgaggactggtgttctaggactataccttcatggaccatgaagttgcatttttcctaattaagtaccaaatcattttcttaacaccgttgcaagaccatatctaaatttatgagacaataacaaattttttttcatagactgagaaatcgttcatgaaaactttcatgatttccttgatcctgttggggaagatagatatcatagacctttggaatgacgcaagtgtattgcacaacccgaacgacattctacaatttttttatagaaatgttgctttaaaatcatactacccattttttaagttttttttagctaatacttaattaatcgtgcactatcgttccgttttccgtgtgggaggtgagggttcctaaatacagtctaaattgggatggaaggagtaacattttagggcagaggaagtacagagtttcatcaaagcagccctgcgaagtggcagcatcggagttttcctaatgcgcgatcgatcgtgcgccctcagtacagagtttcatcaaagcggccttgcgaagtagcagcgatggagttttcctaatgcgcgatcgatctcccgcgccgagggcgcgcgatcgggaaagccacatccgtcccctaacacactcctctcctcttccttctcccttattctcttcctactacaccatacatttaaaaaaataaaaaaacacaagttagagaaaagttaaaaaatagaaaaaaaatctaa

SEQ ID NO: 34517 - DNA, 1501 bp, Oryza sativa
aaggaggttggaaagtgatctggttttcttggatatcatcgttgatttgctgagcagctctttggacgttcggttcttcccctctgaagatcttcgcgtttctctgcagccagacacaggtaatctatatgtcaatctgcaattacatacaaatataacacaacactgaaagcaaaactcaaacagtatcaatcaatgaccatctaggttgacggagtcaaaggcatctgtttcggttgttgctgataggtttcatgtcatttttttcagataatgaataggtttcataccagtattagtatagcttttcgaatctaagtaccaatttgtggtttccaacaatcaggttcaaatctagatacaaatttgtaccgtacagcatttaggttaattggttaatcatgtttagaggggcaacgtgaaaaacacaagcatacttggtttgtggaaaaggttgattctgcactagtatttacatcactttccagtccaacttttacacttttgagtgggctagatgggagaggaaacttaatcacggagtgttaatgtgtgtgttagttggcagtaaaaagatactgttatcagcctgggcttaaattgacctgttttgatatttcagaatatttgataaatgcgaacttaatttttgaagtccttagtataatttaaaattctgactaaccaaacttaaaaccttataatcatacaatatattagaaaccaaatttatttaggtacacttaaattccgcaaatcatatactggaccttggatgtgttctgttatgttgcttgcatccatgccatgcaaacattagtgttgccatgttagctcttgacattgctcactcatgaccaacatactaagcatgcaaatagttttgttgtgaaactacctctaaacgatgcaatgctagaaccaaggtatgtattacgaaaaaaaaaaagaaccaaggtatgtatttacctcttcagagataagtgcctaagtggagcgtgtcagaaaaattcttttcagtaagcgcttgcatgtctgcctgccacaaaatggggcatgaatctcccaagatatctttcaccactttcctacttgcatttgcatggcatgtcatacactccggaataatctgttgaatagactttttgtgatggctttgatttcttttgaaacaacttgatgtctttattttccaatctaccagcgcctacaagcttctggtcctaacattacgtttacgattagtgctttgtgcacttgcttttcttttcattttgaatgggaacagtaggaaaggatcctactatagtttcctgcacaatctcactcgggtaatcgggttgaccaattgtcaaggtcttgggtgtagaacgcaccatttgcttgcatgcacgatggaatgggtagataaaacattaaggcctatatatgcagccccgagaagtaacactgtcttgttgccaatgcatcatacacactgagatatggcgcttggatttcc

SEQ ID NO: 34518 - DNA, 1501 bp, Oryza sativa
ggccccgcttgatggaagtccaaattgtcgccgattggaggagctttctgtcgaaactagatttcggcaataataaaagggggtggctatcaagctagaaaagtgtatgggtttggagacaaaggatttatacaggttcaggccttcttataaaagaagtaataccctactcctgtccggggatgaatccgccgagtgtattattgattgtatgattcgggaaaaatcagcatatgcccctagaggcgcccggacccccccttatatatgggaaggagtccggattacaaaagacaatctatatccctaacggaatatgaagatacaggtaaaatacagtcgtaaccgactaagtctcagggtgtttccttgatacacaagttaagaaacaaacccaagatacagataagatattctatctacattaggtatcctgtacccagttcgaataccatcgccgtgtagatatgggatacccataatctccacagtagcccccgagtcctttgcagtcgaccatcgtagccctctcaaagatgataatccgagtacttcaaactcttcaagccaaaacctgccgagtggactgtaaagggcgaaaagataaagaatatggtgcatcgaatagatgcacctaattaggtgtagcccccaactatgtgattagttaacaaactaaacatatagttgaaagacaatatagtaacacaattgtgcattatatgacaaaagcgtacgcggcgcctaaataggcatgctagccgactgctttttagccataataaaagaaatccgagtggtttacactctaaaaggttcacgaatgaacacacttgacaggcatccgaataaaaactctaaagattacccatcaagtattatgaagattatggtaataaataagtcgaatagcctaggccatgactatgtaccataatgaaaataggtatataacataccaaggaaatgactataataaaaacaagccattcctagttaacccaaacagcttttgtagcctaaaaaagcttgcaaaaacagcataacgcctttctgtcgggcacctttttaatttgcattgcaataattccaaagaattatattaccgcataaaaaggatttgatcagcattgggcaacactgtcgtgcgcataatattgccaaagcaaaatatgcctaagtccctaaggaacacaatgggccacgctgttaaaagtattgggctgaagtactgttcaggcctaggcccattagcacctccgatacccttaactgaaaaatcctatatccaagcgacgcttcgtcttccccgccggaactctcgccattttccccactccttgctacagtgaaaagctgcgccggtgaactagggttcacaactccggccaaatccacctccgaaaagtgcatcaaaatccttcccgtgatccaccgcctcaattcctcacctctcccaagccatccctcgaatcaaatcagcacatttgagaaaaatcga

SEQ ID NO: 34519 - DNA, 1501 bp, Oryza sativa
gtgtacatcttttaaccaaaaccacaatattaacagactaatgagtatattaaacttaagatgaaaattttattatttaacatattatattagacagtataatatagggttggcgattagatctatactaattggatattttgtattttctagaagctctaacgttaagtagaaacatctgaccgtttatcacataaattatttaatcattgcagttgataattgctgatctaaggccatttaaagcccttctactctaaaggtcttcaaaagctattcaaggcccagtagtccagtacgttaatagctcatctcatgctctacacattgaacctaatggacaggacagggaatatgcagaaagaccattcctaacctaacgactaaaatgatatccatagcattaaataagctgccacctagaatgaaatatgatgtgacaagtgaataaataagaaaaaaagaaaaaaccaggtcttgcatacaccatatttaagacatcatgtgagataagtagcattaaatttaagtatagaatagtggtttttgcattgaaagattagtgtctagtattagtttcttgataatgtggagtttatgaaactatatctagtgtcttgggttgggactggcctaaacccttaagcacttgcccctagatgccatgtagactcatttgctgatgtggaagagagagggaaggagagagtgaacgagccacctctcgtgcaaggggtgacctttatacacacttcaataaaaatgtgagagcattaaatttattgaggtttgtgtgctagaggtaacttattgtatagattacctcttaatttatagaaaggtgatagagatgaaattagaggtgacaaccactcaaattgctctaacagattaggatcacaccctgatcgaatgatcagcagcgatttgggcgccatgccgccatccaaccagcattgtgagcaaatcgaggaacgtatggcatgtgagacttcggcagcgacgaaagtgtggagattatgggtatcccatatctacacggcgatggtattcgaactgggtacaggatacctaatgtagatagaatatcttatctgtatcttgggtttgtttcttaacttgtgtatcaaggaaacaccctgagacttagtcggttacgactgtattttacctgtatcttcatattccgttagggatatagattgtcttttgtaatccggactccttcccatatataagggggggtccgggcgcctctaggggcatatgctgatttttcccgaatcatacaatcaataatacactcggcggattcatccccggacaggagtagggtattacttcttttataagaaggcctgaacctgtataaatcctttgtctccaaacccatacacttttctagcttgatagccacccccttttattattgccgaaatctagtttcgacagttggcgcgccaggtagggggagcgtcaagcttttcgccgaccagtgcaa

SEQ ID NO: 34520 - DNA, 1501 bp, Oryza sativa
agccgccgtagaagaaatgcgagaagactacgatctcatgtgtatcaggggtcgggaaagcctcaccgcacgctggccgccacccgatgatctccttggctgggagaacgccgtgcgccaccatctccttcaggttctcctccgtcacgtcggacggcgcccattggctttcgaagctttctctctcttccgccatcgatttttctcaaatgtgctgatttgattcgagggatggcttgggagaggtgaggaattgaggcggtggatcacgggaaggattttgatgcacttttcggaggtggatttggccggagttgtgaaccctagttcaccggcgcagcttttcactgtagcaaggagtggggaaaatggcgagagttccggcggggaagacgaagcgtcgcttggatataggatttttcagttaagggtatcggaggtgctaatgggcctaggcctgaacagtacttcagcccaatacttttaacagcgtggcccattgtgttccttagggacttaggcatattttgctttggcaatattatgcgcacgacagtgttgcccaatgctgatcaaatcctttttatgcggtaatataattctttggaattattgcaatgcaaattaaaaaggtgcccgacagaaaggcgttatgctgtttttgcaagcttttttaggctacaaaagctgtttgggttaactaggaatggcttgtttttattatagtcatttccttggtatgttatatacctattttcattatggtacatagtcatggcctaggctattcgacttatttattaccataatcttcataatacttgatgggtaatctttagagtttttattcggatgcctgtcaagtgtgttcattcgtgaaccttttagagtgtaaaccactcggatttcttttattatggctaaaaagcagtcggctagcatgcctatttaggcgccgcgtacgcttttgtcatataatgcacaattgtgttactatattgtctttcaactatatgtttagtttgttaactaatcacatagttgggggctacacctaattaggtgcatctattcgatgcaccatattctttatcttttcgccctttacagtccactcggcaggttttggcttgaagagtttgaagtactcggattatcatctttgagagggctacgatggtcgactgcaaaggactcgggggctactgtggagattatgggtatcccatatctacacggcgatggtattcgaactgggtacaggatacctaatgtagatagaatatcttatctgtatcttgggtttgtttcttaacttgtgtatcaaggaaacaccctgagacttagtcggttacgactgtattttacctgtatcttcatattccgttagggatatagattgtcttttgtaatccggactccttcccatatataagggggggtccgggcgcctctaggggcatatgctgatttttcccgaatcatacaatcaataatacac

SEQ ID NO: 34521 - DNA, 323 bp, Oryza sativa
  unsure (1)..(323): unsure at all n locations
ctcgcacatctaaccttttgggttttttgcgaaccaaagggtaataagttgagcatttgcacccccaatacgattcccggagagagtgaacagttaaaaaatatatccacagtgagtcttacctcgggatggaaagcccgataagctttaagttcgcacagaggggaagagcgcatagccaccccatagcgcccggtgaacgcctttaaatatcctataaacaatgtggtgttccatggccacctccanatcaatatttatatttatgatcctatttatacatatatcagtatgcatatatatatatatatatatatattggc

SEQ ID NO: 34522 - DNA, 289 bp, Oryza sativa
ttagggcacaaagaatattgcaaaatattcctggccagtgatttttaaggcaaatttttaattctccaattaattcactcgaataaattgcttaaatttttatttaatttctaggaaatgcattattaaatgatttttaatcccgaacgaaaatcggggcgttacacctcgccgccgtctccctgcgttagcccccaccgcctagctagtcctctgcccgccgcttggctcaccggtgtcgtgcaagccgacgccgctcacgcaagcctcacgaatcgcgcatcaacaa

SEQ ID NO: 34523 - DNA, 1501 bp, Oryza sativa
aatgttatctctcttgatttagtcaccagtagaaaatctcttattggtgttggttccaaaccccttatatgtgatcggcaccaatttagcagtactaatgagggtagtcaaaaggtataggttttgcctccatctgagatcgtttagaaattttgaaaattcacttatccaaatagatttgagactttacaatatattttcggatacccaaactacctcaaatcaaaaagtaattaactatcaggttgtagatctcgtggaacactacaaatttcatataaaggtaatcttcaacttagtatgaaaaagttaggtaaaaatacatatatatataagttgcgcatcataggtgccggttttaattgtaaactagcacatatgactttttgtgccggttttggttataaaccgataccaatgactgggtatagatatttcttcttaattatatcccgataaaaagtggaaaaattctttataggtgtcggttttaggcaaatcaatacctataagacagaccggcctctacgtggtgttttatagtagagagtctttcttgctacatgtagtactcactactctacacggaaataaatattcatcttgagaaaatattctcttgtttattttatgacatctaaatatttatgttcttttaagaattataataaataaattaatatgatatataccacttcgcacttcgcagcaaattcgacttctacaagttataaaatagtaaattaaactgaaattggttaatacacattcgcatttatctttgttattttttatattttttgtaactatttaagggatatgaagaatcgctttctcctctccacgccaaccggttggacgccagccataggccctgtttctttgagggtctaaaaaagaagtcccaccactttaagtccctttaagtccctagagtaccaaacaggagggactaaaatgggactaaagtgcattagtccagaagtcccaaatggaggtgcttattgggaaaaagtggctctcttccagccactgccccttcacgccagccaaccctatccatttcctcgcccactctcttcctcgcctcatctcttcctcgcgtcatctctctctcgctcctcacaaccccgcgccctcgccgccgtctctctctcgctcctcacaaccccgcgccctcgtgtcacgcccagaaatttagcccaaatttccagactattttgtgtattaaatccctgtcaaggaccagccagggtacacaaagcgacaagtaatatacagttccaaacgtaaataaagcgtaaaatacttacaaaagaggcacttagtcctcgcaccgaaacgaaagcagcagcagcggaaaaaggcgatcctagcggggcttcagctccactccacaggcaaaactcaactggggtctgagccttggtcctctaacttcgtcttcagctcagaagcactacacttctgaaaagggggaataatagcaaggctgagtaca

SEQ ID NO: 34524 - DNA, 958 bp, Oryza sativa
  unsure (1)..(958): unsure at all n locations
ggcttganccgtgccgttgctcaaccgcgccaccccgtggtcccggtcccgggtgggaccgattccccttgacccgttgacgtgtgggcccgccctgtcggcgccggcctctttgatgacgtcagcgcttaagctttttcctttgagaaaataaataataattgcgcaataaatcgagtttaattctagaaattcattcaaatggctcaaaacttctaaaattcatacctaattcattcgaactccgaattgagccattcaacttgcaaaattcatctaaaattgagctctacatgtttgtttagtttttatgtactgttttattgatttttattagagtttttcctcgttttgcatgccagtgtgtagaatccgtcgtttcgaaagtccgcggtcgcgaggaaaagagttcggaagatcaaagtgaagaagcaaggcaagtcacacattccccttgagcatgttgatcccaatttacaaatattttactgtttgcaaataaatatgcatgttttgctaattacatggggtcagggttttacctatctgctcgcttgtgccatgtttacttgatatctgtcctttgtcaaccatgggtaataaatcacctagcttgtgttactttgatgacctagctagaactatatgcttagccatgcttaattaccactagctcagtcgatgggataattgcagtattagacattctagtatcttgttgagctgcgtgctcgagacatctggccatgcttcatggtcgtaattatccaactaaaatgcgactgaatggtgggctgtgggtgcatggttttgctagtcgcacccatggcaattaaggaccgattcgcgggatgccctggaagaacttatcgtacttaccacaagccagcgtgggcaacggctgggcttatagtgtagctttcctctagctgacgcatccaggcaaggatgggcgtga

SEQ ID NO: 34525 - DNA, 1501 bp, Oryza sativa
caagaaaaaccttatgtagaggctcttttgtagaaacaattttcaaaatgcatctaagttttgaagctctatagtctagagacactttttagaggcacttccaaaatcgtctaaaatatttctactctagagacactttaaagacatttttagcatactttgttaaatttatcttgtagagacatcttttcggcactttaagatttgcctgatatgtaaagatattttcttaaggcacttaaaacgatgtaaaggtatttttccaaatattaatatatatcaagttactagatataagtaacacaaatcacatatttacatgtaattatatgatgttgagatggttagtgcattgaagataaaaatggtcaactcaagaagtcatgagttcaaggattggtaagggttaatatttttctttcttttttcatattgatttgctatagttcccacaacgtattaatgcaaatagagacatcgtagttcgtagagacaattcaccaaaaggcacttatgagagactcttcaaaatgtctcaataacactgaaaggcattaaaaatgtattaatgcctctacaaagtgcctctatttgcatagagacatcttataaaatgactcttagtttgtagagacaattcaccaaaaggcagttatgagacactcttcaaaatgtctcaataacactgaaaggcactttaaaaatgtctctacaaggtatatttgttgtagtgtctatttgcaggcgaccccaaaactgcatataaagacaaattgtaagtgaagttaccttgactttccaactgtactacataaataactcccttaaaccacaagtcatgcaagaccatagatcttagggcgacgctccggtgctctctacttgtagtattctactacaagtagaattaatctcgaccgtttattttaaagggtagattagtaatctcttaatacagattaggggcaattttggcatgggatgatttctctgtctcggtcgcttgttcgcatcaggtccgacgcaatctcgccccaagcccctgacgccgcatcatgtcatcgctaccacctgtaaaaaaaaaaaggttttcgctactcccggtaggcggcggcgcggcgaaaatcgtcggcggcgctgccagtggctcggcgccacgaatcctcagctggccactcctcccacccctgacctgtctatccgttcccattcctctctctcttccccaccatgcgtgtgcgctcgctactcctcctggaaggcagcggcgcagtgaaaatcgccggtggcgctgccagtggttcggcatggcgaaatctcaggtggccactccttccacccctcacctgtctatctgtttccattcatctatcttccccaccgtgcgtgcgcgctggagagcgcaagtcctgccggcggcggcggttgtgcatcacatcccctcccgctgatggctaatctttgcaacgctcccctctacttccattccccttcgcaaagt

SEQ ID NO: 34526 - DNA, 613 bp, Oryza sativa
cagtcccggtcagatccagtccaggcttcagcgcaagcatggcaaggaagtcgctggccattgaatgaaggttgaaatgggcgtccaccgggaaagctggcgaggggggcaggaggcgtgtgctctgcttgtcagaggtcacttccggctgtagactagccctcattgtaaaaagcatgtttcctttcttaggcagctagaggcccatgtggtgacccctgaccagataaaaaggaggcccaggcctagaaggggagaagagaagagaagaaaaagggttctagagcctgaactctctctcgctctccggctcgctggattccttcacacacagatccaccagaacacaggagtagggtgttacgcttctcagcggcccgaacctgtctacgtcgcccgtgtcttgtgcacttcctctctcgctgacgttcctcagatcgagggcgaagaacctcacttagcgtccccggccgaaccggcaaaggggggcctgcgcggtctcccagtgaggagccccacgctccgtcatctggcgcgccaggtagggggcgcgcgtgactttctaagccctcgtcctctttcgtgtgcgccaagcttctcccgctcagcccaa

SEQ ID NO: 34527 - DNA, 1501 bp, Oryza sativa
  unsure (1)..(1501): unsure at all n locations
aggacgacggcaacgaagaagacgaagaggactttggtcctgatggtcagcacatggtaaaccccccatggttactttctgttatgtttgatttgtgctattgcgaaatatgccaattgttgctcatgatattgatactgctatgcatgccgtgatctaagcatgtatatgttgttttacagtatatgttgttcattggttaatttagggttaaatcatgtttttctttcctagaatacgtatgacaaggcaaattggacagaagaaaaaacttacacattgtgtgaaatagcatgtgaggaaataagggatgggcattgtcctaatggagcatggacaactagagggtaccagaatttgaaggccaaatatttccaaagggctaacctaaggcattcaaccaaacagataaagaatagattcacccatctaaagaattattacattgcttgggtgtggctgaaccaacaaactggagctggtagaagtgctagtgaagaaataattgcatcaaatgcttggtgggaaaaaaaaattaaggtatgcagttgtcaaaaatttagctagtttacatgattttagagttttctgtgatattgatttagtgtcaatacaggagaagggggacgccaagaaatttcgccatggcaaccctgagtacttagattttcttatagagatatttcaaggagttgcagttgatggttccacagcatacatccctggttttgaagatgaagatgaagaggaaggagaagaagaagcaggggatgcaggggaggcagctagaggggaaagagctgtaggggatggttatgagaacagccccatgagcactaacagcaggaagagagggagtagcagctgtaatgtgtccacagcttctagtcctgggaaaaaaagcaagagcccagtggtgaagctcatgcaggggctgctcaattctttcaactttgattgtgataagtcaaataccctaattactgaacttgttaacagcaagaagttaaaggagcagaagaaagaagaaattgttagttcattgacaaactgtcagaggttgncagtagagtgtggtgcacaagaagaaagtgtgcaatacttttgtgccacacagttgtttgcttccaaacataacagagttatgtttaagaacattagcactaaagaagcaagatttatgtggctgaggagatggtgccagcagaagaatttgtattagatgatccctttctttagctgcatatcatgggtctggtctgcattagttgtgtcttagctgcattagttatgatctacttttgtgttgaactatcaacttgtttgatgtgatgtgacgtaatgaacatgtgatgtgtggacctatttaaaccttcccttcttttcttcttgaagtttgttcatattatatttatgatgtgctttctttctatgcatatgtcactcctgcaggatggtgaaggcagtggtgatgaagatatctctgatgaagatagcagtg

SEQ ID NO: 34528 - DNA, 1501 bp, Oryza sativa
gcgaagcagagcttgatgcccatgtcttcgcagtagtcaccgaagagttcactagttgtcacgaccgaaaataacccaacgggcgttccttacgtgcgtgcattattccttgtcccaggaggcaaggtacaccaaaagttgatacagttcagagttcaacaagcggaagcgtaaatagttaatttattacatgggcagcgaaggcccagcacacacaaagacaaacgagaaacagcggaagactagggcgacgaccacaggcgcttgacggcaggcacgagctagacaccaaaatcttcatcttccggagactcctcttctgggtttgggaaaaattgagcaagactgagtacaaccaccgtactcaacaagacacaccgacaagtgcataataaatgcaagggagtacaagggagttataatataaagggttagggttgcagtaaacagcattaaaagacacttagttgctcaaagctattttgtaaacacgattctagaactatacaatattatttatcaaggccgtgaacccacacgaacctgccttaactcaaggcctacgatgattcagaccgaaccggcaacccgaccctgggtcccagctcgtcccaagccaacccaggccaaccattcctccttttagttgttaagcaggttttaagaattaaaacactaacttgggtacattgctcggcttgcccataaccgagggcgcggctattcgaatagattatactctgatcagaggtgtacatctttacccacaagacacatcttcctcacgtgcaaccacgtgccacataccaccacggtatacagacggaagacgtgacatagtttccaacccatcctagccatagacaagagtaccgacccaatcccacctacggccgcaacccccgggacaggtaggcaggactgagcccctagcagcaggacaccggccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaactattttgagggttttgaatagagggggaggtgtgaatccaattccacaataatcaaaccaatccatagtgtccaggtgatacgaatatcccaaagtctagagttgaaaaaccacctaatgttacctaattaaatagcgaagcatctacctaaaatcatactagtggtaccatgagtagagtgtccactagttggggttttgtttattctagggtgaacaaggaaataataacaataacaataataaggtcataacaaaggaaaataggcatggctagataaaacagtgataacgcggg

SEQ ID NO: 34529 - DNA, 1501 bp, Oryza sativa
gatccttgacttggactgcagcgggaacaccactccacaggcatcctcgacggcacggacgaagcctactcctcggaaaagccaccatctggcgcatactcaaactctggggttggggaaaatagagcaagactgagtactacccactgtacttagcatgtcataccggaaccggggtatgatgcaggatataaccaaaggatagctagagcggttcatttgcataaaagcgagcatttataaacagtagttgaaagcggtaaaacagttgtaataattaatcaatattactcatccactgtccaatgctacaccacgttgcaacaggcccaaccatccacctgaaataatcaattccattagactaagctagggtgagactaatcatggtgaatctggttgaccgcccataatcgcgggcacgttttcgaatagttttactctgatcagaggtgtataactgtagccacaagacacagccccacgacacgtttccgtgcgctgacatgccaccacgacataccggaaagagaccgtgacaggacgcttcgcataaccccctctaaccaaacacaccacaccttaggtttcacccccactcctcgcaaggcagcgggcagtcccctctcgtgcctaggtgaatccgaaagccgcataggccgtcgcaggacccatccgaactccatcacgctcacccttgcctggatgcgtcagctagaggaaagctacaatacaagcccagccattgcccacgctggcttgtggtaagtacgaggaatttttccagggtttcccgcgaaccggtccttaaatgccatgggcgcgaccatcagaaccatgcacccgcggcccaccatttaatatattttaattaaccgtcaccaaagcggtggcactaaaccctcaacaatactagaatgtgatagctatacattaatgtagtttccccattgtgtgctagttgaactaagcatggctaagcaatttctaatccaacatctaatcaggtcatatcccatgctaacaaaggagcaaggtacaaagatagcatggcttgtaacagtaggtcaacatcccatagtaacattataaaacaatgcaatgtttaagggaaaacgatagagcatttgcaatataggttcaatatgttcaagtgacaagcatgacttgccttggtttgctgctggaggaatctcggtgactatttcaaagtacaccggagcgtcgggagagccggaatctaagcgacatacaaagcaaacaatacaaacagaatacaagactactgaaacagagaacaaaaccatttttaatggattctttgcatttttcttgatttactgagacttgaatgggcttaaacggagctcggatgagttttctatgaattttagaaggttcactgtgtttttactataaacagaaaaatccttaaaggatttattgcgcaataaataaaccctggagagagaaggggcggcaccgacacgcgggccccaca

SEQ ID NO: 34530 - DNA, 316 bp, Oryza sativa
acccctcggggagacagagggaggggtggccacgtcaccctcgggcccgacccccccgagggggtcaggccacgtgggtgactgcggctacccaagcctctagtcacgatacccccgaccccatgtcaccgacaataagcattatttaaatccctggaaattctttcctttttttctttttcctttttcccctcctttttccctaatgggccaccagcccatttcctcctccctcccgcacctagctgggctggccgaaggccacggcccagctgagcccgcgcctcctccctcctcccctcgggtcgtcgacagg

SEQ ID NO: 34531 - DNA, 1501 bp, Oryza sativa
gatggcataatagggttgcatttgcaaaagcagcatttaacaaatatttgagaatttgataaaacagttaagtaattaaacaatattaatccaacgctatacaacataccctgttgtataggcccaaccattctgaacaaccaccccggctgcacagttctatctccaaaccaggaatataccattccaaaccaggagctaatcaaattattaccagtttaagcatcttttacaatgatgagaggtgtgagactaatcacgaaagacattgttagacccgcccataaccgcgggcacggctattcgaatagttttactctggccagaggtgtaccactgtacccacaagacacaaccccacatcatgtcaccatgtgcctcaataccaccacggtatctcggaaaggagttgtgacaatacccctcgcataacacaatccactgcagcgcaccttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacggttaatgtttcacaaccgaaactcgtgaaccggtccttaattgtcatgagcacgaccaacaaaaccatgtgctcacaacccaccattaccaggttttagttggcacattaattaattaactaatcacgattgaccatcgtgaactatcatgaaaccatcattaaataatagtgaatcattagttatcccataagtgagctaatgtttctaagcatggctaagcaattatatctaatatctagttgaaccaatataaataaagctcaactagtcaaattataatatcccaaggtatcaaggaataaggtgatcaagaacaaaagggctatagcaacaataggtcaattccactcaatgacattcgaaaatagatgcaatagttgaatagaaacaatagctttaaataggatcaacatgctcaaagggttgtttgggatctgtgtgacttgccttgctgccttggaactcttcaaactcttcttctgcgaaaacggactctccggaaacgacggaatctaagcagaaaagagcaaaatcaccaaaacagcacataaacaagcatgaacagtacatgtggatatttttaatgtgtagatctcgattttagaaaaatttagagacttgaaccaactaaatcggagctaagatgaattagttatgaatttttaaagattaaatcggattaaaacacttaaattgattttaattgaattatggcgcaataatgaattatttttgaaaaggaaaaggaggattattgcgtcaacggctagggtttggtggaccgggcgcacgggcgacggttcacgcgaacggacggccgagatcgaaccaatccaaaacggacggccgagatcgatcggtctacgaccggctcacggaagagggcgacga

SEQ ID NO: 34532 - DNA, 1411 bp, Oryza sativa
gtgtagttacgtccataataaaagtaatcaccttagagcattatgaatgtataggaagtattttaatcaaatctaaaatctaaaagtaacttatatatatatgatactttgttcaatgaaaaaaggtattaattaaagttactttctttttttataagttacttctataatatatgtaaattacttttaagctttactgaatttacttttgtatgtctaagaagtagcttagtgaaatctaaaagtaatttagatatatcttaaaagtaatttgcgatttttcatcaaaatataatcatgtgagatcttattgtaaatatttaattgttacgaacacaacggtgtaatcggatcgtagattggatgagtagtttaagagaaaattgtatttaaagtataggttgatggtgtctcttatagatgaagtaatagctaaaaccagctatcactagctatatagttacgtccataccttttgtaagtaaattacacaaaccagggcgtgattaagctacgcaacagtaatctggatgccacccaaatggccaacacaaacaaatcagtcactgtcgagcttaaactacactccatgaatatttcatacaccgtccataatttattttaaattcgcatttaattcgctaaatccaaatgaattatcggtcaacgtacgccacacaggcatgcatgcaagccgcatatatactaagttaggtttttttctccacacgcaagctgccacaaaacctagtagctcatatgctcatctctgcctctagatttggacccaaataccgcgacttgttgatacctaatcccctataaaagccccacctggggtgacgagagcttcacacatcaaacaaacacgacctcaacaatggcgatctctagtggtagtagtagcagctccagtgccttcccctttttcctccttgcgctcctgtgtgttacggcggttgtgttcccgcctgccgccgcgaggaccttcccggatgacaagagcggcggcgccgtcgtcagtggcagcaagttctcgctgccgttcccgagtaaagccgccgggtccgggagtggctctggcagtggccatggtttcggttggatggtgtcgcacaacgggtccgacacgaccatcgggttcggcggaggtgttggcggcggcgtctggaccagccgtggcggcggctcgagcgccggtggaggcgtcggcgtcggggtcggcgtcgacgtgggcagaggcggcgtcgatgtcggcatcggcgttggcggaggcggtgccgcgagctcggccgacggcagcgtgggtggcggcggcggaaaaggcgtaggcattcacatcggccctggcggcgtgaccgtcacccacggtggcggtggcggcgcaggtggaggatccggcgggggtggt

SEQ ID NO: 34533 - DNA, 1501 bp, Oryza sativa
aaactggatatctgatgctgatgagataaaagccacaagtggatatgtgttcacacttggaggtggcgatgtttcctggaagtcttgtaagcagaccatcttaacgaggtcaacaatggaagcagaacttacagcactagatactgcgacagttgaggccgagtggcttcgtgaactcctgatggatttgccggtggttgaaaaaccagtgccagctatcctaatgaactgcgataatcaaacaatgattattaaagtgaacagttcaaaggacaacatgaagtcatctagacacatcaagagaagactgaaatctgtcagaaagcagaaaaactccggagtgatagcattggactatgtccaaacggctagaaatctggcagatcagtttaccaaggggctaccacgtaatgtgatagacagtgcatcgagggaaatgggcttgatacccacctaaggttgcataatagtggaaacctgtccattatgatcagagatcccgtgaatttggatggtgaaacaaactattgtgtgactgagagaagagacccttgaaatgggctcattttcatgatgtgcttctcttctttcctgcatggtaggatggcttatgtcttaatgtgatccgagtggcttttccaagcagagatgttgacctgcagaacatcttagaaggaacacacctatatgagttcgactgctagtcacagtctatgagatttgggtgatctctagatactcatgaaaggcctggagtatgacttataagctccaacccgagggaatactaatggttgcctagtatcagttatggaattgagtgaaacctaactgcacaagactgacaattcaaggcatagtccattgttcagttgtggtcaggtgtagctccttttttaggtgaaagttcaacttaacagtcttcaccgaaacactggtatataaaagctgctatggaatagagagcattctcatgagccttgaaatttggtggggattgttagatttaattgggtaattaatccatttaaatcaattaaatcaaataaattccaaggctcattatgctaggaattcatgtgaattcattcttctatgggatatcaatgggatgaagagttttgagaattaatccatttgattaaggaattggtaacttatatcaattagtcctaattgatggatggttgatggttgtgtagtggaggatggttcatggctagttgatgacaattagttgctctattcctcttcctattccattggtaacttacatcaattactcttaattgattgttggttgatggttgtgtagtggaggatggttcatggctagttgatgacaattagttgctccattcctcttcctattccatgactcttactcttcatcttccattcctcttataaaatgagaatggatttgatctcccgcgagaagaagaagacacactttcatccattttcaaaagctgttgctgctacggtaatcccatcccga

SEQ ID NO: 34534 - DNA, 1501 bp, Oryza sativa
tttccattgttgtcccctctctcccctcgttaaaactcgaatattagggaaggatctaatatcaaataattagaaggggtgaggctttgaacccaggtcgtctagcccaccaccttgtggagctagccgaaaaacccctggacatttctctctctctctctcccctcattggcttcctgtttcttcagtttcacagccatcttcagtttcagtggaggtagttggtaaaatcgacggtcaaaagtttggtccgtggaaagtacaaaatatatccatctggaagctggttaattaggtagagattctaaacctcacagcctttatagtatataaacaaacaatgttcacagaaaggtgtctgaacagtagttcatctttcttaatttggaccatactagtatatatatatatatatatatatatatatatatatatatatgcttcataagtttcatcgaaaattgatacgtacatataactgtttggaacaaatcgggttcgtaaggtcaaacgaagatataatctgcgcgagaaaatgcggaaaaggcaaattatagggaaaacttggcagaagattgttttcttagtcagttgaacgtcgaactcttgtatctgactttgttaatatatacgctgataattttttatcctactttcggaagggttgacctttagcaagaaaattatacattcagttgaaagcgaaggcacggccatatctaaagtcaaaaagaaaccgaagtgcatgacagtccggaaatagaatattaatcagttatcttaatttccgaaagtataaattttacatagaaaaatgaaattgcagctgtaagtatgcacgtttttgttggtctaacgtaattaatgtaaaataatcgaggctcccaatctttcttttatcacccatatcatatatttttaccaaaataatagagattatacttgctctatcccgcccaaaatataatgtgtccttaactaatgttctatgtaaaatttgttagatttaattgggtaattaatccatttaaatcaattaaatcaaataaattccaaggctcattatgctaggaattcatgtgaattcattcttctatgggatatcaatgggatgaagagttttgagaattaatccatttgattaaggaattggtaacttatatcaattagtcctaattgatggatggttgatggttgtgtagtggaggatggttcatggctagttgatgacaattagttgctctattcctcttcctattccattggtaacttacatcaattactcttaattgattgtcggttgatggttgcgtagtggaggatggttcatggctagttgatgacaattagttgctccattcctcttcctattgcatgactcttactcttcatcttccattcctcttataaaatgagaatggatttgatctcccgctaaaagaagaagacacactttcatccattttcaaaagctgttgctgctacggaaatcccatcccga

SEQ ID NO: 34535 - DNA, 1501 bp, Oryza sativa
aataaaattggcgatgtgaactatggagttcgggttcagatgatgcaggctgattccatagaaattcagaattccccgaaaaaatcttgaggttggaagggagaaaccgccatagaagaaatcagcaaataccacgacttcatgcgtatcgggggtcgggaatgcttcgccgaatgccggtcgccacccgataatctccttcgccggaagaacgccgtgcgccaccatctccttcagattaccttccgtcacatcggagggcgcccactgactctcgaagctttctctttcttccgccatgaatgtgaactgaatggtttaatttgatccgagatatggctggaaagggatggggaattgaagcggtggacgcggggtgaaatttcgtgaagtttttgaggatggattggagcggattgatgaattgccggcgcagttttgtactatagcaggaaatggggaaaatggcgagagtctcggcggggaagacgaagagacgttttatttcacttcggtgttattagcctaaacacagtactttagcccaattttattttcagcgtggcccgttgtgatctctagggacttaggcgctttttgctttggcaatttgtgctcacaatgatgtggactaatgctgttaaaatcctttttaatgtggtttgataattctttggaattaacacgatgcaaacaaaaggtgcctgacaggaaggtgttatactatttttgtaagccttattaggctgcaaaagctgtttgggttgattggagatgactaatttattaagagtcattctcttagcatgttatatgcttaatttggttatggtgagagtcatagcttaggctattagactcgttgattactatgatttttatcatgtttggtggatcattttaagagtttcttactcggattcctatcaaatatgtctatttttagaccttttgagtgtttatcactcggcccttttcgtattttttatccttgatatgttcaagttgagaagtagtcggctgggtattttactgagtaccatgcatacttcgctataaaaccactcggttcttggctacatgtttagtgtttcaactaatcacatagtcggggggctacacctaattaggtgcatctactcgatgcaccatgttttattttcgcccttcacagtctttgattttagcactcggcaagctggagcaagttgaattgaagcactcggattactgttttttgtttcgagaaggctattttgtcaactgcgaaggtctcgggggctactgtggagattatggataccccatatctacatgacagttataatttagtcggatatacggtaccaaatatagatagaatatatttatgagaactcgggttagtttctaacttgtatgtcaaggaaatacccgagatcttagtcggttaagattgtattttatctgtaatcacatattcctttagggatatggactgtattttgtaatacggatctct

SEQ ID NO: 34536 - DNA, 1501 bp, Oryza sativa
catcgcatttaaaggctacaggtatttttcttttttacggagtgatcaaaccggatcaagggataaactactgcaaattatatcttctcgccctagtggacttctttatggagtgaactatatcaaatgttttgcttttgatgctgatctaattagtctgctgatcgttacggagatgttggtcatttccaactcttaatcttgctaatttttttccttcttttgctccttgataggctcgcttggcaaggaatctcccccacaaaattcagaaaagaggagggactgcataatcaggtactgcatactccccctcacagcttcagtaatgcttgcatgaaaaagttattaaaacaggctctctcaaaacaaaattcatttctttgccagttactaagcttaccgtctttaacaactgagaattgctttattaaagaaaaatcaaagtaaatatgagtgatcttgagtgttgtaaatttgatggtataacagcatagaagcacatggattttatgctgctatgttgctgtaacacaagtttgccaaacatttatgcagcatctccatgttctatctagtagtggtttattttgtgtacaacagtgagatattactcccaatgaaatttctacagatttttataaacatattgaaatatgatccattctctaaaaatatgaatgatttgcactatatcatgtaataatctagctcataatgtattacttactttgttgtattttaatcatgaatgatttgcactacgatatttccacatttggttgattaagtatctgccaatcaattgccattcatcctttttattttctgggagcaattttaccatcattttttgcattgcacctttgactgatatttctaagcattgctatttccttttgagtacctcgacaaacagagttgagcccattgtatatcctataactgattaatgcttgtaggtatggatctatttgagcttcaacaaagccctatcagaattttgacatttcttgtgcatgtcaaaggttctgaatagatacacttcaccatttcttttattgcaggataacatttttagctattgtttccggttaattttcaacatatatagattcatctatgttgacattgacgatcagcgattgtgccaactttattcagttaaaacctgatctagccatttgcagttgtgcaactgccgttgataattttttttccttcttggtatagtcacatcattagtttgttgtatatgcatgtaggcacttattatttatcatgtgcagattttatccattggcataagttatactaatatctgttgttttatcctttgtgttcacaaaatttgtattgttgaagatcatttgaactttgaagtctattgattttggcgaattctgaattcgagcaaggttaccattgaccatattatttggataattttatggttgtttctgagatggatttcgtgtccaaaaattgttgatcactgatt

SEQ ID NO: 34537 - DNA, 193 bp, Oryza sativa
ccaccaccaccaccactccccacctcgccgcgtgccctcgtgacctcctccttgatcccccgcctatttatactcgtctcgtcacccgcctcatcatcaacagcagcagcagcaaaagaagaaaaagaaaaaagagtgatctagctagctcgcctgagttcatcagctgtgtaatttgagttattagcaacaa

SEQ ID NO: 34538 - DNA, 237 bp, Oryza sativa
atcgtcgcctgcctatataactataggctttgatgacctcttcgaccttttcaggatccggaagttggacactggtcttctaaaatgctactccttgtaagtgcataccttctatacttgtgatatgactggactatatctcctaattaaattagttctaatacgtaaatattttaaggttgtgttggatcgagagtcgacgccatggtaatcaggttgggttccttgatccatcca

SEQ ID NO: 34539 - DNA, 1501 bp, Oryza sativa
tagacgactatgaccgtatccatgtggaacatcgggaggacatggcccgcttttggcgaaatcatcggaggactgatcgtcaggaagcgatcgcccaacgccgttatggtctagtttgtgtttcgcctccttctcctcttagggtagtgtataatattagtagtgatgacgaaccaagttcgccaaatcacaccttagggagtggagggtgctttggaggcgaagatgtaattttttttgtaagttaggctataaagccagttaccttctttcacctgtaccatgttgtatggcatatattttttgaagttaatacagatgtgttatatttccttttcgctattatacgcatagccacctttcgtgcttttgttaggttgaaacatgtcggcccccttgcgtatattagcgaaataggtctgctgacttttcagctttcgacttccgttttcgacctgtagtattccgcgttaaagaaacgctcgtgttttttacatagatcgaatacgacggtgctcggttattcatttcctgaatcaagttgtcgcggtttcaacgttcggcgagcgatgtttcggccgattcgttttgccccctagcgctttcgctgatcagacgtttgccttggggtttttccacgaattatcacacacaagtaaaaaaggcgaaagacataaggattttatattggttcgggcctccaggatggataatagccctacatccagttttttttttcattttcctctttttttttgtatttttgtgccgaagggcttacataataagagatgccgaaaggcctatatgatagtatgtacatttttacaagatggcgaatggggtgccaccccttctagacatagaaacggttaagagaagcagcattccaggagtggttgaactcttcgccttccagcgtcgccaagcgaaaagagccagtcctggacctatgcttgatgaggtatggcccttcccacttcgattcaagctttccaaccgccactaggttggccttcttccttaggactagatggccaggcaacagctctgtcgatcgaacctttttgttgtaagttgccgaagtgctcttggcgtattcgtgcatgtgttctagtgcttcgactctcaccccttcgaggagttcgagcgacacctcgcgcccatcttcgcctccagagaacattacccttgatgagttagcccctagctctgttggggtcattgcttcgtcactataaagaagcatgaacgagctaaacttggttggccttgtgggggtcgtccgaaaggcccagagaacagataacatttcgtctagccatttgcccttcgccgccccttcaagcctcttcttgagcgcctcaaggatcttgcaatttgctcattcggccgccccgttcgattgtgggtgtgcgaccgaagcaaacttgatttgcaggtctaggccttcgcacatctctctgaacttgtcagaatcgaactgcttgccattgtcagt

SEQ ID NO: 34540 - DNA, 764 bp, Oryza sativa
cagtgtaatttggatacataggccttctatgggccgactggcgaacgttagtgaaacgacccacatatttccacaacaagagtagaatataagtctatagcatatatcttcataaacatcgtttactcagagatatgcacatcagagttgcatagcagaaacatcgcattggttccagttattatagtaccatagatacagctcaagacaagcctcgagcgataacagcaaaataatatacaaaccccaaaagctcagcaaatatacaacacactagaaaattcacaagtaccgctacagatattgcttctattcatattaacgttactgctactagtacaaatactaccgctgccactgctactaccatcaccactacagcaactatatgaaccatgcatattatacactaattatcatagtcaatctcagcatcatcgtagagtccttcctggttgtcatccataacatgagttccttcacttccagccatatattcttgttcaacagattctaatgattcaacatctatatacaaggaattaacataggggatgagtacaaatggtactcaacaagcccatcaatagcaagaaaatgtgtgaatgcaactatctctagaatccaagattcttcaaagaattcataatgtttttgacaaatatttgttgcaaaaattcaaattttaattataaaacactactgcatatcaagtaccacaggatagaatctccgattgatccctttcctgccgcgttcgcagt

SEQ ID NO: 34541 - DNA, 1501 bp, Oryza sativa
agcatacacatcaaagccatcaaaacgggacatttagctaaacccggttcatctatttcatatatcaaaagggccattttcggctacaatgcgaaagggggagggccatcggccaaatttacatcgttcgccttccgcagccaacgccaaaagaaatctaaaatctgaaaaacaggcggaggtcctcacacctctagatgatattggtcgacgtccgcccctgcacccgtatccgctccaccttcttcggtcgctggctccttgccctgctctgctgcctctaccttcgccaagtgctcgagcaggcgcgccttaacggtagatcggccctccttttgccagaactgcttgcgccaggcgcgtaaggcgggcgaaacgtcctgagagctgacttcccaatcccccttcgtaagcttggggaactcggcgatgtgctcgcactcattttgttgcagcaggcccatggtgaaggccactgacacacacgcgcaacaattggcgtacgcggtggcggaatcggagaccgcaccgccggcctgttgggtccactccgagaagtcgaaggcagaagcaccttcgccagggattactcgcaccttctcccccatttcagtaagggcgaggcaaagcgtgtggcacgtggtctttacggactcagtcgccttcgccatctcccgcgtgaacctttgtgcgtctttctcagcagttgcttttgccttgcgggcctccagacgaagagcctccatcttcggctcggtaaggttgtattattcagggtgcgctcattagtgtaggtttggctgtgctgcgcgtatagacatgcatcaggcgtggaggagggggcgctagtcagtaacatggacacagatgtaatggtgacggtggtgacgagagttaggtggccgtctgcctttccgtctggtccagacaccttattacccatcagttttcgcagtgagctaaactttccccaaaagcttgcgtgttgtgttttgccattcatcgttccttccagagcaccgcaccaccattgttgcatgtccaagctcaagctcacctattgcccaaaatatactgctgtgccctccccattgttcttcgcacagaggacatctcgaggtcgcctgcaggagtatgaagaccggcggtcgtcgaatctcgaatcgtggcagcaagcatagagggcagtcgtcgtctgcatcatcttcatcgtcgccagtccgggcaagcctggcagaccacgcgcatggcataggctgcttggcctaaaaaggaagcatccacaagcccactttggtgtggtgcatcggaggaggagaaaggtgccgttcgcaggggcatcggcgcttcgtgcagagggaaggcatcagctgcccgattccggaatcgctgtggccattgcagagaccggtcatctccgatctcgtgctgcacagttgaaggggatttggcgcccttgcatcgccattgcggaaaggggatccagctctatataagggca

SEQ ID NO: 34542 - DNA, 382 bp, Oryza sativa
  unsure (1)..(382): unsure at all n locations
atcgcccatgtctcgtttcgcgaaagaaccgagtatcnccgcctcggattcgacgggaacgaaggtgccatctccggcgcgactgagaaagtcctagacgctgtcgcaatccaatgagcnccatttccattcaatatgcgttctgtaatcacctctcaatgccgtcttttaacacaaccaagaacacctcatttggtgcacccaatctccaggaacgcgaccgcgtcaactcggaacaccgtagcgctctggacgccgcagcttcacctttgcctgtcgcccggcttcaacagttcgtaacaagctgagcctcttcgccacgagcttcatcaacaccttcagatcaagaatcccgaagtaatcgacgcgaggtggaccacga

SEQ ID NO: 34543 - DNA, 190 bp, Oryza sativa
  unsure (1)..(190): unsure at all n locations
acgccaanataagagcatctgactacactatcggccgaattcgagctcggtaccctacagtatcctgatactttggtagcacctgagtttagaagatcgggtaactggtttaatggtggcggaagaaaaggccgaggccaaggaagaggaaggggatggagtggtcgttcttatcgacctgactctgata

SEQ ID NO: 34544 - DNA, 462 bp, Oryza sativa
  unsure (1)..(462): unsure at all n locations
cttaaaaaatacagtactcatagtgaaagttgggtcggctgctgcaagtgcaagcaacnntaaatgaaatatcacatggcctacattgacatgttaagtcaaatagcacatttctaaagatatagtttacgatataaatgtagaaatagttaggataaagtgtgcaattggatgaacttccaagccccagaacagcaagccatgcaaaccatcacagattggtggagtgagctctgtaattccatacctttgttgatgatgtggtggaacatatggctggtacacaatagaattttccaacaattgttgaagaatggattctaagtcgcttttctagtgaaggaaaaaattagcctaatagtcaaggatctgtctgtttcatgatctttcaatcaatcgctctctttttttatgtaaatcaatcctcatatcttccctagatgtttttttccttttaacaga

SEQ ID NO: 34545 - DNA, 897 bp, Oryza sativa
  unsure (1)..(897): unsure at all n locations
aaaaactatcaaaagattggatgttttcattttaaagtgctngtaaatgaactcaatcatttttgttaaaagaaatatgtgttgctctgataactcaaacagatacacaaaacctaantattccctcgaccttgcattgttttagtttgacaacttctattttctattttatagataaatttataagtactaaaaattacaccgtgctaacgtagtatgttacatggtaaatataaacatatgaattccatttatcataatcgaacaatttaaaatatatcagtggtcaaagtaaagcaagcaccagtcaagattataaaatattaagaaattgatggggtattatataatggccccttaatttgaagtgctatttgttagtaagataatggtttttcactttgacatccctctttcaaataaacaagtcctttgtcgatatttgttacccaaattaccaactttaaattattatatttctgagtaccataaatttatcttacataagcttatgaataaatattagtttatttattctgactagctaatgggtttggaaaaatatgccccacccatcaggtaagattcaattctagccatccattcttttcatctcatttaatcctaggcatcctctccttttcatttcccaactccacctcccataaccattttgccaaacagggtctaagtgttgcacattcagtccttcatgtaattaacatgctgcaaaatttcgtatatgtatttacgttattttgattcataaatgttttttttccttgtagaaagcagggataatatattgggatgatatatatatggaataggggtcacaacaaatgtttacgagccaaaggtgaagcatcattgggttcctagtggatcatggataca

SEQ ID NO: 34546 - DNA, 189 bp, Oryza sativa
accgcccgccgccgctccacttccacccgcgacccctttgctccgcccaccgcccgccatccttccgcccgcagcccctttgctcgccgcccgccgcccgccggggtagagagaagagagagatggggtagagagaagagggaggctgacatgtgggaccacatgggctccaccttttctttttttagc

SEQ ID NO: 34547 - DNA, 1501 bp, Oryza sativa
gcctcgccccggcgacctcgtcccacaccacccgccggtcggctggctcaaaggaaaaaagtgagagagagatgacgtggcatactgacatgtggggcccacgtgagtcccacgctgagtcagctgccacgttggacaaaaccggggtcaaaaccaccgaaggacctaaagtgaacggttttgtaagatgagggatgtcatatatctggttttgcggttgggggacgattttgtaactcgatgacaagttgagggaccttcgtatacattttccttttccacacctctggataagattatttttttcccaggccggggtgaggggaaaaggctaggatgggctgggttagaatcccgactaggcttaaccgaacacacatttctatgcaggccgtgatttttcccatgccaggctgatccatggggtttgggccacaatcccgcccgaaacgaacaaggccttatgcttttcttgcaagtttgtatggaataataagatgagaccattttcttatttgagaattttcttcttctttatgtgcatgatagggagacacaagatttctacaagagccagattgaaatactcaagaaagaaatgcaatgtatgtcaaaaggtttcattgaagagcgcaaagtcttacagagagagatgcaactgttttaccaaaattcccagctgcagctcaatgagcagatcagtgagcaacagaggaggatggaacagatctgggggcagttcaacaccttgatttcggtaaacacctactttcttgtttaatctttatagttggaagcttcataattggctttcaagttttgatagattcgactattcttgactgaaaattttctaggtcctctcccttatattcttagtactcttagttctttacttccttgtgagaatgcatggtaacaccaaaggctacaaacctaccaaagtcactcggtcactgaactgaagactacggaaaacagcaatatctacaattatcagaactaatgatatgaaccaaaggacaacccgatataatagcaactaagcttgatagtttttttgacatttttatactaacaaaatgggaacttcaaggaaactgagtcaaggaaaaaaaatccttatgaaaggcatttccgtcattccgtgtttcactgtcaaaaaacaatctcatcatttgaagaatttagcatctttgctgagctgaatttatttattgctctttctgactaatgattgtaaatttgtttctgtgacaggacacaagtactcctggggaccatgttaagaaacacactaatcacaggtaggaaatctcttgttctagaaaattgaagtatcaaatctttggcccgtctcgtacacaggctcgccactcagtagactttatgtaggtgattctaattagttaaaattttggacatagtatacttgatcatttaacataacttttaaggggcttatcttatcagagagaaattagaacgcaccgactgaaat

SEQ ID NO: 34548 - DNA, 1501 bp, Oryza sativa
ttccagccttagataaagttcgttggcaaacaaaggtagttttccaggccgcccatatactatgttctgaaggaaggagtctctattccactgcactttattgtccttgttaaactcgccattcatgacaacaatcctaacttgcattgaggataaaggtccatttgtgataatcttattatcatgatcatatatggctactttgataggactgccgtcatcagctgttatgacgtgtctcgagaacttgtcgttgcaacatctgttctcaaatttcagtcggtgcgttctaatttctctctgataagataagccccttaaaagttatgttaaatgatcaagtatactatgtccaaaattttaactaattagaatcacctacataaagtctactgagtggcgagcctgtgtacgagacgggccaaagatttgatacttcaattttctagaacaagagatttcctacctgtgattagtgtgtttcttaacatggtccccaggagtacttgtgtcctgtcacagaaacaaatttacaatcattagtcagaaagagcaataaataaattcagctcagcaaagatgctaaattcttcaaatgatgagattgttttttgacagtgaaacacggaatgacggaaatgcctttcataaggattttttttccttgactcagtttccttgaagttcccattttgttagtataaaaatgtcaaaaaaactatcaagcttagttgctattatatcgggttgtcctttggttcatatcattagttctgataattgtagatattgctgttttccgtagtcttcagttcagtgaccgagtgactttggtaggtttgtagcctttggtgttaccatgcattctcacaaggaagtaaagaactaagagtactaagaatataagggagaggacctagaaaattttcagtcaagaatagtcgaatctatcaaaacttgaaagccaattatgaagcttccaactataaagattaaacaagaaagtaggtgtttaccgaaatcaaggtgttgaactgcccccagatctgttccatcctcctctgttgctcactgatctgctcattgagctgcagctgggaattttggtaaaacagttgcatctctctctgtaagactttgcgctcttcaatgaaaccttttgacatacattgcatttctttcttgagtatttcaatctggctcttgtagaaatcttgtgtctccctatcatgcacataaagaagaagaaaattctcaaataagaaaatggtctcatcttattattccatacaaacttgcaagaaaagcataaggccttgttcgtttcgggcgggattgtggcccaaaccccatggatcagcctggcatgggaaaaatcacggcctgcatagaaatgtgtgttcggttaagcctagtcgggattctaacccagcccatcctagccttttcccctcaccccggcctgggaaaaaaataatcttatccagaggtgtggaaaagg

SEQ ID NO: 34549 - DNA, 1501 bp, Oryza sativa
aaatacactacgttaccggcttaccgcgtcaaaaaaggcccatagtacccttagaagtgtatggccaaagctaaagaaaaaatctcatatgggattcatactcaacacaatccaactttacatgttaggtatatatcctttttatgatatatgtatttatcgtttaaactattttgaaaatgttaattattgatttcatgtcacgtactttgacttttcatgtacattgcatgcactttgacttttcatgtacattgcatgcatgaattaggcgacaaataagatcatatctcaatattcccagttttgtatgtttcctcccaatagtttgactacaataaatataaaaatatcattccattctcctcagaaattacactaagagaataaataacagtggtaacctatcattgccctgtctaagagaattctgtaaaattaaagtgtggttgattattaatttgtaccatgtaagataattggttttgatatttgtagataatagatgaagtggttttagggtcgatcagactagggtttgtgtaccggtcagacctgacaaatattatgaattgttttcagatgatgaacatgtgtttcggttgtttggagtcggtcagaccgggcgcatggccgttggtcagaccggagtggagcgagcggttagaccggccatcccgacggtctgaccaaaccgactttgtgccggtttcggtttcaagttgtttatttggatatccgtgattaattcatgcttatggcttctagatggatactatacgtgtataatactgttgtgtgctaatgttgattcaagttggagagaacatgtgctcggatatggtttctttattggttcatgtgtaggtgtgtcggggttagggataaggcataatcatgagatatacggatacggtatatccacaaatatacggaaaggaaccgtataaaataaagaaatagtatttgcaaaagtagaaataacatagtcctactcggagaagattaggatactatctagtcgtacggggtccgttgtctccgagttctacatggaaactaaggtgatccacggtataaacactaagcccctgaggtgtacatggcatcgaatcttagtgcaagacatctgccaccacaaacgcaatccggagaacttgaagcctactcgccaatagatctcgtcgacctcccctcaacgaggatctcggagttcagttgttctctattgtactctgtggtttcttccataatcccccgtataaactggattagggctactaccttatgaggggtctgaaccagtataatccttgtcttcttatgtgcttggtgtcggtatcgtgtagattctcataccaatgtacctcaatacccttcgaatacggtcaacgggtatcccccatcaacagggtgagtcttgatgcctgatgagagcgttgtcggtgatggatcatgagtcaacttgggagaagatgacatccgaacgatcaaggtatca

SEQ ID NO: 34550 - DNA, 293 bp, Oryza sativa
caaagaaattggcgccgcgaaaaggactaagtttttttaggggtctatttgtaaaataagttttctaaaagaatcaaaatgtgaaaaatccaggctattctgaatcaatttcactccttgaaaattgctcatccataaaacaccagcctaaccacatccatcatcttgaaccaaaacagcaactgtttgtttgaattgaccaccaggcactaatcatctttggcacaagaagttgcacagcagagaagggtaaaagagatgactcttgactcggcaaacctaaccagacccca

SEQ ID NO: 34551 - DNA, 1501 bp, Oryza sativa
cttgaacttcctttataaaagaaaattatcttgaactttcaaaatcattcacttttcaaccttaagctgaacttagaatggttgaaatgtccagttttgaaatataaagttgattttaagacttccatgaaagttaaggatgataaaatgaacttcttcctttacaatattgtttctgttagatacaatatatgagatcttgaaaagtagtttttggatagtattatgtgtgctcagttcttaagtagcaaaatttacatattgtttgatctcaaaaggataggagccaatagattaatgaactaccttgtacttaagatatgtcatatgttaactgatgtatatcaaatttgaggtttatcagaatttataccaatattgttgcaaattaattttgcattttacgtctagaaagtgatgctctttaaactctattggcaggcaataagtgaagttgttggttaccataagcgaatccctgcgcctaggttggtacttggtaatattggcattaatacattttcctttgcttcaagtttttcggttgtacatggagttacaacatacctgctttaagtttttgaattgtacatgaattaagaaaagttttgtgctattttaactaatgttatgatgttagttaacagatgaagaagcacatttcgttcagtttttcattttgtagtttcacatatgttgaatttgcacctataaactgacatagtgtctatctctttttatagaaacataatgtttatctctgttgcaagaatatgcaattttatttactttgctgtaaaggactaaaaaacattgcattatctttccagctttctttattttgtttttgctatgtcagttgtcaattgactagatattttatccgatgttgaaacaaaataagattatataaatagtgaagtcatcttctgaaggttaatcgtttggatttctgttgcaaagaggtggagttagggaggtttggaatgtactagccacaaatcgggatgttgtcacacatgctgtcattattgtgggattgagcaaccatgatgatcttaatttatttatgaagtcctttctttaaagtcttaattggcttgtttgcctattggggagggttaacttatcaaagggttcagcttgcttggtggcctaactttacccatcgtgttctactagcaaggctctcagtgaaatgacatccaaggctctcacatgttctcgaaaaagtgctagctaaaattaaaccgggcaccttttttctcaagaaagtagcaagttaagagttgagggaaaagagaacatctagtccatcatatctcattctcatatagtcacgtgcatatatgggatacctgtattgctctgtgttatttttctttgtttctttgagtacacataagtaactgccatatattaaagttcaacactgtatgtttatgatgtacttgcactattttttaggatgttacctgatcagaactgcagcgaaccactt

SEQ ID NO: 34552 - DNA, 1297 bp, Oryza sativa
ttatctagcccaattttatattgagatttaacaaattaaaattagatcttctcttttaggcttttaaaatcatttctaacaattccttttaaacaacaatttataatttaagcatttttaaacaagaaaagctcttaacaaaaataattagatcattaatgatcaaataattactgaactgttctttgtatcatttaggaattgagctccgaaaaatccgagaaaatttcagagagttgacttaatcatggagaatttaataaaaattaaatccatccatgctttatatttaggaaattttatttcccacatttaacttttcttgtaaattaaagaacatttaatataaattctattaataatttattaaataatttataaatcctaaaacgaaaaaatcaggatgtgacatcggtctgatgatttaagactacgcctgcagacttatgttgtaataattcgcactagactctcgtgtatgtgcatttggtatctcggctatgaactcgtgtgtaccagactacttgatccagggaaatggtactgtttacacgattgattcctgttataaaaacgggggtctacagagcccgatgacattaaaaaataaatgcacagttgaaataaatagagaatttaaatataggatcagcatgctcaaaggaactgtgtttgggatctgtgtgacttgccttgcaataacgggtcttcaattaatcttcttgaatacttccggcgcactcgcgaaccttcgaaacgacggaaacgacaagctaaaacgcaaaccaaggaaaaagactaagaaactccaaataaccaatacatataaagtaaacaaatgtgtagatcatgattttagatgaattatgagacttgaacgggctcattctgacttcatatgaaataattacgaattttacaagatttaatctaattaaagcctatttaaaaaggattaaataaatttaattcaatttatggataattttaatatgtagatctttattttatacaactttagagacttgaaccaactaaaaccgagctaatatgaattagttatgaatttttaaagattaaaccggattaaaacatttatatggattttaattgaattatgacgcaataaagaattatttttgaaacggaaaagggaattattgcgtcagtgggctcggctcacggtggaccgagtgcacggcgatggtctacggaacgggcggccgagatctatcctatccaaaacggacggccgagatcaactcggtctaccgtggtctacggcggacggcgtcga

SEQ ID NO: 34553 - DNA, 199 bp, Oryza sativa
ttatctagcccaattttatattgagatttaacaaattaaaattagatcttctcttttaggcttttaaaatcatttctaacaattccttttaaacaacaatttataatttaagcatttttaaacaagaaaagctcttaacaaaaataattagatcattaatgatcaaataattactgaactgttctttgtatcatttagg

SEQ ID NO: 34554 - DNA, 1501 bp, Oryza sativa
cacgacttccgaaatggctggccgctcctcccaccgcagccgtcatcgcaacctgcatgatcatggtgatgaggccgccgatgtccgccccgaccagctgcgccaccgtcgccgcctgacccagcccgccccacagtgccatggcattaaggtcaggattctgttcctgctaacaaacggatatggcaaagaagaaatgaggcggctgttgccgcgtcttgacatattaattttcatttctcaaaaaaaaaatcttaattgtcagcgtctcactgacctcgcttatttttatactctagttgccctttcttttttctggcaaggacactaggtgcttgttttgaccaacatattttataatgaatcatgcttgcatctcggggaaataaaaatatgtccaataagttaattatgaaatacaattcacgttgagatgagtgttaactggcggaaaaaaaattcacgttgagatgagtgctaactggcggaaaaaaaaaagagaaagggcacaggtaatgggaatctatcccacgatatcacggtttagggcatgcaaccataaccagattagctactaaccaatctcattttttattcaactactgtccaattgcggtgtaattataccgtaattacattcgtgtgaattttattaaaaaaaaatctttagcgatttatagctagtccttctgttcttttgtcagtgcaattcacatcacaagttgagagcaagggatcaggagttgttggttcagaagagctgcacaagtggagataaaaaaaatcagcaaacaagatcacaccacatttgtatgtttaattgtgtatgcccacaaaagaaaacaaaagcctggtctcaatacaaatgatacgcactttgcgtatttgcgaaaaaaaaacaaaaagaactgttgggggatattataggcttcgataacccctccggggtaacgataccgaagcctccccaagaatatcatccctccttgaggtgccggaggggcgccgtccactccgaagggtaagcggggccctggatccgtccactagcaaggtacaggccttgccttgcctttggaggagaaggttgcacgcggggcttcaacatcgttgagggaggcattaaatgccttacccaccaactgttcgtgcggccatgctgtagtgtaggctcgagaatactagacccattattacttggctggacccgtgattgttgttggcccatgagtctgctcattctttagtatgctcttagagggttcaccagtcagctagtagcaccaggatatcttgtgaccatagagctacagttataatgtcttactatgtagtcaacttatgggtataaacggaaaaatatgtagtgcaaatcacaaatataatgaaaatttgaaaactactgtttgacccaaaaatggatgcttgagatttgtttacaccaccgagagtaaaaattttatttctagattcaaccatttgtacaaaatttatctggagt

SEQ ID NO: 34555 - DNA, 362 bp, Oryza sativa
ctgcagccctgttcttccaatctcaagctctgcttctctaataccagtcccttgcttccctttctagtcttcactcctatattccttgcaattgtatcccaattacttgagtgatttctgctgtggatcattggttccttcctgtgttgatattgatctgtgaatgagttgacggatcgtgacactccccctcgccttgtcctcttctaacttcatggccacatatcaggcatcctccacctgttgagcagagcagtgggaaaacgagaatgaggagaaggcgccgcagccggcaagctcgatctcgtcgcgcgcgccgaccgtcgcgccattggagcgccagaagcgggcgggtggcagca

SEQ ID NO: 34556 - DNA, 1168 bp, Oryza sativa
aggttcgtgcggggttcacgaccttgattattaatactgtgaagctctaggattcgtcttttaaaaatggctttgggcaaattaagtgatttttaatgcggttttctgcaaaacttaacccttatatcattaccccttgtacccccttgcattattcgtgcatccgccggtgtggctttgctgagtactgtggttgtactcattcttgctctatctttctccccccttcagtaagagaagctttggagaagatgtcttaggtggagtcttggcttacaccccagttgagcgcctgtgaagatggagccataggcccgctaatccgctgctgtttatttttgattgtcaggccttaagtgcctttgtaataatgtaaatattatcgatataataaagatgtgtattttatatcatgtttgtatggtgtaccccggcttttcctgggacggggattaatacactagcgttcgggaaaatgcaattttctcggtcgcgacaagatggtatcagagccgtctcgactgtaggataagccaagtggataaaacctaaggacatattttataaatgaaactatttgcgaaagttccttttcctcctttccctaatgctattttcaaaatgtttactcccttcttccttcttcggatttcaactagtactggatggtcaggtcagtgaagaagaagacatcgtcagttgtttgccgaagctccagaagactgtaggatccgctagcgaagtggaggaagcagtgaagccagctgtgaaggagtgaagatcttggagaacccgtcgcagaacctaagccaccctctagggtagagtcgttagttgtgtgtttccttgcttgtgtgtgtagcgcttggtttgcatcagtggggtgtgatgtaaccatgctaggttgtttgcttaatcaacttgcagaataagtgaaacaaacaacacatcagcaagaagagttagttcctttaaggtcctgtctctagttctggtctattctttcctggcttgtttcctctctcacctcaatccctgtaacagatgtttaacagagaaaaaggaaagaatgtcagcgggtatgcctcaagtaactcaagttttcaactcaatccaccactggcctcaagagagttaaccagggcacacccttggtccattccaagca

SEQ ID NO: 34557 - DNA, 1501 bp, Oryza sativa
ttttactagaaaagatgtccgtgcgttgtaacgagtgaataatattttaatcttattattattatacaatttagctatggtgaaattcactgtaggaatttgcttggatatttttaagataatcatgagctgcagttaggagtccgattttcatctcaaactagtatgcaagtttttctaaaaagatttcttatacgacttctttcgtattttcaaaagcaaacgaacttaaaattcgacacaaacaccaatatgtatttccaaaagagaacgaacttaaaaccaactcaaacacggatgacgtaccaaaatactggcaaaaatatttttaatttttataatagtagagaaatctaataggacaatagatttcttttgattgggagcattcataaaaaatatcgtgagcatttatagtcctagctttgtatggatgctcctcatttttatgacttttgaacaaataaaacaaatacatatgttttattttattatctaaaaataaattttatcatatactccctccgtccctaaatatatgggattttgcttggatatgacgtatcatagtacaatgaatatagacataaagctgtctagattcgttgtactgtaatacgtcatatccagccaaaattccttatattttgggacggggggagtataatatatcgcacaacaaacaataataataatagtctcatgtgataaacttttacattttcaataatgtaattcataaatttttatattcattcaaaggataaaatggtcatttttgtagaaattagacggtcatctgacgggaggagcatagaatggatcaaaatcaaattttagactatataatgaagtaagcaaaattcagaggcgtagaagggattagctaaaattttaggggtatacaagggattttctctatatattttatgaatatttagtactactatttattaaacggtttttgccgcttaatttgattacctcgtctaatccaatgatgcttcacgctttcgtgtgattggaatttgggaattccctcatttgtttttgcgttggattaggacaggaggggtcttttccttcttttttttttcctttgggtgacaattgttggagatcttttgggggggttggtgacgcgatcgattgcgtggttttggtcggccgtacgaatgttgcagccatgaatttgattgcgtcgatgttggcctcctccaaagatcataggatgcacatgttgagatgggctccagatccagctctcaatcaaaaatttgcagctttatcaaaaagagaatgaattagcgggttagagtgatcaaaagaatgaaacaaagaggtgaaacaaagcacgcgagtaagatttagaagctaaagccctatgaacagacctggagtaataatgacgggtctgattgaatttcatgaataagtttgctctgtccgtagatgtcatgtcgtcatgttaatttgaactttggatgattgaaagcatgaa

SEQ ID NO: 34558 - DNA, 1501 bp, Oryza sativa
gcagccatgaatttgattgcgtcgatgttggcctcctccaaagatcataggatgcacatgttgagatgggctccagatccagctctcaatcaaaaatttgcagctttatcaaaaagagaatgaattagcgggttagagtgatcaaaagaatgaaacaaagaggtgaaacaaagcacgcgagtaagatttagaagctaaagccctatgaacagacctggagtaataatgacgggtctgattgaatttcatgaataagtttgctctgtccgtagatgtcatgtcgtcatgttaatttgaactttggatgattgaaagcatgaatgcccgaagcacgaatgatcacaaaactaggcgaagtgatcggtcggccggatgaaccggtttgtgtggttccaaatatgctggaaggtaagacagctacttgatgcagcttctttactttaatttcagagccttaattaattagcggagtagtcacggaatcacgtggctgtgcagctgctaatgaacgtcatggagtactgctaattcggtacgaacaaaatagaggaaaaaaataggcaaggaaaggaatatatgaacgtcactcatgactcgtgtattgcatctgcatcataactctatatttcttcgtctctgtgaatagtgaactccgtagctagattgaaacgtactgttaacgaaacaaatgcgcatcttgtcgttattttacttctaatgtgcttgggaggtacaactgaatatactatgcgaataattagacagcagatgctgtgcgatatgatatgccaatatatgtatgtctgctaaattactccctcgctccgattacaaagaagaaccagggtaactttttgatttcagagtagaaacagctcctcatgggtttcctgaaatccgaccgaaaaccgataaaagccgataactttcagtcaatactatacgaaaatcggttaataccgaccggttttcacaaacggagacatagtagtttcacgaaaaccaatcggtttttacagaattccattggttttgtgaaccccgcaaagaacacgttgtttttggcattaaggtacaaactttgattgataacttttattaaaaagatatttcaactaaaactagagtattataaaaaaaaacttttagggcgacccaaacctagagatgaaaacgatcgatcgataatagtctcttctttttatttttacaaaaatagttgaaatcttttatatttatgaatttaactatttaatgtaaacttcaatgtgatgctaatagatagtagaaaaactaatatttggaaactgtacctgctgataaagatattattattatactccctcggtttcatattataagtcgctttaacttttttctagtcaaaatactttaagtttgatcaaacctatagaaaaaattagcaacatctattacaccaaactagtttttattaaaactaaaatttaatatattttaatagatctttcgtttcatgtta

SEQ ID NO: 34559 - DNA, 469 bp, Oryza sativa
ccctttcaaatcaaataaacatgatgaggaagtgacgtcgactctagatgagaaaaatgtttaatataaaatatacacaaatcattcatacaaaagcagtactttatggtgaagtaagttttttttttgtggggatggttgaagtaattaagtcggttaaacaagtaaaccaaaaaagctagcgtgcggttagttatgatgtttcgacaattcattcagatttaaaagtctgttatgcacttttgataatgtaaaatgcgggtggtaacgagtagcacacaactatagggtacaaaatttagctacaacaaactgcaggatttggttaaacaaacagttaatccttgcattcacgggaacttcagatactataaattttcacatatatagctataaataaaactctaagtacgacatgaaggacacaaataaaatgaagtaaaatgtaaatacatggggctatcaagga

SEQ ID NO: 34560 - DNA, 1501 bp, Oryza sativa
ggccacatatcaggcatcctccacctgttgagcagagcagtgggaaaacgagaatgaggagaaggcgccgcagccggcaagctcgatctcgtcgcgcgcgccgaccgtcgcgccattggagcgccagaagcgggcgggtggcagcatggcaaaggcttcgggagctcctcaaccaccgccgaggcgctccgcttcgtcgagcaccgccagcgcccatgccgccgcgcgcttcccttttgccatacttcccctcgtcctcgccggcggcgaccagtggagcgcttacgtggcagaaccagaaccagacgtgtttcgacgggcgtaaataaggcccatccacacaaggccttgcaaggcttaaagccgggcccattttgaagcctatgtattccacgcctagtggcctagtggactaggcccacaaaactaagctcaaatctcacttgagagattctcacttaggccgagtttagatctaaactttttcttcaaacttctaacttttctatcacatcaaaactttcctacatacataaacttccaaattttccatcacatcgttccaatttcaaccaaacttccaattttgacatgaactaaacacagccttaactcatttttacaagtgccattgataagttactactccctgcattctctaatacattttggtatttgtttatgataaatatggtttctgatagctaatggatctaaatgtactaatattagaaaaaataaatacttttgaatacaaatgtaatcataccactatgttacggggaatgtttcaggtgcgacctcccatttgggaggaaacatggaaccccgaaccctccatctccaccatctagacgcatcctcctctcccgccaatcattttcaaaagaaataaaaacacccaccactaaataatcattttgtattttagttcctagtgttcactttctctttttctctatatctctcttccccctctctctctctctccttcaacgcgactatcaaaagagcaacattagtttacttcttcgatgttgtattatgttagtatttatctctacaaaacctggtaaaagttagaatacttttatctagaacaatgtagtatcccttatatttcttatattttaagatgggaagtatcatataattttgaaaattatataaaaatgtcaagtgagaatttgtatatcacttgaatctattgtactagagcgagtcggagtgggtgagatgtcaccacgtacaaatttacaaaaagcatgtgattagctctagacaaggttctaattaaagaagtttgagatcaaagagaggaagtgtttacatctaggggtgaaaatttttggcgtgtcacatcggatatacggacacacatttaaagtattaaatatagactaataacaaaacaaattacatattccgcctgtaaactgcgaaacgaatttattaagcctaattaatctatcatttgaagtattaatattgcttatttttt

SEQ ID NO: 34561 - DNA, 1501 bp, Oryza sativa
gttgtaacgtgctaccatgtacgtttctatagtgcttatgtggaacaacaatatgtttccaaaattttattcattaaatctcaacccttgagatctaaatttactatgatctagtggttaatatttttctctttttctccgattaatgtgggaatttctagcctccacagcgaacgtggtgcctccttttaaagctgtcttaatagtataatagatatgtagtgtaaattcaaaaattaccgttggatctaaagttaaacgtctaatatttgttgacatcatgaagattaaaaagtttactccagataaattttgtacaaatggttgaatctagaaataaaatttttactctcggtggtgtaaacaaatctcaagcatccatttttgggtcaaacagtagttttcaaattttcattatatttgtgatttgcactacatatttttccgtttatacccataagttgactacatagtaagacattataactgtagctctatggtcacaagatatcctggtgctactagctgactggtgaaccctctaagagcatactaaagaatgagcagactcatgggccaacaacaatcacgggtccagccaagtaataatgggtctagtattctcgagcctacactacagcatggccgcacgaacagttggtgggtaaggcatttaatgcctccctcaacgatgttgaagccccgcgtgcaaccttctcctccaaaggcaaggcaaggcctgtaccttgctagtggacggatccagggccccgcttacccttcggagtggacggcgcccctccggcacctcaaggagggatgatattcttggggaggcttcggtatcgttaccccggaggggttatcgaagcctataatatcccccaacagttctttttgtttttttttcgcaaatacgcaaagtgcgtatcatttgtattgagaccaggcttttgttttcttttgtgggcatacacaattaaacatacaaatgtggtgtgatcttgtttgctgattttttttatctccacttgtgcagctcttctgaaccaacaactcctgatcccttgctctcaacttgtgatgtgaattgcactgacaaaagaacagaaggactagctataaatcgctaaagatttttttttaataaaattcacacgaatgtaattacggtataattacaccgcaattggacagtagttgaataaaaaatgagattggttagtagctaatctggttatggttgcatgccctaaaccgtgatatcgtgggatagattcccattacctgtgccctttctcttttttttttccgccagttagcactcatctcaacgtgaattttttttccgccagttaacactcatctcaacgtgaattgtatttcataattaacttattggacatatttttatttccccgagatgcaagcatgattcattataaaatatgttggtcaaaacaagcacctagtgtccttgccagaaaaaagaaagggcaac

SEQ ID NO: 34562 - DNA, 268 bp, Oryza sativa
tcgccgccgcccgaaaccctagcgcaagccgccgccgtctccttccaaattcggccgcgcctttccttctccggccgaattgattgagggcaattgatccttgagatctcctcttccttttctcttttggaaacatcggctaattttctttggaaaccggtggatttgagttggattcggattcatctctctcctctaaccccgacctttccttctcgtcgccggcagccgtgggccttcactgccgcctccttgcccctttaaaagg

SEQ ID NO: 34563 - DNA, 169 bp, Oryza sativa
gaattatttttgaaaaggaaaaggaggattattgcgtcagcggctagggtttgcggtggaccgggtgcacgacgacagttcacgggaacggacggccaagatcaaccctatccaaaacggacggccgagatcgatcgggtccacggcggctcacgggagacggcgacga

SEQ ID NO: 34564 - DNA, 201 bp, Oryza sativa
gagtacctccgactattgttgtactagtagtattgcgaactattcggtgttgtatcataatgttatcgtgatgagtgttcggactaaacacttttgtttgtttgtactcttgtttaatatgtgttagtaattcgcttatgaacatttattacttatgttgaactaattatttatatgtttctgatcaacctatttgatgca

SEQ ID NO: 34565 - DNA, 1501 bp, Oryza sativa
cattaaaatacgaaaagagtacgagcaatcggtctctcacgagttcgggtcataacagataatcatcatgacgacagtatccttgaagtggaggcaaaataaaaaaaaaaaatggcggtcgattaggttacctggagcttcagggtcaaagcaatcgggggagaggtcggcgggtccgggggagtggtcgccggggatcatcgcgatgccgcgccggaggatgacgagtgggcccgacggggcgtgtggcagctgaggccgcgtccaggcggcggcggtgcaggtggtgtcgccggcgtagccacaccgaggagcaaagcggcccatgtacgaagccacatgacgggcggcggcggccatggcaggttgatcggatgtgaggaggtccggtactcgattccgatctagggtttcaactttgcaattcgttggactaattatccttgcttgtgttttcagttgagtatgtccctgtggcaatgacacgtttagcaagtccttggagcgtgatgacccacaaccaataatcttcttgatcaaaactcaacgaatggttcaatgattcaatcagacattagtcaatttgttgatctcaataaaagaatataaggttattatcgacaatgaaagacaccgccgacaaaatatccggtggcatcggtttagtgattttatcattttcagaaaaaataacaagctcaaaattattattttttgaatacactcacccttatgaatagacacacaacttactcctataaacatctacgaaggacttagtcggtatatcataaaattaatgaagtcaccacggccacgggcgcctcactgtcgacgtatacatcgtctaccactgagagaataattagcctaaatacaaaactcggattaaattgacctaacagaagtgatgaaagtgcattgtaaaataccaaaaatttgtatactgacatattagggtttaacggatattgagtggcaaataagggaatttcaatatatatattcccctgattttttttagaaacacaatataaacgcaaacgctcacactctcacccctaagaacatatacacgcacattctacctttataaacaccttggaaaaactgagccaatacatcttgaggttaacgaagtcaccatagacacatcgttatcgatggatatatatatatcgtctaacactaaaagaataattagctgtaaatttgatcacccgtgtcaagtctgagacttaaatttcaggtgaacaaaggttctaccatgagaaacttagctagttgagctacgctcacttcatcccctgattatttttgttaatcaaccgcttaaaattttgtaaagttcactatggtcacaattttgaggcagatgtgaaatattaaagtcttattacaatagattaaaaccattcaatattacgtagataatatatgcaaaagattgaaacagatctcttaactttttgcagccggcagaggggagaagaggaaatgc

SEQ ID NO: 34566 - DNA, 1501 bp, Oryza sativa; identical to SEQ ID NO: 32215

SEQ ID NO: 34567 - DNA, 558 bp, Oryza sativa
ctgctaccgctgggcagtggtgaccaggttggtcatgttgtccaaccatcgctggacaggggtctccggctccgaatttatggggggatgccgtagaagggctcccgccgcctaaagtgcgcctcgggatgagccgccgttgccgtatgtcaggcggccccgtgccccgacactgcgcggtttctccccgcgcggcggcggggagaggttcctccctctgtgggggggtcgcggtgggcaggagtgggagagttgttgcgacggtggtgggggccgcggctcccgctagcatcgtcactcccggagggagtaggggtgtgcgccaccacttcttcctctaggacctcgaccatgatcgttgaggatggagggaaacttgtggtggaaggaaacgatttctctttcaaacgcgcgaattccccctacctggcgcgccagctgtcgaggaatgatcctctcttgcgggtgattgagggacccccttttgtgagttcggccgggggaaagggcgcactgatcaagaacgtatatctgcctagagtctttcgagaccgcgtg

SEQ ID NO: 34568 - DNA, 1134 bp, Oryza sativa
acagttttttaggtccagaactgtcaaatttttcaaccataggatttgtcatcaacgattacaggaaaacagtctgcactagtacaaaccacgagtcttagtgcccaaattgataataactttcaattcaaaagtaatatgcatatatatgtccctgaaaaaaattacaaatcctaattttataccatgtaattaccctgtaactactctagttggtgtaagtgctatgtaactaactagagtatgtaactagagtataagtgttatgtacctagggtgtaagtgatatataactacaaatgctattaataatcagaaagtgcccgtacctcagcgtaacgtgtggcaagtttgatggatagatcctagctcgttcaatgcttgtctagcccacacgagattttttttattctacccatatggccgtatatgttgcacgaatcctggagtgcatctaatggctagaaaatcgaaagttttctaaagaaaaaactgtcgccagttttttagcaaaaccgttgtttcttttttcttttagttacataaagagacaaaaaggagatccaacgtcccacattgtttcaatccccgggacttagtatattttgcactacttgacgagctctatacatccatggttcctgatcgcctattcgaacaacggtttaaaaaaattgaacttttgcgcatttgttctaatattccccgaaatatactaattcgaaactcggggcattacacaaccttagtgtgtaggagcattccataagtaagacatctcataattttcactttggaagaagtgtacatttatttaaagtcactctttcgtgactgaataaactaagaagcatcataaatccttctttctagttttcacccttattgttgctgctgcacattttgcttctatactgaattagttatgtctaggttatacttctgtgatgcaaagtgagcgaggctcaactaaagaatgccttgtacactacatcttgtcaagaatgatggacaactgtcacgcccagaaattcacgaaccagaatttctaagctgaatgtgcattaaacccatgtccagaaccagccagggtatacaaacgacaattgttgaaatacagatccacgttttaca

SEQ ID NO: 34569 - DNA, 539 bp, Oryza sativa
acagttttttaggtccagaactgtcaaatttttcaaccataggatttgtcatcaacgattacaggaaaacagtctgcactagtacaaaccacgagtcttagtgcccaaattgataataactttcaattcaaaagtaatatgcatatatatgtccctgaaaaaaattacaaatcctaattttataccatgtaattaccctgtaactactctagttggtgtaagtgctatgtaactaactagagtatgtaactagagtataagtgttatgtacctagggtgtaagtgatatataactacaaatgctattaataatcagaaagtgcccgtacctcagcgtaacgtgtggcaagtttgatggatagatcctagctcgttcaatgcttgtctagcccacacgagattttttttattctacccatatggccgtatatgttgcacgaatcctggagtgcatctaatggctagaaaatcgaaagttttctaaagaaaaaactgtcgccagttttttagcaaaaccgttgtttcttttttcttttagt

SEQ ID NO: 34570 - DNA, 230 bp, Oryza sativa
cggatggatggtagggattagggacgatgatttggcctgaagcattgctaggctcaactcatcctttttatattagtatagatatagatgtacaattcttccaaagttaaaattatgacatgtcttacttatggaatgctcctacacgcggaggttgttcttgctgacactctcgtttctatgagaagttttttctaacatagcaagtcgatagtttactgccaataaaa

SEQ ID NO: 34571 - DNA, 662 bp, Oryza sativa
ccataacttggccatttgaacacggaattggaccgttcaagtctctaatttttccttaagaagtcaagaacccatttttgtgctttgtttctgcttgttatatggagtttattagagtaaaagccttttctttttcgttggtcgtgtagacgctgcagcttcggaagatccgctcttcgtggaagttgaagtcgacgtttgggaaagcgagcaaggcaagtcacatcatccttgaacacattgaatcccagtttataaaattatattgatttaaattattgcattatcgctttatttaaattcccgcgttatcactgttttgtttagccatgcctatttgcctttgtatgaccttattattgttattgttattattaccttgttcaccctagaataaacaaaaccccaactagtggacactctactcatggtaccactagtatgaatttaggtagatgcttcgctggttaattaggcaacattaggtggttttacaactctagactttgggaatattctcatcacctggacactatggaatggatggattattgggaattggattcacacctccccctctattcaaaaccctcaaaatggttttaggctgggctcggggtgcatggttttgatagtagcacctcggccataaaaggaccagt

SEQ ID NO: 34572 - DNA, 233 bp, Oryza sativa
ctttttggtatataaaccagaccccttaggagagagaggggaccgggcccctctaattcaccgcggccattatcacaatcccgggaaccaccaaacgccccaccttcaaacccacctccgcccaggcaacccgttggatatccgcttcagggattagcccggctagtcccctaccctgtctctggatactgtcaggagagacaaaagtgctatctctgatcttgccgggcagg

SEQ ID NO: 34573 - DNA, 462 bp, Oryza sativa
gagtagtcagatttgtcaactagaaatttgattctagcgcaaactacagaactcctcgaatccgattaggatattagccactgaacagatcaatgtggtgcttgtatttcagctcctcgacgtgcttgttttgttgatggagatcgatgccgagtctggcttggacccggccagctgatgccgcccaccggttggcgtcctgcacgtcgatgggttagtgtcggatcagttttggattccgccaacactatggtcctctgccgctgcgacatcttgaagcttgattggtctcgccggatcgaatagttgatggcgatgattccaatctcgttgggagacgtactttggccaggttggatctccctgatccgaagtcgtcgagtagcttattgttggagaatccatctcttaaacccatctcgtctaaatcctgaagcaccaaaaaatccccctacctggcgc

SEQ ID NO: 34574 - DNA, 362 bp, Oryza sativa
tgggccggctttcggcccaaagccaaaagagacttttaaaaaccttttttaatttaaattattcatgaaatgcaattccatttattaaaaatactttcttggctcaaataaatcccagaaaaatctaggaactaaagattcaagagaagtatttaacaaaattttatctagcccaattttatattgagatttagcaaattaaaattagatattctcttttaggcttttaagatcatttctaataattccttttaaacaacaatttataatttaaggatttttaaacaagaaaagctcttaacaattataattagatcattaatgatcaaataattactgaactgttctttgtatcatttagg

SEQ ID NO: 34575 - DNA, 205 bp, Oryza sativa
gcacatatgtgtagatccagagcatagaatataatagtatgaattgagacatagacagtagtgttaattgtaagatgtagtttagtttgatctggagaatgtaacgtaattttagaaatttagagaacaatattgtagagaatgtaacttagggcgtagtacagaaatgcgaggttaacgcagttattgttttcatcaggcacaa

SEQ ID NO: 34576 - DNA, 1501 bp, Oryza sativa
cgcgaaggacaccaagtccctcctctttttcaaatcctcgtggagtttttgcgtcgtgtcctctttctcccattcttctctcttctgcgcctcttcttcacactcttctctcttgtcttctctcttcttctcctccgactcttcttcaaagaaatgtggtttcttccccgtcaataactcaagcatcacaacaccgaaaccgtagatatcgactgacgggttcagaatgcctgtcataacgtactccggtgccgcgtatccgtacgtgccaacaaccgtatcctcatggcctgggccttcccaggtgagcgccaacccgaagtccgtcaagcgcggcacccagttgccatcgaggaggatgttggacggcttgatgtcacggtggataatcggctgctcaccgcagtactgcaggtactcgatggcctgcgacacacctagcagtatttccatgcgtgtcttccaggacgccatcactggcgacgacgacgacgacgacgttgggccgtgcaggtggtgatccagcgagccgttctccatgtactcatagacaagcagatgctctttctccttttccttccggaacggtggcaggaggcgccgctgcttctcctcgaccaacacatcacagtagccatatagtggaacaatgtgcttgtagcggatgggggagaggattgtgatctctgccatgaactccttgtaaccctgaagtgagttccgactacggtgcttgatggcgaccacccgctcatcaggaagccttcccatgtacaccgagccgaagctaccttcaccgatctttctttcaggggcaaagttcttggtcgcctttgcgagctccttaaaattaaactcttggactctatggggttccttccagttccaacagatcttagcagtatcctagtatagagaaatgcacataatggaagaatggtaaaattagagctgagttctaacttctaagcttccctttgaagccaagtacaaagtgcaattgaaagtttgaggatatatatactccctccatcccattttaagtgcagccatgatttttccatgcccaactttcatcattcatcttatttaaaatttttttgaaaaaattttaaaacataagtcacgagtaaaatactattcatattttattatctcgtaacaacaaaaatactaattataaaattttttcaaataagacggacgatcaaagttgagcagagggagtattatatatgtatgcatttcaatgtgtacctgggaggctgggacagggatttggggcatggagacaggagacatagatggcccggccatgtcgttcggaagcaggatgttgtaaattcgatcgagacggcgagtgatgtccatgtggctaataactggaaagaggaggaggtaggagtcgatcctgctctgaacatccctgaacttttcagcctgcctcccggccatcaccaacctgtacacggcgctcttgtcctggcacgacaacacaagc

SEQ ID NO: 34577 - DNA, 641 bp, Oryza sativa
acctttagtcccggttggtaacaccaaccgggactaaagatcccggtgatctttagccccggttggtgctaccaaccgggactaaagtcccacccctatatatatgtcttcttcctcctccagctgcccgagcaagcttcaaaatttcttcaaaaaagaggggaggtcatgccaaaatttctattgaatttattttattgaattacatacaaatcagaggtgcctaaaaggtttgcaacttcatcctccaaagtttttttttgtcatactacatttgcacctatgttttgcacactttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaattaaaagaagtaaaacacattaaaattagtttaaaactttacaaatagtttttaagaattatttggtgtaatattttatgatttttgtatgaataaagatatcttataattattgtatgactgtcattattgtaagaataatatttgtgtagggtttttttgactcatgtaga

SEQ ID NO: 34578 - DNA, 434 bp, Oryza sativa
actcgacggattacatgaacaaaattagagtgtcataaaaatggaagcactaatcccgagaatgcaaaccgccataacaagctttaccttttgttaaagattaaaaccgatgcagctcaacccgaaagcaagaactcgtcgaaataaaacaaaagcaaaagggtggcgatgcgccgaaattgtattgaatgtgtgtccctttttttacatgaggctcagggtctatttatacccgagaattacaagatatatccatctcggacacgactattatctctaacaaactctaaaataccataagtctttacggcagacttttgcccaaacatattttaaggaaattacataaaatatcctaattaatagatacagttgccttctcaggactctatccttgcgtggcaaccaccatgaagcatattaactcaacccga

SEQ ID NO: 34579 - DNA, 703 bp, Oryza sativa
  unsure (1)..(703): unsure at all n locations
gattaggttagatattgacgttgatttaggttatataggatatctaccactctatgaatttccagcggcttgattgtctagatattgttcttcttttcatactaaatgctgcatcagttgagtntgatctattaagtcgtgcttagaacttcaatctctagcttgtcttctggttgccgattagggtagtatcggagtttcagccaatcttacctgatttaactacttttatcctatatgcttgattgatatgttaaatctgccctttatgttaagatcttgttgcatttaagtatattaggcttctgcttgatgtattctgcttgctttaatatcttaatatagagtagtatcggagtattagccgatacatgctagatctatctgatcggctatgctataaatgtatctagtcccattattaatatatatttcgatctaagtgatttatactgtctcggcatggcgtccgatctatcccaatcacttgatttaagtatatatcgatatagggagtatatattgttaatatctacagccgatcgagtaggtttagtttctccttatctattcacaactgccgatcgatgtacatatgacatcggctcaaagataaatgatatgtcatcggcacttagccgatcggctatcgtttatagatttaattacggtttctttgttgttatttcttgttgattgcagg

SEQ ID NO: 34580 - DNA, 1501 bp, Oryza sativa
atgatggactcaactcgactacacagacatgcagaacacagcattacagtacacacagactcgatcacactgaaactgcttattattaagatgaagctaggaatgggcggatatatatccaatttgaattgaatccgatcatgaaattaaatgcagttcagatgatatccaacccaattccgttgcaacccgaatgcatgatgtggaaatccatgtgttatgtgtatcatcacgtagtccatggatttccggatacccaaatatgcgataaaatgaaagcttgacctgttcggggaatcatgcagtacccttggtacttgatctcgatcggtgctcgccgccgtggcgattctttgggtgtcgccgcggcggcggcgccgtcgtcgtcatcactggtggtgatggatcaagcacgagctgcgcctgcgcagctgccggagcttagatgcttgcatggcttcctccgtgcacgcgcgcgtggatcacatcacggagcaggaggtgggatcctcctccatggagtggacaaggtagtaagggaagacggcgccggtgggggtgcatggctgcggctgcggcggtggcccggccgccttcttgcctttcctccgtttgccgcccttccctccgttctgcttgtgctgctgcccgcccttgttacctttgttgccgctcttgccggcgttgatctccctctgctccgaagattggtcagctcaatcggctaaagaggaaaaaaaaaaaaacaaggagtaattttgatgagccatgtatcttactggattgtttgtgcggcggtgatcgcccccaccagcggcgacggcgaggtggcggtccatcttcttctgtaggtgggcaacgttgacggcctggagggcgatgaggcagttgttgatcctactgttgacgtcatcgagcttggcggcgagcccgtcgctggccacgaacctgtggagcctgaagagcagaccgtccctgctcctgccgcaggactcgacgagcttgagcgcgtcgtcgagggcgtccttgagacggcccagaatcttccgcgtcgtcgccgccgcgtctcccatggccaccttcttgtactccctcaggatgtcgtcgacttccttcacgcgctgggctagctcccggcacctggtcttgttccggcgagccgtcttcactgccttggcgatcgccgaagccaccttcggcaccgcgcccacgatgctgcccaccggctccatctttgaggttgttgatcacccggggctgcttgctttgctttctctaacgttgcggtactgctcttgcaagaagaggaagtgtggccactctacttatcgtggaggccattgacggctggccaaacggatctagtgctacgatgcgaacggtgagccgtactatcttatatcatattcacgtgaggacaatgctttgaaactatgggcctgtctagattccatcccagaattttataccctatcacattgaacatttgaacacctacata

SEQ ID NO: 34581 - DNA, 214 bp, Oryza sativa
ccaaacaaaggaacagaagttgcgcaagatgtccgccgatcgccaagaagtagcaaaagccgaagtgcaaaagctgctcaagcccggggtgatccgagagatcgaccaccctgagtagttggcgaacctggtactggtgcggaagtcaatcggcaaatagcgcatgtgcgttgatttcacagacctcaacaaggtgtgcccgaaagacgacttc

SEQ ID NO: 34582 - DNA, 747 bp, Oryza sativa
  unsure (1)..(747): unsure at all n locations
cggttgcttttgaaaatacgaaaagaagtggaataaaaattcttttaagaaaaccntgcatactagtttgagataaaaatcggactcctaactgcagctcatgatatctttaaaaatatcaaagcaaatccctcaagtgaatttcaccatagctaaattgtataataataataagattaaaatattattcactcgttacaacgcacggacatcttttctagtaaaataaaaattttaatttattacatttgttttatttttaaaatttatgtcaaaattttccgcactaattatttagtctcattagttacataaaatgcatatactatacactcaaacaaaaatttcattatttttcaaacttatttccaaacctaaatcatcaagggcattaaagacatgagccaccaaacttaacagtgaaatgatagaaaaatgtaacggcagggacatgaaaaggatcaagctgaaattttagaggtatataaatatgctcatatttccttatttgatctctctgtaaatagaagagttccctttcatacttcctatctatccatctaccgaaatacaaccacgttctcttattaatgagggatactttcgtcttttctctcaatgcaaatgtgaatcctgataattaagaataaaatttattttagaacaaaaatagtaataatccattacacctcccgaaatttcgcttgctcggctggatcctctgactctcccagtctccacgcccac

SEQ ID NO: 34583 - DNA, 734 bp, Oryza sativa
tgtcaacaagtcaaaatgttatgactgattgatagtgccacttaaaagctcccatcactccaattcacataagttggcatcagttagcaatatttaattaaagataccatcatgtaaggtcatacccgtttacttgatacgcaattcttgactttcgccggcatcggttgccctttcttttctcataacatttcatatttttttctccttaaaaatactatatccgttctaaaataattgtctcattagtattcaaattttatctcaaaataattaacatctacagtactaatcatgtcttagtattcatttttttcattttaccctaaccacccttccaaccctagctatatttcatttaataagggtattatagtttattttttctaaaccttgttttatgattaaaaaaatcaataaatgaggagcccgctcaggcgctcacaagggttagttccattctctttttagttctttcaaaaaaaatgacaaacagatggacactcgagcaagttatttcacctaaaagtggacagacaaatgaatttagatcagcttgtcagaaaattttggttcgttgtatatttagaccttcgcaccatgttatttcgatggaataatgtgcaaatcttttacaagttctcgacatctattgtaaaaggtcgatttttttttttcaaatgatgattgttttgttatattacctccgaaaatggacaggcactcagggactg

SEQ ID NO: 34584 - DNA, 525 bp, Oryza sativa
tcgagatagtcgccgaggtttctccagcagcagagcaaggcaagtcatgcttgtcacttgaacatgttgatcctatattgcaaatgctctattgtttttcttcaaatattgcattgttttataatgttactatggggtgtttacctattgttacagccatgccatttttgataccatgctcctttgttagcttgggttataacatgaatagattttggactaggaattgcttagccatgcttagttccactagcacacaatggggaaagctcactaaaatatagactttaggttcaattggtaaggttggtttagtaccaccgttttggtgttggtcaattaaaatgaatcacatggtgggctgtgggtgcatggttctgctagtcgcacccatggcagttaaggaccggttcgcgggatgccctggaagaacttatcatacttaccacaagccagcatgggcaacggctgggcttgtagtgtagctttcctctagctgacgcatccaggcaagggtgggcgtga

SEQ ID NO: 34585 - DNA, 243 bp, Oryza sativa
accagtaggcatctgcctaatctgtggtgtaaagaaggaaaatggtttccatgcgactgttgaatgtccaatgccgagatcgttcggaaaagccatcagagagttctgggcgctaccgccggaaaagaaagtttgctatgactgggcctgactggctccttgtcctgttggatagcttgaatagttcagacaaggcgcgtgttttgtacttgttgtgaagagcatggttcctcaggaatgata

SEQ ID NO: 34586 - DNA, 1501 bp, Oryza sativa
gagtaatcaaaagaaattcatagccaacattcaaagtaattgcatacaaattatttgccaaaatagacttagaatagagttaatgaatatttcaagaaaagtccacctacgtagaatcattattttaaattaaaataacaataaataaggtgcccacaaacattaaaacgataataaataagatgcgcgggctacctttctagtttgtgaataaaacttttatatatgtattcttaggctccgttcgttctccagttttggagagaaaattttgtggcacgcaaaacaagaaatctcattagcatttgattaattaaatattaactattataaatttaaaaaatgaatttatttacttttttaaaacaacttacatatagaaactttcttaagaaaacacactatttaacagtttagaaagcgtgctaacggaaaacgagaaagttgaagtttggagttgaagaattgaacaaggccttaatgatctaaaagcaaatgataaaaattaaactacgataaaaaaccccaaaatcaactccgagtttaagtttgaaaattcaaattttggataacaagcataaccataagcgatggcaacggcgaacatccggagaggagataaatggacaacgtgcagattagttgctgcttgatcgtgcgctgtgcgagagacggccggggccggggacgtgcttccgcggccaacttccaagcaaccgcggatccactctcggcgtaaccggagaagtacgtcggctctcgccgggatgagtgacggagcgcaaggttcgcctcgcaactcactggagagccctgacctgccactgccagcccaaaggacatgacctctctgacataggcaatgggctctcacgtgttcgatgaaatgccgtgctgagtagaccaagtgcctgtgcattctaagtatatattgcaaaatctgtccaagtttcacgaaaggtgcgtcaatttcaatcgtcctcttttgataccatccgatggtatgcattgtgctaagggctcgaacttgcaacctgcaggctgagcatgagcagcaactaagccagaggacagctgctgcagagaaacgctcgaacctgtaaccctttgggaaactatgtagttacctcgagaggatgacctctcgttgtttgcatatcactcaaataattataaaaaaataaaaaagatgtattaacatgtgatataacacttcacaaacatgcaagttcaaatttaacttctacatttcgtaacgaaaaaaacaaattaaactgcagctagttaacgtatattcacggtcaaatttgtttttttgattgcgagatgtagaggttgaatttgaacttgcatgtttgtgaagtgatatatcacatgttaatacatcttcttttttttaaattttttcataatcatttgagtgacatgcaaaaaaaacgagaggatatcccctcaatagattaaaatccacttttgtaacccttgtagtggctcagaggta

SEQ ID NO: 34587 - DNA, 1501 bp, Oryza sativa
ggaacataaaaatcatctctaagtaaaagtgtgaagccattcgcgagctctaggcgaagatctccaacagcttcaacttttgcttcaactccattggcgactctaatggagctttcgcttctttacgtagttctcgtcgaacggaatccctttaaacaattagacacatgaatagttgctccagaatcaatccaccatgtggatctggaataaccaacataatgagattcatttacaaatgtaataatgttctcacctttctttgccatgattattttcaggaagtcaggacaatcattcttgtaatgccctgtcttcttgcagtggagacactgatccttttcaacagtgaactgttgttgctaaggcagatgctgaggctgttttgcttttgaggagggtgacttgtagttctttttcttgttatctttaacatagttaatagagtctccattggactctttgattctttcctcctcttgcacacaattagcgatgagcttttcaaagttccatttctctggacttatattgtagttgacaacaaagttgtcaaagtgctttggcaatgaggccataaccaaatggacaagaaagtcatctgagatgcccaaatccattggcttcaacttggaagccatgttgctcatcctaagaatgtggtctcttacaccacctccatggtacctttctgtcacaagctgctttattagctgtgtagcataagtctttgaagaaccagtaaattggctctttattctttcaaggtacttagagatggtgtcacactctgggattgagcccaataaggttggctcaatcgtgttctttaccacagccaaacatttcttgttgactaaggaccatttcttttgctcaatgtaatacgacattatgaggggagcattgtccctctgtcttctttgccagtcagcatctgactcattttcaactctgacaagtgcagcaggttctataggacatggggtagtcaacacccagtccacctctcccaagatgaaagcaatgtcgagttttcttttccattctgcgtagttatctcccttcagggtcggaatatctttaatgcaacccatcaagcagtagccacctgaaataatcatgtacggtgagagcaaaattaacattaaaaatattatgcattaagcctacatcaccgttgggtaaaaatagacataacatataaagctataactataacattgcaattatcaacgttggtcagaaaattacaacatcatagcacagaattaatgttcctaaaattaaattctcccgttggttcgaaatttaattttagaaacactaattttcatcaattttatctatttgtagcggaataactttataaaatacatatgaacagtagcaattctgttatttacactctgtaaaaaattactcctttggatcaaattttaaacagaggtaaagcatgcaaaatcgcttcaaaattgtgttgaaatttgcatgaaaatag

SEQ ID NO: 34588 - DNA, 277 bp, Oryza sativa
ttttggaataaggaattgatttatggaacaagggaaaaggatttattaaatccctgggaaaagaaaatggatgagggacgtgaattagacttcctcaggtggcattggtgcggcccaagggttgaagggggcttggccgagccatttgggccggcgcggtcgcgggaaaggcggcccattagggcgcgcgggagggagagggggcggtccggtggaccgggtgcacctcgcggggtcccgggtggggcccacatgtcggcggcaaggctcacggtgg

SEQ ID NO: 34589 - DNA, 1501 bp, Oryza sativa
gcggcagcagctcggcaatcatgaacacgcggcgggcgagctgctcgcactccttgttctgctgagccgtcagcgccgccagcatgatcatggagattgttagatagatctccctccccttgagcccaacggcacaaggggccttgacacgcgccctgatcgggggcgcccagcccaatagctggtgggctcccgtcaccctgcgccatataaaagagaggtggaggccggggcggcacaagacacgaggttcgctgccaccgctaactccacccacaaaaccctaatccgatcgagagggggcgtagccagtgacgcaaagcttcaccgccgcgccacgcctcatagacgccgccgacggtcgtccacgccacgaccaccgacgccatcacgaccaccgtcgtcaccatccacgacaagcccgcgacgacaacgacgatggccggcacttcttcatcctccaacacctcaaccggtcggtctctaaaccctctcgtttcatctctatattgttgttcatccacccgatagaaccacctggctagatctaaacctaggcgatcctagagagaatcctaacagtggtatcagagcgagaaccctagtgtttatatcggttcggggaaagaaatccaaagaagacaagaaaagaaaagcaatgatccgaatggatcgaaaagaacgaaaccctaaccctaatcccttaccacgtcgccggtcattgtcaacgccagcaaaggggggagggcaaagggcaccgccttggggcccctcgatggctgtgcatgcacccacgggtgcacgcgcgtgccggcgagggggccgtggcggcgccgccatctccttcgtcgccgcctactctctctcactcggtggggctggtggcgcgttgggggagaagagaaaagaaggcgcggcggcgcgagggccgccggcatcggctgggccgaaatgagcccaagagggcgcgcgcgcaggagcgctttgccggcccaggcctaggttgcggttgcgcgcgcgcgcgcactcggccgtgggccagctttcctccgatgggccaaaatggcatcatgaacagtagcatttttcctttaaattttgtctattttcatgcaaatttcaacacaattttgaagcgattttgcatgctttacctctgtttaaaatttgatccaaaggagtaattttttacagagtgtaaataacagaattgctactgttcatatgtattttataaagttattccgctacaaatagataaaattgatgaaaattagtgtttctaaaattaaatttcgaaccaacgggagaatttaattttaggaacattaattctgtgctatgatgttgtaattttctgaccaacgttgataattgcaatgttatagttatagctttatatgttatgtctatttttacccaacggtgatgtaggcttaatgcataatatttttaatgttaattttgctctcaccgtacatgattatttcaggtggctact

SEQ ID NO: 34590 - DNA, 1114 bp, Oryza sativa
cgattgaacgtgaacgagctagggaacatgaacgagcgaacgaacgaggacgaacgttaacgtgaaatgcaatatatatatatatatatatatatatatatatatatatatatatatatatatatatatatgttacttcgctataatcctaatacatctttttgtatcttgcagaaaagacgtgttgtcggagtcgtccgtcaagcctgagtggaagagctagccctagaaggaattggagcaggcaagtgatgtaataatataaatgattgttatatttgtaatgcaattaattaagattattagacctgtaattggacttatcatataagattgtgtagtgttctaatattatttgagttttaatataagattactttatttgtaattagacttagtatgtataattattgactacggaattggggcgacaagtagcaattgactattgtagtcttaattagacttagcatatacgcacgaaacacttagcatagatgactattttagtcttagcatgtaatattattggagttttaatataagattactttatttgtaattagacttagtatgtaattattgactatggaattggtgcgacaagtagcaattgactattgtagtcttaattatacttagcatatacgcacgaaacacttagcatatacatgactattttagtcttagcatgtaatattacttgagttttaatataagattactttatttgtaattagacttagtatgtaattattgactacggaattggtgcgacaagtagctattgactattgtagtcttaattagacttagcatatacgcacgaaacacttagcatatacatgactattttagtcttagcatgtaatattatttgagttttaatataagattattttatttgtaattagacttagtatataattatttactagctagggttgtacaatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacaga

SEQ ID NO: 34591 - DNA, 1501 bp, Oryza sativa
ctaaaaggactttaagttgtgttcgggaggctacgttcccaactgctcactcttgttttatgcatgtaaactttttaaactgctaaacgatataatttttacaaaaaaaatattatagaaaacttgttataatagattatactaatttatttttcatgttagttttaactaatactacctccatattttaatgtgcaacgccgtttactttttgtccaacgtttgaccattcttcttattcaaaaaatttatgtaattattatttattttattatgacttgattcgtcatcaaatgttctttaagcatgacataaatattttcatatttgcacaaaaatttcgaataaaacgaatagtcaaacgttggtcgaaaagtcaacggcatcatacattaaaatacggagggagtacttgattaattatgtgttaatgggttacttctcctgtgccagaggaagagtttcccaaccggcacaaacgaagacaaccacctctatgaactcagtagagacgagcttccccagttgagtggagtgtgcgaatgccacacacgctcgtcgataatcagccatgcacctttgtcggccacggccacatgcacctctaggcgtgtgcctcaactcaagggcacgtagcatggacgatacaaccatgcaacatacgtgcaccccgtggcgaggcagctgcggtggcgcgcccacccggccatcagcgtccttagcgcgcctcagctgcagcacgcaaggcacttgcgctctattcgacagggggtgctccgccgttgctgtcctttttataaatgttccctttttataaatcaaaaggcttgcttaatttgctacgcagttacttacatctacggatatttggcaattaaattatagattaattaaattctttacgttaatttactaagacaattaaaaaccccgttgtattttagaaatgttgatattattagtttagaatgaatttcatttgaagtccttactaattcatcatgaaaaatttcattatacatgtttaacttgtcataaaacattaaaaaaaactctatttttcctaattgttgacgttattaataaggtaaattttggttcatgatacttaagtttgtaatttggtagaggacataaaaaaggtaggacacgaattagtggtcatagttcatggacatgagaaaaatcgatccttggagaaataaatcctcaaagtatgattatttattactagacactctacaaatcaaaatatttatttgtgtttgaaaaagagagaaatagtgtctagacccactgtcatatttttttccgaaaaagtccaaatcaacttcctaaactattgtgtgagtacaaaataccccctagacccgaaacccgacatctctgacacgcgcgggggagtccgtccaacagttgtggcctgacgtttggttggagtatagctttcgtatgggtggcgcgtgtacgtgtgcacgatcattcttctttgcactggtca

SEQ ID NO: 34592 - DNA, 1501 bp, Oryza sativa
gacatcaactcattaggtgtggatgtccatactgtaaaaaccaaagtgtagtaaaaaaaatcctaatagaattatgcctgctgtacatttgtcagggagttcttcagctggagtgaggtgtgtatcatcttaacaagcagtgcaagagaaaattccagatttccagttactgtgtaccagttaccaggccagtgagaagaagggaggacacataacacattgtgttggtcaggtcagcgatgccgcaagcagcggtggaggcagctcctggacaggtcgggtgggcgtccgggctccgtcgctgccatttccattgccgttatctgtcgacgggtataaaaatcagtcggtcacccaaaaactagtagttcgggcttcatggtgatgctggctccgccactagccgcaagagaacattccatgtgcggcgaggtggatcatccttccccgtggctgctgctcatagttcctctttccacgcgcacgggccggccggcggcgccaccacgccggtcccggcttccgaggcacgcgccaccgtccaccctgtcataaaagatgagaaaagagccggagaacgtgtgcaaaagaggagccgcaccttaccctctcctccttcctttcaggtcctttttttttctttcctaccccctgcgtgcaaagctgagcagacgcagccgaaatattcttcttcttgagctgaagaactattgcagatggaccagcagtgatgctgcagcatatgaaaaaagaagaaaagaaattagactggccctgcttttgtgagttgatgctgcagacataagggggacacaatgtcatttgagcctgcggaaactattgtttatgcactaacaatgcagccttgtggcctttcttggcatatggattgatggtttgatgatatatatcaacaggggaacaaaatgtctgtcaagactcagtctgatgtgtctgatgattcttattagtatcagttcaccgttagagatcagtaaacctaaaccatctgcagttgcactctttcactgtatgtccgcatcaaggacacgtgttgttttcactgtttggcatgcttgtctgaatggaacctacagttaaacaagtaaaagcatgaaacctgaaaaatgaaaatagatgcatggaagtgatccttgtacctatgtctattgtcaaattcatgcttcaattcgatgattatggtttgtgaccaacaccgttatgcttgtcaactaatattctaattatccacattatctcctttttatgcagcaaagcatgcatgctgatgccgtcatcaaggctaataaacaatctgtaacagtggccacctcctttatcttcctcccctctttatatccggcgttccctccatgcaacggcaagacaagccaaacccaaaaccacactacactgccctccagcttagcagctcaagcagtagctgagcaagaagctagctgagctccaaattcgacggcaatggagttcttgtcgcaga

SEQ ID NO: 34593 - DNA, 705 bp, Oryza sativa
aaccatggtcacttgaacataaatgcaaggtgagataaaacgataatggcgttagaagagggaaggaagaaatgatcagaagcagcaggctactggcattgacacttgatggtgttaacgataatgttaaacaagtcgacacgaaaaaatcactactactcctactcctaagcctcagtgaaggaggaaacggagaacatctctctcgcattgcagtaaatggtactgctggtgctggactcctcacgtttctcagctgttgaacgctggaggtagaacagtagtagcactggtaaacagtggaagtaaaatttcatttatggattattaatttgctattaaaggacagtttaaactgatctaaagccaagctaacatggtgaacttttgtggctaacgcaagtatggaagggttgccatacaatgtacaagctaacatgaacgttattgaagctgaaaaaactataatgtaatactcctatatcctactgacatgtctgcaccatatattgatccatgagactcattcctgactggccttttactggcacatgcatggaacaatcagcttaaagttaacagtcagctatactgcatttagctgcacgcctgcactacaacagattttgcaactgccattacattggctaatagagaaagctagcatacagttgaaaaccaaacggaacaaacccccaacgctta

SEQ ID NO: 34594 - DNA, 1501 bp, Oryza sativa
tgaaaatgcaaaccacccggatcccatggcacttgtagctcttggataatcaaaatgatcaagtcattcccatcactattgcccttccttgtaatgagtaatgacaatattccactccagcttagtatgccttcttcacagtgctcatattttaccacaagcttaacaattgtgcctcttgttttcagccttccaagaatagttggcatagcaacatgacatagcaaataagtgctaatatttggcttgtaaatgcagaattgcttgtcaccttccaagactgatttgatggttggaataaaaacattcttccatgctgaaattatattcttgcttgcacttggcttgatcccttgcattctccatttgctggtaccatcttctagtataactagaattcccttgcagtcccaagtatcctgaacattgttgccatccaagtggcttatatcactaataagcctgctttcaataacctcaaaatattgtgccatcatataggaggtgaatggatttttggatgccggtagcaagtcatctcttttatcatcacttgggtcttcagttaatagcaccaacaaggcaagctcatgcattctagaaatttcaacaacggtgcagctcctgtaactaacgaaatcccactgtgccttccaagcaaacagactaattgccactccaattttccaggacctgcattgcttaagtctaattggcggtggccatggtggtattagacatacacttgtccaaacggaatcaaatgcagaccatggaacatgccacacattccctcctctaaccacaccacctgaccaaggaagtggccaaggttttctcttgggaagccccgccagcagcctcttttcacttttgaggcatttcatcaaacacccgttgggcatcaccaattttatgcagaaaatggaatccagcttttctgccatgactagcatgggctccgttggtgctgcaatcatgttcagtgtgtgaaacggaaaggggaatgcaacctcggcctgaatagtaccgatgttgtctttgaggctgattgtcgtacaccttgaatgcataaccttggtgaggtcagtagtattgatgaaaatagagcaggccttgtcctcgctaaccactgtctccatggtggctgcagcagtggtactagcaaacgactcctcaagaatggcatgattcacaccggtgtcattgtcgaagcaatttaccaagcacttggtgggcgtcactgttgtagtaccaatgccatggttcaaactcacctgcaagcccatggcgactgtcggagtaggaacatcaatgttgtggcttgcacttgttgtcgtgtacgcactggcactgttggaacacgcccacgaacacttggcgagcactggagtaggcgaggtcgggggtgttgaagatgatgcagaattgaagatggaggttgtcgccttgatgatgttagttgtctcctcgaatgatttgcgcctattatagttggcca

SEQ ID NO: 34595 - DNA, 1501 bp, Oryza sativa
caagggaagggaaggtggagggattggatggtttgagtgactcgggaagggaagtggagcggagcctcccgggagataagatttgcgcagaggcacgcgtggcctacgcattggcaccgctggcctccatctgggccgtcggcttcacatccgacggggttggtgtcgagggctcggggccccggtttttgcgttttgagggaaatgcgttccatatgtttccgacgaggagtattccagaataatacctactacatcatcaacattttttatttcttttgatgaaagtaggtaaggtgtctattttgattggtaataaagaacatagtttacataaatattacatatgctctagcagataaatagttaaaacataacgattttttaccataacggtggggggagccaaactagaaattaagaaattaggagtaaacattaaccaaaagtgcattctattgttattagattgtacttggcatatatcattttgtttttttattccaaactatagttgatttgaatttactaattacctaatttaaatatctatattattagtctaaattatttttaaaattaaaaatattaaaatattacagatatatcacaatgttttagggacgggaagacaaagtacgttcaatggtttcaatttataacctgataaagaaagaatgttaaattagattcatgccaagtgtcacagtatgtcctttagaaaattttgtggaataaaaattacttataagaatataccttgataaaaagatattttgtgtgactatgggtagtttgtggtctagattcttcttaagaaatttatgtgagtttggatgagtacaaattatgtgagcttacatttttcgttctaagggtgtttggatgagattcaataaccaaattacatctgctaaaaacggaaatcaaaattaacaacttgaaagtaggtggagctgggcagaggcagatctaaccctgtttcggttgaacccccaaactttttgagggataacgcagaatacctgatgaggtgtgggtagggagggatgctcaccggcgagcgacgatgcggtggaagaaggaggacgccgggcgccacctctgctcgcaggatggggatcggcgcaagcggcgggcgaggagacgaaattcgaggccgaggccggatgggatggattaggatgcgaatgcggcgggagcaggaggacgccggcgccacctctgctagcaggatggagatcggcgccagcggcaggcgaggagacgggagtcgagggcggcgggcgaggagacgggacggattggggaggcggaggtcgtgcagcgctctgctgccgcgttgtcgcctgcctatgggtcatatgcacaggcgcctcatctcccaaaaaagttcatctaaggtcccttatcttgtcgttgagttttaaacggccctgaacccctaatcttgcaaaacggtccacttttaatcccaaggtagtattgctttccggttttg

SEQ ID NO: 34596 - DNA, 1230 bp, Oryza sativa
attatccacccgattatctaatggcaatacagtgcctaaaattcctgcttccggagtcttaaactttacccgaatccaatctggaaaccgaaaagacagctgcttggctgatggcaagtcactgggtacattgatttgtgttaattttcagtccaataaaacagcgcaaaaattgtaagggtgatccctctttagtaaagccatgcattctgcaaactctgttgcaatgcaagctgtatcctatatccagtgccgatgaaccaattctgtttgcagactgtaccctatctctactctacaagccaaccaaaggaaagtgtttgatctgcagtggaatactagcaggtattccaccatttcagggttgggagtgtgattgatatgcaggagattgacattgtgcagaacattggccgtcaggctgccgctgccgtcgccggtggtgtcggtgagaaagcccggtggtggtggttgtgccggcggcgaggagtggctgcaacaggatgggctgttgtgcatgggcggatcagcgggtggcttatggcggtggccacgctgttcgccggcgacggacccggcggcggcggccttcacgagggacggcgcatgatgatcctggataatttcgagacttcgggccggcgtgcgtgcaaagcccatacatattctacgcgcaactgtcacgcacaaaaacgaagtttttagtaccacatggaaaatctatgacgactgacaccggcataaaagacgacgcgctcgcatcgctcctggcgagctcggtggcgtgagcttgttaccccagctgcgggggggcgggagttggcatgtttcggctgctggagaaaatgaggtttctccctcgatcgaatatggatgcaaacatcctcccgactttggcccacgagggagggaaggtgtgagtcaccctgggctcttgacggctgcgtcatggagcgaagaggacgctgaatcgtggtagaggtgtgtggtggccggtgcccgacgacggcgcctggcgatgggtggggagaaggtgagcagttgtagttgggacccgtgccacacccccgcacgtgcgcaagtccatgacgtgagcgctcccggtcattaggagccacgtcagctggcggcctccgccgttgagcttttccctgccaaccgacacccttctccccacccattggcgaatgccctagaggtttgggttgagataggagtagaggggagtga

SEQ ID NO: 34597 - DNA, 1261 bp, Oryza sativa
cctggggtggggttggaaagggctttgtcacaaacctccgacaccggctattttctggagtaagtttcgtgttgtgtgggtaaagtatatccctctacagatgtgaagtgtttccaattgcgtagttttgtttgcctgtgctttgtgaaaagtattgtggattgagactcattaccagaatcaacctttgtggcagatggatgacctaggtggtcaggaatggatttgtgtgtttcgggatgtttgcggcatcatagactatgcttactgagtagaagaagattgttgtgctatgggggcagtgagaagtccgagaaactgacaatggctcggggagctgcttaatcaagtgaaatggctttgggagccaagaattaatgaaccgacctgggaagtctcttaagtggaatcgagaaacaagtctcttttcgacctaaacttaaaaagaagaaaaccacttagtggtttcaaaatggttccaaataaagaatttgcaaaacaatcttgcctctctttcatgctttcactcaacacctatgttcccatgacgtgttgagtacgtaagtactcatccttgctctatatatatagttcctccaccctgaaggtgaagttgaagagaagtgaaaattagggtttcatcatggttccctgccgtcgtctatggtgttgggtgttagtccgttggttccgttgctgtcggtgaaatgggaaccagggtacccctttccccgaggacccgaggttatattctcattatataaagaaaacacattgattagcagcgattaaaaatatccacgtggcaaggaagggggctcgagagttaccccgtgtcgggtcccgaagtcccctaagcccttctatgtagcacacccctctttcaagaggagtgtcgaaacatacaaaattcatatataagatttacatcttaaaattacaagtcagggaggagcccgggacctgatctaggccgggtcctagggccctcctcaccttgttatgtcatacctccctccttgggaggggtttagagacatataagatctacatcttaaaataacaagatagggaggagcccaggacctgacctaggccaggtcccagggccccctcaccttgttaggtcatacatcccccattgggaggggtgtagagacatataagatctacatcttaaaataacaagttagggaggagcccaggacctgaccgggtcctagcccccctcaccttgttatgtcataccttcctccttagg

SEQ ID NO: 34598 - DNA, 422 bp, Oryza sativa
cagctcatggttaactaatcacgctataatggaccgccctggcttcctagcgcacttttggtgttgagaacaggtgatggcaaacacagccttgattcgttctggagatggaaaagaactaccacagatttagtaggggtcaagaacaaggctacttcgaggacatcatgcatgaaaacgtctagcgcttttgaaacatccggattattatacattttgtgtgcggtaaacatatctacttgctatgttagattaatcttctcatacaatcgagggagtcagcgagaacaacctcagcacggacgagcattccataagaaagacatttcataagcgctactttggaagaaatgtacgttctttgtagggcaatatttcgtgaatgattggactgaggaacatatctaactcttcgttctagt

SEQ ID NO: 34599 - DNA, 1283 bp, Oryza sativa
acttttcgttttttatttttggcggaattattttaattaaaacaggggccaacctttttaaaaaaatagtgaatatcccttatattaggggacagaggtagtactagaactagtggataccccacagcttgatgtgggatttgaaaaatccttcaaaagcacttaaaaacaacattaaattaaaggccagacaataaaaaaaatacaaactgcatgttaagttactaaaatgcctgaccgcagaacatgaacagagcaaaaaccgaaaaataaaagccatgctatagttaatggtcctagtgaaaaaaaaaacacttctcccgtaaaaaaaaccaacctcgtactccaacgaatctggatactctctatgtccagattcgtcatactaaagttggtttttgctatacatcactagcatgtttttttccaaattgcactcaaatttctagcctttggatggacgtcaagattcgtgctatgttatcgggcccacagtcctttgtcaggataggatccgttttgttttggcccgtttccatccgaacccgatccacatgcatgtttttttttaacttccacaactccaatggctccaggcaacatcgttgaggagaggaggtgaatctggcgacgagcggcaagcgcaacgccttcaccgacgggaggagctaggacagctcgcgcagcaagtccacgagtaggatgccttcaccgtgacttgttattttaatatgtagatcttgtatgtctctacacccttcctaaggaggaaggtatgacataacaaggtgaggggggctaggacccggtcaggtcctgggctcctccctaacttgttattttaagatgtagatcttatatgtctctacacccctcccaatgggggatgtatgacctaacaaggtgagggggccctgggacctggcctaggtcaggtcctgggctcctccctatcttgttattttaagatgtagatcttatatgtctctaaacccctcccaaggagggaggtatgacataacaaggtgaggagggccctaggacccggcctagatcaggtcccgggctcctccctgacttgtaattttaagatgtaaatcttatatatgaattttgtatgtttcgacactcctcttgaaagaggggtgtgctacatagaagggcttaggggacttcgggacccgacacggggtaactctcgagcccccttccttgccacgtggatatttttaatcgctgctaatcaatgtgttttctttatataatgagaatataacctcggg

SEQ ID NO: 34600 - DNA, 360 bp, Oryza sativa
tgactagctaatgggtttggaaaaatatgccccacccatcaggtaagattcaattctagccatccattcttttcatctcatttaatcctaggcatcctctccttttcatttcccaactccacctcccataaccattttgccaaacagggtctaagtgttgcacattcagtccttcatgtaattaacatgctgcaaaatttcgtatatgtatttacgttattttgattcataaatgttttttttccttgtagaaagcagggataatatattgggatgatatatatatggaataggggtcacaacaaatgtttacgagccaaaggtgaagcatcattgggttcctagtggatcatggataca

SEQ ID NO: 34601 - DNA, 636 bp, Oryza sativa
cgcgagtgcgccggaagtattcaagaagactaattgaagaccgattattgcaaggcaagtcacacagatcctaaacacaatcctttgagcatgttgatcctatatttaaattctctatttatttcaactatgcatttattttcgaatgtcactgggtggtgtgaatctattcctttgttatggcctgtttgcattgattactttattccttgataccttgggttattataacttgactatttgagctttatatattggttcagctagatattagatatgattgcttagccatgcttagaaacattagcacactattgggataacttatgactcattattatttaatgatggcttaatgatagttcacgatggtcaatcgtgattggttaattaattacttgccaactaaaacttgataatggtgggttgtgagcacatggttttgagagtcgtgctcatgacaattaaggaccggttcgcgagctactgttgtgaaacattaaccgtgccaaccacaagccagcgtgggcaacggctttaccttttgtataacatgattcattgcggagcaccagactgagaagtggcggagataagcccacgggggtcgctggggagtccatgccttgttttata

SEQ ID NO: 34602 - DNA, 1501 bp, Oryza sativa
ccctcccccagatcaggcggtcccgagcatcaccgacgtcagatctggaggtcttgagtcccgccgcggagagcccgggatcgctagatctggccagtggcccgggcctcgaagttgaccgatgcagaggtggacctcggcaaaggcggcttcgtcgtggagggaggcgacggtgatggcgccggagaatggccggagagaagggcgtagaggagaagaaaagagggtgcgggggttggtgggaggggtggcttgttttaaaatgatgcgcggggtttcgtgtgttggttttagctgcccccagcacgccagcaaaaattcaatttcgctcgcgattgtttaagagatctgccagcaaaaatatggatatttttgcaagcggatttcttaaaaaaaggcttacgaaaataatcaatcttcgctggcggcccacctaagggaccgccagtgaaaatggatatatcttcgtgccatgtacatacatacgtgtggacgcgccgtggatgggagcatgtatggcgctgaactacaagcttggtggaagcgtaggcctaccatatgctgagtttcgttgtgttcggcgaaataccccgacgagcaagaaatatagctagaggcaccaatgaatagtcacacaaccttagttgcggagcttgaactgaattagatggggcatggaaaaaaaaagaaggaaagaaccctattataggaaggagaagaaaaaaaaaagaaccctattatagtgtaataatgtatcagacagtagaaaatatgaaggaaaaagaataatttgctagtagcattttggaagtttttatttattataaaaacaatagaggggacagaaaaaaaatctaaatcaaaaacaaaaaaaattaaacagagcgggagtcgaacacaggacatacggattgaaagctattcgggtacaccagccaagcaatgaagtacgacttgtactagttgaaagagcaaccaattttaacaggatgagcttggcttggcctccaccgagctcagggcctcaggccccttctcgaagcttggagcgcagccgcggcggcgccattgctgtggcttgcttcgtttgagccgcacgcgcaccaggtgcgaccgaccgaccgagcggctgagcagcggcggatgaacccagacgccgaagctggcgtccgaatgaggacggattcccggcggcgaggcggccgtgcagaaggcggttataataacaacctcgtgttctgggtcttgagctccaagaaatcgccctccaccgcgccgatcgccgcttcccaccgtgacgccgcctcctctcgccgccgcgcacttccccaccaccgcgcccaagaaacgacctccgccgccgtcgcttgtcgccccggcggtgactccgtcctgcaacgccttcgccgtgacgctccggccgaagcgagccatcctcgccggcgcgcgcccgctacctgttcgacaggaggcgtgcctcatccgcgcgctcgccgccgtc

SEQ ID NO: 34603 - DNA, 1501 bp, Oryza sativa
gcttcacaatctcgactaatttctatcaacttttacgattccaatcgtctcaaggctcgaactatgcatctcaacggaaaaattatcaaaactcattctaaatgtgccaattttcctttgaaattagcaaagaaaaatcaatcgagatcataaaccttggtgagtggaggtggagatgttgagcaactttgtccctaggccctatctagcaccatagcaggtctccaattcacaccaagagaaatcgacaatttttttaaagagatcaatgtacgtgacaaataaaaaaggacacgtagtgcaatgtgcatcatcatcaccacctgcctagaaaggggattaattaacactgtagtgttagtgtacatgcattggcacgggtgtgaagtgctcctcctacttactcccttaagcaggcacaaaagcttcaccttttcgtacaaaaacccctttctttgtcttgtgccttctgagtacacgaaggatgttcttgtcccccaaagcaagcacgctcgtaccatttgaccaacctaaccctcacaaaagcatgtgcttagcttaattagctaacataatagtgttaatttatctcatcccaatctctcataaattctcccttaattacaattggcaccctaaaaaacatgtgcttagctaagctaacataaatcctcccaagtttctctcttcattacagttggcacaaaaaaataacatggtttagcttagctaacataattatgtttgtttatctcatcctaatatctcctaatcactctgttaattacaattggcaccaatgagatgggcatggacagagggtgtggttagagtatattgcccttggtaacctgctttcaattcacttaatcccctaggatcacgtacacgcatggcgtgattaagcagctcacgacatgattagggattcttgcgttgcgtacctgtgatgggaaaggctaccgtacaaagctgttcttgctcactcactcctgctgtcacgtccatgttggagtggagcagcctcaactgctgaaaatttgtgatgaaatttaatgaagcaagtacaacaacaccgtggagtttaatcgtttttattgatatctttcttacatccatataatatggctttgtcaatgcggaatttaaatcatgacaagatccgaaagcttatctggggcaacttgtgacttgtaaatgacacaacatatagtttaaactctgatgtcttacattttatgaactgggacaaaacaaaagggaatatgaacttaagaaatggcacactaaaacccaggttttatatgccacctaacacacagacataaacaatggaattgcttgaccatgatttgaagtacagaaagttgcttgcttgcatatgttgattctacattttgttcatgtctccaaagtgtgttccacaatcaaacgcgaaactgcatacttgcagaacaaaaaaaaaagaactagggcaaaatgatgattgacagacaaattc

SEQ ID NO: 34604 - DNA, 1501 bp, Oryza sativa
gagagagggtagtgaaacagagaggaagttgttgtggtcgcggcgagattaatccgcgttaattgcgggggttaagtcggccatccatcgaggacaagcctaaccccatcgtgtccacctggccactgtgctgcgcgtcagcgctgtggctcccatggttttttggctaccactgattttctctttaaaaatctttaaatactccatccatcccattttaaatacaaccataatttttcgtgctcaactttgatcgtccgtcttatttgaatttttttataatttatatttttttattgttatgagatgataaaacataaatagtactttatacatgacttatgtttttaatcttttttagaaaaacattaaataagtcggacgatcaaagttgtgcatgaaaaaatcatggttgcacttaaaatagaacggagggagtatatatttatttaatgcttattaacaaaaaaataatatttttaaaaacatatttagatatatatttccataacacttattaaagaaggaataatatatttttaaaaaatatttaaatatatatttttaacgagtttaaagtcaatatcgagaaataaattatgatgaaaagaaataaaatttcacgggtttaaatttaagttttaaacttaagctttaaatttaaaattttgtacatcgtccggacgtgctcgactacacatacaggacatcgtcgctgctgtgtgtctttttggatacgttatattcgtgcgacagcggcaatggcattggtcggaatatggcgatggtgacgaggaggaagaggaggaggagaagcggcggcggtgaggaggaggactacgactactaatgtgtcgtactgtgcgtgtacttagcgggaggtagaagaagacgcggtttggggttgggagagaagcatatgcagatggatggattgtggatggatggccatttatggtcaacgtacgtatttggtcacggtgagtatgtaggaattaaatggtgatcttgatctgatctgccaagagacgagagtgagagagagagtcggctcagctactctcgatcggatcatcgtcttccccgggggtatatcaatgctcccaacggcttgatttacccatatttacagccttgtttggttttatatacaatcaatatcaatcatcactcagatagtgacaagaaaataaactatggtgttattttttttctattattaacagtttgtgtttgcagtataattccctaaagtggtgaaattccactggttgtaaccatcttcctttagaagagaagctatgtttggtcatatctttgtgtgataaattaaaataagctctcctttttattttgaaacagtgataaaataagctggatgtcatatactgtagattttaacgatggacaaagactaaggcttatttttttcccctctttacgggcacgctttttaagctcccctaaatggtctgatttcttttttcaaaagctttatata

SEQ ID NO: 34605 - DNA, 1501 bp, Oryza sativa
tgctaactgcatgcatgactgtctgctttagttcacaaaattttttgacatgacagtttgtcacctgaaagacttccttctcttttttttttgtttatgatggagtgttctgtgcgatctcagttgtagttagcttccccctcatgcccacaaaacatttgtgctctaaatgaattgtttgtactgaatcctagttcagtattattgtccagaaataatttgctgatagtatgcaagactggctgcttcagttcacaaaaattggtggcacggcattttgtcacctgaaagacttccttttttttttgtttgtaatggagtgttttttggggggagtggtgtttgcctgtgtgggatcctttgctgtgaagtttaggaagatggtctgatcacttacatttctatcaatcctcagttgcatcctgttcctctatgtttatattcaaccaatgttatctgcacgccttactgaagataactgtatttatgggattactcgctcctataagctctcctgcatataagctatcttgacattttctggccttcttacaaatgcctatttgacaaatatttggagtcatgagttcattcttcaccattaaagtttgcttctgtcattttttggtagctcttggtctttgatgacctcgaagttcctagccacaagacaaaaaacattgtgcagtacattggccagatggaaggcacaaagaaggttttgttggtagatggaggtgacattgataagaagttaaagctggctacccagaatcttcactatgtgaatgttcttccatccattgtgagtgtctctgaatctcatcacttgattggagtaatgaagatggcatagttttccaggcagattatttcactgatgcttaaatatcatcaaatgcagggcctaaatgtatacagcatccttcaacatgacactcttgtaatgacgcggaatgctatcaatagaattgttgagcgtatgcacacccccatcagccgctagcatgttgagattcgacgtgaacaccactgttttgtagcagatgtacttcgaccccctaaagcttcatgcatgccagttttcactttgctggtgtaaggcattagcaacaacacaattttccttttcctttttgaaaatgatctatttgcttctgctagtgatttcagtgaaccatgttgcgtcagatccaatacatcaaagtaggaagtgaattggtcatcatggtgtgcgctcatgactccagatttctaataaagacagttctgataaacttgacatgttattcctaagatttgctattcattacgaatttgtctgtcaatcatcattttgccctagttcttttttttttgttctgcaagtatgcagtttcgcgtttgattgtggaacacactttggagacatgaacaaaatgtagaatcaacatatgcaagcaagcaactttctgtacttcaaatcatggtcaagcaattccattgtttatgtctgtgtgtt

SEQ ID NO: 34606 - DNA, 1501 bp, Oryza sativa
gccatattccgaccaatgccattgccgctgtcgcacgaatataacgtatccaaaaagacacacagcagcgacgatgtcctgtatgtgtagtcgagcacgtccggacgatgtacaaaattttaaatttaaagcttaagtttaaaacttaaatttaaacccgtgaaattttatttcttttcatcataatttatttctcgatattgactttaaactcgttaaaaatatatatttaaatattttttaaaaatatattattccttctttaataagtgttatggaaatatatatctaaatatgtttttaaaaatattatttttttgttaataagcattaaataaatatatactccctccgttctattttaagtgcaaccatgattttttcatgcacaactttgatcgtccgacttatttaatgtttttctaaaaaagattaaaaacataagtcatgtataaagtactatttatgttttatcatctcataacaataaaaaaatataaattataaaaaaattcaaataagacggacgatcaaagttgagcacgaaaaattatggttgtatttaaaatgggatggatggagtatttaaagatttttaaagagaaaatcagtggtagccaaaaaaccatgggagccacagcgctgacgcgcagcacagtggccaggtggacacgatggggttaggcttgtcctcgatggatggccgacttaacccccgcaattaacgcggattaatctcgccgcgaccacaacaacttcctctctgtttcactaccctctctctctctctctctctctctctacacgctttgcaattttgcatcgtgccatcgtcctgtctctctctcttcctcgagaaagaaaggaggagaggggataaagcgcacaaagagcagccgctttgtgccaatctctctctctctctctctctctctctcttctctctctctctctctcatcttctcctccccaaaaagaagagatcaccaattctgtggctgcttgtttcagctgcttaggattcccaagaattccattccaaagcagcagctgctcctcctccttgaatcttgggattcagtgcacgcctccctgcttcttccttcctcctcctgccttgcaaatcttggagctttttttttttttcccctcttctcttgtaggagtaggagagtaggaggggttggagtggaggagattggatttggtggtggtgttttgtgcggcggttgggggtagaggaaaggggagtttgtggggggagtggttagttcttggcttcttcttcttcttcagcgagagctactacagctacagctcgtgctcgtgcgccattaaagtcctcgcctttgcgtctcccccctctttctaccagcccacctcctcctcttcttctttggattagggcttcgaaggcggctgctttctctgcggagggggttgaattcttgcgattcttggaggggggatttgtcctgagtgatttggtatgtgggcagca

SEQ ID NO: 34607 - DNA, 624 bp, Oryza sativa
cattctgaagtagtcaaacaaaggtttcaaattgggttcttggtacatgaagtgtaattttaccttgttgagttatcttttaataccttcgtacttgaggcataatggcataatatgcatttgttcattttccaaattcgttggttgttatttagatcaggtgttgttgctccacctatgttaggaagttaagatgtcctattcattattgaattattaatgcaaatggcgctctcactattaaaattggctgtcctggtgctcataacatgccaaccatcaattcttctcataggtgcactgcaagcgtgatttgatttcctatcaagtatctaacatgtttctaagttatgagttatgacatctgataccattgatgctactgataattgccaaccatatggatgagtggactgacttaaatgaaactttgctctcttttttttcatcagtttagctaaatggaccgaccagccacaatcagtacttttttctatcagcttaagctgacagtgtacattttatttctgtaacattggttgacccaatctgcagcattgtatttgatttgagatgttcgcgaatggtacatcttattcatcgtaatgtgtgacatcttgtagg

SEQ ID NO: 34608 - DNA, 1501 bp, Oryza sativa
ctctttgccgaatccgcttcgactccaatgccgaacctggttcatatcttaccaaatttggtcgttaacaggtagctgtcgtcgatctgcggctttgctgctcggtggttgcggttgcggttgcggcacaatcccaaaattcgatatttaggtctcgttctttttctccaacaaaattaatccatttttcaagtttgtaataactagaaaaaaagcccgtgcgttgcaacgggtgaatgattttttttttacaaaatcataagctgtaattaggagtccgatcatctcaagttagcatgtgagtttgtttaaagagatttcttataaaactctttctgtatttttaaaaccgaacgaacttaaaaaccgaatcaaatacggatatgtattttcaaaagtgaatgggcttaaaaaccgactcaaacacgtagatcctcctcacagagcgagcaggacggtggcggcattcggggagtacaagatctactaccaccccggccatggtggcctgccaccgccacctcatgcggctagtcggcgcgagctcttctggcttgtcctcaacgaccccgacgtcagcatggtcttcggcgaggtcggattccgcagagaggacatcaagctcgctatcctccgtcctttccatgccgctcctcagccacctccccatgcacagctgcccccgtttcttttcctctgcagctttgccgctgcggacaacacgggcatcccttatcccgccgagaacctcaccgccacgaggaaggagaattgccgccgcatcgctaatatcctctcccgcacccacaacccatgcttgttgtcagttgtcacgggcgatgcgagagaaatagaagggaggaagaagagaaggggatcacaaatgggcctcaccttttttaatacttttttactgttgtcacttacatgtaggaccctgttctgttttcaactcctttgatgattaggtgccacgttagcacacttagaccaagtcaactcgccgcgtcaacaaaaaccacttcccaaaccacccaaggagtcaatttgcactagtttttgaaatttggggatgtattatacccggttttgtggtcgagggatgcgattaaaccaagggcaagagctgagggatgcaaaatagacttatttcttttagtggcggctcactcaccatgtctacttccacagcccaagcccatggaaggcccagcccaactccctctcgccgccttcaccctcggccagctatgagaggaaagcttcgcacacgacacgagcacgaatatccacacccaattcccttctcacctttcctcctccaaatccgacctcctcttgttcttcctcctccacccccatcgccgatccgatcccccaaactcgcagtccacttcctcccgcggagatccatccaccaccagccgccagccgccgcggcgcgagattcagattcgtcgttctcttggttgtttgaggaggaggaggaggagggacaaga

SEQ ID NO: 34609 - DNA, 343 bp, Oryza sativa
aaggtagaagaggtcaacataagcctgcgaggggggaagaccttgccggatccacacaagtccaaagctccaaatgtagacaagcctaccaaggaggcctctcctcctggagaagctccagaagctccaaaaacaaaaactggaagcaaagagaagcctgctgtcgactacaacgttcttgcgcatctcaaacggatcccagcactattgagtgtctatgatgctcttatgaatgtgcctgatctgcgtgaagctcttataaaggcgttgcaggctccggaagtttacgaagttgatatggctaagcatcgactctacgacaaccccttgtttgtgaatgaga

SEQ ID NO: 34610 - DNA, 469 bp, Oryza sativa
agttggggatagcttggtctcggaatatggtttctttatttgtttcatgtgtaggtgactcgatgcctcgggagagtatttgcggtgatggaccgggagtcggcttggtggtaagacgatgtccgtggtggtcagatatcatgcgggatactaaggctagagttgatgcacgtggttgatggagattccatatcgcatacgatgaagttattgtgtgcgtatgggatgcggagtcaaatttggaaggatccaaatttggtacgattggttatgtaaagtttctttcttgtactagagggtttcctaaagtgtttagaactcttagtatgagtttggttcgtggctttatgctgcctacctcatgtataaatagagggggagcgtgaggcttcccggtatcgcttttcagagcaatagagttgagttttgagttagggtttcaagtttagtcgaaatttttgtaaggagc

SEQ ID NO: 34611 - DNA, 1318 bp, Oryza sativa
ttcagataatccactgggttgatttatcactggttttaccttgtgctttctcagtgtctctgctttttattgtaaaaaaaattcctttaaaggtttaggtgatctactttgttctacatacctttcctaccaaactttaataatctgctgataaggacaacagtaatggaatccattactgcagtgggccttaataataaaattatacctgatttctagtcaattaaagtatatatctaaagtactgattgctatatttttatttttatcaagatatttacatcatcattttttggccatgcggtgtctacatactataaggttttaagccaacaaatgagatatattctgattttctctttggcagagtttgtttggaaaattttgccaaatgtttatatggatgcatttcctttgtctttaggtgcacatgtgcacatgtgctgtttgcttgcttttgtccaaaatatgatttggacttactggagtttgaattatcaattatgttaattggccacatacctatccatgtgcatgagtgcatcgctgttcctagcttttctttttcctgagtggatgctgcttctagctaggtgaattgttcacattcacacatcggaccagggcatgtgttggcccaacttgagattaggctttgccacacccctaagcccaaccttcattggacctgtaccttgcttcaaaggcttgaaaagtagcctcatcctgctagaccaagcttatagggaacagatagacacatctacacacacaaactgaccctggtaatccattaattgactccacatctaccttcatggctacaacatctgtctttcctttcatctgcatgtgcattttgtttctcaattagtttacgaagacagacatttttttccacccatcacttgtgtatctgcaatatttgctttcacttttgaaacattgtaatcacgctactttgtttctgccaaatagttaatcatgctttattgtctgtattgcagtattgcaagttgccgtgaaaggccattctagggaatgcagaaagatgtgcttgcacgccagagatatctcctatgaagagaagggcatttctcccattgatttgacatcactaattcttgatgagcgaggatttcagttgctcacctggtgcattctgcaatcacaaagtaataatgatgctatcaatgtcagaaatactgctatgctagatcatgcaatttctgatgatggttgaagtttttgcttttacggttttcctctaaaattccaataaagaattgtccgctagcattgttttgaatgatggaac

SEQ ID NO: 34612 - DNA, 1387 bp, Oryza sativa
  unsure (1)..(1387): unsure at all n locations
gtgcgcnccgtgacatacaatcgactgtatacangccgaattctagctcggtaccctgatccaaacccaagaagtagaatgccaattacaaaaataatggaaacttactggttcaagaaaggacttgatagcaagctaatccttaagaacgtggagacaaatgaaccagttacagctcttgctgatgttaatgttgttttctcctccatgggtagcagtagtagcaaaaagactgaggagaaacaggatgcaggaaagctaaccaaccttaacgctttcgatattatttctctttcggaaggctttgatctttctggcttgtttgaggagactgataaaaagaaagaagcaaggtttacatcaagtcaatcagcttcagctattatctcaaaactagaggatgttgcctcatgttcgaagttgacagtgaaaaagaaagaaggtggtgtgctgaaaatggaaggtgcaagtgaaggaaggaaaggtgtattggcaatcgatgcagagatcttcgaggtgactccttcatttcatttggtagaaatcaagaagaacaatggagatacactagaataccaacatttgtggaaggaggacatgaaaccagctcttaaggacattgtttgggcttggcaaggtgaacgccaggatcagcaacctgaagatcatggccagccatagaattgtttcaatgtcgaaatgtttcgttgccttaggaaaggcactgcttatccttttgcttattattcgttctatcttctgtcttcccaaaatccatagctcaatgaaattcgcacaacaatgtaattggattctaaggaatctgaacttataatgcagtgtaatactagttattttttgttgttggcagttcagtgttcgtaattgaaatacatcaaaggataagctacctcacatcgtcgtctggatgaacatagcacctacttaatatttgagtactttcacatgtttttgtaatgtgattgctgattacaggatattaggcatacagtgtcaacagtggtacttacagagagttgcaggtgaatctttgaaagttgcaattgtgtttagaaaagccgaggatttcagaaatttaattgtgtttagaaaagcccaagatttcagaaatttgaagcactcagttaattctcatcattttgcctgttggacaaatgattagtcatttaggtgctcaactctacctccttttcttttcaggactgcactacttatcttttttttttttgaaggattgcatccttttcatccttgacagatcactagcactagttataaaaaatactaatgaaaaacatttctatcctgacactagtagttgtactccaaaagcaatggaaaaattggttgcttgtcggtagtagct

SEQ ID NO: 34613 - DNA, 463 bp, Oryza sativa
atatgggctaatagctagtcttttttgctgcctcaagtaagtgctccaaagaatttcgtggaaaatagttcgacttgtgtaagtatccggggaatttcatgtggtcaaagcaattattgaaccgataaaagagattggcttcagtttttggcttctgacttgctttcgatcgagacatttctttcgtaggtaggctgccttttccatcaccttgcttatgcctccttaatacggagtattgcaagtccaacctactgtttcatatttgacaatataggctgaccatataagcttttgaggtaatgagaaaagacggacaattcatttatccttcaatagaaataagaggcacacaatcaaatttggatactcctttattgtcttgatctcaatactctaagtctcaatattttgaatagtcaaatggcagacgacggtaaaaatccatgtcctcttttatagg

SEQ ID NO: 34614 - DNA, 590 bp, Oryza sativa
tgcaatagttactgatggttggtgtcatacattgtcggttcacattaaagtactcgagtagagttttcattcgattgtgtggcatagaaacgagcgatagaggttatgtgtgtgttgttaggatatggagacagtggtcactgtagactaggcacctaccgccaccagccaagccaaaatcagtccaggcgcgcaactctaccacaacaaactagtaacgcagccggtcgtaagcccaacgtacaaaacatcccggcctcctccactcaaataactccatcaatcgttctttccttgcctcattgctagtgtaaccgcctcattcgatagagggaagcgatgccaacaccgcctcagctaatcttcatcctggaaggccaggaaattacagcaaactaatggttgagattgaaacaacacagtcgtgtctttaccctcacaacatgaaggaatgcgcaagaagaaattgatggtttcgaatgtggtttaagttaaaccctgctagccgccaacgcttcttctcctcctgatcttattattctcttcttgctgccttaatcttgttatgtttggttcctgatcggtgagga

SEQ ID NO: 34615 - DNA, 694 bp, Oryza sativa
caaccctcactcccaaatatacccttaagatagtggtcatcatgggctgggcacttgccgcagccatctgagcaaaaggcagtccacgcactcgcaaaactaccgcaaaatactagtacctctactgatcatgagcccaatgtacaaaacatctcgggctcctccactaaacaaaactccattgatcattatttccttacctcattggcactataagcacaacacttgagggaggagagcgacgctgatgccgcctcatataatctccatcctagaatgtaagaaaattatagcaaactgatggttgagattaaaatagtgcggccgtgtctttacccttacaacgggaaggaatacgtgggaagaaactgatggtttcacatgtggtttaggttaaaacttgctagctgccaacgcttcttctcctcctgatcttattattttctttttgttgccttaatcttgccgccttagctaatatccattctagaacgctgggaaattacagcaaactgatggttgagactgaaacggtgtggccgtgtctttacctttacaacgggaaggaatacgcagggagaaactgttggtttcgcatgtgatttaggttaaacattgctaaccgccaacacttctactccaccatgatcttattatatttttcttgttacgttagattcccggccggtgagga

SEQ ID NO: 34616 - DNA, 1501 bp, Oryza sativa
aatatataaccaaccaaacaaaatacgtacacagatacaactcacaacacaagctagcctttattgaagagacagtatggaaggctttatatatatactatatatataggccctgaaggcttaaacagggagaataaccatcttgtcgtcgtcgttgtcagcgatgtagcgaaagctatatggaaagatgaaggcgtaggcgagctcgacggcgatgagggccatgacccaaccgaccacgaggccccacggcggcagcggcatgatggagccaaacaggtagaacagcatgaccgagagacatatgtacaacaatacagttaataccttgaggcgaaaacggaggctgttggaaacggtgaataatacgttgcggctgcggcggaggagaaagcggcagaggtagatgaggatcatgtgtataccggctacggctgccagctccttgagatgatgcaacatttgcaactccttgagatgaggaagtgctgccagagaggaagtgcttgcagctccttgagatgatgcaacaaggaagggcttttatagtagctgatgttagtgaggcggaaggaaggcataatctcaccaccacgacgaatttacctttgaaacatgggaggtggtggaagtagctgatgtgaagggcgcggaaggagaatattgcgatgttagtgatgttcgggttagctgtgagatgatgcaacatagtgaacccagctataatacaaagtagtaatatagggaagactttgactcagggaagaggaagcgtttagctcatgtggacagggaggaagacggatactttgaaatagcggaagggaaggggggactgctaatgcgcgccaagcgatcaccccgcattcccctccccccaatatgcaatacctcctccctcttctcccccttcctcctccccttctttttttcctactacagtacaccaaaaaaaattagtccaaaagcatatattctttttttcctactacagtacaccaaaataattagtccaaaaacatatgtgtttaaatattgatcgcaacttacctgaattctccatatgggactaatcctaccaacaccatgcatgccatcggccactcgattagacctctttcaggctttgcaattttcgttttgtatacttacgccgggaggaaattttgagcaaaagttttattaaatttgaactaattttgactgtatttaacaaagtttgaataaattcaaaagaaattggaaattttggacgaaatagtttcgtgcagggggttcaaaattcatgaaatattggaaattaatttcaaaccaaaagttcaaacattgattcatatctctactaacaagacgggatagatattactttatgttgcaaagacgggagatgagtaatatttgttccatttactactcgttaccttatcaaccgcagctaaaatttaaatttgatcattaatttttttactatctgttacacattcgacattaaacacccatc

SEQ ID NO: 34617 - DNA, 1045 bp, Oryza sativa
ccgccacaccgccgtgaacgagaacgtgaccgagaacgtgaacgagcgaacgaacgtggccgagaacaagaacgagcgaacgaacgtaacgagaacgagcgaacgaacgtgaatgagaccgagcgaacgaacgtgaacgagaacgtgaacgagcgaacgaacgtgaacgagaattgaacgtgaaagaacgaacgaacgtgaactaacgagcgtgaacgaacgtcaacgaacgtgaacgtgaacgaacgtgaactaacgaacgtgaacgtgaacgatatcgtgaacgaaacgtgaacgtcaagtgcaatatatgttacttcgcatttatcctaatacatctttttgtatcttgcagaaaagacgttgtcggagtcgtccctcaagccggagtggtagctagccctcgaaggaattcgcgcatgcaagtgacgtaattatatatatgattgttatatttgtaatgcaattaagactattagatttaatatacgtcacctagacttagcatatatcactatttgagttttagtataagattattagatttgtaattagacttagcatataagattgtgtagggttctaatatacgacagttacacttagcatacatgactatttgagttttagtataagattatttgagttttaatataagattattatatttgtaattagacttagtatataattattgactagctagggtcctataatatacgtcacctagacttagcatatatcactatttgagttttagtataagattattagatttgtaattagacttagcatataagattgtttagggttctaatatacgacagttacacttagcatacatgactattttagtcttagcatataagattatttgagttttactataagattattatatttgtaattagacttagtatataattattgactagctagggtcctataatatacgtcacctagacttagcatatgattgttagcatataagattgttaaaacataaatgtctcatgacttagcagatgtttcctgtatgaacaga

SEQ ID NO: 34618 - DNA, 1501 bp, Oryza sativa
gctgaggagcggcatggaaaggacggaggatagcgagcttgatgtcctctctgcggaatccgacctcgccgaagaccatgctgacgtcggggtcgttgaggacaagccagaagagctcgcgccgactagccgcatgaggtggcggtggcaggccaccatggccggggtggtagtagatcttgtactccccgaatgccgccaccgtcctgctcgctctgtgaggaggatctacgtgtttgagtcggtttttaagcccattcacttttgaaaatacatatccgtatttgattcggtttttaagttcgttcggttttaaaaatacagaaagagttttataagaaatctctttaaacaaactcacatgctaacttgagatgatcggactcctaattacagcttatgattttgtaaaaaaaaaatcattcacccgttgcaacgcacgggctttttttctagttattacaaacttgaaaaatggattaattttgttggagaaaaagaacgagacctaaatatcgaattttgggattgtgccgcaaccgcaaccgcaaccaccgagcagcaaagccgcagatcgacgacagctacctgttaacgaccaaatttggtaagatatgaaccaggttcggcattggagtcgaagcggattcggcaaagagatggattcgaagaacagagtatgaatcggctgcgaaggcatcggctggagtgtgcgtcggctgagatggattggatagaagacaaccgatacagccgatagagatgaagcagccgattccgacggtagtggcttcaaggctgtttctagaatcaatcgacgtgcttcacatggattgccatgatggagataaagctcttacataggcaattatatctattaattaggatatcttatgtaatttcctttgagatatgtttgggcaaaagtctgccgcaaagacttatggtatcttagagtttgttagagataagagtcgtgtccggcaaggacatattttgtatctcgggtataaatatgactcgaaccatgtaatcaaacaacacacgttcaataacaatttcggcgcatcgccacccttttattctatttcgacgagttcttgctttcggattgagctgcatcaattcgatcttcaacaggtaaacttgtcatggcggcttgcgttctcgggattagcgcttccatctttatgacactctaatcttgtttatgtaattcctcgagttatcatatatactatataatctttgttagtttcgttatataacttgtcatcggctggtttttactgttagaaagtagccgatagagttaaatctcgttattgatctagattatatcgtatatctaccatctctcagagattttcatcatcttgtttagatcttacagttattttatatgcttaatgttgcatcggttgagttcgatctattaagttctatctataattgtgatatctagcttgttttatgatcatttatagagatagtatcggag

SEQ ID NO: 34619 - DNA, 152 bp, Oryza sativa
tcgtcgtggcacggcgtcgtgtcgtgacgaggtcggcgtcggcgtctgcaacgagacagccggcagcaaccgagagggagagacagagatcgagatcggagagagatagctgattagatcgagggaggcggcggcggctctcaccccagaga

SEQ ID NO: 34620 - DNA, 622 bp, Oryza sativa
gtcccacccctatatatatatatatatatatatatatatatatatatatgtcttcttcctcctccagctgcccgagcaagcttcaaaatttcttcaaaaaagaggggaggtcatgccaaaatttctagtgaatttattttggtgattacatacaaatcggaggtgcctaaaaggtttgcaacttcatcctccaatattttttttgtcatattacatttgcaactatgttttgcacacttttttgtctccaaaatttagttgtaagttgatgagagagaaaatttgtgtggggaagaaagaatatatagaaatttagttgatttgctaaagaaggttttataaaatagttgagaaggaaaatatagtgaaagttaatcttaaataatagaaaacaaactaaaatgaaaattaaaagaagtaaaacacattaaaattagtttaaaactttagaaatagtaaataagaattatttggtgtaatattttatgatttttgtatgaataaagatatgtcattattgtatgactgttgaaagagtttgtaattatcttataattattgtatgactgtcattattgtaagaataattatttgtgtacgattttttttcgactcatgtaga

SEQ ID NO: 34621 - DNA, 1501 bp, Oryza sativa
tccattatcatccttgtcgaaaatcctgaaagccttcctcagttcttcctcatcatcacccttgtcattctcctgaatttaaaatgaaaagaagaacttcaattttcccagctatttacaggcaagatcataaaaaagatacttgtaatttaattcttcatgtttcagttgcattttacatatagtttcttcttcattattgcgaggaactcgtcgaactcgatcgtgccattgccatcctcatcgacggccacgatcatgtcttgcagatcctcctggcttggcgccatgcccaggcgtgtgagcacggtggccagctcctccctacttatgcaacctaacatcagacatacaaccgtttcaggttacagatttttcagtgcagatcatttcatcattcttcagagtcagactaagtggaaaaagaacaaaatgatatccaaaaatatatgtacaattaactgcagatcaagtattcaagcccatgcattcacaatatgaagtaagaaaaactttgcaatcaagtccagacccagacattacataaactggttgtgctgctacattcagaggcattcagctgcagagtccatggaattcagtgttgtcacggagaaacctgaattttaggatgtaaaaacgcattgcaatgcaaaattagaggaggaaacatgaaaaacataccgtcattgttcttgtcgaacagcgagaaggcgtctcggaaatcggagatctgctgctcgttgagatggctctccatgaactttcgaattcaagccttgaattcgatcgatggtatgtgtgaaactttcttgtcgtagatgtgtaggagatatatagtagcaggagatgtttcttgcttgtttttgccttttgatggcatgaagtgtgaggcatggaggagcttgaagaattctcgtcagagaagagggatcaggggtgagagaatatgtgcatattcgttttgtactaaattggggtttaattatatctcaaccttcattagtcaaacctagtttatttcacttctgttttcttttaggctcatttgctacagatcaccagattgcaaagtcatgtttgccaattttttgccatgaagagcagaatgtcaacgggcgtcggatgtcgactggtttataggttcggctaattgcaattccattgcacaataacctatctgacagtggcataagcttctctttgtttggcccattatctttgtggattctggtcgtctcattttttaattttgaagaacatggaagcacttctccagaattatatttttgtatgaagaaacgtgactgtgtcacctgcactgacgatgtcctacgcgcttgcgtggcaggatggcacatgtaaaactgttaatcagttgcatttcaggagcaaatttggcattaggttcagtggctgttaggatttgaaataaaatttgaattcaaatccctgtaaaattcctttctattcaaacaatctcaaaggggagcaattcctg

SEQ ID NO: 34622 - DNA, 191 bp, Oryza sativa
cttagagtagtttgactttaaccaaagtcaaaagtcttataaccagaaatggaggtagtacatagtaactatacatccttgctttgaggcttgaaaggaaactcattggatatgccgttgttatttctttaatgtagaataagcttccaggagattgttgctaacaatgatttctttctctttgttttagg

SEQ ID NO: 34623 - DNA, 1501 bp, Oryza sativa; identical to SEQ ID NO: 30491

SEQ ID NO: 34624 - DNA, 562 bp, Oryza sativa
  unsure (1)..(562): unsure at all n locations
aagtgaacatgggtcttgacaggaacaggccnttgttctttcttgtcctttgtttgtttcagacgctatttttctcttgggtactagaccttgtataaaccggttgtgaaatcctcaatcaaataaaagttaactcgaaatttgtggcctgttccaagtgtttggcaaaccaatatgtatattatccacccgattatctaatggcaatacagtgcctaaaattcctgcttccggagtcttaaactttacccgaatccaatctggaaaccgaaaagacagctgcttggctgatggcaagtcactgggtacattgatttgtgttaattttcagtccaataaaacagcgcaaaaattgtaagggtgatccctctttagtaaagccatgcattctgcaaactctgttgcaatgcaagctgtatcctatatccagtgccgatgaaccaattctgtttgcagactgtaccctatctctactctacaagccaaccaaaggaaagtgtttgatctgcagtggaatactagcaggtattccaccatttcagggttgggagtgtgattgata

SEQ ID NO: 34625 - DNA, 1501 bp, Oryza sativa
atggacgaatgatgaaagagatttgaatttattggatattagcttgagggttgcttcaaaattccaaggacaagtcgaactcatatggcttaaatcctctgaactttattttataaaatgtctttagaaaatattgcgaagcaaattaatttttgcattttgaaatatagccttacaaaaaaaaattacttcaaaaaggaagaaaatgtttgtttcaaactatgtaattgcaaaattgtccccagagccgcactgaacttatattaaattttgggaatggtcgaaattagcttgaaaagaaaattttctctgaaaattatttgtgaaattttgattccaaataatgtattgcaaagttttccaaaataaaacttcattcaaaaccaatttttcagtgcatgtcttcgaaagcctcctttcaaaaggttttccaagctgaattccaataattatttgcctaaagctttgtttaaaaataataataataataataataataataataataataataataataataataataataatagtaaaaaaataaatttctttcatgagttttcctttgaggtgttcaaaattattgttgtttcaactttgaaccatgcatacaatctatatggtattttggccctattggcaagagtgctcttttgcgaaataaaatcaaatgttgtttaaaaaaaaaaatttgattacaaaagtttttagttgccatgttgctttttgttaaacatatgtatgattatacaaaatcttgcttgaaaaatctattttcaaattatatttggtgagaaactgcatctcttgaatattttaaatgttttgcaaacatcacttccaaaggatatttctgcaaaatcattttgaaaaaaaaaaatcttctttgtgaacgcaaaagcatatctccttttaaattgctttcaaaatttcttattttaaggggggtagcctatgatggagaaacctcgaggaaataataacttgtgggaaaatatggacaaggaatactatatatcaaggtatatttgcccttgtacagggaatttgaagtatcattggatagtaaaactgcaaagggtgtgaccttaactctcgtcggcaagattcataataaatattaaggaacgaaggattgaacaaatgaagaagaaaaacaacaattcagcattgtcatgctactattgatgactagtatagtagtttactaactttcaacctactaacttctaacaagagaaacctaccacaggacgtgaagacatggaccaatcgacatcgaaaaacaagaattcctccaatctacaagaccccaaaatatgggaataaaccagcccatgctactctttgaagatcctccccaagcttccaggaacaaaggacgagtccaagcctcactaaagcctgaagactacaccatcaatctgaatcacctaaagcaatattcttcgaatgaaaggtgccacctgactccagcaaaacgaaggataaatgtcac

SEQ ID NO: 34626 - DNA, 1501 bp, Oryza sativa
ccttgtcggtacgcttgcgtatcccacaagatgatcggagtgcggtcttgttctaggtctcgttccccagtcgactgcctgtggcatgttaaccgggcccttatgttattttgtcttccgctgttgttctctgatagttgttggcctacctggccctaatgtaagtatttaactcctttagcctaaattcattcgtgatatgttgtgatccaactatgtatgtgtgtaccaactactgatccagggattggtacggataaacacagaagatttccgattgccaaaatcgggggtctacagggttggtatcagagcctatcgactgtaggtcgagaccctagatagaatggccgttagttgcaggaccttatattttacaaatatatttttaaaatgctaaaaaaaagaggttatgaaaacattcaaatattgtttctcatcttacctctcttcaaaaatatctgattccgatacgccaaaaagaaaaaaatatttttgataccttacatctcaacccttcctttgacaaggcgattttatcacttgatttgtgattgaaaaatattggttctacattctcatccacatttcaaaattttagaataagaaccgaaagcaattaagacgctatagggatattattgattgtgccgaaacctcatcctcgaaagtagacgattgcatcatgattatatgaaaaacaaagtaaagaaaaacaaaagaaaagaacgaaattaactcatcaatcatgataactcatgattgttagtactagtttgctctagtcacacactcgtatagtagaagtgaagtctcgactaagccgttagtgaccatagaagctcgacctgcgacatggaagttcataaagaacaataaagagaaaagaaacagactacgtatttatgagaaagcccagcaagaatactaaacatacaaggatctaaagattatggatcaagaaggaacataagatgctacgtagatatggaaattcaataaaaggaacccttatttggataagagtacatggacgaatgatgaaagagatttgaatttattggatattagcttgagggttgcttcaaaattccaaggacaagtcgaactcatatggcttaaatcctctgaactttattttataaaatgtctttagaaaatattgcgaagcaaattaatttttgcattttgaaatatagccttacaaaaaaaaattacttcaaaaaggaagaaaatgtttgtttcaaactatgtaattgcaaaattgtccccagagccgcactgaacttatattaaattttgggaatggtcgaaattagcttgaaaagaaaattttctctgaaaattatttgtgaaattttgattccaaataatgtattgcaaagttttccaaaataaaacttcattcaaaaccaatttttcagtgcatgtcttcgaaagcctcctttcaaaaggttttccaagctgaattccaataattatttgcctaaagctttgttta

SEQ ID NO: 34627 - DNA, 618 bp, Oryza sativa
  unsure (1)..(618): unsure at all n locations
tgcgcnagtgagaactgatcacctttggcgaattcgagctcggtacccgttgcacgcatgatatttgacaaagcagtcggtatatcactcggatcatgttattcagggattcacaccgcatatgctatatattaatattaagtcacttgtttgactacgattatcaaaaccactcagttggtgcatctattaggtacatctactcgatgcacctgactttatttttcagccctccacagtcttcatatttggtaaaagtactcgggagatcatggcgaggatgattgaagcactcggctttggagtaatctagttcgagagaagattatctttccgactgtgaaggtctcaggggctactgtggagattatgggtaccccatacccacacggcatggttatccgactagtcataggggatagcttatatctatggaatatgtaaccgatcatgacttgggtattacgtttccttttatattatgaagcggcctaaagtcctgatttgataatattgtaaaatagatttaggaaaccgataccgtatgggttaaggtttctatcttgtaatcctgccccccatcctatataaggtgggcaggaggccctctagggggca

SEQ ID NO: 34628 - DNA, 1322 bp, Oryza sativa
ttgaaacaataagatgcagggtaaagttttaagatgccatctgcgtacaagaaaaatgacaaacacttggtgtgcatagaaaaacttagtgcttaacaatttgctacctgccgtcatatgcacttgactgccttagggtcttgaccgtcttgatcaccaagcacagatccaccaacaccaagtgaaaatgtgatggtgaggtcgctgttgctgatgtgtggcacgcacaagggacatgtaacggggacgcacggaggatgctagccacaccgcgcgagtcggaactggacctggattcctagggataggccaccggggcggctagggcacgtctgcaccggcgtggaggcgaccggtggccagcgctgcaggggctcgggcctgttttggtggctctcgtcaacgacggagtgctggggaacgagactagattggatgaagattggaagggagcgcacaggcctacacgtaggagatgagcgtgtttctcaatcggtatcacaactgcttctggataaggagaagtgaacccaggaaattgagaaagaaacatgcaaaaagatgtttctagactcaattgatgagcccaggaacttctttttttttcatgtttttcaggaacgatataaatagattagatgcaattcttttctttttaggaatgagagaaacagataagatgcaattcttttttttaggaacgagagaaataaatgattgccatttttttaggaacgagagattttcttttgtaggaacgagtgaaatagatgattatttttgtaggaatgggagataggtgagatgcaatatattagctaactcttctgaatgctagaacacgtgtacacattttaagtgctagaacacgtgtacactattttatctgtgccattgcaaatgtgtctttttagataaatactactccctccgtcccaaaatataaacatttttagcctaatgtaaagtcaaccatttttaactttgactattaatagaaaaaaataaaaatataatcatgtaaaattgaggttactagatttatcattaatcaaactatcttaatatgtaacttttttatttaaaatattttatttttataaatataatgtgaaaatagcatgcatctcgaagactttgtcggagtacaaaaatacttatattttaggacatgagcattaaaattcgtctatttgtaagggatgttgtgcgtgaagctccacaaggagatctatgctgctgccctccccggcggctgcgacggcaacaccaacagctgagagcccgagaacaacgcatcaccattagtctttgtctttaga

SEQ ID NO: 34629 - DNA, 281 bp, Oryza sativa
acaaccaagaacacctcatttggtgcacccaatctccaggaacgcgacctttttaactcggaacaccgtagcgctctggacgccgcagcttcacctttgcctgtcgcccggcttcaacagttcgtaacaagctgagccacttcgccacgagcttcatcaacaccttcagatcaagaatcccgaagtaatcgacgcgaggtggaccacgatgggagatcctcttcttcttccccaattccggccggcgacgccattcctttctttctccttctctgggcagc

SEQ ID NO: 34630 - DNA, 1211 bp, Oryza sativa
acctgagagagtaaatgatttgagaagattggagaaaatgcaaaacttgtttcttattaactgaaaaatgacagaactttagaaatttgtagaaaattcatcctaactataaaaattgaaaactaaattttgttggaatcatattttcatgctctgcatataaaaatgtttaacttaacagaatcataaagatttatgtctcaaaaatccgaaatgcacttaggaccatatttaacatgtaaacactttaaaaatctgtaactttgaatgtaaattgttagattgaagtttctttcattaaaaatcaaattaacacagagcacaccaactccataaaaagcattcattttagagcatgttggatttttatgtatgttttaattttaatttttgcatatgtatgtttagacgattcgccgccgagtctcgaggagatctactttggagctgaacaaggagtggaagagcaaggcaagccacctcccctctttgatcacattgaacctatgatttggtggtttttgaaaagtttgcaaaatatgcatgtctattgtacactaatccattaaaatcttgtaaaatttgttagatcaactcctttacttgcattatcacctaaactccacaaaagaccttaaccattatttcaaaccttaggaacaattgattgtgtcacattaagaacgatgtttgaagtcacaagtctatagaaatgcttagccatgcttagtgatgagtttacttaccatttgggctcaattacatatatgaaatgatttattttgtgatctgaattaaaatgataaaatgtgatatttgttaaataaaatgttggaaaatgtggattttaagtttgggcctcatgtggtacacatatggtgtttagttgtgtgtcgatagggggagaatgtgcccagaccgacctaaggacttcactcaatgtcagttcattttgtatacagtacaaccacatgtgctagtatgggatagcccaagcttagtaaattatttatggtttagccttacattctggtaggccggtgtgtatgagttcgtataattcagaggagctttctatttaccccgaagtggtagtttaggtgactaagtgtgtccaatacaatgctattgtgccacgtggtgtgttcccgttgtgtctgccaccacggcgttaagtttaaggcgtggacctgccacttaacggttctagg

SEQ ID NO: 34631 - DNA, 835 bp, Oryza sativa
gaagatgcttccgcgaacctaactattcggccaatcggccatacttatctaagttataagttgtataaacttaactaaaacttagaacttagaattccctatgttgagatatcatgtgcttgaatgaaagtgtttagtgtgttccttttgttagggacatattaaacatgagtatgagttaaagatatttgagatgttgtagatctttagccatttttgttaagtcttctgaatgtgtaacacatctggttgccgtcttcgagtggtttgacaggcacatctcaagctgaagttgactggcaggctaaaggcctagcaatgtctcacatatctttctctcggagcgtcgaatgtcttaatatgtttgatggaagaattgtgtatagctattcatccttcaaatatactaatgggttcggagtgcttccgacactaaatcgggcgaaccatatattcggttcgactgtctcaacgagagattcaatatggtggactcaaatatatatttggcctcatgttgttggtggttatggtgcgcttttttataactcaatcggaaactctccaaaatgttcagaaatgaacttatttatgaccttaccttgcaaaacatgttgaaccaataaaactcatggaattctgttgatttaaaaaagaatggcaaggtaacatgttatcttcttttattttactaaaatgttggtggttgtattatgtttaatgacaaccaacacctacagtattacaaacacgctattgattagcccatagagattagagtcttttcctacccacaaaacatataaatttgaaggtaggagtatttccctttgtt

SEQ ID NO: 34632 - DNA, 661 bp, Oryza sativa
tagaatagtcattcacaaattataatagcattttctttcttcgtttaatttggaaatcctgggcccaccaaactaccgtccaaaccaggggcagacggctgcttcgtttcaaaaaagcaggggcaaaatcacaaaccttaaaaagtaggggtaaaatcacaattgacatgtaaagcaagggcagaaacacaattgccccttaatgttattaacaattaaagttagaatagtgatggtcaatactaacaagtatttgggaacaaagttagtataatataacgtcttttctctattcaaagtgaaatggtattgttggaagaccctagggaaatgtctattatgatctaagatttgtagtaagcttcttttattgtaattgttgtcgaaacgacaactgcatacgtcgaaagacgtggttactcaacagtggttggaaagaaacgaagtgtattaattttagaattttttactccggatccccccattacatggccctaggggactatttatagccccattacaggttcttactactagggtttaggttatacagggaaatttacatggttgcccttacgaaagggacatttacaggggtacataatgttatggaggctcatgggcccctgatgggccgtcgggcgatcgccggccctatagc

SEQ ID NO: 34633 - DNA, 334 bp, Oryza sativa
taaagcccatttaaaaagaattaaataaatttaattctatttatggataattttaatatgtagatctttattttatataacttttgcaacttgaaccacattaaactgagttacaatgaattagttatgaattttcaaagattaaatcggattaaatcctttatatagattttaattgaattatgacgtaataatgaattatttttgaaaaggaatagaggattattgcgtcagcgggtcgggttcatggtggaccgggtgcacggcggcggctcacggaaacgaacggccgagatctatcagtccacggccggaccacgggagacgacgacga

SEQ ID NO: 34634 - DNA, 1501 bp, Oryza sativa
cgacgacttgggcacgcatgcccgccggcgaacgacggcgcggcggcgcgaaaggagagcaccaaaacgatgcgggtgacgcagcgaactcaccggtgaccaaaacaacggcggaagatcaacggacggcaacggttacgagcaagaagcggcgacgaccttcggcttgacgacggcgatggtgttccagcggtcgacagcgacggcggaggggcggacgagatcggcgacggcttggtgatcccgacggcggctttcccgagcgacgacgacgaccggagcgacggcggcgcacggctggacaaacgacggcgcaaaagctcacggggctagggcgctacagacggcggcgggcgaaggcgagagtggctgcgggtagaggggagctcgggggtccttttataggggcaaggaggcggcggcgaaggcccacggcgaccggcgacgcgaaggaaaggttagggttcggagagagagacgaatccgattcgagatcgaatccacgagtttccaaaccgaattaggcgatgattccaaaagagaaaaggtagaggacatcgagaagatcatttcccctctattgatttcaccggatcgggaaaggggcgagcgaatttggaaaggcggcggcggtgcggctcggctagggttcggccgggcgacggctggaggaggaagacagccctgataggtgggccccacctgtcagcgggcgaacgcgcgcgcgggcggctgctgccggactgggccgagggagagagagagaggttttgggccggctttcggcccaaagccaaaagagacttttaaaaaccttttttaatttaaattattcatgaaatgcaattccatttattaaaaatactttcttggctcaaataaatcccagaaaaatctaggaactaaagattcaagagaagtatttaacaaaattttatctagcccaattttatattgagatttagcaaattaaaattagatattctcttttaggcttttaagatcatttctaataattccttttaaacaacaatttataatttaaggatttttaaacaagaaaagctcttaacaattataattagatcattaatgatcaaataattactgaactgttctttgtatcatttaggaattgagctccgaaaaatccgagaaaatttcagagagtatacttaatcatggagaatttaataaaagttaaatccatccatgctttaaatttaggaaattttatttcccacatttaacttcacttgtaaattaatgaacatttaatataaattctaataataatttattaaataatttagaaatcctgaaacaaaaatcaggatgtgacaattttctgggtaatcaatatacattttgctacgaatacattggattatacagtacatatttttcctactaatttataccgctttgagatggtatagagctatattttccatttttaggtattgactttggaataaatttcgctacagaatgatgaagc

SEQ ID NO: 34635 - DNA, 1501 bp, Oryza sativa
tttgtagaaggtcatatggcggcttgagagtatttattggaagtttaattaacttttagtatataagtcccttaaattttttagaaacgctagtaagctgtcacgtgacactcatataaaagcttgtaggtcaccacatgtcatatctctcaattaaaagaattattaaaaaacataagaaaaagaaaaagaaatctaactgtgaattttcacttaaatcggtaagatgtggttttatatatctattaacactacctcctaagctcccctagtgtacgtacgatgtgcggagtagtagtactgttttcagaaggtgtaaaggaaaagtactgtttgcaaaaaaaaaaggaaaaaaaacaatactaacgtggagtacgtatgtatgccgccggaaaaaaaaaagaaaaaaataatagtaacgttccctgccgatccagacctcttgtctacggtgttatcctctttgtttttctatatattattagttagagcaaatatggcaattttttttaaaaaaaagtagggacgccagatttattttttttaatggagatctaatggttaaaattaatgggtccaccgatttaaaagaaaatcgacggtgagattatagaatgccacgtggcgacttaggagcgtttgtaggaagtttcatggatttttagtatataatagatagatattagggaaagcttaatggcactgggcacgctcgtggtggtgattaattgactgctgatgaggacgaatgaatgatgagggaggtgttgttataaagatagatacacaacaaagaaacaaaattttacccagaaaacccttatagaaagaaaaaaactacgtccgttgacatgcgattactattatggagttattacaaacacagagggtacaacggattgttgcacccttcctgtgctggttacataagtatataaagcgggaaaaatacaagagttataatagggaaagactcgaaatagtaataatagaaaacaatccaaatatatattgctagctgaaattcaaataatatatttaaccgccatagtggcctccgactacgtccatgtggaggagatagggagagaaagagagaggagagaggggagaggggagaggggatcttggaagagggaggaagaagatagctaggggatgacatgtggccatattcgcagtatccatggtggattcaatctgtctaggtccatggtggattcacatgcagcgtcctggagtggagaaaacagaaagggacactttcaatattctttacagatttcgtcgccatgtcgtcagctccaatattctctcttcgtggccctttacgtcggtcaaacacccttttctttcagcgcctttagaaaaagtgaagcgcatagatgcttttacgcctatatgaactcaccaaattgggcttgaagaatcattcggcatcgagaccgggctagctagctagcttagttttggcggcgagcttaattagctaggaactaaa

SEQ ID NO: 34636 - DNA, 790 bp, Oryza sativa
tcctgcagcccagatcggctggatgttgtgacttgctggccaatagttataaattatttatgataccactaatggagtattcaatgccttgcaataggacttatggatctagttcttcagaaaccacctttaagtctaacaatgtcattttaagaaactaaaacaaaactgttacaccacctgcccaattggtggtggtctcacattggagatttggagtatgctgtggtggaatgtagtacttgcggggttcaaatgtagcatttctggttcttttggggaggtgaggacgaaggcccaagcaaattgctatctgtgttcaggcatatcctaagaagtgaattttgggcctagactgttcaaagaaatctgaatagatacttcatggcagtagaattgcatgctactgggatgaatatggaagccatggtgaggaatccctagcccttgcaaatccacttagcatcgccctcactggatgaatatgtaagccatggtgaggaatcgttaaaaagccagatgaggaccaaccattccatacctcacaatattgtacagaaatcagaaatcaaataagtaaacaataactaatcattgattttctctaattaagaactgtctaacacaccagattctcaatacatacagattacactcattagcaatgcgaacaatatttaggcttgtaacttttggcctgtgatattgcaatatatgaattattcttctgtcaattgatatacaaattgcttggataggttgaattgaccagtcttattgtttttgtagg

SEQ ID NO: 34637 - DNA, 1120 bp, Oryza sativa
gccgcctccctcccattctctccgtgtcgccgcctccgcatcgccgatcgcccgtccgacctcctcgtcccggtgacctcctccccactgccggccgccctacccagagggagatgagtgagagaaagaggaagggagaggaggggaaagacggagctgatgacatggcgtcctgacatgtgaggcccacgttgacttacccgtcacgtaggacaaaaccgggtgcaagaccaccgaaggatgtaaaacaaactgttttgtaagttaaggaatgttatatatctggttttgtgtttaggggacgattttgtaattcgatgacaagttgagggaccttcggtgtactttttccatctatattacgtacggccacattaagcccattcatgtcccaacattacgggccgcaggtacaccggaatcccgtcagggcttacttcaattgagaaaatccaagatatttcattgacaagccactaattccaatataaatactttttgatgagtgtgaatttcatgaaatatatcattgtacaaacgactttgccctagaattactataattgctagggtttcactcatcccgccctattaaatatgatgttcgttctatagcacttaatgagggcgatcatatttacggatatagtcctttgtatgatatgaaacaaaaactcgcaatcatcgatggaactttttggacttgggcgttcgtgaataataacatttcttggattttcactaattaatatgggctgcacgttcccgtttcagcccaacctatacatgggccgcacgaaccttggaatcccgttccagcccaacgtatatgggctgcaggtaccccgcaatcccgttccggcccaacatttgtgggccgcatggagaggtcgcggccccgttcaggcccaaaaatgtaacgacgcttcgtctcatagaggctggagggtggggcccaccacgagctcgggacacgcaaagcctcgcctaccatttcccccaactccggcgagcggcggcgactccccgatgcggctgggttgctccggccgccgccgccgcctactccgagccgcgctcctccgcctcgtcgtcctcgtcctcgtcgcgccgccgcgga

SEQ ID NO: 34638 - DNA, 1501 bp, Oryza sativa
ccataaaggaaagaatctagggaaacaaacaggaattcaggaccaggatataaaatattggtcgcttaacgctaactgaaatttccttcttaaaccctgattagctagtaagtgaaccaagtgaaaaaggttcacaggtgataaatggattatccaccatcaaaattgtactacggcagatgtcatacttagagcagagtatgttatacagacatcaaaattgcatgtgtggcaatactaggcatgtactagcattactggagatattacataggttaaagatcatgggaaagaaataaaaattttagatgttatgttagagttctaaacatgtacaactgtataggcagtatttggcactgggggtggatgtgctaatattgtgaaagtaaagcacatactgttttacatcaaggactcagaaacaaaagaaataatgttgaagtgcctattcacattaccatgcttgttatccaacataaacaaaacatagatagaagaacaacataccccttgctatgactggactggtcctccttgtacagattaatgacattattaagaatagtaacttctttatatgtcagctttccagtagattttctgaacatgatggagtatataccatcaagaagaaaataaacatggagcaagaaatactccagcaaaagcttagaagccatctcactagcctcagccccattatgaccatcaaatactgcaaccactccgacgtccacctctttaatcctcatatgctctgtgttttttggcaggatagatcagatcaaattgcaaatgaaaagagtgcatcttaaagcattaaacacaaaatagggaacaaacaaagcacttctaaaaagaggtctacatgtaagatatttgatatttcaattgaccgaataatagtagcctgtgatctcctgatctctacacatgatacaaccatcttcagcattgagcaaccatcagcatgtagcctttacggcacgcaaaagacattttccatcgataacctcggttggaccaagcaaattgtatgtatatgatacctttctacaaaacctccaacacattaacaaatcatgatccctctagtgtaagtaaaacccagcttcccacagtcccagttggattttacgacttgttaagaaaccactctcttcagagagatgccattaaacatttcacaggacaaagcgcataccgtagaagacctgattttgcactaggttccctgcataatctcaaagttctgattcaatctcatagaatctctcaaaatcctaagctggttttcgtactcagtttgcccatctcatactcaaccatgacacgaaagtgagaatttggatatcgaagcttgtggtatatacctatgaaggggatgcggatgccgagcgcgcagacggcgcggtcctcctgggaccgccgcctgcctctgtcaaccgccacgtggcaccccctcgggtgcggcggcggcggcggggaggaggaggac

SEQ ID NO: 34639 - DNA, 1449 bp, Oryza sativa
ccatggcttggatttatgaaggcacagagttttttttttgtcttttgaatttttaacacttcagaatatatatatatatatatatatatatatatatatatatatatatatagttttttagtaatcaaaagggcaatgttaaaaaaaaggatttaaaaagccacattttttcgcctataattgattataagccgtagcacttattagagaggaaaatgtgggtaaaatttttatatttgtgttttagcaatttaaaagccaatgatgaaaaaaaaatcaaaatcaactctaaaattatggtttaaaaattcaaattttggatgtggctgagaagccaaagagcaaacgatggagctgtttctatgaatcactacgatttctactaattatattgatgtgaagttagacgaggtaatgctttttatatagtactagtacgatacatggtcaaaaagataaaatgaaatgaaaggatggtgtgatgcaagatttcatatcagacacttgtatttggcttcatgcaaatctttttcttggtctgcctaacaatttcaacaacaaagctggatttcatcacctataaaaacaacatgttacaacttacaacacaagatctccatgatatcacatctaaagttgtgtttaggtaaatgataggtgtaaccatccaggcagacatgacaaagttaggcctttttccattaaatttcatttctagcttggcatatccatctgaaaatgtcaagaaaacgtcaaaggatgctcacctcatgggtagtggctgtctgcctcacttttttctgatggaatttcagctgcaagcttctgtgtcagactcagagccacatgctaagagaaaataaatctgaactcgttgaattgaatcgtttattaatgggcttgtggtgactatcagatgagctcatagaacacatgatgaggctggatagagaggataagagattgtgatgataagctctcctatgcgtctcaaacactactgatttattgaaagttatccactactgggagagccttgtttacatgatcattattagggttttaatttgtgtgcttgatgtcaaaagttttgcttgttttgtatattgaccaaattgccacaaaaaagtgccaaattggccaattcctggtgtatcgatgtggatacttgggtttaaattggcttgaaagcaactaacgcgtattgtggttaaataacaagattgagctgtaattatgaagttattgacaagtgcgttaactatatcttgcacacgaacgaaaagactatattttacgcacggacaaacttacgtaaaccaacttcaattcgatctaaaaacgtttgaatttgttgtatcaatgaacgatctatcgctctgccttgctaatttcattcatagcgtaatgggcctaaatttcccaggcccatgatagtccaacctgatc

SEQ ID NO: 34640 - DNA, 203 bp, Oryza sativa
ctaaagatcccgggagggcctgacaggccctgacagcattcgaaccgggactaaagatgatctttagtcccggttggtaacacaaaccgggactaaagatcaaatatgcccgttacccttttgaaccgggactaaagatcatctttagccccggtttttattgcatccgaggctattgtggaaatcggccgaccgacgaaaga

SEQ ID NO: 34641 - DNA, 211 bp, Oryza sativa
cctgcagccccaacaatccgatgtgacagttactgaatcctaagttctcatcacctacatgctaggctttatgcacctaggaaccaactctagcaggtggatgcaacatccatacttgtagacgtagagaaagaccacactactagaaaaacgatttttcatggcattggtttataattttcgctggcggagaaatgccaaaactaccagc

SEQ ID NO: 34642 - DNA, 1501 bp, Oryza sativa
taacactgtaagaaaatctcacattttcacaagtaagaacaaatatatttgaaacaaaaacaaaagtgcgtggaattatcgaaagccattacttattttaatttccaaatttaataagataaatatggccgtgatcgtcagtgttggctattgcaaccgttcatagttgcgcactccctccttccataaaaaaccaatctacggatgtgacacatcctaatactatgaatttgaatatatataggagttattaaaattcttattactaagatgtgtcacatcatagatttgtttttttatagaggaagtaagcttgtatttattttgaaatgctcattgctggaacaaggtttgttgagcatgtcctagttttggatatctgaactattggtaaactgatgagtatctgctaaagtggagtacttaaaaaacaaaatcacacattttaaaaaaataactggaaatattaatcgaaatgatgcaaagttttgaacttaacattaaatggactgttggcgagaatcttgcctagggttcttccggttaaccgacctgggttcgaaactttattccttttatttaaaaaaaaaatctacttaacggcgtcccgtagcggtgcggtagtcacgggacaaatttaatactccctctgtttcgttttatttgacgctgttgactttttagcatatgtttgaccgttcgtcttattcaaaaaaatttgtgaaatatgtaaaactatatgtatacataaaagtatatttaacaatgaatcaaatgatatgaaaaaaattaataaatatttaaattttttaaataaaacgagcggtcaaacatatgttaaaaagtcaacggtgtcaaataaaacgaaacggagggagtatgtccgaaacgttacgccactttccctttcctccacttatctgtcctcaacctttttcccctctactcacagctcgccagcgtccctccactcacagcttgccggcgtgcgccgccgctcccctcgcttcctccaccttcgcacgccggcgctgctgcgccgccgctcccctccattcctccgcctccccatgccggcgctgctgcgccgtcgctcccctccctccctccgcctcccccatgacgacggtgccgcaccgctgctcccatcccttcctccgattctgtccacaggtaccacttagcagcaaccccctctcatgcagcagactcaaaccataggtatgtgattcatcttaatttctaagtttcatttcctatgtcttctcgcatcccaacttttcaacttggctaattcagcttctatctacatttctgttctagggtctacatcaaagttcagtagattttctgattttttatagacgaggccaagggaagccgtgatgggggtggcaagaaaattatatcccgtgatggggtagtcgtatttgatacttgacctgttaaaattaacaggttggttactcctctcatgaaactttttgtttgtggttggaat

SEQ ID NO: 34643 - DNA, 543 bp, Oryza sativa
tttgtgcttactctttactcaacagttaaagctaaatctgtgcatatgaacatgtcttgttaaatctgggaatacaaacattttgatttgcaacatttctgttgtagtcaagctgctcggctctatgttttaacctgttaagaccttgtagactgtgctcggctctattgtagtcttatattttacacggtcattctataatgaaaacttgaaaaagatatctattgaaccgtacaatgtactgaacaaagtagaaaagaacaatgagattttgtaacatttattcttccttgtttatttgattgcttcagacaattgttgatatgctaaaaataacttggtatcaaatgtgggtgttataagattcaatttttttctcaaccaggttaaaaaaagtatacctttgtgcatttaccttgttccgttgctttggaactttaaaggaaaactgacttttcttaggcattgaaagacaaatatcaccagtttcacactgtacaccttaccaaccaattttgtttcttagatgtcatttactttgtc

SEQ ID NO: 34644 - DNA, 1501 bp, Oryza sativa
ctttcaacacaaacatcatccttgtcactatgttgctctttcatacttctttcactaaggacaacattcccctcatttgctacctcttccatcattcttccagcagatccaaccgaggaattcattctcttttctttcagccataaaaaactttttaactaaaattgcatgaataatccacacatttttctagttagtttttcaccccacacataacaagcagaacacaaaccattataccttgaaaaatagagataagctgatacctaactagagaaaaaaaatgatacctaaaaactagagaagctgataccctaaaaactacttgaatagatacctgagtgaggtacgcaaaaggaaatccggcgatggaggtcggcacctgagatggatttttgctgaggactactgcgactaggtgcacgcgctgttgccagcaaggtatcgcgcgcggaggcactggatttaggggaaggagcactcctgcttgttgtagttgaaggcgccgccggcgatgtatcgcgtgcagaggcgcgcgataccgagccgggttttggttgcgggaaggatccttctcgcgctctgcgccgggttctggctggtagttgctgcggcgctccgcgcccccgccgacgaggtatctacgcggaggcggcgagtaggggaatcgcgtgcacaacgttgggctcgatcagaaaaggaatcggtattaaatctgttgggtgctaattttatcccgtgactatcgtgcagtaacggaattccgtggggtagctgccctcttttatttaggctgtgtttagatccaagggtgtaaagttttggcgtgtcacatcggatatacggacacacatttaaagtattaaacgtagactaataaaaaaactaattacagaatccgacagtaaaccgcgagacgaatttattaagactaattaatctatcattagcaaatgtttattgtaccactacattgtcaaattatggagcaaaaaggctcaaaaaatttgtctcgcaaattagttgcaatctgtgcaattagttattttttaacccatatttaatacttcatatatgtgcttaaacgttcgatgtgacaataaaaaattttgggtgggatttaaacaggcccaacgttaaatgggccgttggttgtaaaagattggaaatagagagcggcgtccaatgcagtgactagccgttagggggaccagtctggcaacacgcaggccgtcccgttccgtttcgtttcccctgcccgagagagagagagagagagagatttcaaaattcgaattccctctgctcggctcgtccaaaaaaagcagacggcgtcagtgtggtcgtcggtcgcccccaccctctatataaagcgtcccaccccaactgccccaaccctaacactccactaacgcctcccgacgccgccgccgcctcctcctcttgtttcgccaccgccgccgccgcctacgaggaagaagaaagaagaggaaggagaaga

SEQ ID NO: 34645 - DNA, 208 bp, Oryza sativa
aggcatgtgccccgtgcacactttgaacacaaattaaattattttaggacccgaagactaaaaaactgacggttggtatatggtgagaagaatacggcaataggatattggccaagttctcaattcagttacatgaaggtaatgggcagttatacaaagtggggtggatatgttcagggtccaaccgtctaagaaaattctccacaaa

SEQ ID NO: 34646 - DNA, 448 bp, Oryza sativa
gaggggggtgcggcccgaccccctcggggggactaagaggagggcgaacgcatcaccctcgggcccgacgtccctcgggggtaccaggccacgtgtgcgattgtgtctgcctcaaacctctagtcatgatactcctgatcccatgtcaccgacagagatgattggatttactgttattttatgtgaccggttcgaccgggctgtgtatgccggtcagaccggtggtgatcgagcggtcagaccggccggcccgcggtctgaccggccgacgctgtgtcggtttcggtttcgggttgtttctttggatatccgtaattgtttcatggttatatggcttctagatggatactatacgtatgtaatactgttgtttgctactaatgagtcaagttggggatagcttggtttcggaatatggtttctttgtttgtttcatggctagagttga

SEQ ID NO: 34647 - DNA, 1501 bp, Oryza sativa
ttagaactcacccaacagattacaatgtaaagattgctagtactgtctactcaaattttttcttctctgctggttaatgcagaatgcttgaatcaagtccctttcatcaaagaaggaataatggttgctaaatccaagcctacacatgataagtaggcaaaaagaagtatatgtgggatcattttgtcatgcttttttttttaagtttattgttccacaacttgcattaagctaaactttcccgtgcatgttttcgaagcagtaccaagttcatatgttgcatttggattttggacgacttcttttctccatacttgctctagatatgttctggctctgaagaaaacacttagcatgaaggaattgactgccattaacatcaatatggcactttcagttccattcatcaaaattattttgttacacaagtaactgaatagtcaagtatggttaggatcactagacttctgttgcatattcgtggtgttaacaaaagcagacaacagcaaccaccagcatgagcatctatgctttttaccattaaaattacatacttactaaaataacttacatcctccccatattcatctgtttcttcaaagtccctggatttctttcttgagtgcctcctacctgcgaccatgcagagttgtaagaagatatacaaattatgataactaaatatttttcttgaatgccttcatatttgccagatgattccgaaatgtagattagagggatttattgacagtctatgacatcagaaaaatgtttactgaaggtcaaatatcatagattgattgtattgccatgcaggtgctgcattacttatattgctgcacatagttgacacaatttcacaaactgcttagtaatggtaatcaaacaaacgagaagcaaaattgtcgactttcatatttactgacagtaatcagtttttttttctggagataataataagaatgctttacatattctgttttcagtctcttgtatagcagatgaccacaatgcatattaaatttcaaaaccatatcctcagagttctaccagcaaagtaagtggctcagatcatgatcacgatcctatttgcattgtcatcatgttcatcaggtattacattttactttaaccatgaacctggagagaattacctgaaagcccaccgaaagtgtgccttctgcttccttgcttcctgtccaacagaaacttagcgtcacgtcggaaatagagcatgccgatgaggccccacatgcagcctatgttctcctgacgcctagccagtctttgacttctcttccccatgttagttggcttgttcctctacactttgcaattgaaatatgcctgatgttctctgcagtttagttcattgagctaatcctcttgcagcaggtttggttcctgagagaaactctgcagttagctgatgaacacttaggattcatcccgatgaaccatgcaagccaagaatgaaagaacaaaagaaatgagattttgc

SEQ ID NO: 34648 - DNA, 901 bp, Oryza sativa
  unsure (1)..(901): unsure at all n locations
tgtcctcccacagctcctgcggctctgcccgcactcccagtggcccgcgctcccccagctcgcgtgcgccgtactcaccagtgtactccccctacccacacccagttagcccctcctacacccccggacacaccccagttgcttcctcccgccgtggcccacgctttatccgcaccgcgcggaagcgtgttgttggttcttccaccgtgttccgtttccactacccagctcccccaccgccagcggcccgtgctgctgtcggccctcgacaggttccgccggtcccttcgcgtcagccgatcgacatttcttcgactgaggagccgactacaggaggcagccaggccgacgaggagtagaggaggcagtctacagcagccgcccgtgtgttaggcccttttgttccgccgccaactctttcggagtcgtggcaaggtagtgcgtgcgtgtgtttgttgtgggtgttgttcggtagtctggttctcctaggtggtgtgcgcacagtcaagctcggcgtagctctgtgacttgtccacacccgttgtatcaggtgtttttatgatttgaaaaatccagtttatgcttagtgtgcgctatctgagtggctatttacgttgctccttgccctcctaagtgcttatttgattcttacnccgccctcttctgggagtttagatggctagccgcccccgccgtgcagctcgtgcaccagcccgctttggttttgaagatggtagagccgagccagaagcaaatcatgagcagtctcaccacagcaaccgttcgcaccgtactgcttcccgcaatgcagaagttgagcaaccccgccgcagcaaccgctcgcatcgcacggcttcctgtgatgtagagatggaacagtctcaccgctctcaccgcactg

SEQ ID NO: 34649 - DNA, 667 bp, Oryza sativa
ttgatatagaagttgaattcaaatggatgaatgggaggatcaagtactggatgaaccgatcgaaactagggatctgaattgtattcctcatgaagttatcatttaatttcttcagaagtttaggacggtttttggaaccttgaggttgagacatcatttttagagacatcatactctaaggctgataatgtatcactttaatatggagataaatctcgtaagggtaaaaattggacatatatgaaatttgtaaaagtaaaaaagttgattatataccaaatctccatgcgtttcccctctttctacacattttgataaagatacctaatctagacttatcacttgctactcttttcccttctcgtcactactgaaaaacgatttttctgtacagcgacccatttagattgtagatggaccataactggtcgcgtctaggaaaataagctcattttcacgtgtggtccatttaagaggaccgcaagaaaaaatcgatttttctgtgcagtcctcttaaatggaccgcacgcgaaaatatgcatttttgcgtgtggacctattaagagtgccgcatgcaaaaatacccactccctcttttccctcttacccactttaaattttcccctctatctctcctctcctctctatctctttttcttctatcagt

SEQ ID NO: 34650 - DNA, 1296 bp, Oryza sativa
tgcaacgtttgcccactcatcttattcaaattttttttgcaaatataaaaaccgaaaagttgcgcttaaagtactgtggataacaaagtaagtcacaaataaaataaataataatttttaaaaaaatgaataagacgagtagtcaaacgttgcaagtaaaaactcaaaatcccttatattatggggcggagggagtagaaagagaagggataagatcgaaacgttatccactcatttaatttatcccgtaccgacgaaacaccgtacagtagattttctgtagaaatatagagggcaggaggagattcatgacatttcctatggaaggattggaagaaaacatgggagtaataaaaacatagtaatttaactttgatcagaaaagggagagcatctggagttaagctcgaaaaagaatattagaaaaaaaaaactaatgttttttccaagcgtggtgtgctccctttcaacagtacagaacaaggttcttcaaaggttcagaaattaatgctttaaaataattgttcaaaaattacctggattgataataaaatataatacctgctaataatatatacaaagttgagaacatatgctaatataaatatttacgataaattttacatgctaggtatgttaattatttatgatcatgaaaatattgtttattataaataaaagatgtaactgaacttcctacaaaactagcctatgatgtcgctcaatcgcgcgactctaggccttctattatgtggtatgtgggagtggtaatcttttttatttatgggtttctcgttgctcgtaaaaaaacataggtcaggctaactaatattatgataatacactaaatagcttaatatttgttacagattttataagttattgtcttgtaggtctttgtggctgcatgacccccttactttttttttggcacgtgctttttataccttatgcataaatattttgtaggtttttaaggaatgtgtttgatttcatttaaaatcctgtgaaaatcattaaaattatatgggcaaccataactgtgcatgtcctaatagtaatttttttctcaaatatattaaaattaattgttagaaacaaaattaatcaaatgaatatacattttgatgagggtttattagcaaaatagtttttacaatagatgcaaatcgtaaataaattatatgtataacattataccttcatatggttattctttagctttgcccttcctttctttctttccttctagtagtttcatctccggaaacctcttaaattattattttcactgtc

SEQ ID NO: 34651 - DNA, 1501 bp, Oryza sativa
gtgcgtttattctaatattccacgaaacatattaattggaaactcggggcattacattcttccccctttaattaaattcgccctcgaattcgtccaaccattctctagaacacagggtattacacgatgatctacaggctttccccaagctaggcgtaatctgaagaagtttgcagccttgtcccagtgtgctaacccattcaaacctctcagtcttaggctccatagttccataaacttcaatacatatatacactgcagtaaaaccttgaaatcagattctccctgcgtcccaaattagaaggcctatattttttctatacggtcttcaataacatacttgatcattaatttatttcatattatgtttcggacaaatataaaattagcatcacattaaagtactctaaaatataaatcttgcggtataacatgcataatactttgtgtctgtgtgtaaattgaagatgtttttgccgagattttggtacattatccgtgttgaatcagattttaagttcgtttacttttagaaatacaaaagaagtcgtataagaaatctctttaaaaaaactcacttactaatttcagatgaaagtcagactcctaattatagctcatgattttctcaaagaaaaatatatccaagcgaattctcacagtcaagttcaccctagctaaatgtcacgccccgaactagtcccgactggaactaaaccgtgacgctccaaattaacctgttaatcgataccagtcctagaaaacagtgctggtatcacaggaagatagaatatcacagcaacagaggtctctttattatagagtaggagtacagtcatgttgggctgcggacagatcccgagctcacaactgcattacaaaagggaaacggaagccaggactcaggctaaacaacacaggcgcgacttgggaactaggccgaaaccctaaaactcatcgtagccggcttgctcctggaagaactcctcatcagcaggatccgcttcatcttcttaagcatttgggggggattatttatatagagcaagggtgagtcgaagagtactcagcaaaccagggtatataagtgtttaatgcaggcttcaagaagaggcgggtgtttttgcaattgattttatttgaactcttttctgaaacaactaagtgagtgcttcttaaacgacacggatgagacagtgcgtctcgtccggtcggagtatgtgcaatgtattagtctttagattttgaaacaaggttggcacccggccaacagcttttcaaacggccacccgggccaacaacttccaaacggccacccgggcgtagctgatcccatcagctgcagattttccaaacatcgaacccctttccacaacagcaatttcacaagcagtagtcaaataaaactacgctaggaatcacctcacatccgcccatgaccgtgggcacggcttatcgaacagtttgttaacctctgcagagggggtacactttacccaca

SEQ ID NO: 34652 - DNA, 1501 bp, Oryza sativa
atctcgcggcgccgcctccgtcatcagcatcgcagcagcgtgttccacgccatcctcgtctccgtgcagccgctgacggctgcccttgtcgcctcctcgccggccccgatcgtcgtcatcgtcgtcctctcgtcgttcccggtttcgctcgttgtgtcgctcatctctccgtcaagccgatcgcgttcgtcatccacgttcatcaagcgagccgctgcagccccgtcgtcgtcttcgtcctcggctccgcgtcgtcaagcctcgtgccggccatgtctcgccttcatccaaggatcgctgctgaagtcgtcccctcgctttcgtctccgtcattcccggccgtctccgccgcacccgttcgtcgttgtcgttccctcgcctcgtcacgtggtggtaaggatctcttcttcgctgccccgtcctcgtcctttcggtgtcatccgtgcccgttgtgcggttgtcgaccccggtacccgtgtaccggtgtcggtagtcgttcgcttgtgcgtgtggtgactgtgttagtgtgcccgctcggtagccgcgtggtttccacgtgtgcagcccgtgtggtgtctagtggagtccgtttgttggccactcgcctcggttgacacacgggatccgcttctgtcgacccgtggaccgtctctgtgtacccgctctgccgtggtcccttaggttgacatgtggggtccgcatgtcaacagcgcagccttcctgtcttctccaggctagcgcttgcacatattttatagttgaaaaacctaattataataatccgcaaatctccatataacagcattaaacttcggatgaccatgtcttggtcatacgagctccgaatcgatccgttcaagtctcctaatgtttgttataacctaaagaaccctgtgctttctttttatatattgttattgcttctttataggcttgtagctttgcgtgtgtgcttcgcgtagtgttcgtcgttctgaaggttcccgaagcgtggtttgcggtcgtcgccgaaggttcggaaggccgttatctctgagcaaggcaagtcacatcatccttgaacatattgaatcccagtttataaaattattttgatttaaattaatgcattatcgctttatttaaattcccgcattatcattgttttatttagccatgcctatttatttatctttgttatgaccttattattattgctattgttattattaccttgttcaccctaggaaaataaaaccccaactagtgggtactctattcatggttccactagtatgaatttaggtagatgcttcgctgattaattaggcaacattaggtggttttataactttagactttgggaattctcatatcatttggacagtatggaatggttggcttatgttggaattggacacacacctccccctctattcaaaacccccaaaatggttttaggctgggctcgaggtgcgtggttgggttttgttagtcgtacctcgggtactataaggattaa

SEQ ID NO: 34653 - DNA, 262 bp, Oryza sativa
tgtgaaaacaaaggctaagatgatgtttttatttagagcagtcaaccattagatgagaaataattaattgagatctcttccatccccttctcctgtcgtgcacgtgcatacttagaaagtaaccatcggattcaatgtattaggccccgtttggtaggactctaaactctagctcccagctactaactccaactccaactgaagtgggtacgaaagtgtttggctagagtagttagctccactccaccacgtctcttgtagg

SEQ ID NO: 34654 - DNA, 1087 bp, Oryza sativa
ttcctcatcttggaactctggaagaaaccagagataaactgcacgaaaccaagaaggaggccaggagaacagaacatacacttagggaccggatcgccgagctccaagaagccaattttgaactgagtggttcttcaaaaggtaactctatttctgctcaactcattctgacttgactcagtgactaaatagacattgtccatgttatagtccaagctgccaaaattgtcgagctggaaaggcaagttagtatctggtagtttagacgtggtgtctagattacgggatatcattatttggggttatatattgcggatgagaggtgggccgctgatggtgacagctcagtacgggtattcctctgcgcctatatataatcctaagttaattccttggggagggtattcctccgtatttagccccggttatatggtcatgacgggctgtcgtaaggaactcggcagtcaggggtggcttctcgaagtatcaggagggcatcggataaagggtattagctagtatatcagttaactagaatatatgtatactatgtatactagaagtataagaatgagttgttaattcttgtgtgtcactctacccttgaattatcttagcccctgcttagaatatgattatgacaagtaatatataaattattagtggagttctctctacatgatcttcccacttgataaaataaatacgatacccttggaatactctcgggtggaaagctacaatggtatattcgtgcgcttacagataatctctgtaactataataaaccagaagtatttctggcgccatttctgggaattatatttctagtaatgtcgttaagaaataccaacaagcatttctggcgccgttaccggggaagattcataatagagatttcttgaactaatactttatatttacctctgtataatcatttcctttgcaggctaaccttggttgttttcactgttgttgtggaaacagggtagtgcatgactggtttcaacctgccggaaaacttcaaagaaaatccagaagctttcttccagagcgtcaggcaacgagtcgttgctccgcagaaagc

SEQ ID NO: 34655 - DNA, 1501 bp, Oryza sativa
gcgttgtaccggtaatatacccagtggataaagtttaactgaaattttttttaagcaacctagtatgaccaataataatcacaaatgtttttttttggataattattccactatgcacatgtatgatatgaatgatgtacctgacgcgttagtgtaatgatcgtgttagtgtaatgatcgtatcatgggagcaacaagtgaatgcctcggtcgctttcgtgcaagaggcgatggaagaaaatttatgtgattaacaaaaatatgtatttaaaataagtaattttaccaataattagaggcaaattaaacaaatattaaagtggaagtacccataatttttatgtcaacaataaaacttgaaaaaaaaattaatatgatttgtttcaagcaattcttctatagaaaacatttacaaaaacacatcatttaacaattttgaaagcgtgcacgtgaaatatgaaggagtacaattttaaaaagtggacaatgcacccttaactacgagtcagagtcactgggcctgtttagaaaaatttttgacaactgcagcttctctcgaaataaaaaggcttctccaaaataatatgtactttcattgagattctgagacgctctacatacataatctgaaacatgaacgagctaacttctaagaagctgggtttcacagctcccccgtattattatatcttaattatcaagtactccctcaattccacacgaccacccaaaccatcatagtttggattaccttaataaatatattacatgcgcctaataaaattagagatcttgatggtagatgatttaaataataatattttaatgaaaaagatgtgctagttaataacatgcatttatacacaccttctattatgaacaactttaaataaatgtagttatgtctatattatataaaatggaaggagcagttgattcttagaatcttagattttcccagacataccatctgacactttgcaaaggcaattcaggtcttgattagtttttaaataaaaatttttcaccatgtcatatcgaatgtttagacatatgcatagagtattaaatataaaaaatattaattacataaattgtgtgtagattgccatgatttgacaatgtaatgctacagtaaatatttactaatgacggattaattaggcttaataaattggcctcgcagtttttaggcgaaatctataatttttttgttattaatctatatttaatatttaaatatgtatccgtatattcgattttacatgttaaaaaatttggtgttcacgaactcaaaaggcccttagagaaaaccctcgaaatcaaacaagcaagcaagcaataatgcagtgcaaagggccaaaaggcataattgaggccacccgttgcagtgaaaggtttggtggccagcgaagggccggaccacatacatgacctcgcgtccgtctcaccataaatccgccatccctctcctctcctcccaattttcatgccttcctcc

SEQ ID NO: 34656 - DNA, 267 bp, Oryza sativa
  unsure (1)..(267): unsure at all n locations
cttcgtctacaggtgcactctcctttgaaaggcaaagttgcaccgtctccgaagccacgttgncctggctttgcagacgacaacattgccatattaagttgcggcacggacgacgacgactcntacgctgtggcgctcttcacccctgcatcatgtcaactcaggcttcacntgtgtcgctctaccccgatggaaagccaggnagttgaacctcccatcagttgacagtgaagaagcgctgaaggggaacggtgtgccccgtccntg

SEQ ID NO: 34657 - DNA, 1501 bp, Oryza sativa
agcagttgtcagctctagcaatgcacctcgtattgctccaatccaaaggcccatcggcaaatcaccgctcggtaaccccgcgagcaagaagttcctacctgctgcagctgtcaagagagttgttactccaccatcgaagatcaacaagcagagcaacattcccggtgagacttcagccagtaggaattaaagaaacaagtcggttaggttcgaataatggaagcaatagcagtcctagccaagccccctacgtttcaagttcagcagcagtctacaagtgtttaaccttatagcacttctctctgtacatagatgtttatggcagttatgtaatgaaaagggaatattgaataaagtttgagtcagtcagtttctcttcttttatgattcatcttgagcatgcaaaagcaagttaaaatgtgaatctgtcggtgtcacaagaaaccaagagtttctcttctaactcatcgcaattctgttgaagctccaaaacctgtttgcgagcaaatagaggaatggttaactagcagattgaaaatggttagacgctcaacacccaacatgatgagatctctttaaaggcagtatcaatggtattcggatgaaaagagtgatggaatatttgaaagtgacatcatataaagaatcttgggaactcctctaaaccttggaagccgttagaggatggtaagcggaaatttacaccctagtggtgcgatcatggatcaattacatttttccttagttcaagacagccagtataagctccaggaatcatctcaatgtttctcagaagttgaaaaagaaattgttccatacctgggtcagaagtatacagagtcaagtccagaaatgtgtagttagcagggtatatggcatagaatcccttttaacgaatcatctttaccgaagataggaaagcgaagtggttatgatcaaaaagcagaaactctcggcagtatcaaagtcaatttccggcagtcgttcagattgtagtatttttgggaaaacaattgcagggcctatagtccgtaaacccaggaagagtcagcaaaggacgatcgacgaagtgtaatgtcatgtcaagagaaggacttttgagtttgatctgttaagtgatcagtgggtatgcaatctatttaggcatacgacaccgaagtcaggctagaagcgggacagttatgccagcagttcaattgttcccagtcaggcgaaatgtatgactactcctgtaaggggggtaggtcgcagagatgagttctggctcacctcgtcgctgtttcagttgaaggagccaattgcaaggtgtcatgcagaattacgccggtcctaggtcacttgatggaattctgagggacaccggtgaggccaggtcaacagcttagcttagagaagcaacagtgaggacagttgcggttcagacgaaagacaggtcaagcaggtttcctggaattacgtgtcactcgagtcagaacccgttcaagcggacgtaggatcaatg

SEQ ID NO: 34658 - DNA, 1501 bp, Oryza sativa; identical to SEQ ID NO: 21266

SEQ ID NO: 34659 - DNA, 400 bp, Oryza sativa
aagtggccttcttgaatgcaagttgtgagcctctggtgcacttactttgatccagtgagggaaaattacgctactaggaccaattttcccgacgatggcattttatttttgaaggcgggtagacctctcggaactaaatgaccgcttacgaaaataacaaccgtggggtgagatggttgtccacctgcgaaaatctattttcgcaagcggaccacctaagcagtgcgtctgtaaaagaaccctttatatctgcagggtccgcctgccaaaattgatgtagcatataaataggcgccaaatcgcacaatttttttttctaagtcttatctcctctcttctccctcacagcccccagctctcctctccctcccccttagcggccgtgggcgttcggcgggga

SEQ ID NO: 34660 - DNA, 224 bp, Oryza sativa
ggcctatcagtcgatcggctatcggttgactaattgtagcacgagttccaatatagtatgtaagagagatgggtggattagatattaatgatgcagtatatatctataactaactattgtataagtggctattagattggctatatatgatatttcaattttgggagctagtagatggctatattattaaacttgctctaatctcacctcttcgtctgtctaga

SEQ ID NO: 34661 - DNA, 1501 bp, Oryza sativa
atgaaatcccgttgccgaatgcggggtatcatttgtacaactgccatgaactaaccattcccctgcagaccatagaagaatctcgtgcaggtggaacatacagggagacgcgcaacatgacaaggaacgaacgataaagttcatcatcctcaacacccgtgcagatgtatgaagcaggttgagcaccaactggggatgcacccggatggacccaagctccacgacatagcatcggagtctcgacctggacaagcgccagtgaggaccggtgacatgcgcctcatgacatccaatggggggacaatcaaccctccagatcaagagatgtgcctccatctccaagtgaatggcgctcaagttcctctcgttgggacttgggtgaaatcactaggaaaatagacacccttgatatgcagatgggggagatccagtacaacctcacggaacacatagcttagacgcaagaatggcaataatctgcagatgcccagttcaccaacatcaataacatgatgcagcaacagcatgatgaccttcaagcgtactttcgctttcaggggttcaatccttatcaaggaccctgagcgaaagccaagcttaggggaagacatcgctccccccactaaggtaacttgtatcccattacatatttccctttccaattgcatatttgcttcccaattgcatcttataaaacttgaaaacaacataaaaatctgcaaaatagaaaataccaaaaagataagataggtttgagtcatgctatgtaagacaagctagttctctttgttgaaatgatgaatagttgctctgttttatatctctaatatataggttcttggtaagtgctctctcaaaggttaaatataagtagccaacaattatccaggaacctaaggtaaatgggctgcacttgctgatttaagtctaagttgttgcgagatatgaaataataaatatgagttgctatgatcctgatactagtttgacttgaattccagatgttttgtttttcaaaatgataaaattgaaagttcctcatttggtataaattcctaccaaatccaaaaatatgctatcattattaaaccatatacattttggttgcttgacattccattgaactttgtcgaactcttgtgacttgtttagatacttctcatgctctctgatcaagatcatacacccacatatatgcacatgctaaactcctacactgggagctaaccaatattccattccatttccatattaccaccaaaataaattctctatgctttcatgtgttttctcctcttaaaaagaaaaatccttttgaaaaaagagagagaaaaggagggaaaggcatggttatgaaaaaaaaataaagttatgctccatcaagcatgagcatgattgaaaaaaaaatgtagccatggcctctcctaattaataaaagaaggatttttgggagaagaaagtaagcacaaaggagaagcatttttcttttatttttcccata

SEQ ID NO: 34662 - DNA, 1501 bp, Oryza sativa
ttgttctgtcaaataattgtttttgtgaagttcaagaaattgagttttactgaatggtgagagtaaattatacagaaattttgactttctatgacacccataattgttgtatttggcgggtagtcgtgtgatcatcagctgtagcatactctcagatgtgttataatctgtcgctaatatacaaagttacattttttttcaactgcactttcaatagtcattagggccacatgaccacctcaatgattctatggtggatccacgcttgtacctgatggagtgattcagataacatgtaaatgtggttcagtgatgtaccttgaatacctccgttaaatataaaatgctcatgatgtcataaatgataagaatgaaagatctacaggtttcttacttctaaaatgagagctatcaaaaagtacaatatgtgaagtatatacaattaagcagtagctttttcttgttttctgttgttgacgctgcattgataagatgatgccatgtccttgcgtggtgcctatcaattcgacttcactggatagtaatttcttagctttcctctttttgtgttttctgtaaagcaaaaggatgtgcaatgattagttttgttccacttcaaaatgcaggtacagatgagacccagtgaaaagccaatctcgacattcttcatgaagaaaccagtgaaatcagagaagaaagatcaggatcacgcagaaacaaaagcctttcgagctgcaaacaaagaatggcatgaatcagcagaaaaccaattggataaaacgtaccagcaccaagtggaagaggagcaagatgcttctatatttaatgatcaacctatcactttggaacatgatgtcgagaaggctaaaaccatgaagaatgacgaccttatatttactgacgaagcaacacagaaacaagatgctttaagattgaagaggaagaacgaggatgatgaagttcatgcggataaagtgatggagaagagtggcagatctcctgttcatgtgaaaaagaaggtaaaaggcccgaaacctgcttcggttggacaagcatcactgctttcctattttgcaaagaagtagtttctcaagtaatgttagtgctgactctgtccctcggaagtacatcaccttatctagcagctactaccttctttttctctattttttgaggtaaattagaggctatcttcaatgtcaagtagtgtgtctaatattttgctaatgatgtattcccttcgtttcacaatgtaagtcattctaccatttcctatatttatattgatgttaatgaatctagacatatatatctatttagattcattaacataaatatgaatgtgagaaatagtagaatgacttatatattgtgaaacggaggaagtaagcaggtacttcctctggctgtcaacctgagcgttgcatgggtcatttaatattaaatagaaaaaatgcatgtgcgtgacaatgggataaaaatgtttgaacttaaaagaaga

SEQ ID NO: 34663 - DNA, 1501 bp, Oryza sativa
atggtgttactcctagcatggcggatgtgattctgtccatcactaatgagggcacactatggtgtatggcgggagcttctaggctccaagagctgttagccaaggcaatagctcttgtgccctaggaggggggcgaatgtgggtgtgtttctttgtgtttttgtttttgtaagtccgaacatttattctttgcttaatgaaatgatatgcacatctcatgcgtgttcgaaaaaaaaagattcaattttgattattcaattagtgaaagtctttttgttttactgtagatgaaaagcatttacaaagtaacaaacttactgtatacataccttaaacaatgataatttcaaaaggaaaaaaatatttatgaggagcgaaatttggaagaggaaaaaaaggagaaaaacagaaaagaggagaaaagagaggtgattagaacgagagggagaggatcgggatgattggaagaaaaggaaaggacaaacaagaaaatggagagaaaaagacgctgatcaggagagggggacgcgggacagggtggtggattggtgtgagttggtttggttgggctgggaggggttgggttggaagagggtgtataatagttattgtagagtcacgttgaattggatacgacaacgtacaaccaactcaaacacaggtgacgtatcaaaattccagtggaaacatgttcagtttttataatagtacagatatgtacttttactaaatcttttacctggtgtaatttacattccgaaacatttgttcccatttttgtcgtgctactggcacactatgtttgtgttaaaacttgattaataaatgacggacgtccaacaccttaaatttggtagagatttcaagttgattgaacagacccatatagtttgctattactattagtactgaatatgctatccttttttagcaatctctttaaaaaaacgatattcttttaccaaattcttacctgatggtgtactgtgattttatttctttaccttataataatatctatctgtagtgtctcatttatggttatgttaaaatttaaacaatatttttctgtcaaaattccaatctaatgatgtactataatctacttttggttatgctaatagcacagttatgtttatgttaaaaattcaataatataaggtgaatgttgtggggtgcatggtaccgggtgcatagggtaagccgagtggcccatgcccttgcggctatcttcaatgtatagaaaaggatagagataagaaagtctatcctatcccacatgattaggcggttggtacccggattatgagggatactgtaccatgcacgccgcttgccaccctagctctatataaagggtggcagcaggaaccctaaagggttacacactctttctttgatacgcgccatcagccacaccattgctgatttgcgcacaccttgacataaatccaatctatgctaactggactagggttttaccttattcaagggcctgaac

SEQ ID NO: 34664 - DNA, 363 bp, Oryza sativa
cgcggttatggccgggttgagcaatgtttttcgtgattagtctcacacctctcacaataattatggatgtaatacctggtaataatttgcttagctcctgggttggagttagatctgtacagccgggtatggttgttcagaatggttgggcctgtgcagcatgggtgtgctgttcagtgttgattaaaatttctgattaatcactccactgtttttacttctcttaaaagttttgctaaatgctgcttttgcaaatgaacctatattatgccatcctttggtatctttgtgcacttgcatatttgctgtgtggcttgctgagtatgtcatatgctcaccttgcaataatcaatcaacctcagt

SEQ ID NO: 34665 - DNA, 1501 bp, Oryza sativa
gtggtcaaggaaagtccagagaatccctctgtgcaatgaattttttttattttttagacttatatttttattttttagacttatttttttaatttgattaaaagacaattccaaaaagtatttccaaatctagaccttttggccacaccagcccgcctagtgtggccaaataactttgtcacgccacgtgcagtttgcgtggccgcattgtttggccacgccagcctcttgccacgccaccatggctggcgtggccaaacaacgctggccaaaaggttcagttttcgaaaatactttttggaatggtctattaataaaattaaaaaataaaaaatttcctgtgcaaactcaagttgaaaattaagaggcacaagtggataaagttatgaaagaagtgacttcaacaaataatatctttaactccatctaggtaaagtactaatacatcctaacaaggttaagctagatcatcattatgatgattctattgatttgaagattgctcacaacttcacacagtgttgaaaccagagtaaattttgtagcagagacaaagtttgacatttggtgaatgctaccacatgtaccaaatcacaaaacatgacacataattggctatgttggtagctaaaaaggccaagtagcatttcggaaaacttccagattgggcatttgtcgatttttatggtcggcaatgtaatttgtaaggtgcacaagatcaaggagagatggtgatagatttatactggttcaggccctcgagtgaggtaaaaccctagtccatttagcatagattggatctatgttgaggtgtgtgcaaatcagcaatggtgtggctaatggcgcgtatcaaagaaagagtgtaaccctttagggttcctaccgccaccctttatatagagctagggcggcaggcggcgtgcatggtacggtatacctcataatcaaggtacctaccgtctaatgatatgggataggatagactttcttatctcttatccctttctatacattgatgataccgcttgggcctaggccacttggcttaccctacgcagtacggcccaaaggcctctcgtggggcaccagggtaccgtgccccccacaatatcccccgagtacttcgcttgatgtagagtctgaagatgacgacgtcgttcgacaggatcaaatccagctgagtactcaccccaaaattttggatatagattactttagttgggtccgagtggaattgcgaacggccgatttttccttcttgaaggatggaaactgaacttattttccaaaatcagagtcctttcatgggtcggcccgtcaagaatacctaatggcataagtacgcccgacgggagtgttgttgctcaactttccccaaatggcgttgcatcctcctcatctgctacgttctcgagtcagattgggcgagattttccaccgccccacttctctcgccgaagctctttgctttccgcggccctgatgtcgtagtcgatggcag

SEQ ID NO: 34666 - DNA, 1501 bp, Oryza sativa
gatcggtaaagatcaagaagagcaaacgtggctctgataccacttgtaggatcgaaacacaggaactaagccaacctgagggggggggtaaatggttggtgtactcaaaaaccaaaacttttagcggaaataaaagttcccctcaatttcgatgtagatcagtctgaccggagtagtcccgtcggtctgaccgtgcctgtgccgccggtttgaccgatgtagattgcccggtccgaccgccccaaagtctcctcagcctcctgatgccgccgcggtctgaccgccgtatgcccgccagtctgaccggaccgatgccatcggtctgaccagtggtaactcgccggttggaccgccgcacctgagaaaacacaaatcgaaaaactctcaaagtagatgacaactttattacttctctctgtgtttacaaagtgcaccaatagcacttcttacaaaaatcttgactaaactcgaaagcctaactaaactatcaacacaattgttctcaaagcgataccgggaagcctcatgctccctctctatttatacatgagatagacagcctaaagccacgaaccaaactcattctagaagtcctaatccccataggaaacctcctagtgcaagaaacaaattttacataaccaatcataccaaatttggactccttccaaattcgacttcgcatcccatacgcacacaatacctccatcgtatgccatatggaatcttcaccaaccacgtgcatcaactctaacctaagtatcccgcatgatatctgaccaccacggacatcgtcttaccaccaagccgactcccgatccatcactgcaaatactctcccgaggcatcgagtcaactacacatgcaataaacaaagaaaccatatttcgagaccaagctatccccaacttgactcattgttagcaaacaacagtatcatatacgtatagtatccatctagaagccataaacatgaaacaatcacggatatccaaagaaacaacccgaaaccaaaaccgacacagcgtcggccggtcagaccgcgggctggccggtctgaccactcacatagcgccggtctgaccagcaacacctgcccggtctgaccggacccgacaaaacagcaaccctgttcattacctgaaaatcaatcatctccaaaaccacttcgacaataatctccaaatatcaaaaccaataatcacagatgccaattattcatcacagaataagaatcaaaacacacattgatcttacataaactagtacatcaagaatatgcaagatcgtactacctccatcaataaacaacggtatgggcttttgaaagtaacattcgattattcatcttaatcaaaaatataaattatgtaagtattatttattttttgacctttctttattattaaaaatattttaatcattgctaatgttttttcatatttacactttttttgaaaaaagaaaaatgatcaaatgtcgtattcaaaagttttttcat

SEQ ID NO: 34667 - DNA, 1501 bp, Oryza sativa
taggtggtgttcttttctcctgaagataaagatgaagattaaattttttacgcaaaacgaggtggtattaacgtatgattgattgagttttaattattacaagcttaaaaaatagattaatatgatattttagagcgactttttcccacgaaacacaccatttagcagtttgaaaagcgtaacatgaaaatcttaatttttatttttatccaactcttatattggagaaaagaacgggaccttacactcctacgaacctcattcatcaaatctgatggtccagaatcatccgatccaatggctcagatcggtccacgtttccctcagactcgcctccccgcacggccgcacccataccttcacgcagacgcaaacgcctctgccgccctcctctctctctctcttgctcgctattccctccatcctctctcgcactcaccccgacgccgccgcctccctcctctctctctctcactacctgcgcgctcgctccaccccgcgccctaatctccgtcacgcccttcgcaagcaccaccattgccgtcgccgccgccgccgccgcccgtcgtggcctcccctccgtgcgcccggttgctccttcacatcctgatgagagaaaagaggtaagctttctattccacagcggaagtttggatcttgattcgaaaaaaagaacacttttctctcccttgttactgacctgcaagaaatcatgttctgattataaattttccatcttttctaagaaccgtgagatactgattcttggagatgttcaatagtaaattagccgatagattatactctagattgaaatcaggtttaggagacccctccccggattgatggattgattgatctcgtgtgatgttaatttcagaggggaaattgagatacagtcatctgcgtaacgttagtaacatgcacgtgctaacattttattcattattatggcttgccaacatgacatagtgttgattaagccataaaacatccggttttctctgtgttggtgaattacagtgggagctttaccaatcagtactattttctatataacaatgatttatgaaaaaagatagtagcagctttggttaggtcactggtcacactatctgactgcccgcgtacatgtttatgctttacacttccaagttgccaaaaaaaaaagaatgatctcatattggttctctgaaaattgtatagagaatcaatagttcttctgggttatagttgttcatctgaattaatctttccggactgaataattatctcacttggagtgttcttgttagaattgagaacaatttgcttgctcttgatgtatatagggatgggaagaaaatggcattatgttcaggatgatgcgatgctctgaccattttacactgttcttctcaggtttgcccagggtaatcatcgttcgattccattccttcaaccattacatttcaaatgcaaagctaatcttaattaacatgtgcccgggcagagtacgaga

SEQ ID NO: 34668 - DNA, 1501 bp, Oryza sativa
tttaatgtaggaaaaaaccaattacacatattacgtgtaaattacgagacaaaatttttaaaccaaattgcaccatgatttgacaatgtggtgctacagtaagcatttgctaataacgaattaattaggcttaataaatttatctcgcagttttttagtagaatctataatttattttgtttttaaactacgtttaatacttcaaatgtatatccgtatatctgatgtgacaatcaaacctaatttttttcccaacaaaagaaagcctcagtcgtccggctgctcatcgaatcaaactatccatttagcataattaattaactggcccatgcatgcatgtttgctgccaaattagtcgtcattgattgtatatatttcccatttcacgtgaagcacatacccggccgtacgtaactttttctgtttgggataacattatttatttatccattcctagctactctcccccgtttcacaatgtaagtcattctggtattttccacattcatattgatattaatgaatctagatagataaatgctagaatgacttatattatgaaacggaggaagtagcacagatccagaatgagaaattaatggaggggatcatcccccaaactattgctcctctccctcttgttcctcctcccatctttccttgtatcaatgacgattcaggctgtgtttggaatcctgtgtttccaatccctctccgttgtatttcgcgcgcacgttttttaaactactaaacggcgtgttttttaaaaaaagtttatatacgaaagttgcttaaaaaattatattatctatttttgaaaaaaaagaaaatacttaattaatcacgcgctcatatactgctcggacatgcaacagctgattccaaacgcaccctaacaaggcagaaaagctctattcgctagcacccatgtcgcatccgacccttagctttatttagctcgctagttatcctaccagcatcaagatgctcactagaacatgcatggtgtgttttcttatgtttattgggtgatactcagcacgttgctacaggattttataaagtcataggtaaagtagaacaatggtcaagaaatgactggagatcatttatcttgttatcgagggaattattaaattaacataaattggagagcccatccagcttagctgctctttcttgatagagagtttaaaacatactattatcctgtatataccaattaagaaaaaaaagcttcaccgggtaaaggtcattactgaaatacatatcgtcggcttaaagatatatacacatcgaatttaaaaaccaacttgttgacttatattcttattagatctgaataaatgtaggtgacaaatcaaccaactggtctagatgatattttttgccacatccttgcaactgcagtaatgaaaaatgatctgtgattcgatcggggacaaaaaaaaagtatctaaaatcatgggaaaacgaacgggggatgcatggtaaaaagaag

SEQ ID NO: 34669 - DNA, 1501 bp, Oryza sativa
tccttaattagaaccaaattccaatgtactagttgcttgtgccgtcacataactgtataccagcatgtgtcaacttaaatgtgtatccgcataggcatgacataaacaacgaaagagacctggtggcatgtgcttgtgggctgaggaaggagagtaactgctaaatgcagatttgtagggacccaacaaataaatcggaaagaaattttcatgcaagtaaagaagaaccgagatttgtacgcaagtaaatcatactggaacttccatccaaaattcataaaaatggtgtcatggtgagttaaagatgtggattatttaggttctgttgtggcatggcgatgaattttacattagtgttacttgtatgagaattgctttggtggtcgcctcctttatagtttaaatgatatacactctttttttttcagaaaaagtgtaaatatgaaaaaacttttgaatacgacatttgatcatttttcttttttcaaaaaaagtgtaaatatgaaaaaacattagcaatgattaaaatatttttaataataaagaaaggtcaaaaaataaataatacttacataatttatatttttgattaagatgaataatcgaatgttactttcaaaagcccataccgttgtttattgatggaggtagtacgatcttgcatattcttgatgtactagtttatgtaagatcaatgtgtgttttgattcttattctgtgatgaataattggcatctgtgattattggttttgatatttggagattattgtcgaagtggttttggagatgattgattttcaggtaatgaacagggttgctgttttgtcgggtccggtcagaccgggcaggtgttgctggtcagaccggcgctatgtgagtggtcagaccggccagcccgcggtctgaccggccgacgctgtgtcggttttggtttcgggttgtttctttggatatccgtgattgtttcatgtttatggcttctagatggatactatacgtatatgatactgttgtttgctaacaatgagtcaagttggggatagcttggtctcgaaatatggtttctttgtttattgcatgtgtagttgactcgatgcctcgggagagtatttgcagtgatggatcgggagtcggcttggtggtaagacgatgtccgtggtggtcagatatcatgcgggatacttaggttagagttgatgcacgtggttggtgaagattccatatggcatacgatggaggtattgtgtgcgtatgggatgcgaagtcgaatttggaaggagtccaaatttggtatgattggttatgtaaaatttgtttcttgcactaggaggtttcctatggggattaggacttctagaatgagtttggttcgtggctttaggctgtctatctcatgtataaatagagagggagcatgaggcttcccggtatcgctttgagaacaattgtgttgatagtttagttaggctttcgagtttagtcaagatttttgtaagaagt

SEQ ID NO: 34670 - DNA, 441 bp, Oryza sativa
attgggacccttaagactgatgttattagagtgtgttaacagtgaaatttggtaagcctggagtagtcaacggcttagagtcagcatcggctttgaagtctgagattagccgatgagagttgtcaagtcgtcagttgtcggattcttgctatattcggttaaggaaattgatctactaaatgaagtttatccagaagagaccgagttcaaagagaatgcggcatggcaagttatctattaattaggaatagtttgtaagtttccttttatctttaggaaagtttctttcttgtcctacaaggactagtatctacccataggtataaatatgtacacccggggtcattgtaaactatcttcacgatcaatacaattcggcgcatcgccacccttttacttctacttttgtttttacgttccggcggaacttggcacccgaca

SEQ ID NO: 34671 - DNA, 1501 bp, Oryza sativa
ggcatcgagtcacctacacatgaaataaacaaagaaaccatattccgagaccaagctatctccaacttgactcattgttagtaaacaatagtattacatacgtatagtatccatctagaagccataatcatgaaacaatcacggatatccaaacaaacaacctaaaaccgaaaccaacacaaagtcggccggttagaccgcgggctacgctagtctgaccacgcatataccaccggtctgaccgacagcaccggcccggtctgaccggtccagacaaaaacagcagtacctgaaacacctgcaaatccaatcatctccaaaaccacttcgtaaataaattccaaatatcaaaaccaataatctccaatgccaattgttcatcacataataataataatcaaaaacacctttgattttacattcccacccctataattagttaggtaccccctcagggtttcttgggttgtttagatgaaagtttagccattgctacttccttgcagctcgcgtgtcggctagaccgtccgtctgcttgtattcgaaaccctaacttatcgtgtgtattcattcctatttgtaattcagatttattttatcttgttcttacttgtttcttcgatttgcttgccggaataaggttgatctgcaccggcaagatcaacaacccacgaagagttgcgtcgatcgcaaaggcgcaacacaacgtcttgtacggttgtagttgggtcgtcaacatttctcccaaatcgtagttatcattaactcaccaaaagatcaggccaaacaactgccttgagtgtcgattggaacccagggttcatcaatttggacaatagatctatcatccgaaggttagaaataattggagtgatgtggtttaatgagagaagaaagaaatagcattaactacaattagtggggatgagctatatgtgaggggagattaccgataaggaagaaatacagatatggaaagcgtccacacaaatcaattatatcctaatataactcttctggagattataggtaccacgtactcacgctgttgggctatccgattggttaaaggggtaactcatatagatagaatatgtataggataagattcaggtgttatattacttgtgtattaagcaatatcacgtagtcttagtcggctacaattgtaaagtagttatagagctttaaaccataagggataaagtctctacattgtaatcatgctttctttgactatataaggagggtaggggaccccttgtgggcagaatcacacccaagatcgtcatatcaataacacaatcggcggaatatttctccggacataagtagggtattacttctcattgagaaggcctgaacctgtataaatccttcgtcttataacccatccactttcctagcttgttcgctacccacttttagtattgccaaaatctagttttgacagttggcgtgccaggtagggaagcgtcaagtttctcgccaactagtgcga

SEQ ID NO: 34672 - DNA, 316 bp, Oryza sativa
ggggagcagatccggcgcctcctccctccccactggcagcgatgaggtggtgacgacaagagaccggcggcggcacgattttttttttttttttttgcatgtttcctgatgatgtagatgttttgtgcatgttgtgatgtttgatatgtgtacatgtgtgctaatgatgattttatattgtgtttgaatttggaaatgagcagccatatgtatatgaattggatttgaattttgaaaatgaatctattgtcttttctccaaatcttcgctggcggctgggcagttgcatgcgtgttttttttgttccccaaataga

SEQ ID NO: 34673 - DNA, 1501 bp, Oryza sativa
tgcagcgtaggaagaggtgctccacatctttaacagaggagcaaaaaggacaacgtgcggatgctactaatccacatcgagcttgtctctcattggtgaagatgcgcctcttgtgtgtagtacaaaggaagatcttgcatttgacttgagcgtggttgtcccaaatgggcttagcgaaaaggtcatcctataaccctaagaagcttaagtcgtaggctgtttttgctgtgagggggcgatttgtggacaaggtgcgtctgttttttatctctgggtctagctttaggtggcataccagggcttggatattggccaattcgtgtatggccactgtcgacacagtcggggccggagatgaaggagcaattcaggagcggtctgttagaataattgggctaggcccaacttataatattaaatctcaaaggcccataatacatgttgaggataataataccacctctggatttaagcgagaaatatctcaacctaaatagggagttattagaggctccctgttgaccagttgaggtgggggtcggaatgccacacgcgcgcgcgcgcgccgggccgggccgtgggcgaggcgaggcgaggcgtggctggctggcggcgtgcgtgcgtgcgtcacgtcgctatccttttgcagccactaacccacgttcccacgattccctccgcaacagcgcgtccacgttctttctcctgatagataaggaggccgcgagtccgatccgagttcctcgcttctttcccggtgttagtttctccttctccgcgcctgagttgctctcgcttccccgcttctgatctcttgcgcgcacgagagattggaagaagcagtgcctccgaaaccacaccttcgcctgatatctgcaccgggtaggcgggtgatcaggtttttggggagtgcctcctgcacgactgctcatcgccatgtctggagttgctgccgccgctattggcggaggtggtgcgccgccgccgacaggagctgcgccgccgccgacgccgacaggagctggatccggagctggtgcgccaggaggaggtgccgtgaacgactacaacaacggaggcaattctgcctcaccatccagcggagggccattctcggggtataatcttctccttctactgctgttagcgctactcctgttcccattgttagcgctatactgtgtgcgctatgttcttgtttctgttctacatgatgcctctagcatgttatcgcattactggtatgttcctgtttctgacattcatgatgcgcatagtatgctactggttatgttaagatcaccctacactgcttatgccatgatcatagtttcaatttcttggattaaaatatgccgaataatgactatatttccaacattccaaaaacctgataggtcattttcggtagttggctttgctgctgcactgaaaccacatgcttttgatggttcaaactataagagatggaaagcacgtgcactattgtggttgacagcga

SEQ ID NO: 34674 - DNA, 1501 bp, Oryza sativa
gacaagactctagagattccttatgtgagcatgaatcctggttgattttgaaatagaagctttcatgctcatttgtggagttctcatcctccagagttgatgtctcaaacttgtccctggcctgaatgttctccttctcaagagagacgtcattcaagaatgaggttgatacttgatgattatcaagaacgacgttttgaaggccagagggacaaggtttaggctcgataggaggttgtgatggtggttctatggagagcaattcaagggtctcaccagaatctttttgaatgaaatgaagatcatcctgttgtagaattgattcaggggattcatgaagcagaactaacattacttcctctatcggcgtgttatcagggaggatgcctgtcaaggttttctcataatcggtatgaggatcatccctgaatttaggagcgtaacccggagcttgaatttcattggaatccggcgatggctccagggaggactctttagtcagacctgaagatgttgaaggctcgggtttaggctcggcaaaagaaggttcctcccttcttgacacatgcttcttgatggggttcaacatactgcccgacaaaggaggtattttctaatatgcgattgagaatttccttgccttcggcgggagttttgtgcatgaatgaccctccagcacttatgtcaaggtagaatgcagactccctatctaaacccatttgaaaatgttgcaatagcacgtaatcggctatagatagggttgggccagactgaactaaattagtgaatttggaccaggctgcatcaatcgattctttatttatctgctggaaactcagaatttctacacgaagagtagtaatacgggttatagggaagaatgcgaggcataacctgtctcgcaatttctcccggtcaccgtttacatacccgacggtagatgtgtgtcagggttacggataaagcataccctctatcctacgacttatggaatataccgataaggtataccttcgcatataaggttggttcccatatacgccgttaggaattcacctcagattatggaaaataactccacgaagttaaggaattgcataagtcctcggaaagggtgaaatctctagtatatcgtgtaggtttacatatctccaagacttacttgagggtcaaggtattccacggtataaaagggacccctggggagaggcaaagatcatcgcatttcatcgccaacacacccaccaaagtttacggaaccgaagtccacggagtcaactcgccgggagatctcgtcgaatccctcgactacgatcttatcagtatcgcttgcttcggttactgtcttggtaatctgtcctcatcatcatcaatcccatataaattggactgggcctattacctgataaggggcctgaaccagtataatcctagtcttttgtctgttttaatgtcgtactacatagatccctgttccaacgtacgccaataccctattctt

SEQ ID NO: 34675 - DNA, 581 bp, Oryza sativa
tgaaaggcctagggagaaatatttaatggtgcaaaagggacgagttttgaaacatttgtttgtcgcagaagcaccagaccattctgattgttattgtaagctgtaacatcaaagttttggcagcaggttttcatgtgctcttaagcgttgggggtttgttccgtttggttttcaactgtatgctagctttctctattagccaatgtaatggcagttgcaaaatctgttgtagtgcaggcgtgcagctaaatgcagtatagctgactgttaactttaagctgattgttccatgcatgtgccagtaaaaggccagtcaggaatgagtctcatggatcaatatatggtgcagacatgtcagtaggatataggagtattacattatagttttttcagcttcaataacgttcatgttagcttgtacattgtatggcaacccttccatacttgcgttagccacaaaagttcaccatgttagcttggctttagatcagtttaaactgtcctttaatagcaaattaataatccataaatgaaattttacttccactgtttaccagtgctactactgttctacctccagc

SEQ ID NO: 34676 - DNA, 1316 bp, Oryza sativa
ctctacccttggattatattaacccctgcttagactatgattattacgagtaacatataaattattagtcaggttctctctaccatgatcttcccacgggattaaataaatacgatacccttagaatactctcaggtaaaatgccacaatggtatatccatgcgcttacggatgaattctgtaaccataatataccatgagtatttttggcaccattgctgggaattatatttctagtaacatcattaaaaaataccaacacccgaccaccacaccgatgctccattccaccacccgagcgccgcttaaaccacgaccccgagccaccttcgccattgccatctccagccgctcgttgctggcggttgggaccacgccgggggacttcgcctccactttcggctccgcagcgccgccgcgcctaggcgatcgctcggtcgtcgtcttccaccgctaaaaacctaccctacgcgtttgccggtgagcttctccatttattcctcctctggctggtgattcacgccgcttcacgcctctcattcctcccctaaccccttctccacctttagcaggtcttggaggtgctcggacgctcctccacgaccaccggtcgtcgtcggagcttcgctccccgttttcctcgtggagcgccgcctcggtctctcacagctgagcttccgcgcaccgcctttttcgtcgttggtgctcggagagcacccttctctactccccgctctcctctccgctgcttgtcgggcagccgccttgcttgcacggttgccttcctcgctggctatgccgcccggccaccctcgaccgtccgatcgacgccgtggacttggtccacggtggcctgctgccccttgtaccgctgacgagtggggcccacctttggtggactcggtccacacccgccccactgctgatgcaataaccattgacttcctttaagaaaaataattaataatagcacaaaaaatcaagtttaattctagaaattcatttaaatggctcaaaacttctaaaattctcaactaattcatacgaactccaaattgggccattcatcttgcaaaattcatctaaaattgagatttgcatgattgtttactttcacatactacttatttggtttttattagagcttttcctcgttttgcgtgccagcgtctagaatccaccgtttcggaagatcgcgttcgcgaggatgagtgttcggaggattgtttgaagattcgagcaagtcacacattccccttgagcatattgaacccactttataattttttacaaataaaattgcatgttttgctaat

SEQ ID NO: 34677 - DNA, 938 bp, Oryza sativa
aaagtttaagactccggaagcaggaattttaggcactgtattgccattagataatcgggtggataatatacatattggtttgccaaacacttggaacaggccacaaatttcgagttaacttttatttgattgaggatttcacaaccggtttatacaaggtctagtacccaagagaataatagcgtactgaacaaacaaagggacaggaaagaacaagggctgcttctgtcaagaaccatggtcacttgaacataaatgcaaggtgagataaaacgataatggcgttagaagagggaaggaagaaatgatcagaagcagcaggctactggcattgacacttgatggtgttaacgataatgttaaacaagtcgacacgaaaaaatcactactactcctactcctaagcctcagtgaaggaggaaacggagaacatctctctcgcattgcagtaaatggtactgctggtgctggactcctcacgtttctcagctgttgaacgctggaggtagaacagtagtagcactggtaaacagtggaagtaaaatttcatttatggattattaatttgctattaaaggacagtttaaactgatctaaagccaagctaacatggtgaacttttgtggctaacgcaagtatggaagggttgccatacaatgtacaagctaacatgaacgttattgaagctgaaaaaactataatgtaatactcctatatcctactgacatgtctgcaccatatattgatccatgagactcattcctgactggccttttactggcacatgcatggaacaatcagcttaaagttaacagtcagctatactgcatttagctgcacgcctgcactacaacagattttgcaactgccattacattggctaatagagaaagctagcatacagttgaaaaccaaacggaacaaacccccaacgctta

SEQ ID NO: 34678 - DNA, 1501 bp, Oryza sativa
cggaatactaggagcatgctgcgctcctagtagtatctctatataattcatagatttttcttttgttttgtaaggagtactccctccatttcatattataaattgttttaacttttttgggtttaaccaagtttatagaaatattagcaacatctataataccagattagttttattaaatgtagcattgtatgtattttgataatatgttgttttgtgttgaaaatattgctatatttttctacaaacttggtcatacttaaagcaagtttaactaggaaaaaataaacctacttcatatataaagtcacaagaccttttatccaaaaattgaaactttcaactaaaagttcaaaaaaattatactcttggctcaaactttcaatataaaatccaaaaactgaaacttcccaaaaaaaaatcaaaaactttgtgctcttggctctcaatctttcgatacgaagttacagaatttgagaaaactttcaactgaaactcctcacgagggtgtcaagtagggatgaaaacggtcggaaacaatcggaaaaaaggctcaaccattaccataaccatatttttctcagaaacaaaaacgatatcggaaatatcgaaaaaccagaaagggcagctacgctggatgggctctccaatttatcttaatttaataattccctcaataagaagaaaaattatcctcagtcaatttcttgaccattgttctacaattttacttataaccaaattttacttataaccaaatattacttatgactttatagtaataaaatcccgtaggctgcagcaacgtgctggatatcacccaacaaacataaaaaaaaaacatgccatgttctagtgagcatcttgatcgtggtaggatagctagctaaataaagggtcggatgcgatatggatgctagcgaatagagcttttctgaatcgtcattaatacaaggaaagagggaggaggaaccagaaggagaggagcaatagtttgggggatgatcccctccattaatttctcattctggatctttgctagggatggataaataatcttatcccaaacagaaaaggctagagtacgggtatgtgcttcacgtgaaatgggaaatatatatactatcaatgacgactaatttggcagcatacatgcgtgcatgggccagttaattaattatatatgctaaatggattgtttgcctcgatcagctgccggacgactgagagcaaaacataatgcatttatatactcgctcgtgtatcacgcataataatactatactactcctatgtatcaatgatcgatcacatgcaacaccgacaaattaaattacccaccatcgatccatctatctagctatgcctatatatatacgccatatgtatgacatatacgcaagctacatatacactctctccaaagtttacattcctgatatatagctcatcatcagttgatcgtgtccggaggtgtgagaggtcggcgatgagctccggc

SEQ ID NO: 34679 - DNA, 171 bp, Oryza sativa
caatcaaaatagacaccttacctacttttttcaaaagaaataaaaaacaacactaataaataatgaacatgattttagatgtagtaggtattattctggaatactcctcgtcggaaacatatggaacgcatttccctcaaaacgcaaaaaccggggccccgagccctcgac

SEQ ID NO: 34680 - DNA, 1501 bp, Oryza sativa; identical to SEQ ID NO: 21243

SEQ ID NO: 34681 - DNA, 1501 bp, Oryza sativa; identical to SEQ ID NO: 21232

SEQ ID NO: 34682 - DNA, 896 bp, Oryza sativa
acatgatcctacctacccaggtatcatgatcgacgattttcctaggtaggatcatgtgtgatacttcacaagtatcacaccatcctactaaagtatcatctctgaaacctcacaaggatcatgttaccagagatgatacccaagtagaatcatgtgtgatacctgtaaagtatcacatcatcctactaagtatcatctgtgaaacccatagggattatgttagaaaacatgatacctaagtgggatcatgtgtgatacctcacatgtatcacacatgatacctaagtaggatcatgttagaagacatgatatctaagtaggatcatgtgtgatacctcacatgtattacacttaatgatactttttttattaggatcatatgtgatacctgtaaagtatcacaccattaagtagcattcgtgaaactcatagggatcatgttagaagacatgatacctaagtaggatcatgttagaagacatgatccctaagtaggatacatgatacccaagtaggattatgttagaagacaagatccctaagtaggatcatgtgtgatacctcacatgtatcacacttaatgatactttttgagtaggatcatgtgtgatacctgtaaagtatcacaccattaagtaccatctgtgaaacccatagggatcatgttagaagacatgatacctaagtaggatcatatgtgatacctcacatgtatcacttaatgatacttttttgaggagaaccatgtgatgctacaaagatatcacatgatcctacaagagtaccatgtgatcctcaagagtatcatgtgatcctactagcgtatcacatgatcctaacagagtatcatctgtgaaaaccacatgaatcatgtgctacttgtgtgaaaattttta

SEQ ID NO: 34683 - DNA, 1501 bp, Oryza sativa
acgaaagtagtagtaactggggttctgtgttaacaaagatcacgatcaacaacattctgctggaaccttcggtacgaagaactaagatccatgttgcccggccgtcaatccatcgaaccaaagcaatgagctttaaatctagttacctcgtcggcggggttggcagcgatgagccgcgcgggacatggacgtaggtatattgacgtagtgctgcagacctgcatcatcgatgacggaggctaagcttgggcgctgcaatggcattcttccaggaccatcgtgaatggccgcaagggcgcggtgggcgtggaggacggagggcgaatcgctgtgttggacgacgacgacggcggcggtgcaatggaagtgtaagatggcggtgattcgtcgccggtgtcgtgggtgacggtcctggacgacgaagggcacggtgaggcgatacggagcaacggcgagagggatggggtgctggtggtgggggcacggcggattcccgtcgatccggcagcggcggtgacgcaggatgaaggccctatgcatggcgggagggatggggcgctgggggtgagggcgtgcgtggattcttgccggtccggcggccgtggcgctggacgacggcgacaacggacggcacagcgggaggaatgggtgctgagggtgggggcgcgggcggatttccgctgatctggtggcagcggccgcgtgttggaggagccggccgggatcgcgggggagggaaggagcgcattggtgggggcaatgcgggaagtggtgagggcgtagggccgggatcgtgagggtggatacggcaggaaatagggcgtggggatcgtggggtcgatctggtcgttggatgttgtcagggttatggttaccacatacctaatagtagttgattaaatctcaggacccaccacataccatgtcttatacggaaacaaccttcggatataggaggagttccgcataaggaaggatgaatagaattctacatggaaacaataaggactactcggattgtatccatataggtttccctagttctacttggataaggggtcacctatgggtataaatacaaggccccctatgaggagaggggacacgagacggaataatagatcaatatacaagccaacacatccaccacagcctatggagccggagcacgcaggggccaagtcgccgggagatctggtcaaaccaactcgactacggtctcgtcggtatcatcgagttctgctattccctttgtaatctgtggtttccatcatataatcccatatcaataggatgtagggttattacctgacaattcaggggcccgaacctgtataaaaatcctcgtccccatctcttttactacaatctcgcgtatatcctagtaccaacgatccccatactatgcaaataccggaatcgtgacatcaaacgtcgacagtggcgcgccaggtagggggattttggtgcttcaggattttgacgagataggttcaagaga

SEQ ID NO: 34684 - DNA, 779 bp, Oryza sativa
ggcccccctccccctatactcctccctcctctcccctattcctcctccccttctcctctttctactacagtagactacacaattttttttgaaaaataaaagttagaaaaatttatgtatagaaatactatatataaaaaatttgaattcaaattcaaatttgaatcgggtatgtaagcttttgacttataaactttgggtctataaactttaggtgtataaactttagatgtatagaaatactatatatagaaaatatttgaatttaaattcaaatttgaataagatataattcaaattcaaatttgaatcgggtatataaactttaggtctataaactttaggcctataaactttaggtgtataaactttagatgtatagaaatactatatatgaaaaatatttgaattcaaattcaaatttgaatcggatatttgaattcaaattcaaatttgaaataggtatataaacttttgacttataaactttaggtctataaactttaggtgtataaactttagatgtatagaaatactatatatatatatataaatatttgaattcaaattcaaatttgaatcggatatataaacttttgacttataaatttttggtctctaaactttagatgtgtaaactttaggtgtataaatttactaaaataggaaagtaatgcggtgccaaaaaaggaaacaaggtggagaggtggagggagggaagggggggtgcgcaaaactgatcgccctgggcgagcgagggcgatcgctcgcctaatagc

SEQ ID NO: 34685 - DNA, 222 bp, Oryza sativa
agtccaaatttggtatgattggttatttaaagtttgtttcttgtactaggaggtttcctatggggattaggacttctagtatgagtttggttcgtggctttaggctgcctacctcatgtataaatagagagggagcgtgaggcttcccagtatcgctttgagagcaattgagttgattgtttagttagggttttgagttttgtcaagatttttgtaaggagt

SEQ ID NO: 34686 - DNA, 491 bp, Oryza sativa
atcatgaattagctcagctagctaggagattaaatagttgtgcagtttggcggtttgatgctgctctctgtattagaacttagaacttctgactgtaatctctctggttgagtaaaaaattcaccctttccccgcaaaaaaaagaaaggaatatgaggaagatttcagagagagctacaaattggacgtgggcgcccacgtcatcatgacgtcatcctacatgtatgcatctaagcgaactttaaactatttttttctcttaaattatttatccaaatcatgatccgattgcactattaaatccgttgcaactaaatctttaaaacaaaaccacacatggatataatccgatgaaaaaattagcttattattaaactattttttaatgttgcacgctgctgcaccaagtatatcggaattgtttcactaactagatcgaaaatgtttcatcggacgttgtttcgccttatatgaaaacaatgtttcagcaa

SEQ ID NO: 34687 - DNA, 1501 bp, Oryza sativa
tctgtgaattatctatctctagttattaagaagtatgaaatatacttcagggaaggcatatgctacttagtctttgggcaattcaaagtggatacttatttctttgtgtgcccttaatgtattattacaggaatcaacaatgcgatttcctttcactagaagatacaaaatggactgtgctggttcattcttttttatttgattttaatttctttttactaccatgaaaactgaaagcaaatgattgtaattgtactgattgttttgtaatttggatgggacgtttagattaggccttggcatttctacactcttccattgttcatctaaatgtgtattcattacaagctgtacacgattaatacactgtgttatgttgagaagttgcagaattataggatacttcctgtcaaaaacaagaaaacggattggtagagtggtccattttaatgtatggtcaaaccaagtatttgggaaaggttatccacctaaacgactcctgggcagtaaattggtttatcttgccacaactatccttgcaaaccttgtgacattgcagaatgacttttgcacactttttgttgtttctctatatactcccttttcataacctggcattatttttcttgcttgtggcacaggaggagcattttgtgtccattctcaatttttcgtggcctcaggttacatgtgtgacacaatgcccaataagtgggagcagagtggtgtttgtgagcttttgtgataagtccaaacaggcaagttttcttgaaccatcaaatatttactgcatttattataacctgtacaacctttataatcacatttttaatggccaaaatatttatgcactttatttctctacagatccagaagtttgctttacgtttcccacatctcagtgatgcagaatcatttttaaattgtgttaaggtgcaatttcctatatctgtcatccaacaatgtgtacctcttcatagttatgttgtatgaatattccatggacctctcttgcctattctcttaactcatcattcctaatagtgttttgctcaagtgtttaccaccagtccaccaccactcgctacccatttttaaactatatacttccatcttgtaacctgtaatcttcatcaatgttgattgtaattttctgttcaatgtgtgaacatgactactggatattatagtggttagataaaaccatttgtgatgcttctgagttttgacattccagttctcttcaagattctcttaaatttgttagctccctagaccctagtttactgatatgaaatcacagtggtgaaagttactattcatacaattgaaatttcagtactgctagctatagaattcatgatactacagtaatggtattttctgtttattctatttactaattttgagattttcttgacttatgctctgtttaatgttaatgaagcactaaatgcatttctatatggtttgtttacaaaggaatgctcaactgaaacca

SEQ ID NO: 34688 - DNA, 303 bp, Oryza sativa
aggagaaagaagacaaaaatggtgacaatgtataatgagttgaaggcagcatgtgcaagtgataatgagacatgtttcgccatgggacgtgggcatcctcgggagagagaccgggtccctggtccccggtgtacccccgtctggtagtaacgtcgctataggcgtgaaatatcaggcctcgggtaaagtgggataatggcacaaactctctccttccactttcgccaagtgggagaggagcagagaaggagacggaggtgaaagaatagagagatggagagatggaccgacagatggacaaag

SEQ ID NO: 34689 - DNA, 1501 bp, Oryza sativa
gtaggtggtactcgttggtgaagtgcattgtatccctcgttcccaacaggcgtagagttcagcttgcacatggaatatcaccgggcagtcctcaagagcatgcttggttgtcttatgcacaggacaccaagttctcggtcttagggtggtcgtccttgtcggctttgatctttcacatggagaatgaaattcagctgcttgaggatacctcccaggtgttggggccgtcgatgttccgttctccaccggagtgggaggaattatcggcggggcgtcgtttctctcagtcgttgccgtacccttctcgctcccgatgacgatcggaccagtcgagattgttgtaacgatatagaccggaaagacaatagatccgacttgagtccacaccagcggtgtcgaggtagaaactccttgattggcgctggtgatgagactgttgtcggggagtcctgaagtcatactagcatatccataagcgccaagtgcccctacctggcgcgccactgtcgacgagtggtactcgcggaccgaaagaatagggtattggcgtacgttggaacagggatctatgtagtacgacattaaaacagacaaaagactaggattatactggttcaggccccttatcaggtaataggcccagtccaatttatatgggattgatgatgatgaggacagattaccaagacagtaaccgaagcaagcgatactgataagatcgtagtcgagggattcgacgagatctcccggcgagttgactccgtggacttcggttccgtaaactttggtgggtgtgttggcgatgaaatgcgatgatctttgcctctccccaggggtcccttttataccgtggaataccttgaccctcaagtaagtcttggagatatgtaaacctacacgatatactagagatttcaccctttccgaggacttatgcaattccttaacttcgtggagttattttccataatctgaggtgaattcctaacggcgtatatgggaaccaaccttatatgcgaaggtataccttatcggtatattccataagtcgtaggatagagggtatgctttatccgtaaccctgacacacatctaccgtcgggtatgtaaacggtgaccgggagaaattgcgagacaggttatgcctcgcattcttccctataacccgtattactactcttcgtgtagaaattctgagtttccagcagataaataaagaatcgattgatgcagcctggtccaaattcactaatttagttcagtctggcccaaccctatctatagccgattacgtgctattgcaacattttcaaatgggtttagatagggagtctgcattctaccttgacataagtgctggagggtcattcatgcacaaaactcccgccgaaggcaaggaaattctcaatcgcatattagaaaatacctcctttgtcgggcagtatgttgaaccccatcaagaagcatgtgtcaagaagggaggaaccttcttttgccgagc

SEQ ID NO: 34690 - DNA, 931 bp, Oryza sativa
gcctgcagtcgactctagaggatccccatgcttcccagatagtatcaaggaaggaaacttaccagatcatggcatctagacaatgggatgccagagtcctcacccatcatgactgcttaaataagcaccagctttctgttggtgaactcctcttccctacctctccctaattcctgtttccccgcacatggtacatttcttccctgctttagaaacccctaatggtagtcagttagggaagtgaatttgagactgatctcccatatcctcaacagcagcacctgattaaagccttcttccctggcaatacttgttgtctcagtgattggctttctgtggagtgaacagcaggacttagaccaaacctctggcattttggtaataaaatgatgctgtgcaactttcaaggatagatcacaaaaaatgatgcaacttctacgtggatccctgaaactctggactgcatgtgagaagccccactctcctgaggctgccctgctgtggaggaagccaggtcacacagagggggcacatggaggcaatccagcctacagacctgctcaggtcctagctgacagccaacatcaccctctagccatgctgatgaacatgcctccagatgattcttccctctgagtcattccttgcctttgagtcttcccaaatgaggctctagaaaatgtggagcacagacaagattttctttctataccctatccaaaattccaatactaacaatctgtgaacttaataaaatggttgctttacatcaccacatttctgggtgttcaatgcaaaaatagtagctggcatattcagttttctcatatgtaaaataaggataattttacttacctgttgtccaataaagtctctataagtatgctaaattgcattacacagtaaagtttttttaaaaagtcaaatttag

SEQ ID NO: 34691 - DNA, 239 bp, Oryza sativa
ccgggtgttaggccttataagcaaccacctcgtcgttttaatcctttgctatatgaccgagtcaaagaggaaattgatcggttgttgaaggcggggtttattatgccatgtcgttatgcggagtgggtttctagcatagtcccggtggagaagaaggggagtggtaagattagagtttgcatagactttagagatttaaataaagctactcccaaagatgaatatcatatgcctatagc

SEQ ID NO: 34692 - DNA, 1320 bp, Oryza sativa
tacccgcacaaatgcagaacccagagatacagaggaccagctgtaggattatttcatacaagggacttgagcatctgcaaacttcagtaacctcagtggacacctggaaccaattcttcatacatactgagggacaactatacatgcaaaatcctttaaagtgtttcaaagatattcttcatgagcacaacaagccttaaatttgccttttttttgagacggagtcttgctctgttgcccaggctgcagtgcagttgtgcaatcttggctcactgcaagttccgccttccaggttcacaccattctcctgcctcagcctcccaagtagctgggactacaggcacctacaaccatgcctggctaattttttgtacttttagtagagacggggtttcacgatgttagccaggatggtctagatctcctgaccttgtgatccacctgcctcagcctcccaaagtgctgggattacaggtatgagccaccgcgcttggcctaaatttgactttttaaaaaaactttactgtgtaatgcaatttagcatacttatagagactttattggacaacaggtaagtaaaattatccttattttacatatgagaaaactgaatatgccagctactatttttgcattgaacacccagaaatgtggtgatgtaaagcaaccattttattaagttcacagattgttagtattggaattttggatagggtatagaaagaaaatcttgtctgtgctccacattttctagagcctcatttgggaagactcaaaggcaaggaatgactcagagggaagaatcatctggaggcatgttcatcagcatggctagagggtgatgttggctgtcagctaggacctgagcaggtctgtaggctggattgcctccatgtgccccctctgtgtgacctggcttcctccacagcagggcagcctcaggagagtggggcttctcacatgcagtccagagtttcagggatccacgtagaagttgcatcattttttgtgatctatccttgaaagttgcacagcatcattttattaccaaaatgccagaggtttggtctaagtcctgctgttcactccacagaaagccaatcactgagacaacaagtattgccagggaagaaggctttaatcaggtgctgctgttgaggatatgggagatcagtctcaaattcacttccctaactgactaccattaggggtttctaaagcagggaagaaatgtaccatgtgcggggaaacaggaattagggagaggtagggaagaggagttcaccaacagaaagctggtgcttatttaagcagtcatga

SEQ ID NO: 34693 - DNA, 1501 bp, Oryza sativa
attccctccctctttccccccacttttccctctctctctccatcggattcgttcgggatcttttcccctaaacctcgccggcgcatcaatggcggccggatcttccgcggccgtttccccctcatccgaccgccctctctcactcccaaccatatataaacactccccgtgcctccctccaccgtttccgccactcgtcgctctctctccccgtcggaatcgagctcgcgccgtcgctctctctctccgccgtcgccgccgagctccggtccgccgccgtcgtcgccccggaccctctcccgcctcggcgccgcctccttcgggttcgccgcaacctcgccgacctcgtccacctctccgtttcggtcgccgatcgccggaacgccgccgtccccgtctacccgagccgcgcgctccggtcaccgttcccgtcgtcgccgtcgacccggggtgagccgtggaccgccgattcgcttcccccttccctcccctctttcgggcgccgctccgccgcgccggtggtcgccggcggcgaccatcggggcgcgagtgcgccacctcccgtcggctgtgccggcgtggccgccttcgggcgcgtcccgcggctgccatgtggggcccggccgtcagccgcccgcgccctcgggtgcggctgacgcatgggacccacggcgccggccggtgtgagccgggtgcacccggtccaccgtggaccgtgaggctgccgcgtgggccccactcccgtggacccggtccgcgcgcccctcccctcggctgacgcaataaatctattttaaattaaaatttaaatgaagaaattcgcaaatattcatttaaagagcatataaacttcaaatggccataacttggccatttgaactcggaattggaccgttcaagtctctaatttttccttaagaagtcaagaacccatttttgtgctttgtttctgcttgttatatagagtttattagagtaaaagccttttcttttccgttggtcgtgtagacgctgcagcttcggaagatccgctcttcgtggaagttgaagccgacgtttgggaaagcgagcaaggcaagtcacatcatctttgaacatattgaatcccagtttataaaattatgttgatttaaattattgcattatcgctttatttaaattcccgcgttatcactgttttatttagccatgcctatttacctttgttatgaccttaatattgttattgttattatttccttgttcaccctagaataaacaaaaccccaactagtggacactctactcatggtaccactagtatgattttaggtagatgcttcgctgtttaattacgtaacattaggtgattttacaactctagactttgggatattcatataacctggacactatggaattgttggagtattgtggaattggattcacaccgtcccctctattcaaaatccccaaaatggttttaggctgggctcggggtgcatggttttgatagtagcac

SEQ ID NO: 34694 - DNA, 1501 bp, Oryza sativa
gcataatttagaggatgtattttagggtcgttttgggacgcgacagtatagcatggttcattgcagagcaccggactgagaagtggcggagataagcccacgggggtcgctggggagtccatgcctctggtttttgagggggtgattatgatccaggaatggtgcactgtggttgattgtgttgtgcgaggggtaatgtcacagctcctttccgaggtaccgtggtggtactgaggcacatggtgacatgatgtggggctgtgtcttgtgggtacagtggtacacctctggccagagtaaaactattcgaatagccgtgcccgcggttatgggtgggttgagcaatgtttttcgtgattagtctcacacctctcacaataattatggatgttatacctggtaataatttgcttagctcctggtttggagttagatctgtacagccgggtatggttgttcaggatggttgagcctgtgcagcatgggtgtgctattcagtgttgattaaaatttctgattaatcactccactgtttttacttctcttaaaagttttgctaaatgttgtttttgcaaatgaacctatattatgccatcctttggtatctttgtgcacttgcatatttgctgtgtggcttgctgagtatgtcatatgctcaccttgcaataatcaatcaacctcagttgaagaataaggatccagaaggagaagacgtttggcttataccccagttgagctgcctgtgggagtggagccggagcttcgctagattttattttccgctgcagttttcttcatggtgaggactaagtgcctcttaagtaagtacttatcgttttagttaatttgatgaatctgtatattaaattgtcagtttgtgtacctcggctgattcctggacgaggattttatgcacaaataagttcggaaattactagtgaatttccgggcgtgacaagttggtatcagagccatctcgactgtaggataagccaaatggtcaaaccttaaggactaattttccgaaaacatgatttgtgaaaatttctcctttcttccttatctagaattctttgcaaattgtttcattgtctactcccctttctctttcaacttgagtagttctgagacattgaaacttgaagacgccaatgaggtctacttaaacttatggaggccagtcaagtggatcgaggaagaaccgaagtgccaagtggtcaagatggaatgaagtttggatcctaccttagaacctatgccgccaaagtgtctttgaggaatagttagtagggtagaacgcttgttgtttgctttgtgtgtaggtatggttgcattcccatcattggagtagttcattgatgagtgtgtaactatactaggttgcttgcttaatcaacttgaacaatataatggtctacacacatcagatcagtattaacctggttaaggtcttgtctttagtgtaacccctctccttctatcttctctaatatgcaacaga

SEQ ID NO: 34695 - DNA, 1501 bp, Oryza sativa
  unsure (1)..(1501): unsure at all n locations
ccctcttcttctctttctctatctcttccaaagccttcaagtgcttgttgatgacttcatgaaagttgtctcccatcaacgtcttgtaatcttcacttgacaaatcatcttgcttgatataacgaagagaaccaagatttatctcaaccggtaaaacgacttcttgaccataaaccaactcaaaaggagtgactttagtggcaccatgtttagatatcctatgcgcccacaatgcttcggaaaccacttcatgccacctttttgggtgttcctcaatcttttttttcactagtttcaacaatgtcttgttacttgactcggcttgtccattagcctgagcgtagtaaggagaagaactcaacaatttaataccataagattcggcaaaattcttcacttccttaaacataaaagaagcaccttgatccgtagttaatgtttgcggaataccgaatctatggataatatgcttcaaaataaagtcaattacctccgtatgagtcgtattcatcagcggcacggcttcggcccacttggtgaagtaatccgtagaacctagcacgaacctatgcccctttgatgacgaaggataaatttgaccaatgaaatccaaagcccaacctcggaacggctatggtttgattatgggattcaacacggcggcgggcgccaattgaacattgccgaaccgttgacaagcttcgcatcccctataatatttgaagcaatcctcaatcatcctcggccaatagaaccccgctctcctaagcaaccaattcatcttgtgggccgattgatgagttccacaaattccttcatgtacctctcccatagctactttagattgatcttcatctagacacttcaacaagactctatctatattttggtgatataaatcttcatcaagcaatgtgtatttgaacgcttgccgctgaattttccgatcaaccttaagtgtgggatctttcagatatctaatcaaaggaattctccaatcctcctctgtttcctaggcacaaatgtccgaattcacaattaattcggcctctaaattgattgaagcgtgccccccaacgctctgcccagaaccggtcagactggccatacaaggccggtcagaccgctcggggtcgccggtcagaccggcgggatgtggccggtcagaccgcccctagtcaccagtgaactgcagagatatagcctagagggggggtgcataggnnctttcctgaaattttctcaacaatcgcagcggttaaattacagggcccggaacctcctggtgaagaacaccggaacttcctagcaatgatgagcagcccggaacttccggagttcttgcgtcaggaacttccaggcaacagagaaaaatgaaatcagggaagtaaaacaggtcctagctagagatgatcaggcacagagttgcacaagatgtaaatcacaagataccagcagattcaaacacagatcatgcacaagagagacaaaggcgattttt

SEQ ID NO: 34696 - DNA, 560 bp, Oryza sativa
ggagtttattagagtagaagccttttcttttccgttggtcgtgtagacgctgcagcttcggaagatccgctcttcgtggaagttgaagccgacgtttgggaaagcgagcaaggcaagtcacatcatctttgaacatattgaatcccagtttataaaattatgttgatttaaattattgcattatcgctttatttaaattcccgcgttatcactgttttatttagccatgcctatttacctttgttatgaccttaatattgttattgttattatttccttgttcaccctagaataaacaaaaccccaactagtggacactctactcatggtaccactagtatgattttaggtagatgcttcgctgtttaattacgtaacattaggtgattttacaactctagactttgggatattcatatcacctggacactatggaatggtttggttattgtggaattggcttcacaccgctccttctattcaaaatccccaaaatggttttaggctgggctcggggtgcatggttttgatagtagcacctcggccatataaggaccggt

SEQ ID NO: 34697 - DNA, 1501 bp, Oryza sativa
ttactcggcagaagggcacagaaagagcatttactgggtacgattgctttacactctaatccaagtataatgtgtagttgcacaccatgtcattttggtcttgtgttttttgttatgtaatcagggaatactggaacaccaaaaccccgggcatctaccattgtgtctgctgtgacacccctctttttgagtaagcactcctcctgattgtcatgtcagagcagaagattgttctttcatataagctagagatagtagtttcgatttgcaccaaaacaatagtattatagtctgctcattattctgcattactgctttctggtggtcttaggtcatcgaccaaatttgatagtggtactgggtggccgtcatattatcaacccattggagataatgtaaagtgcaagcttgatatgtccatcatattcatgcctcggactgaggtgctgtgtgctgtctgtgacgctcatctggggcacgtgtttgatgatgggccacgaccaacagggaaaagatactgtatcaataggtatatgtgagattttcttcacttgttatcaattgttcataggcctcatttgaaatctgaacagaaacattgtctcccatatctacgaaattattttttttgaggggtatctacgaaattaactgtttgcttaattttcccactaacatttttcccattgttcaactccggtaagtcccagattagtttctaagtaaacttccgtgcatatatacatagtagtaccatagctaatatctgtctcatatgtgttgcattgcaccgaaggacctttctatacatgttcttttggttgatacatgactgcagagttgcagcttgccaacagtggatccaaaggcccacacgtgtataggtgccaattacaactgaatgcactctgaccaaatcttcaaaaaggaaaaaaaaaactgtccttacgtataccactgcttgaaagagaatcacattttcttttacaacagatgaaatattttactagggcatggttgccatgaattagtttataaaatttagtagcatccagtgaaatagaaccgccttttaatttatatttcctagataatggtaatttcactaggcaaaagaaagcattcagcttctgcacaaagtgcatataaccaacaacaccacgacacacacaaaagaaggaaccgtctttagtcgatgagattgtttgctcactgttttatccttcttacttgcagcgcatctctcaagctgaagaagacccagtagacctgtgaagattatggttaccatgtacctacacggctacactatccgactagttataagggatagattatgtatatagaatatgtaaagaattaagacttgggtattatgtttacttgtgtatcaaggaaatgacgtgtagtcctagttcggtaagattgtaaagtagttgtaggagatttaaaccatattaacttaaatctctatcttataaacctgtctcctccgtctata

SEQ ID NO: 34698 - DNA, 1501 bp, Oryza sativa
tgtgaagtaaagtgagctcctctttttatagggtcggtatgacggttactggcatgcgaaatgtcgattttaccctcgtaaccgtcatcagcatgtgatcctagacgcccacgtgtaaggccagctggagccgcaattgctagggtttggccgaacctgagctagcccaataggcccccaagtttggcagggtggttgacatgtgggtcccaatgacggttgtggcagattaggcggttttcggcggttacacctgtcatgtgggccctccttatccatttgcttgcttaggagtgaggttctctccactttctctttattttatttgataaattccttcaacatgttattctccttgtacaagtggaactatattatttgaaaacaaatatgtattgcaagtataagctaattctctattattttagttatattgacagtcgaaatttgtttacgacgaccgtcaacaatggcggccaccgaggaggctcctcaagcggccggggatcctctttcttcccctcctctccgtcgtcgttgccgtcagtggagtagatgagaaaaataattccccatcttccagcatttctcctccaccgggcggctgcttcctctctcaccctgcgtgggcgcaggtcgagttagcgacagccaactcactagctcaccggtggatagggggttgttggtggagaggaggggagaggcggccctaggatctcatcatcgtcagcaacaggaaggaggagaaaaaagaaaagggattttttagtgggccccacctattggttggtctctacacttgtatgtgaccaccgatggtccaccgtggcatgccacgtgggcaagaccacggtcaatgaagttttggaccggaatgatacaataaaccaagttaaaggatcttgatatgcgatttgtaagttcgtagacctaggtgaaatctgcttatgagtttaaggaccgctggtgcaattcactctatgaacaaagtacacacacatttgcagaaatgcttgatcgtatgttttgagctaaaactgttaatccatacaaattttgacataaatgcttgatcgtagagttctatttgcatctagctcacgcaggaatttggtgacagaaattttgatacgccacacaatccatagcccgggtggccggatgatggatcgtggcggcgtgggcgtgcgagttgcgacccctgtttggcaattgaaacggactggtccagtgaagtgcagactggaacgctcgtgcctgctgcagcttctgcgtgtgccgatccagttcacccacgtctcggcatcgccagccacggaatccctctgtctcgcagaggcaaatccgcccggctggtcggtccgtccgccaaacgacgcgactcctctcgagccgaagaaaatggccatgcggcaatacgcggctgctaccgctgcctcctccagtttcagagcacgtccacgggcgcgcccctcctgcctcccagccgccgcctgcc

SEQ ID NO: 34699 - DNA, 245 bp, Oryza sativa
  unsure (1)..(245): unsure at all n locations
tgtgtggtgtaccccggcttttcctgggacggggattaatacactagcgttcgggaaaaggcaattttcccggtcgcgacaagctggtatcagagccatctcgactgtaggataagccaagtggataaaacctaaggacatattttatgaataaaactatnntgcgaaagttcctttttctccttcccctaatgctatttgcanaaggtttactccgttcttccttcttcggaatttcaactagt

SEQ ID NO: 34700 - DNA, 206 bp, Oryza sativa
aaacccctaaaacctgttttcggtggggtttgggtgcatgccagttatgggaagtagcaccccggccactataaggattaagctcgggcctctgttgcaaagcactaccgactaaccacatgtctaatgggtaaggcttaactcggtgctcagtctagtcctgaacaaaaggacacggatagagatggatgaagtcgttgcgacga

SEQ ID NO: 34701 - DNA, 1501 bp, Oryza sativa
cggcgttcagggaggagatgaaggccaccttccatatgagtgatcaggggcctctctctttctacctggggattgaggtgcaccaggacgactccgggatcacgcttcgacagaccgcctacgccaagcgcgtcgttgagctggctaggctcaccgattgcaacccagctctcactccaatggaggagagactgaagctgagccgtgatagcacgacggaggaagtggatgctacacagtaccggcgtcttgtgggaagccttcgctacctcacccacacggctggacttggccttctccgtcggctacgtcagtcggttcatgcaacgaccgacaatggagcactagcaggctgtgaagaggatcatccgctacgttgcggggactctcgaccacggtctctactacccgaggtgtcctggcaaggcacacttcgtcgagtacagcaacagcaaccacgccggtgacatcgacaccagcaagagcacgagcgggattctcttcttcctcggcgagtgcctcgttagctggcagtcagtcaagcagcaggtggtggccctgtccagctgcgaggccgagtacatggcggcctccgccgcttcgacccaggcgctctggcttgctcgactgcttagtgatctcctcggcagagatactggagcggtggagctcagggtggatagcaagtccgctctggccctggcaaagaaccccgtttttcacgaatggagcaagcacatctgggtgaggtaccacttcatccgaagctacttggaggaagggagcatcaaggcgagctacatcaacaccaaggaccagcttgcggacctgctcaccaagcctcttgggaggattaagttcctcgagctctgcttcaggatcgggatggctcaacttccccacaagacgacgcacaagacttagagggagaatgatggataagtctttgtggtccttggtgatggaataagccttgtggtttttggtccttgtggtccctctcttgcttttaggttgtttttcccttttaggacagtatcctttcagttttgcttttagcatctttcggttttgcttttagcatctctaggacagcatctaggaccatcacctttctgctttattcagtttggatgctctctaggacagcatcacgttcaaattttagactagtgtgggcagcaattagcttgcagccatccagccagctatggctatatatatgtattcaacctctctcgggaaggtatggcttttgtgttttgtgaatgaagaaaccagaaaattgccccatctcgagtgccatcctcttctcaatgagagtaaccattgaaattctaacatctggtatcagagccacactttcctgtaggctaaatatctcctgctccactgcttcccaagctcggttgagctcttagccagcagcagcagcaccggctgctcctccttccccttctccttccccttctccacgcagcagcctcccggaggcgcgcca

SEQ ID NO: 34702 - DNA, 339 bp, Oryza sativa
tatcctcttctcaatgagagtaaccattgaagttctaacaaaatttatggagtggcgccaaaaaaaatctctaaagaggataaccatttccataaacaagaatatgcattaagtagagtttcaactttcaattgttaactttgggtaagattccaaatgatgtagatactacgtgtagagcatgaggggcacaaacacaatcctatagtccaaattgcttcctaatctgttgaattaaatttaaggtctgcagaacagattttatttcctggttatcaccagtaactgactagttctcatctgaattttcatccccggcctcaacattttttttgcaga

SEQ ID NO: 34703 - DNA, 257 bp, Oryza sativa
catatgtatactggtcacttaattttagtttattttgaaagaagggagcaagtgataagaatggaagtactaccttagcaaatgccatcgcatcataatatcatatagccgcatttgttgaaacaattctccaccgacctgaaaaagaaatccgtgtcagtactctctagcgctcgctgcttgtacctcgcaagtcgcaagccccaggacctcgccgaggacggcagcgatggccacgcaagaacgggaacccgaac

SEQ ID NO: 34704 - DNA, 230 bp, Oryza sativa
accactagtatgattttaggtagatgcttcgctggttaattaggcaacattaggtggttttacaactctagactttgggaatactcttatcacctcgacactatggaattgttggattattgtggaattggattcacacctcccctctattcaaaaccctcaaaatggttttaggctgggctcggggtgcatggttttgatagtagcacctcggccatataaggaccggt

SEQ ID NO: 34705 - DNA, 1501 bp, Oryza sativa
tagggcaaaaggcccaaatatatacaggtacaggaatacacaaatatacagaaaaaccctttacaaataaaggaatataaaatctaaatatacatctaacagaaagaagctcaaatataattggtaaccagaattttggtattaattggagccggttgggaacaattaccataggcaaaatgattgcccagctttacatttaggtgcaaatcagacagcgaattatttttatgaaaatgacttacagaattggtagctactttggctaagcttggcaccattagtagccctactaggctattatgccccaaaaagaacatcttaagtcatttggagcaagtaaactagtctaaaaggatatgcctactttgcactttattttatggtatctggccagaagcattgctacttaattagacttcactctaggccagatatgattacctcaaaatgcagaaccaaggcagactaggcaaggttaaccacttaattaggcttctcgaaatgcagaactaacataatcaaacttctatatcttgtaaagtaggggctatatgaagttcacccaaactgtaacgctatccagttttcttgtctccagtgccgtcaatggggacacaacagcaatgaaatattaaaatgtggacactgaccagttctcgaatgtaatttatgtaagtatggagatcaagatcttggattgttaaaaaggacatagacctctgttagaatttcaatggttactctcattgagaagaggatggcactcgagatgggacaattttctggttttcttcattcacaaaacacaaaagccatacctacccgagggaggttggatacatatatatagccatagctggctgctagcctattgctgcaccctcctagtctaaaattcgaaatttaaatgggatgctgtcctagagggcatccaaactgaataaagcataaaggaggcataaaggagatgctaactgctgctgtcctactaaccacagctgtcctagcaactgaaaaatatgctaaagggtagatgctgtcttgaaaaaggtgaaactacccaaaagcaaaaagaagaatcacgaccaaggaccacaaagacttatccaacattctccccctaagtcttgtgcgtcgtcttgtggggaagttgggccatcccgatcctagagcagagctcgaggaacttgatcctcccaagaggcttggtgagcaagtccgcaagctggtccttggtgttgatgtagctcgccttgatgctcccttcctccaagtagcttcggatgaagtggtacctcacccggatgtgcttgctccgttcgtgaaaaacggggttctttgccagggccagagcggacttgctatccaccctgagctccaccgttccagtgtctctgccgaggagatcactaagcagtcgagcaagccagagcgcctgggtcgaagtggcggaggccgccatgtactcggcctcgcagctggacagggccaccacctg

SEQ ID NO: 34706 - DNA, 1501 bp, Oryza sativa
cccgccggtagatggccgcctcgtgcaggctttgctcgtagcccatccccttgagcgtggaatccaacttggcattccacgccctcggtgcctgccgcaagccgtagagggccttgtgcaagcgtagcaccttgccctccttgccgggaatcacaaatcccggcggctggtgcacgtagacctcctccttcaagtcgacattcagaaacaccgacttgacgtccatgtgatggacgccccagccttcatgagcaaccagcgcaagaaggagtcgcacggactccatccatgccacgggagcgcaggcatcgtcgtagtcgatcccctcctgctgcacgaaaccgcgtgccaccaagcgagccttgtgcttgacgatggctccggcttcatccctcttcagcttgaacacccacttaagggtgatcgcgcggtgaccacgagggaggtcagcaagctcccaggtgcggttctcctgaaccgcgtccatctccgactgcatcgcggcacgccatgccgcgtgtttctcggcctctgcaaaagaccgaggctcaccgtcgtcgcacgcaaggtgcaactgcgcctctaggtcgcgaggcaccagtcccggcaccggctggtcgccgagaagatcctccatcgtacggtaccgtagctgctcgccgtcgtggtacgcgtcgatgcgctccccgtcgtgggagagcggagtagcgaactccaccgggctgcgctcaacacgagctggcgtcggagtagacgtgcttggagtggctgttggtgctggagcatgtggagtcactggctgaggtggtgtcgacgaagagctcgtcgtagtcgaagtcgtggcccgagggtgtgttggtgtcggagtcggtggagattcgggggctggggtagacacgctcggtgaagaagagctgcctactcccccagctccctcgaagtggacgtactcgacggtgaagtccaaccatcgtccaccgccttgtcccatacccaccctcgcccttcgtcgaacacaacgtcgcgcgcagtgcgcacacgctgtctccgggtcgaggatgcggtaagccttcgagccctccgcgtagccgatgaacacccctggggtgctcctgtcgtcgagcttgccgatgtggccaagctccttggcgaacgcgaggcagccgaagacccgcaggtgggagaccgccggcttgcgcccatgccaagcctcgtacggtgtcctgccatcgagggccttggtaggcgagcggttgaggatgtaggcggccgtcaccaccgcctccccccagaagatggccggcatccccctctgcttgaggagggcccgagccatccccacaaccatctggttgcgccgctcgacgacgccgttctgctgcgggctgtacggcgtggtatagtggcgctgaatgccctcatcagcgcagtacgacgcgaattcagccgctgtgaattcgccgccgttgtcggtgcacagcacgcgcagcttgcggccgca

SEQ ID NO: 34707 - DNA, 1501 bp, Oryza sativa
gtttgtaagaggaaaggccatttgactttatcataggctttttcgaaatctactttaaaaatttccccatttagttttttacgatgtaattcgtgtacagtttcatgaaggatgacaactccctctaggatattccgtcctctcgtaaaggttgtttgagaagagctcaccacatggtctgccacgaattaattctatttgttgcgaccttggtgaaaattttgaaactgacattcaaaagacatattggcctgtactgttgtatacggtttgcctcatgaacttttggaagaagtgtaattatcccaaaattgagactaaacaatggtaaatcacccacatggaaatcccgaaatagattcatcaaatcatctttgatggcctcccaaaaattctggtagaactccgccgggaaaccatctggaccaggggctttgttgtgttccatttcaaacacagctccctggatctcatcctccgagaaaggtgccgttaggaattcattttcctcattcgttacctgcagaatatcctcaattctatattcatctagtgtgatggaagtatcctcaggtggcccaaaaagattttaatagaatttagtaatataggacttcaatgctatattaccttctaatttcccttcgtcctgatcgaggcaaaaaatacgttttttccttttcttaccattggcaaccatatggtaatacttggtgttgttgtcccctcgtaggaggtcagtaacttttgccctttggtaccatttgatttctttttctcgaagaagtctagataactgatctctagattaagcaagatgctctctctcactatcagttaattcccgtacctcggctgtgatgtctaactcatcaatgatattttgtacggtatttttttcttgtttgtaagaaccactggtgtgagccgcccaaccttgaagatgtcttctcaaagcactcatcttattgttccatctttgaacagggttgtggcccttaactggcttatttcagatttccacaacacggtcacgaaaatcatcccgaaggaaccagccaagttcaagtttgaactgtgcacggttccccgaaaaagctgctgatccagtgtctagtagcaatggtgtgtggtctgatagacctctgtctaagcttggacagaaaccaaaggatatttggattcccattccgtagtcatttcttaagagaaatggcaatattttctattagtttttttcctctttctttttaatacaaaacgaatggcgaggaaggggatgaaaaataataaatttacctagatggataatctgttatctaacaggtccaattactttcttatttttgtaacttgtttcctatgtattcagcacaataggatgccattcaggacaaaaccttgatgtacgtacttagccagggacattatttgtatggggaaaaagtacgaattaccctcccgaactatcgcggtcgtccgaattatacccttaaaccaa

SEQ ID NO: 34708 - DNA, 1501 bp, Oryza sativa
tacccctaacttaacccctgcctagactttgacaattacaagtaatatatgtataaagtgcattagcaaagttcactcttattatcttcccttgggattaaaaatatgttaccttggaatacttctgggcgaaatgctacaatggtatatccgtgcacttgcagattacttctgtaatcataaatataccaggactatttctggtgtcattgctgggaatgaatatttctagtaatgtcgttaagaaataccaacagtgtggctgtaccgggatagtgtaggtggcgaccggaaggccgctgctacgccgcaagtgatcgccggtgaccccttcaggatcaagctggcgttcttactgctacgactacttcccctacgccaatgatcgctggagcagttcgagggacttcactagggatggcaatcgagcgcgacaggcacaggtagtgcctacccatacccgtgcccgtgagattatttgtacccatgagtatgcccattactacattacgggtaaggattgttgcccatgcccatcgcccgtgggcgtgcccgtttacccgccacaacaaaagcagtggaacaaaaagtctacaagcttctaagttcgaatcgaacttaaaacatcaaatattctctgccttggtgtagtgtctctcctctggtggcgatagaggaacggggagagaaataaaagggaaaccgtagaaaacaaagaacgtggcttatgtatcctagtggattttgctcctagcctacatgtaagttagatttcgcgggtaaacgagcaaagcgggcatgggtagtgattacccatacccatgcccatttacccatcgggcatagcttttgacccaataagaaacccatgggtataaaatggagaacaaacccaaccctaatagggtttttatccacgggtaaacgggcaaatgggcacaattgccatccctagactgtgccctctatttccactccggctgacggcattgcagggggtacaaggaaaagcgcatcaatggcttcaaacaacggttagtaaccctaagaattccgtataagggtgatcatatttagacttagcactcatgttagtagattgcaaaatttacatttaggagtacacatttctggttgtatagttaagggacctaaaaaaatctcgctaataagtgaggacctccggtgaacttatttccacgcaatatactaggaagcgggccaggctgttccggcaggcccagccgcccaggcgtgccgatgcctccggggtccgggccaccgtaagcgggtacgtgtccactgtccagattcatccacacctgacccaggcacgcagacaagtctaggttcgccgtcgtcctcttcttcccgacgcttcatatagttgcctcgtcggcgtgcacgatcccccgccgatcaagctagccggccagccagcgaagcagctccggtgctacttcttgcctatacctcgcaacttctctcatggcggcggcgg

SEQ ID NO: 34709 - DNA, 1255 bp, Oryza sativa
agccaaaaggtgcatcctggtccaagtcaggtgaagagaagattccatctgcaacaggagatcgagccaagcagttccgagtggtaaagttttgctggaagttcgtcaagaagacgcaacggaagaagtcagacaagaagagaagaccgcccaacctatcttcttgctagcctcctcgaatctcggggacgagattcttgtaaggggggtggatttgcttgtcgcgaccgggaaaattgccttttcccgaacgctagtgtattaatccccgtcccaggaaaagccggggtacaccacacaaacatgatataaaagacacatctttattatatcgataatatttacattattacaaaggcgcttcaggcctgacaatcaaaaataaacagcagcggactagcgggcctacggctccatcttcacaggcgctcaactggggtataagccaggactccacctaagacatcttctccaaagcttctcttactgaagaggggagggattgagcaagaatgagtacaaccacagtactcagcaagccacaccggcggatgcataattaatgcaagggaggtacaagggaataataatagggattaagttttgcagtaaacagcatttaaaagtcacttagttgcccaaagccatttataaagacgatcctagagctacacagtattattaaacaaggccgtgaaccctcacgaacctgccttaacccaaggcctacgatgattcggaccgaactggcaacccgacctgggttccagctcgtcccaagccaacccaggccaaccattccatattttagttgttgagcaaattttaagaattaaaacactgacttgggtacattgctcggcttgcccatatccgagggctcggctattcgaatagatttactctgatcagaggtgtacatctttacccacaagacacatctttactccgcattccatggccttggaacccgtcgtaaagatgtgacataacccttcacccatcctagccgtgaacaaaagtaccgacccaaccctgcctacggccggtatcccgggacaggcaggccagggttgagcccctagcaacaagatctagaccgggtgcgccacacacataggggtgagaccacccgcgtactagtccagtgccatggcatctcgactaacgggcaccgacccgtgtagtttcatttgcctagacatctcgattaccgagccgcagctcgcgtagccttcatttgcctcagagatat

SEQ ID NO: 34710 - DNA, 1501 bp, Oryza sativa
cacttggtggggatgaactttatagatatataggatcagtgcacatacgaccacaagctcctttctaaaaaggtcaccgcgcaacaagaaaatggacatttggccacattcaaaaagtggtttcgctagaatgccattccgaaaacgtgtttcgctaaaatgacaatatgaagcgcgcaatcacagccactttgccattttctccattttcatcattttcaattccattttcactggaattcggcttggagggagcgggggaggcggaggtggtgggagattggggcggcggtgacgacttcgtcggtggtagtgctggtgaggaaggccgccgcggagagccaccacggtcttgggcagccgcatccgccgccggacggcgccgtcctctgccgaccacttctccgacaacgggcacaggcgacggcgcgacctctggtgcccgctgccaccaccttccccgatgatgacgagcttcggctaagttgataaggggcaattttgtctcatcacctagtagaggagagaaaatctttttgaaaatgaataaaatgataaaaatggcaaagtggcggtagacgcacgctccatattggcattttatcgaatcgcgtttttgagatgatattatagtgaaaccacgttttaaacatggccaaatgtccattttctgccgcgcaaccctccccagtccccgcacacgccttctcgtgagaatgaaccgtgtgttgtgtgtgcttttcctactgggccgatatgaagcccataaacaccacgagaggaaaaaaacatatggggagctagggttccacctcgatccaaaatccaatggacaaaataatattcataaaaaaagaagtacaaacaagagtcaaaagcaaataaataagctccatcctgagacctaaaaatgcctcctagtttcaagcttatgtacattccatcacaaatttcatctccttttctgatactaaaaaaaatggtgggaaaaaggcaagttatatagggagaaagttatttctaaattatgtaaaagttactccctagaaatatataagttacttttcaaactagtttaactgacttccaaaagccctgaaaagactgcatcttctaacatgaaaaaaaaaggttatgttactcgttttgcatctcttcatgtttatttgtttatactggcaaatactccctctgtctcataacgtaagactttatagtattccatatctatatagatgttaatgaatctagacacatatgtatgtccaaattcattaacatctatatgaatgtgggcaatactggaaagttttacgttatgaaacggaggaaatacatatctacggtagggataatagttacttcctagaatcatataagttacttttgaataacacatatttagcatcataatatcttgcttattacctatatagagtattagaaaagaaaatctgagataagtttactcaatgaaaaccatccatatctgtcgacgagt

SEQ ID NO: 34711 - DNA, 330 bp, Oryza sativa
ttctcccggttcggcatcgcctccttcgggttcgcgcgacctcgccgacctcgtccacccctccgtttcgcccgccgaccaccggaacgccgccgtccccgtcaacccgagccgcgccgccgccttcctccgctccggtcgccattcccgtcgtcgccgtcgacccggggtgagccgtggaccgctgtttcgcttcccccttcccacccctctctcggccgccgctccgccgtgcctatggccgccgccggcgaccataggggcgcgggcgcgccgcctcccgtcggctgtgccggcgtggccgccttcgggcgcgtcccgcggctgcca

SEQ ID NO: 34712 - DNA, 1501 bp, Oryza sativa
tctggcgacttgcgaggcggccggatcgtcgcgcaagtctgctcacgaggtggcggtcatgctcggccgtgcgggcgccggagcgtgggcggcggattgccagtgcccgcgtggcagcgcggcatcagtcggctccgggttggcgagtttggcgtccggccaccccccctgtcgctggcaactgcggaagccgtccctgcaaccacccgtttcttcttccttgctttcttcctcctttctcttttcctctctgttcctccggccatcgccggcagctgctgaggcccctcatttccttcctccccccaccccacatcccttcctcccttcctctcaccatcgcttcttcttagttgctcttctgctcgccctggtgtacctttctctgcgctggcggtgaagttggtggtggttgctgcagtcgtaaggattgtcccgcgatagccggagttccttgccggaatcatggaagacacagtggtctttgttgcccctgacttcagctctcagttccttttcatgccggccacgactccttcactccttggtgctcctctcttcttttggccgtctccagacccggtcgtggagcctttcggttattgaggagaagtgtttgtccgtgtttggggtccagtgtgtctgtagtcaaggcttttgggtctcgccgatgctttaagtgtcctgtgtctgtatgaacctgtcgtagtgccgagttttgagtggggtgcttgccctctacaatgctagagtttctgtgttaagacggagtcggagttgctgcatcgggtctagccgatgagctgggcaacgataacacttaacactttgactctggtttcttataggctctacacctttgagggaatcttaagcgaaagccttgtctggtcttccaggatcggcgacatcgatgcctgcgggcgccgtttccttcttggaggtgttgccttgtggactctctctccctttgggtgaaaacccagcctagttctttgggcgggagtcgacagtggcttatgtcgttgttcacctccttggaggcttcgccttgaaggtattgctctcccctcggtcactactgtggtttgtagttttatcgcatgcttttcgtgtcttttgtgtaaggttttttgccggtttccttttagtaagctgtacagttgtatggtttttgacctgattttcctaataaacaggatcaactctcttcttctaatatatccggtagatctcctaccgtctactgtttaaaaaaaacaaattatatcgctggtctttggatctgaactagtagacgacccaggaccatctaaaggtacagtaaaaaaaaagaaaaactttttttcattatactgtactccgtttatcatctgcgtgtagatcgataaataaacaagtactctgcagtaaaatataactatgaactcagagagagagagagagagcgcacatacgagcatacatgcatgcggcccgtcagtgcatgaattattcatca

SEQ ID NO: 34713 - DNA, 1501 bp, Oryza sativa
cggagcacagcagcgccgccgccactgcggccaggaacggccacgcagctgttgagagcctcgccattgatcgatcaccaccggagtccgaccggcgcgtaccgtacccatgcatgctcgatatcaacttaaattaaatgcgcgcggtagctagctgcctagctatgcggggcaagtcgttggcgagacgaaatgtagcctcacattctttagccgcttcacttgcactgcatgcgggggtccgccaacattaggcaatgcaatgccagcccgcccactttccaaggagaaactagatttttgattgatgtctaacgttatcataactaagcttagataagttatgacatgataggtgatagcataactgtggctcggaaataattggccacatgtgtaatatggttagctacaaatttaagaatgtgacatatggatcctaataagagtataaaagtgtggcatgtgatgatataggtgcgacaacaaaataaacacatgtggcataactaaagtgtgacatggcaaagtgagataaccaacataaacacctctttaatgtctcacatgcctttccttataggttccgaaggtagccgtgggtggtagtattagataaacaaaggtacaggatatgaatgcaactctccatggatgatagtattcaatgcaatgataggattattaatgtactcgcatgtataatcacattgcaaaagctatagtagcttttaggcttaaatatgtgcaataagtatgataaaggtatgctttaatttgcctgcctgcctggctgttgctgccacagctcataaacgtctccaagttctccttggaaccccgttggcacatttgagctagggctgctcaaactgagcccggcccaactcaatggtgtactgggtcagggtcaggactacattttgaagcacgaaagcccaaaaagccaccaaacgagaatgctcaggtcagctcaggcttgtatttttgtctcagagctattttttgcctagccccgttaatttgatcaggcctaatttgagcctacccaaaaccaagctagcaagatatacgattgaagactacgagcaatagctcaattattagttagactgctcacccaaatttaaatattatggttcgcatggatgctcaaattttcttaggtttaaccacatgaggcaatacatgtagatgtgggtgtgttcaatgataagcatgtacggatgtaccccacacatccttatatgtgagcctatgcctctaatctctttagatgtgtgctagctaggacacatctacatgcgtgtgtatatacatgagtgtggtatgtgtgcgcatgtatatgcattcgacttgtgtattcataaaatcgaaagcagtgaagagtcgatctatgtagtgtaaagcaatgaagcaaatacgtacacgcctagaggatgaaattgactagtttttttttctactttcatggtgattccgaaattggctccgtaattta

SEQ ID NO: 34714 - DNA, 1244 bp, Oryza sativa
ttctcccggttcggcatcgcctccttcgggttcgcgcgacctcgccgacctcgtccacccctccgtttcgcccgccgaccaccggaacgccgccgtccccgtcaacccgagccgcgccgccgccttcctccgctccggtcgccattcccgtcgtcgccgtcgacccggggtgagccgtggaccgctgtttcgcttcccccttcccacccctctctcggccgccgctccgccgtgcctatggccgccgccggcgaccataggggcgcgggcgcgccgcctcccgtcggctgtgccggcgtggccgccttcgggcgcgtcccgcggctgccatgtggggcccggccgtcagccgcccgcgccctcgggtgcggctgacgcgtgggacccacgggcccggccggcgtaagccgcgtgcacccagtccaccgtggaccgtggggctgccgcgtgggccccactcccgtggacccggtccgcgcgcccctcccctcggctgacgcaatagatccgattttaaattaaaatttaaatgaagaaattcgcaaatatccattaaagagcatataaacttcaaatggccataacttggccatttgaactcggaattggaccgttcaagtctctaatttttccttaagaagtcaagaacccatttttgtgctttgtttctgcttgttgtatggggtttattagagtaaaagccttttcttttccgttggtcgtgtagacgctgcagcttcggaagatccgctcttcgtggaagttgaagccgacgtttgggaaagcgagcaaggcaagtcacatcatctttgaacatattgaatcccagtttacaaaattatgttgatttaaattattgcattatcgctttatttaaattcccgcgttatcactgttttatttagccatgcctatttacctttgttatgaccttattattattgttattgttattattaccttattcaccctagaataaacaaaaccccaactagtggacactctactcatagtaccactagtataattttaggtagatgcttcgcaatttaattaggtaacattaggcggtttacaactctagactttgggaatattcatatcacctggacactttggaatggtttggttgttgtggaattggcttcacaccgccccctctattcaaaatccccaaaatggttttaggctgggctcggggtgcatggttttgatagtagcacctcggccatataaggaccggt

SEQ ID NO: 34715 - DNA, 1501 bp, Oryza sativa
gtcacgcatgattctatctcaatcgggccataagtaaagcccgtcaccgatagttttgacccagacgaccagtcaaactatagcccgtcacagatgacctatcttaatcgggccacaactagcgcccgtcacagatgacccttatacagatgacccttatctgtgacgggcattaatcatctgtgacgggcattacattaacttatgctagagtaatgcccatcacagatgagtatattccaaaaataaataaatttcattttttggctagccctcactcgtgtgcacccacgcaggaagttcaaatttgagtaatgcccatcacagatgagtatattccaaaattaaataaatttcattttttggctagccctcactcgtgtgcacccacgctttcaaatttcccggtcggtcacccatcccaaaattgctccagaccaagcatacttaacgtcaaaattctttagagattggcttctggaaaagtaattgtaacatgttggtatgagtattctattaatcctattatgccctaggccaggatgtcaaattggggttactaaatgatttcaaatggaaaagtcaccaaaaccaaagttgtagaactcatcgaggtgcaaaatttttattttggtcatttctccatctgactctatttaaacaattttaaatttgaaattcaaagtttaaaaagttcaaatagaattttagatcagtgaacgacttcaactgaaaaagtcatcaacaacaaagttgtataactcatcaaaatctataacttttattttggtcatttttctatataacattttttgaaccgtttgaatttgaatttgaaaatataacaacttcaaacaatattttcaaatactaaatgatatcaactgaaaaagttatcaacaacaaagttgaataactcatcaagatctaaaacttttattttggtcatttcttcatacgacaaagtgatagtaacattgtttataaaattgacatatctcttatctggttttataaactataacacatatatgtaaaatttgtgaataatattaataacatttcgtcagatgaagaaataacaaaaataaaagttttagatcttgatgagttattcaactttgttgttgatgactttttccattgaaatcatttagtatttgaaaatgttgtttgaagttgtcatatttttaaattcaaattcaaactgttcaaaaaaatgttatattgaaaaatgaccaaactaaaagttgtaaatattgataagttatacaactttgttgttgacattttttccatttgaaatcatttactacccgtaaaattattttgctatagtcaacttacaaatataaacatttcatatgaaaaatggaaaaatagtcatcggtgacgggctttagttaatgcccgatagagattaagtatatagcccgtcactgatgagtcatctgtgacgggcctagttgttatctcaaacgggcctcaagttggtgcacgt

SEQ ID NO: 34716 - DNA, 1501 bp, Oryza sativa
agttgacgcccgaactagattgcactaccacatccaccgcttgatcatctgccgggggtgccgccaccagatcttgcccagctttcaccagagccctggaatcctctacctctttgttccccagatccaatacggcgtcatccttcagcttcgggcaggtaaccatcgcattgatggtccctttgtcgcccccactgagagattttgccatgagatggatattgagagaacactgcccaaaacctagatcaaaacctgacaggagaatctccagagtttgcaaaggatgtatcgttgtggaaaccacaggtgtgtttttataggaggaggagacagagtccagatcggattcatacacatacgtctttccaaaggacaaaactgagacgaagttacgtagatgatcaaacctgccagaaccgattgtctcatgaacattccagaacttgatagccaacagagaaatacctaagaacgtggaccgcttccatagtgggacaggtctcttcccaccagatgagagaggattcccaaactgctgaagaccaccagagatatttccatgatctccagagatgcgaacagcagaatcaaacgtcacagaaccaaactttgttggtggaacagagacgaactccatccaaagaaccctcccaaaggagaagatggccgccacgccccagtcgcctgggcgccgccaaaaccctggcatctgtaaattacggagccaatttcggaatcaccatgaaagtagaaaaaaaaactagtcaatttcatcctctaggcgtgtacgtatttgcttcattgctttacactacatagatcgactcttcactgctttcgattttatgaatacacaagtcgaatgcatatacatgcgcacacataccacactcatgtatatacacacgcatgtagatgtgtcctagctagcacacatctaaagagattagaggcataggctcacatataaggatgtgtggggtacatccgtacatgcttatcattgaacacacccacatctacatgtattgcctcatgtggttaaacctaagaaaatttgagcatccatgcgaaccataatatttaaatttgggtgagcagtctaactaataattgagctattgctcgtagtcttcaatcgtatatcttgctagcttggttttgggtaggctcaaattaggcctgatcaaattaacggggctaggcaaaaaatagctctgagacaaaaatacaagcctgagctgacctgagcattctcgtttggtggctttttgggctttcgtgcttcaaaatgtagtcctgaccctgacccagtacaccattgagttgggccgggctcagtttgagcagccctagctcaaatgtgccaacggggttccaaggagaacttggagacgtttatgagctgtggcagcaacagccaggcaggcaggcaaattaaagcatacctttatcatacttattgcacatatttaagcctaaaagctactatagcttt

SEQ ID NO: 34717 - DNA, 1501 bp, Oryza sativa
gccagccactggcaatccagtgatagtgagcaccctagctagttgtactaaaataaaccctagttgtactaaaatacatgctgcacagaacctttcttctctaccaaagtccaaacttgccaagttcatccatcctccccttcccccctccgatcccctcccatcccctccccgccgcctcgtgcgatcgatcgatcgatcgatccgcaccacccacgcgcccgattcgccctcctacccaggccacctctaaccctagcgccggcggctcttctcccccgccgccaccgccgctccaaccctccccaacagtgggtttctctcccccccaatcccctcccctctaccgccgtcgatcgacgcgccaccaggaggggagcaggacgaaagccggtgctgcctaccgcctccgcaggtacctcatcgagcatcggtcggagtgcaaccggagtgccaaggtcagcgaacgcctttccccccttttaattctcctccttcctgtggtacatgattatagttaatcaaattgccttcttaatgtgtgcttttagctctacatttccgtggatctgaaacttgagctgttcaccgtgttgaattacacggtctgtgtaatttggtgtggtcatgtcatgcagcagagatttgtttcattagtctccactgtgatatacatgtgttcaagattagtactagattacatacatacctgcagcacgaatgtaaagtaaaaagaatcattaatcttgagcatgaatccgtacgttttggccctgaatagctagctcgtggagaagatagatagggaactagatcactgtgcacgtttagaggatttgcaggtctgattgtgctagaacaattttattttagtaatgttactacgttagacatgaattcggcttcttgttaaatgttgccttgaatagcagaaagttaatgtccaggaccttaaagttgacggcaatggtgtattcctaaacatttgtaactttgggtggtactccctccgttcacaattgattgtcatattaccaaaacagaaatatccatatttgatcgtcgcctaacgtcttgagccagcagatttccttttttttttattgctgcatgcgtgtatggattaaattgcgagagagtctcctgagatttactgcttagcatgcatgcatagatttaatgaagagtgattattgccgtattagttaaatccctccgtgattctggttggtctagctccatgcaccacacgcggaagccgaaccggcactgcggcagtctccttgatccacgctgctgttgtgtgatttatttctcccttggtattgctgcgcatacctaatatgatgatcaattgtgaatggagggagtattagagagtagcagtgacctcacttgggttctttctatgtcaccaaacttgtaaaaatcgattcttatgatctgtaaccctagcaaacagtgccactatggcaacaagagaatcgccactatagctcaa

SEQ ID NO: 34718 - DNA, 1501 bp, Oryza sativa
atccggctagccactgcgacgctgaattctggagatccccgcacatggagtcgcagcgaggtccgccgccctccctccctctctctctctctctctccttatttagtagtagtatgtatgcctgtgctgtgctgcctcgagaacaaacgttcaccgcgtccccggcggcggcactcagccggagcacgcggctgcggtgtggatcgccctggctttcaggggtgaataagggaacaatttgttgtgaagactagtagcttatagtcaatttattcaattccttggtctatgtgtgttgtttataattcaacataaggaatgctagttttgtaaagtaggattaattcagtgctagggttgccactcaattgaacttcaaggccaataggcacattttagacgctcagagcgcaagaactaagataatgatttagctcaagttattctgtgggagacaaggaaaacatcagtttgtacgattagtttcaaaaatggtgccccaggagacatcgtataagctcttttgagcctaacaagtgttgtgcatttcacattacaaacaagttggccccctttgatttgtaggaaaaacataggaaatttggaggatttcaatcctataggaaaaatatctatgaaggtctttgaaacaaaggatatcttatccttccctttgaaattcctatagagattttgaaggaaagttagcaagagctctaacctcttggaaaatttcctttggagtctatctctctcatccgattcctgcgtttttcctgcgccctaataaattgaccattcttgtatttttttcctgtgttttgcaatcatctgttctgcacttatattcctttcaaaatcctgtgtttttccaaatcctcctttttttcaatcctgtgcttcaaaggagcactttctgtgttacaatcacataacagcacaaacaagaccttgttctttgttatactcaagtgaagatgccatctataatttctatacactacatcttattatcagtatgccaatttttgtgcacttgttgcctctgtttggttaataaatcatctcaacagtagttcttgaatctgttgttaatttgatgaatatatatcaacttgagaaatctattttgtagatacgttgagcatgagtgctcttactttgtccatatacaaatttctatcttctctattatacatttgcttgttggtactttaaagtaaaatacaaaaattgatgtgcacaatgtgttgtacatttaactttctggctcaactgggaagccgtgccctttctttacctgaaatttatttgtttgattgcttctcatttgcatgatgtagcactaaccaatgggacatctaaacttcaatgctgaattgctgatcatatcatttactttctgttacctacttacctgtacttaactaaaaacctaaaatttcttgaagccctattgtccaactgtaacatattttttgacaatttttttaatgacatt

SEQ ID NO: 34719 - DNA, 1501 bp, Oryza sativa
atgaaaattgatttttttctgcatcacatgcaattttagccattaccatcacaaataaattttcaatgtaagcatgaaacatgcagttttctaacaatatttttaatataaagagcatttttcactggttctgacaaaattttgttcactcaaaaaggatttaaaataaattagttatgattttttgaagtttacacattttttagttgagagggcatattggtcatttacgaaaaaaactaacctttgactaaaggtcaactaacactattgtgatgggagtggcataaaaaggtggaaaaacttaaactagtggcatataagggagaagccaattttaagtggcatataagggaactggtcaaattctagtggtatataagggattctctcactttataatgggcctcactagcaaaaaaaaaatcgcagaagcccaagcgttcatcccttttcccatttcctcttccagtcttcctcgaatcgcttccttttctactgttgtcactctctccttgccatcgctcctcgtcccttcctctgtggtgtcgtctaccatcattttttcagttgtatcaatttttatttgcccaaatcgagctccttggcactcagatcaactcctccacaggccaaattgacctcgaagtcgtggtcctggcagctggcggagcaccgacaatagtgacacttaagggtggatctgacaatggtagcgacacttgcatcacaggaagagtatgccgcggtgtcttgcatgatggatccacaacgatggcagtggcatcgctcgtagatgcatccgatggcagtggcattcgcgggtggatctgacgacgacaatagtgttcgcgagtagattttggcaatggcaatgcctcgcaccacggacctggaacgatggctttggcattgcttcggggctaccagacgtcattgcctacttcccattttcttgtccataatgacaaccaactagggaaagagacaataacacaaaatgaaaagcgatggattattttattacatagcatgcaaaaaaaaatcatacaaataacaactacttgtcacactgccattaaagaaaataattattgaatacatgtataatttttcttcgatctctcactcactttaaaattaattatattttatttctcacttacatgtatattttattaattatatatatataagtatgacacgcaccatgaatccgataagccctatatgctctgagaatgatctacttcctccgtaaaaaagaataaactttctagagatacttttaaacggatgatgtacgacatagatacagatttatttttcctaaatactatgcccacccaacaaattagcaatgctgccagccactggcaatccagtgatagtgagcaccctagctagttgtactaaaataaaccctagttgtactaaaatacatgctgcacagaacctttcttctctaccaaagtccaaacttgccaagttcatccatcct

SEQ ID NO: 34720 - DNA, 1501 bp, Oryza sativa
gatgatcaaagaaattgattggggaccaaaccaagatcttctccaagtctagtcccaaatcaccacgtcacttttggtccataaaaggcaaaagatgcagttttacatgttttggatttggattcaggccttctgattgtattaacttcaaatgggcttagctattgatcccaaaggactctcagggcccatgagtacttgtggggaaaattatagagtttaatttcagatggttttggtctcacatcaaaattcatatcaagttgttgggaatatgcaacacaagtcatgtacctcatctagtccgagtttgatttaggccttgggctttataattgtgtcataggttaagttaaatagggggtgtgtatcctagggctaaccctagtacgtccctaatcctatttatttaatagtcgtcattgtttagagttgggttttgcttagattctgttgttgtagttccaccgcttagttcagtttgtggaacatcaatttgtgagcttcatcatatattaataatagttcagattgcttcttctactctcttgcttgtgttctcgattcacttgcaggagatagccttatcgacaaggtcaatcatgtttcggcttgattaataaccaatggatgagtggtgtagtgatttcgagggttcggttgtcatgatctgagcctttggatcatcaacttcaagttccataatcgacttatcaatacctatcggaagatcgggatcctacttcctcatcaagaagcaacctacctgaaagacgaggtgtcagtgataactgaaagagcatctaggcccctaatgagttttagctaattgatgacaaacaattaagggactaatgcacttattgaaggaataagtaggagattggtccaatgatggcactgaagatgaagatggaatttaaccaagtttcattgtgatatagggaaacatgtgactaaagatggtaaaatggggtgaagggttggcaagacttgattaaacaaaggaccatgcattggagaagaataaggagaggcatggtgctgaaggaccgacgcaatggtgaaggagcaaatgcttggctgaatgcagacagatcgattgagtccataagagaagtcacgtgttgttgatgattaatctttgttgaagtgaaagtgaacagaataaagcttgagtcgaacaataaaattggagtctaacagtctaggtgaagatgttcaacaacccaggagacaagccattctagatctttatcgagaacctcacatagtcacagatgaagtaacgattgagaaagagtttgaaaaaaaaacaccatattagaaaatagacccaagtctacatatggaagacgacgaattgtagactatctaaaaccctaagggcattggcaatgtatatagatgaagtggtcttttataggtagggcatgtgtgtgagtaaactttagctgtttctattaccacaatgcttaaggcctagatggactttataaga

SEQ ID NO: 34721 - DNA, 1039 bp, Oryza sativa
aaggggttttgttggggaattttggtgtggaatagtggagtggatgtagtagtggctgcgtcccacagtactactttattgttttttaagtaaatttcttagtgtacaacttaagaaatgagcatactacttaacaagtgggtataacttagtacaagaacttaataaataagcatatgggtacaaataattaaaaggtgggtatggttttagcacataacttgattgagaagtggtgtaaaaacttaattattttgagcatttttggctatatgtcatcattttttttaatgtactcagttgttaatatacttatgtagatttgtacaagcatactttttttttcattctagtaattaaaagtcaaacaaattttactgtgtagaaattttaagttggtatttgagatggtgaaaataatatctaaatcaatggtgcaaattgagtaatatattcttacaaattacatcaaacattgtaagataatatctacgggattgctatgtgatgacatattaacattgtgaaaaaacttacatagcactcattaaccaaaatagcatatctagttaagttattgcaccaaaatactaaatacccactttccatgttattgtacttaaacgtctcattctcaagttcgtgtactacatcgtacccacctatcaacttgttatactgtgggtataatttacacttcttaaaaagttataaaaatgaggagcactcatacaaagataggactgcgaatgctcaccatatttttttatgaatgctcccaataaaaaatatattgtcatattaaattttaaataaaaattttattttattacatttgttttatttttaagatttatgtcaaaattttccgcactaattatttagtctcattttctacctaaaatgcatatattgtgcactcaaacaaaatttacaatagttttcaaggtcatatttaaacctaaatcatcaagcacattaaaagatatttgccaccaacttaattggtgaaatgaaggaaaatgtgacggcaggggca

SEQ ID NO: 34722 - DNA, 163 bp, Oryza sativa
tttgctttccgtgaggtttcttgtgtgcgtgggctggcggggctgtgcagcagcgcagggagtcactgatatacatggtggcggcggcatccaaggctgataatggggcggtggatttggcgaccgcgcaggcagtaaacagagagagaaaagagatggagga

SEQ ID NO: 34723 - DNA, 1501 bp, Oryza sativa
accagactgaagttgtccgtcaacaagttttgttgtttcttgtagtgctgctttgcattcagggccagctgactcaccaatcttcagagatgtgaatcatgcagaaaggtagaacttttaggtgcatgccaaaatgcgataacattataacatgattaaggatctgcacctgtagttacctgtttgtcaaagtcagtatagttgtaaacagaaagaacaactcctgaactcgcaagacttccacatgtcaagtgagggaacttcaatctgaaccaagcactaagtgctccagcgtacgaccctccaaaaacaaaccaagaactgtctgctcctgagcgattatacttagcattcaaagtttccttcaaataagagaagccaaactcagatcagtaggtacactcgtttggacatagacagtacaaacggtcctatgcccacctgataatattggcggaaaacagccagatcaaacaaggcctgttttgatgacaagaaccttagattttccgttgtcaaactctcaaaaggggaactctttccgtagtaccgatgctcaggggagaccactgccgcaccaaacttctttgccatcacctacacacatcacacacaaaccatcccatgtgtatgttatcaaaacaggtgaagtaaaatataaccatatgcttaaagtatagatcacacctagaatgtgtaacaaataatgtctaattgctccagttggaaactgtacaactatatacttgagcatactcacagctaagtagctgttaggaatcccgttgcacgaagattctccacagatatataagaaaattggcccttttggagctcggtagtaatcaaggaattcatagtaacgctgcttgaattgccgatggtcctgcattgaaaataaaataaaggtccatgaatgccaaaaaaaaaaagaaagaaagaaagaaagaaagaaagagaacatctaacaacgatggtagaatgcatcaacattactccatatcacatcacatttgaaacaacttgaatcactagtcaagaggggattatggacaacagtgaagcgctagtttgttatgtagcaagtctagcaggctcgtaaattttcagatacacaacatatatacaaaggggaacatcaacattataccgctgaagtaccgattgcctttttatgaggtccgaaagtctcatgaacattatgtgtacgggacatgaacatcggaatggcgttatcaaaagtgaagctcacatgaaatctatgaaacaaaacagaaatttctttagcatcctcaaactccataaattctcccagcttcaaaatcaatcgattgtgccagtgcggacgtgggcgtgctaattcagtaccaattcgcttagttctcacactggagactatactaggatatagattgactagattccgacagagccaaagaccaaactgatgcaaagtgacggcacagcacaaatccacttccccatatccccaattccccca

SEQ ID NO: 34724 - DNA, 1501 bp, Oryza sativa
aaggtctcaatgagtgtttttgactaggaaggctttaccatcccggtccttgtaaatttatgagctgagattacaacagtttgcgtatctgttcatctagagctattcaatctcgtgtttctgactaggaagactttcccatcctgatccttgtaaatttatgagctgaaattacaatagattgaatatctcatcatctagaactattcagtctctagacgaactttatttagccttatcgatctgttactattaaatggtgacctctctctctagtggagtaaaggattgggggtctttgatattgctccgtatggctacgctgcaacctgcagttgcgttataaatacgttaattaacttgcaaccagcagtttaccaaacaaatataaacgttttcttttttgacaaaatatatataaacgtatttgcggcatcaaccgcagcatcattttctatggctggctactgtggctacagcgctgcactattgcagcacggccacagccagtgctctaacgagcaggtccattcgttacttcgataattaagctaatagatggggtaatcattatcataaaatccaaaaatgttgctatcaaaacaatttggctcatatatctcgctatttgaccgcctctttgttacttcatccgtttcacaatgtaagtcattctagcattttccacatttatattgatgctaacgaatttgtctagattcattaaagattcattagcattaatatgaatgtggaaaatactataatgacttacattgtgaaacggagggagtagaaccatagccacattgcccccatccttcccaaaatagtttgtggcagtggatcgacacttccatttttttcatctttcgtagtggattggacaccggaccgaccggtactacgtactctctggtttgtaatactttctccactccatttcatattataagatatctttatttttttaagtctattttttaagtttaatatatttatatagaaatatagcaatatctgtaacaccaaaatagtatcactaaatataattttgagaatattttatattgtatttgttttatattaaaaatgttgttacgttttcatacaaacttgattagaattacataagtttgatttaggaaatactaataacccttataatataaaacggaggagcactggtcggcttaaatatacaccaatatcttacattttagatggaggtaatataatttattttgtttggacttggtaaaacattagagtaacactttttcatatttaaatgaaataaaacatttaaatatatgtccaaagaacaacagcgtaatctattaaaaaaattaggggtgggtagatatgttatacacactctttttggcttcacacacacactcggacacacatctccaatcttgagcacacagccacacacacacacaccatatcgctcaagttccaatggaggtacaggaactagtaccgtcgccatggt

SEQ ID NO: 34725 - DNA, 333 bp, Oryza sativa
ataggaattaggatgataatgaatttgcatgtccagatacacaaattcaataaacattggtcatctggggaaaaagtaggctcattatcctgtaatgtagtacaaatattacctgtatgaatcagtgccatcttcaaggctgcactctttagtttcactgctgttatgagaaccataagaatgacaccggaaattctggccttgttggatcaaggaaccatttgactgcccggtggtttgtccatttttctcatttacacaaaacctgaatgttgattgatatccattcatgcacttccttaccttcgctttttgcggtatacaattcaatgc

SEQ ID NO: 34726 - DNA, 728 bp, Oryza sativa
cattgagtttcatccagcccagcctcggcttctcccagtgcaaatgggtcgatgcagcaggaggaccatctggtcctcttcttctaagcgcacttataacagatctgctaacaacagttttacctttttccagatcagcgtgggggcattccctgatttggaatagagtagcaatataactttccaggaatcttttggagacttccagcggaggaggcggcttattatgtgtgatttcattacgcacataccagtttcgccagagagttaataaaaacatctcatgttcttcggttggtagatattccaaacaatcaaacagccagtaattgccgaattggaaattcaccaaatcaagcgacaagttacctgattgtaccatatccgacaacaaggcactggctcggggacatttgcagagagcgtgcacagaattctccacctctcggttgcagatgatacagatatcagagtttaccaacttccttttccttttgttgtccatggtagctaaacaattggaggccactttccaggcaaagattttatcttctgtgggagcttacacttccaaattaaatcccaggatttgcgggaatgcaaagcagaggaacttgaggatccttcagtatttgccagcctacaggcaagattataagcactccggactgagaaccgcccagacttgtcagggtgccaagctagaaagtcttcttcttgggctgcag

SEQ ID NO: 34727 - DNA, 1501 bp, Oryza sativa
acacactggaccccaaacacggacaaacacttctcctcaataaccgaaaggctccacgaccgggtctggagacggccaaaagaagagaggagcaccaaggagtgaaggagtcgtggccggcatgaaaaggaactgagagctgaagtcaggggcaacaaagaccactgtgtcttccatgattccggcaaggaactccggctatcgcgggacaatccttacgactgcagcaaccaccaccaacttcaccgccagcgcagagaaaggtacaccagggcgagcagaagagcaactaagaagaagcgatggtgagaggaagggaggaagggatgtggggtggggggaggaaggaaatgaggggcctcagcagctgccggcgatggccggaggaacagagaggaaaagagaaaggaggaagaaagcaaggaagaagaaacgggtggttgcagggacggcttccgcagttgccagcgacagggggggtggccggacgccaaactcgccaacccggagccgactgatgccgcgctgccacgcgggcactggcaatccgccgcccacgctccggcgcccgcacggccgagcatgaccgccacctcgtgagcagacttgcgcgacgatccggccgcctcgcaagtcgccagacgccgcagcagccgccgccagccgggccacctccgcttcacgccgccccacgacaccgccaccgacgcaccgtctagatccggcgacggcgtctagctgggatccctcgccgccgccactccccaccgccggcgaaaactccacctcccccatgcctgagaggggaaaccaccgcggtggagaagtaaattaggaaacaaattgcatgtcatttaataggtaaaatttgttggacaaacgagactaaatcagtcgattaggaggcacttgacgaggcggcggttagaagggacgatgcatcggcggttctgcgtaattcagatgaaggcgacgaccgtagtaataacattaaaggtttgcaacctcgccagcgcagggcaggctggaacaaggccattctactcgactgctcgtccttgccacactagtacagatccttctatctgtgacgggctctaatatgcttagaaatagcgggccgtcacaaggaagtcatctcaatcgggccgaaaagtgcccgattgagatatggtcgcacagacatgttagatgggtataaaacttaagcccgtcacaaatgaccatcatctgtgacgtgcaccaacttgaggcccgtttgagataacaactaggcccgtcacagatgactcatcagtgacgggctatatacttaatctctatcgggcattaactaaagcccgtcaccgatgactatttttccatttttcatatgaaatgtttatatttgtaagttgactatagcaaaataattttacgggtagtaaatgatttcaaatggaaaaaatgtcaacaacaaagttgtataacttatcaatatttacaacttttagtttggtca

SEQ ID NO: 34728 - DNA, 592 bp, Oryza sativa
tctgtttactactttggaattatcgtttttagagtttcgaattagctgattactgcaagtacagttccccgctgtgtttttgtttgagattctgaactgcaaactgatctaggatcgagaaatgttggtgtatttagagatttaaggggggcgactgatgtgtcaccatttagaaaatcaattatgcatttcctaattgtcatggctgcatgctgtcaagttaaatttgagataactgctgaagattacagaaggcctagaattctattaccccattcatagagtagctgtgattctgacaatacaatgcacagcaggtatttagaaaggaaactgttactacatggttgttaacagcaagcagctattattgatctgataaggaatgaagttctacagtatttttgacgcgacgtattagcatcagttttgctcaagattcacttactgttgcgtgcaactaatgtccaaatttcacatcaggtactaaagatcatatctcttcaaactggttaggaagcttacttaatgaagacacaattggattgattttagtggccaaacccaagccaacatacagactgtgcgcata

SEQ ID NO: 34729 - DNA, 1069 bp, Oryza sativa
tggtcaaagttgattctactcaccaatttgttgagtgtcatgatttcactattgcaatgtgggaaatggcgtgtgctctgatcgtgtaatggtagaggtcatgagttcaggccagcacctttaccttattcgaacatgtccagtttcctcttcatgctcagtttttcagtgtttataatatgatcacaagtcttcctaataggtagcagttgttcttatgtgttatttctatccatttgattaccttcacgaacaaagttccgatgccaaaaaatatttgttactcttattttgtccacagattgagaagtttgctgtacgtttcccacagccttgtgatgcagagtcattcttgaattgtgtgaaggtgcaatttctatctttcaaatatattaagcagtccttttaagttataaccctgtgtagcccttcactgtaatcttgtaatgttggtctctggagttaattctatgtcaggattaccgttcttccttattattttcatgttaattgggaaactgtcttccttttggtcacatttatctgcatattgaagtgcttgctatttaattaccatgtatatagttatactctaatggaaaatgttggatacatcaattgatatttttatcaaagtttgttattttattatttgcatatactatttatgcacaaaaagcatgtttccaatctgtgttgagtgaataaagacttacaagtttcccctcaaaaaagagagaaactcatttcattcaagaatgttaatatagcaagattacccatgttcttaagaatgatcagtgagtgtgtgactagatctgtcagtgctctgaagaggtaatgacgtggttatctgtactatataaattttgcaaatgatttctgcttaacctctatatttgcattcgttgcaggtctatacatcaggtgttcttcaagatggtaaagaaaacaccatgttctgcttatttgtcttgtctcttttaaattctattcatgacctatcaagaatgtttgacacagttgttgctgctaaagaaatgactgctgataaagttgaaggcgctgg

SEQ ID NO: 34730 - DNA, 1501 bp, Oryza sativa
aagtgtttaatgcaggcttcaaggagaggctggtgtttttgcaattgattttatttgaactcttttctgaaacaactaagtgagtgcttctcaaacgacacggatgagacagtgcgtctcgtccggtcggagtatgtgcaatgtatcagtctttagattttgaaacgaggttggcacccggccaacagcttttcaaacggccacccgggccaacaacattcaaacggccacccgggcctagctgattccatcagctacagatttttcaaacatcgaacccctttccacaacagcaatttcacaagcagcagttaaacaaaactacgctaggaatcacctcacattcgcccatgaccgtgggcacggctgttcgaacagtttgttaacctctgcagagggggtacactttacccacacgacattactaacccggatcacccagcccgtggggatcagccacgtcgggagacctccaagctttcatgataaggcatttccaaagccgacacaggtttaccatatgccgacgagaggggtcccagaccaacaacaggttaggtcccagaccatactgtgccaggaagcccaggggtcctccccgacaccaccccgatgaattcacatgtctctcggcatcaaggctcccctgataagctagttactcagccaggggtgtcccattccacccatgtggtcgtacttgtcttatgttcggatgaaattccaaggaaacggtccttaggtgcaagagcgggaaaccgtacacccggtacgttccccggtccgcggttttggaaattcatttagttcgcaagcaccgacccaggtgtcgggttttccaagtcttttataaaacccaagttttacccaagatgtttttcagattttaagtttgaaggcggccgtcgatactcgtgcagagtgcatgatttccgaggcgcaactgggtggttacaagggaacatggtataacaattaacaaaggaaggatcaaatgcaacaaattaggtaggtccgtcaatctgccttgcagacgggacaagcagattaagtgcgatcctatcaatgcataataatctttcaagcaacataattaagttgaaatataggctcaagatattcaaaggtggcttgccttgctcgagatctagagcttgatcctcgaaatcctcgcactgcgggtcttcgggctccgaaactatacgcaaaacgggacaactcaacaaacggcgaaaataaagccctattaatgacctctaagcgtgccattaaatagatctcgagatttgaggaattttggaagttgaatggagtcaaatggacttacggttgggaagatattgaatttctaagattattggatttttggtctaaaggaaaaggatttacttaaatcctttttttgaaaaagaaaagaaaagaaaaggagggggaaaattagacttccctcgggaggctagggcgcggcccgagagaaaaggggcggctcggccgagctaaa

SEQ ID NO: 34731 - DNA, 1501 bp, Oryza sativa
aagccaacatatataatagattggctataaggttggctgcaattttcttctcctctctctatctcttacttatgcatttaatggatttgtcttggagcttgtgataagctagctcttgcataagagccaacatacttaattttccactacctcttttcttcacctaagtatagtaagcttatagttcactattatacttgctcttagatcgttcggatgatgattcatgagtgtcgccctgtcgaagaggcaagatgaaatgaaaggagagaagggtatcgtgtatcatgtgtggtcgtcgtccactgctattaaagacaagaacagaatataacggtaaagttatacttccttcatcccctaatataaaaaatattccctatttttaaacgtttgaccacttattttattttaaaaaatttatacaatataaaaaataaaagttatacttcaagtactttgaataataaagtaaatcacaaataaaataaataataattctattttttttaataagacgaatagtcaaacagtgcaagtaaaatgtcaaaattacttatattaggggacggagggagtagagtagtacagacataggtggtgttcttttctccggaagatgaagatgaggttttttacgcaaaacgaggtggtattaacgtatgattgattgagttttaattattacaaacttaaaaaatagattaatatgatattttagagtaatttttatatagaaagttttcgcacaaaacacaccgtttagcagtttgaaaaagtgacacgaaagtcttaatattctttcaacttttattggagaaaagaacgggactataggactcccttcattctaaaattcgaacagggctgactgagttcgtttattcatgttccctatttccctctcttgtttgtcgcgtgtaatctctatagaaaaattatttttaaaaatcatattaatcctttaaaaagttttttaagctatacttaattaattatgtgctatgttgctccatttttcgtgattagggggtcaattcccaactccatgagacagacacagtcttagcatgattgaaacaaaggaaaaaccatatgaattatagaggattttatcctatgaaaaataatcctatagagttatttgaaataaaaaatgtttcctatcaatttcttaggaattcatgtggaatgaaccttacaagattaattttagaggaaaataagcatgatatcttacttcatgataatcaaacaacttttcgaaatcccataagaactccctaagtataacattctattcctacatttgttcctattgctgtgttttctcatccccacatttcaaaggagccataaactcttaaataatgttttgagttaatggtttgcttgtttgatctatcttaaatccatttttagggcccctttgaatcgtaggattgaaaaaacggaggaatgggaaaaacataggattctgataggaatgcaagtgtaaaac

SEQ ID NO: 34732 - DNA, 1501 bp, Oryza sativa
tgcacatggataccaaaggatggtataatatagggctcatttgcaaaagcagcatttagcaaacatttgagaattataaaacaatagagtaattaatcatcaatattaatcaatattgaacagcacacccatgctgcacaggcccaaccatcctgaacaaccatacccggctgcacagatctatctccaaaccaggagctaaacaaattattaccaattatatcatcatttattatggtgagaagtgtgagactaatcacgaaagacattgttagacccgcctatgaccgcgggcacggctattcgaatagttttactctggccagaggtgtaccactgtacccacaagacacagccccacaacatgtcaccatgcgcctcaataccaccacggtacctcggaaaggagctgtgacattacccctcgcacaacacaatccaccacagtgcaccgttcctggatcatagtcacccccttataaacaaggcatggactccccagcgacccccgtgggcttatctccgccacttctcagtctggtgctccataatgaaccatgctatacaaaaggtaaagccgttgcccacgctggcttgtggttggcacggttaatgtttcacaaccgaaaatcgtgaaccggtccttaattgtcatgagcacgactctcaaaaccatgtgctcacaacccaccattatcaagttttagttggcaagtaattaattaaccaatcacgattggccatcgtgagctatcattaagccatcattaaataatagtgagtcataagttatcccaatagtgtgctaatgtttctaagcatggctaagcagccatatctaatatctagctgaaccaatatatatagcccaactagtcaagttataataacccaaggtatcaaggaataaagtaatcaagaacaaaagggctataacaaacaataggttaattccacccaatgatattcgaaaataaatgcaatagttgaatagaaacaatagctttaaacgggatcaacatgctcaaagggttgtttgggatctgtgtgacttgccttgctggccttggaactcttcaaattcttctcctgcgaaaacgaactctccggaaacgtcggaatctaaacagaaaggagcaaaacaccaaaacagcacataaacaagcatgaacagtatatgtggatatttttaacatgtagatctcaattttagaaaaatttagagacttgaaccaactaaatccgagctaagatgaattagttatgaatttttaaagattaaatcggattaaaacacttatatggatttttattgaattatgacgcaataatgaattatttttgaaaaggaaaagaggattattgcgtcagcggctagggttcacggtgaaccgggtgcacggcggcggctcacggaaacgaacggccgagatcgatcctatccaaaacggacggccaagatcgatcggatccaccgcggctcatggatggacgacgacga

SEQ ID NO: 34733 - DNA, 1501 bp, Oryza sativa
gattgagttttaattattacaaacttaaaaaatagattaatatgatattttagagtaatttttatatagaaagttttcgcacaaaacacaccgtttagcagtttgaaaaagtgacacgaaagtcttaatattctttcaacttttattggagaaaagaacgggactataggactcccttcattctaaaattcgaacagggctgactgagttcgtttattcatgttccctatttccctctcttgtttgtcgcgtgtaatctctatagaaaaattatttttaaaaatcatattaatcctttaaaaagttttttaagctatacttaattaattatgtgctatgttgctccatttttcgtgattagggggtcaattcccaactccatgagacagacacagtcttagcatgattgaaacaaaggaaaaaccatatgaattatagaggattttatcctatgaaaaataatcctatagagttatttgaaataaaaaatgtttcctatcaatttcttaggaattcatgtggaatgaaccttacaagattaattttagaggaaaataagcatgatatcttacttcatgataatcaaacaacttttcgaaatcccataagaactccctaagtataacattctattcctacatttgttcctattgctgtgttttctcatccccacatttcaaaggagccataaactcttaaataatgttttgagttaatggtttgcttgtttgatctatcttaaatccatttttagggcccctttgaatcgtaggattgaaaaaacggaggaatgggaaaaacataggattctgataggaatgcaagtgtaaaacaaaggattgcaaaacacaagaaaaacacaggaatggccgtttgattggaccgcaggaaaaacgcaggattcaaacgagagagatagactcaagggaagttttccaagaggtcggagtggatgttaaatttcctacatttttcctctagaatcgtaggaaaggaaagtttcctacgtttttccttttatcattcctacaaatcaaaggcatgaatagtgtaggatttcaattcatttgtttttcctccatttatcctccaattcaaagggggccttaatagcattaactttcttttccaaaataagtatataaatccaaaaccatgaaaagaagtatatatttttttcaaattttattccaaaactacgttccaacaagcatgctccatacggctaggctatagagttgatagagagatgtggagggcccacgtgtcagggacacccaacgggattgtgtttttttttttttgagatagtgttgacagcgaaagagtgtggaatgaaattcttggctgtagatgagcctgtaggccccgccacggatgcgaggccaccagcggatgagcgccacgtgtccgctacaggcatgggcagcgcgaccagagaagtggacaggacaaggccgcatccgccatcctccattgattcatctcccttcctttgctt

SEQ ID NO: 34734 - DNA, 1185 bp, Oryza sativa
ataggcctgcctccacccctgtcttccacgttccgttttttaactcccgacgaaaaccgccatcgccgacttggagtcgccggcatctagccgactggagttttctcggcatcctccatcatggcagagacgaacttgctaatacaagcatggatcggagacggacctgaggcacggcgtcacgccgccgcccacgccactgcacggcatcgaaccacggtcgccggccacgccgctgcacggcaccgccgagaaccgcgaccgcctcgtgtgctgccgcgcaccgccgccggctgcgcctcgcacggtgccgccgcccgccgcagtgctcaccgcgagccgccgccggacgcacggctttgaccacggcgccgcacggccccagcagtgccgcgctccgccacgccaacgccgcaccctcgtcacgccgccaacacagccgccgcaccgtcgccgcgccgaccgcacggccgccgctccctcatcgcgccggccacgctccggcagcaacgccaagcgctgccgcgagccgccgccggccgcgcctcgcatggcgctgccacgcgccaccgccagcaaccacgccggattcaacgggaaaataaggaaagaggaagaagaaaagaaggaaagaaaaaaaaaagaaaaaagaaagtaattggtgattttgcaaaaaggcccccggattttcttaaaactgttcgcatatctctcagcatggagattccttgcgcctagaccctagaatttcagaaatttccatttttatccctccaccacatggaaacttagtaaagggcccctgtacttgcatatttcacctatatttcatatttaagcattttctttttatgtctcatgaatttttgaatttgattttcatgaggcattatttactgttatttgatagtttgaaatttcatttttgagtacttatatgaatatatgcatccttttgtcctctttatatgaatatttgtatgaatttatatgaacgctagtatttctttattgaaaaacttgcatctcctacgtataattttcattccctattgaataattcgcatttcctattgaacaagttgcattccctaagaatataaatattggaaaatcatgaaatatttgcattcatatttgcaatcatgttactagtagtaacttatgaatattttgtccagatcg

SEQ ID NO: 34735 - DNA, 1435 bp, Oryza sativa
ctaagggacattggttgcgtatagcatactcctgatccatgaaggtactagtgctcccactatcaaccagcccaacagctcttttcccattgatgaggattatcactgaaaatgtatcacgtctggtagtcccctacatggcattttgtgagacatatattagctcctcagtctccaaatcctctggagttttctctgggatttcttcctctccctttcctcagttatgtcttctttctattctccctccttctctccagattcttcttcttcttccagcaacagagcatgtaaagccttctttaccttgcattgatgcccagagaaccaagcttctttacaaaaccaacacttcttctccccatttcctctaggtggtgctttggtcatattagctctgctttgatttcccccagtatggatcagaggtttgtttttgttccaattcagagcaaccttcctagcattagcagccttttcatagtttttagcataccaataagattctagcagcccctggggtttgtaaccacacacatcatgttttatatccccccttaattctcctatgaaacagctgttcaggtatagttcttgcaaacaaggatgatcccttctcactaggtccacatattcttcaaacttgtcaatgtactgctcaaccgattggttatattgtttcacattctggaagagctctactgcctcatgtacatcagcagctgaaaacctggtgcaccatagcgcaccattggggccaagaaatcatctgccagggaattcctatacccctgtacaacttaagagctctcccctgcaagtgtgccaatgctaaattcacccattgatccatcggggttccagttatctcataaaacttttcacactgtttgagccaatcaataggatcttctcctccaaacaatggaatttctagccttggtcccttaatcacagcctctgcataatgattaccttcagcccccattctaccatatatactcccctgtcgatcaataaaatgcacccctggacgtccttgaaatcccccttgagttccaaccccatgctggttagcaactgttggaccacttcccccaaagttcatattctgcctttggtgaattccatgaggtggctgctgcgtatgaagtccaccctgtccatgacccatggtatttcccccagaagtagcccatagattaaccagttcattattgggtgcattagtgttagtttccaaagcaaaacgtacctcaggagctgatggctcccctgtgggaggattacttggtctagcaccacgagttgcttgaccagttgcattctgaattggcagcgtagcagctgcttcctcagttcctccttcaccttcttcaacattcttctgcttgcacaactccctcagcaatcctttgatctccctcatttcagt

SEQ ID NO: 34736 - DNA, 1501 bp, Oryza sativa
gtaaatgtaagccctctggtacctgatctcaaccatcttgtttgccatttaattcatgcgctaattaaactgtcttgcagaggattcatcttaggaacgaagctaaaacggcgaccttagagaagctagtccctcatctcgggaccctcgaagccaccaggagtctgctgcacgagacaaaagagcttgccaggaaaaatgagcatgatctgaggaatcgaattgctgagctccaggaatccaattttgaactgagtggctcatcaaaaggtttgcgcaaactctgcccaactgatttgtgctgttatctctgtaatcctgattaaccgaagttaatgtagtgcaagctgccaagatatctcaactagagaagcagatctaaattctggaaaataacaaggcagagctggcaagacaaagagacctggcttcaaaggaagttgaaggtatcaacaatcaatacctcaaaatccattatcctccatatgctgacttattaatgtgaatctgtcgatgcagaccgcaagatcaaatctcaagctcaatttgacgtcctggttggcaagatcaaaaaacttgaaggagcccgggatgaggttgctaacactgctgccccaattgttcaagcgatgttcctcaataacaacggcccgagtgcacttgatgtttctgaaattttcgacaagctgagagttgctcggatatatatttcaagaacatcaaagaagctggaagtataggagcaagtatggcgttggcgatgactaaatccctttatccgagagttgatattgacgccattgatggctttgcagacgggacgagcgaagaagctgctcttgacctcatcagtgatgcgaaaaaagcggctgacaaaattgctgctgatgtagttgagagatttcaggacaacgatcttcgaccgactggtcctgaaaattctgatgatgaaaagactgataccgattaatgtaccgataactttgatgattaacgatgatggaggcacaatttgtacaatactgatgaatttatgctgtgcttgatatcttagcttagctcctgatttcttaaaagtttttgtcaaaccttgttgagcctaaaacccacaaaagttgttaaaaaactttcagtcctcattgactaagccaagaaatcaaacagggcaatgatacatcaagtaagcaaactgaattgataaaaatcacactccattattattatagtagccccctgactaaaaacttcgaggaaaaacttgaagttagcagtcaaagaggaaagatacaaacgaaatgcctaagcgtaaaatcgacgaaggtgttcaatattccaagaattgttaatgatagtaccatcttcgcgcttgagtcgataagaaccaggccgagtgacttcagcaattatgaacggtccttcccataaaggagataatttatgctgatcctgtgttgtttgaattttcctcagaaccaggtcaccgactaaaaaggctcgcgat

SEQ ID NO: 34737 - DNA, 1501 bp, Oryza sativa
gaataggggattgagaagattgggaagatacgcaaaacgaggtaagccattagcatgtgattaattgagtattaactatttcaaattgtaagaatggattaatatgattttttaaagcaactttcctatagaaattttttgcaaaaaacacaccatttaatagtttgggaagcgtgcgcgcggaaaacgatgtgctatctcactcattgtccatggaacgaacgcaccctaagtttgccataatcgatggatgcactaaggcataggacgtgttcctcctccgcttttgttgtcgtcccatcaccggatcccctccatcgttgccgcttcctttgctcgccagagcggccctagggaagaggagtggtgcaagtcgacattgttcccacgggaccaagccaaaccgtttggctttagctcgaagaagttcctatgtagttggacctaattagcctattatactaaggaaaaatttaagattgaggagtggattttcagtttgatttgtttcaaaatgattcccattgccgtgaaattttgtttagagtttttatattttaattttattaatataccatttccaaaagtattttaaaatctgaaacttttagccacgtctgttcgtctagcgtggccaaataacttttatcatgtcaccattgttggcgtggcaggacaatgctgccacgcaaaagttcagttttcgaaaatattttttgaaaatgtctattaataaaattaaagcataaaaagtctattttttaaaaaaaaaaaacgttgccgttgggtcggagacgagttggttggacttggaggtgtcagctcagcttggcgccgaaggggattttttttttctttttacatttgtttttcgcatggtgggggatcaatcttatccgttcacttcatatcgcacggtccagagtgttcccgcacctctgtatatttttctccctccacacgattctctcttgttttctaaaaaaaagaaaagataaactcgagaagttcgagaagaagcgaaaagaaaaactaggacgggactaaaacttctaagtctctatcacatcggatgtttggaaattaattataaatattaaacgtagactattaataaaacccatacataatcttggactaattcgcgatacgtatctattgagcctaattaatacatgattagcctatgtgatgctacagtaaacattctctaattatggattaattagacttaaaaaatttgtcacgcgaattagctttcatttatgtaattagttttgtaagtagtctatatttaatactctaaattagtgtctaaatagagggactaaagttagagtccctggatccaaacaccacctagagtcactgacatgtaggtccataccaggcccacatgtcagtgactcaaaactcatgtgaattaaggtgaaaggatctctccatccgaagcggaggcggcggactatccaccgaacaccagcggcggcggcggagacgg

SEQ ID NO: 34738 - DNA, 911 bp, Oryza sativa
cgccccgcgcggtgagacggcggctggacaacgacctgcgtggccggagggcagcgggacggcggcgtgcagaggccattcgcatggaagaggatgagggagaagaaaaggggaactttagtttgggttggcaggggcattttggtattttctaaaaattctgacaacacaatacacggtttgagcaacgtatctaatggaaacttaacgggaggggcatggaagggatcaaagcgaaatttcaggggtacacagaggatcgtgtaaaattcgagggtatagaagggattaggtgagttttcatgtgtacacaagggatttactcaactgcaaaaccagataccgggcgtggctcaacttacaaaaccgttcgcttgaggtccttcggtggttttgaccccggtgagtgtggccgtcagtgtggccggcgagcgcagcgggccaatgggctaataaagatgcatgttttgctaattacatgggaacaagctttacctatctgcttgcttgtgccatattatttgatatctgtcctttgtcaaccttgggtaataaatcgactagcttgtgttactttgatgacctagctagaactatatgcttagccatgcttaattaccactaactcagttgatgggataattgtagtattatacctttttagtatcacgacgagttgcgtgctcgagacatccgaccatgtttcattggtcataattatccaactaaaatgtgactgaatggtgggctatgggtgcatggttttgctagtcgcacccatggcaaataagaaccggttcgcgggatgcactggaagacatacaacgcttgccacaagcgggaatgggtaacttccagacttgaagtatagattttctctggctgacgcatccaggcgagggtgggcgtga

SEQ ID NO: 34739 - DNA, 1501 bp, Oryza sativa
cccctcgtcccgtgcaaccacccggtgtgctcgttttcgcctgtatcgccgcggttcgctccgccgctcgccgctcgccgctgtcgtccgccgtccgttccggccggcgtcgtcgtctacctcccgccggcctgcgtggcagccacgtaggcgccacgtcggcgccagctcggccaagaccgggtcgagccgaccccggtcagccgctcccctcggccccgctcgcgggcgcggtccaccgcgagccgtgaggctgcgcgtgggcccgccgcatccgcgtcctccgcgaaccgcgcgcgtgcaccgcgtccctcccccaaaccctagcgcgcgccgcgtgcgcgttccgcacggtgaaccgtgtcaccgacaagcgggtcccactcaggaccacgcgaggtgagcccggtccaccggctccctctctcctccccgcccgcgcgcgcgctctgggccgccttgttgggccgaccgacccatttagctcggccgagccgccccttttctctcgggccgcgccctagcctcccgagggaagtctaattttccccctccttttcttttcttttctttttcaaaaaaaggatttaagtaaatccttttcctttagaccaaaaatccaataatcttagaaattcaatatcttcccaaccgtaagtccatttgactccattcaacttccaaaattcctcaaatctcgagatctatttaatggcacgcttagaggtcattaatagggctttattttcgccgtttgttgagttgtcccgttttgcgtatagtttcggagcccgaagacccgcagtgcgaggatttcgaggatcaagctctagatctcgagcaaggcaagccacctttgaatatcttgagcctatatttcaacttaattatgttgcttgaaagattattatgcattgataggatcgcacttaatctgcttgtcccgtctgcaaggcagattgacggacctacctaatttgttgcatttgatccttcctttgttaattgttataccatgttcccttgtaaccacccagttgcgcctcggaaatcatgcactctgcacgagtatcgacggccgccttcaaacttaaaatctgaaaaacatcttgggtaaaacttgggttttataaaagacttggaaaacccgacacctgggtcggtgcttgcgaactaaatgaatttccaaaaccgcggaccggggaacgtaccgggtgtacggtttcccgctcttgcacctaaggaccgtttccttggaatttcatccgaacataagacaagtacgaccacatgggtggaatgggacacccctggctgagtaactagcttatcaggggagccttgatgccgagagacatgtgaattcatcggggtggtgtcggggaggacccctgggcttcctggcacagtatggtctgggacctaacctgttgttggtctgggacccctctcgtcggcatatggtaaacctgtgtcggctttggaaatgccttatcatgaa

SEQ ID NO: 34740 - DNA, 228 bp, Oryza sativa
tcaatccctttgtgggagggattaaccgaacaagacctaagtggttttaccatcaaaaaaccattttggaacagttattcatattaaacttctaataggtttgccagttagatcaccagtcatcattatttttacttcgattgttcatcttactcaagcaacttcgtcatcgtttccagggatgtacaccagaaatggattgaaggcggaaactatgaactttgcatc

SEQ ID NO: 34741 - DNA, 1501 bp, Oryza sativa
cgacaggcagaccgtgaagcaaatgaggtgattgccgggacatctagaaagtaaaaaaaaccattgataatcatattcgattaaaatctcaatgacaataaaaaagagaagcagcgggcagggtgtataggcgtatagttgcagagccaccaacggttgacgggacttttagaaaataaaaaatgaattccgatgatatttatgttcgatttttagaatcacaatgacaataaagagtaggcggcggacgggccataaaggaacatagtagaatcgtttgacgagacttctaaaaattataaaaaatgaaacccaacaagacaacaaactctaaaaactacaaggttcaatttttaaaggtttggaacttctaaaaagtaaaaaaaagaacgataatcatgttcgattttaaaatctcaatgacaataaagaagggaggcagcaggcgagccgtagagaagtacaatggcaaattaagccactaacggtttggcgggacttctagaaagtaaaaatgaacacgataattatgttcgatttttaaaatctcaatgacaataaagagaagagacaatggacgggctatagaggagtataatggcaacgtttgacgggacgtctagaaattataaaaacgaaacccaacgtgacaataaactctaaaaactataatatccaatttttaaaggttacaaggcgaatgaatagaaatagtggtagatcgagcaagcaaataaagaaggagatgacataagggatagtaactggtgtgacttttaaaaaacactccctccgttttttaatagatgacgatgttaactttttctcacatgtttgaccattcatcttattcaaatattttatgcaaatgtataagatataaatcacacttaaagtactatgagtgataaaacaactcataacaaaataaattataattacgtaatttttttgaataagacgaatggtcaaacatatgagaaaaagtcaacggcgtcatctattaaaaaacggagggagtataaaattagaaacacggggataataaggtttggtcttttaaactcttaagacaatgagatacttaataaattttaagtaaaatcatacttaaaaaaatatatgattttgtttaggtgctagccgcgcaaattgcgcggcccatccaacttgctaaccttcgttggattagcatcctatacgtggctgccctgcccacgttagcatggagtgggtcccacgtcaagctggcccccaggaaaagcgttcatggaaagagtaaaatatttcgaacccctactctttggtgggccctggcccatcacaggcgcgaggagaagcgaaagccccgcacgctgtgatcaatgaaccgataaaccataagctttagctttgcccatcaacttctcatccaagccaactctcccctcctctcctaggtttcgcctccgccgccgccgaccgccgccgccgtcgccgccgtagaccgatcgagcgggag

SEQ ID NO: 34742 - DNA, 1501 bp, Oryza sativa
ttcattccatagcagttctgaagatatttcttttatgttcagaactacccgggagcatttgatgtactgaagatattcctttatgtacagagctacatatacagtccattacattatcgccgtatttagtttcgaaatatttcttcaaacttacaactttttcatcacatcaaaactttcctacatacataaactttcaacttttctgtcacatcgttccaatttcaactaaacttctaactttgacgtgaactaaacacagcctatatagcctatatagctctttctgaatatagtagtacgacacgctttcaaaataaaagaatatagtggtacgactttgagtaaagagctttatacattatatatcccatgctgtgatcttcactcatatagtagtactgtgttatccatgtcaatattgtcacttagacatatggccgtgtttagttcacccacaactaccttaaacttccaactttcccatcacatcacatcacatctaaaaattttctacacacataaacttccaacttttttttccaaatttccaactttcccatcacatcacatccaaaactttcctacacacataaacttccaactttttttttccaaacttccaactttccccaaacttccaacttttttcaggaactaaacacagcctatatagttaggccccgtttagttccccaaaagtttttcccaaaaacatcatatcgaatttttgacacatgtatggagtattaaatatagattaaaagaaaaactaattgcacagttaggggggaaaccacgagacaaattttttgaacgtaattagtccatgattagccataagtgctacagtaacctacatgcgctaatgacggattaattaggctcaaaatattcctttcgcggtttccaggcgagttatgaaattagttttttcattcgtgtccgaaaatccctttcgacatccggtcaaacatctgatgtgacacccaaaaaatttcatttcgtgaatgtggagattatggataccccatatctgcatgacagttatactttagtcggatatatggtaccaaatatagatagaatatctttatgaggactcggggtaggttctcaacttgtatgtcaagaaaatacccgggatcctagtcggctacgattgtattttatctgtaatcccatattccgttaggatatggactataccttgtattacggatcccttcccctatataaggagggtccgtgtgcttcttggggcaagattcttttttctcccaacatacaatcaataacacactcggtggaatcatccccggacagaagtagggtattacttctttaataagaaggcctgaacctgtataaaattccttgtctccaaacctatccattttcctagcttgatagccacccccttttattattgccgaaatcttgtttcgacagttggcgcgccaggtaggggaggcgtcaagttctcgccgactaagtacga

SEQ ID NO: 34743 - DNA, 1501 bp, Oryza sativa
aggttgcatcatgtatgcaagcgcaaataaatgtaggcagcatccacactgaaacaaaactctttaaggtttgaaagctgaaaacttggtaaaatcctctaaaacatttaggcataaaggaagaaaggaacccgtaacaaaggggaaaataggtgtactccatatggaactgaaccatgtttacacctctacttgaacatgactgatggtgagtggcaacaatttctgggcatgtcaaagatattagattccatatattgccacttgttgtgttgtgtttaattcaccagcctcctttctaacatacagttagctgtctgggtgaaatttcaaagttcctgaaataatcctaggaatcaggaactaggaataaattgcttgtactcagttacaaatgtaccaatgggaaaaccagagctgttggctagcatcagcggttcttgagcagcaagatataaacagtgatgaccagataacagaattcatgaaataacattatgtagaatgaagtgcaataatattaaaattgcagggtcacacccctgcagagcatacatgtgtgcagagtcaaaacaaaaattaagacagggagagagacccaaaacactaaatggataaaaaaaagttattgctaccatgcaacacaattattgacgcagccttaggggccaacattccaacaaggtgtgtacaccaatatataagatgtgaaggaccttggtaagtggtaatgtggtactgaacccaagcaattgctgcataaatcacataatatggttccacattattcagtacaacatatgagctagatttaaacttccttatttgatatcaccattggaagtttggaaccaaccatactatgtaagactcaatgttgaaaataaggactagtgaacagcaaacctactactgtgcatgtgacacctatagaccaggagctgggttttacccattacggccatgtgtgccctcaaatgtttcttatttctataataccgaccaaaaagcaatggaagattcagaaaaaataataaaattttgaacaataggcatccatgtttccaaaatttcaaattattgcgaaggaaaaggtatagatgagacactttaagttagactcaatgttcaagagtcagaattgtgagcatacagcaagcctacttcacctatcacactattgatcaattcaaaactaaataaatctatcagaggcatacatttaccaccttcgtttcagcataacgatagcgcatttgtcaatccacaaaatcgaattaaatctacaatgaagagcgcaatgtctcaagccaaacttgaagtaatgagattaagaaaagaaaaagaatacccttttcacctgtagtcgaaggatggaattggagggctgggcgtctcgaaggactccaacacgtccgacttgcggtcaccaccagcagcagcaggcttctcctccttcctcccgaaaattcccctaacccatgcgatagggctcgattca

SEQ ID NO: 34744 - DNA, 1501 bp, Oryza sativa
ctattatagactagtgggaggaaagcgtactgcacgtacgttaggttgattcttgctagtgggtggataactcgcatctgtattatgctgttgctcatatcgaatactcatatatatatgcacgactgtccgatcgattaaactagtacatatggtagtgcaagctagggtaggataagttgaattatttgctggttgctgctcggcttgactaatccgaagacgattattttaggttgtgtccactaacgatccaatccaatgggcctccgccgcttgtttgcgtattaacggcaagataagttaatagacatgaacctgttataaattgtgatacagagaagtaaacaaaatcggggatgtagctcaaatggtagagcgctcgctttgcatgcgagaggcacggggttcgatcccccgcatctccattaatctctatcccttttttacaaatcatcgcccataatcatttttttctatcgtactcctaccaagtatagtgtatcctattataaagttatctacactaacttcttaagcttaatatgtaaagatgacatatcatcatccactgacaagcttagtataaagttattctccactgactccttaagcttaacatacaaagatgccacatcatcattcactaacaatcatcacatttaaagtacaaacatgctatatgtttatagtttttataatttaattactactacttttatgatcgactcgaaagtaactctgcactgtgcgtgtactccattcatttccggccggcattattcgttatcgtcggattccgcacattgataatgacatttgagatagtagtaaaagggatgctcgctccccctacattgccaactttgacactgcatcgtcgatgctgtcaaatgcatgatggctgatgctgcctcttcctctttaatttcctgcagccagcgtagctactctcgcttgcatggccggaattccacgcaactaaccaaccatcgactttgatcggttggttacattccccatggtcatagattccactcttaccgttcctttacacaccaaccctagataaaaactgcaactcatcagtgatggagatagcatcgtcgtaaagttcggatgactagtagtgatcgattttttttttctttacgtatcaacggctaacgataatgaagacgacagtgacggagcccgggcagccatccgatctgcccaggagctgtgttcgtcactgctagaactatataagtggagcaaatgaagtggattacttttccatctattacaataaagattatttttatcttagtgattaataatactaagtaggaaataaatcacaaacgggcttgtatttgggtagtgaattatcccgttacctcccatctggcaaaaccggcctgtggtcgtcgtttatgtgaaggggttggtcgcaccaacgaacccaaacagcttagcttgtcctatatatgccgaccctgtccccgtggtgtgatgt

SEQ ID NO: 34745 - DNA, 1501 bp, Oryza sativa
caaaccaaagcttgtgacataatttaatttgaaaccggattaattcaagtgacatgacctttaccatcaataattgacatcatcgactttactgtgtaaaatttgatctgatagtttcatcacggattctggtgattaggaatctaaggaagggagatttttcccttccatatgggaatttgttcccaagtagagttgtagagggactgagagtgtgtccctagctagcttaagagttaagagtgctttgccggtttgccagtttgggagaatgcggaagcatcagcatctactcctgccaatttcaatttccatgggtaagtagaaaccaaagcttgtgatataatttattgtgaaatcggattaattcaagcgagtgccctttcctttgatgtggttattttctcttttagtttctctactgtgtggtgagcctacaacatctcatgtttcattggtccggtgatggtgtcgtatactaactgaaacaaatttatatttgctagtattgtcatcctctgtgttaaagaaaagaaataaaggcatttttattcaatttttgtgttactatcctgattcctgacacaagattgcatcgttgcgtagagctatcccagcaatatatcctttgtaaacacagtgagcaaagtgaattctttagtcttcaaatgaagtttgatttcccttggtcttctttttttgttgaaagaaaagagtatatatttgaaattttgtactttcagtgccttgtagaagaaatttgcagaacttgtccttgcttatgtttcagtcgttctaggagtccaagttttcccaagatcagttacattacaggggtttgagagcacagaagccctttgcttagtctggacatcagtttcaagtctttgggcactgtgataggatatggtgaagagatgatacattatgttggctgggagaaattccatagcaacaaatgagatagggatattgttcaatgagctgtatgattatatttcatctcaattgattttccattctaatgagtgaactaagagccgaagacttttctcgatttttcatcaatgcatccaaagaggaatcaaggtcctcataaggttaagtttttttgtcaacaagcagggtggctcaggaagcaatggattctctccctcagaatctcagatgttaaagcggtgtgagtaaggcgggtaagttcgctgacttgtttcgttatgtctgattgcttaatgctgttctaagttgaccgctctgcctattttatgtgaccatgtagatgtgagaataatcttcagtagtggtgaggcccttgtgcaggaaaagggcaatctcaatatatttgctgaataagttcatgaacacatgtcccatatgttcatggtggtcatggtcattgactcagtgcacaagaagttacatgaaaccttcctctaaagttcattgatgacagcggttctccttagcttttgttttgcagggttttgaaaccatgttcagg

SEQ ID NO: 34746 - DNA, 1501 bp, Oryza sativa
ttactgaaatattcatttacatatccacaatggaaacaaaatggaagagggaaccgaggttccatctgacagcttgacaatcacatggacaatttaattcatttggtcccccagttgcatgctgataggtgcagtgactgggatttatggaattttgctgcacttgcagaaaaaacacaagagcaaaggaacaagaagtccactgtgaagtctgagcaattggatgagctagtgaccaaattaaaaattaaaggagatggcaactctgaattcacaagcagaaacagagatagagtttcagacacagatagagagaggaacacaattctggcccctacgaattccagccattttcctcacactttcctggagagaaaaaaaaatccaggaaacatcaataacactctcagaacaatttgttctttggcaagatgcagcaagctttttcattttcttctctttttcctcagggaatacggtgccatcgatcattggactctttggtgtgtgaatcttcagagagtagcaccgactatctcagatgccaattttcaggaaaatttaccgtgttgatagaaatttgtcatagtctcacatattttccacgagagaattccaagaattgaggagtgcttgttggtacagataccgccatacgcgaatattttttagtaaaaaataataggagttgacgacagactctatttctaagagtttacatccgtacctcccaccaaacaagataccaaacaagataggctatgttcagtggtttatttttcgccgggccggcagaaggtattaagtggtttatgagaatcctattagtgtcgtgttgtatagtttttttttcttaatttaataaagatcattctactagtttcaaggatcgagttctttttattattttcgataaactaaacttctaccatcatgataaacgagatcaaatcaactccatgaattatgaatcatcattcatgtgaacaataatatgaaatcatggtacaaggatttgtcctgtcaacatggcaatcctctgccagtgtaatgagggttagttcaaaggtcacgtatgacaaggacatgatcatcatcagcttgctccaattggtgcataattacatggagatgcaaatagtaccaatttgccagaagcatccaacggctgtcgctgcccagaagcttcatcccagataacctggcagatgccaggtcagctccaacattttcctgtgctttgaccaaattatcctgtttatttcttagaagcaaactatttgttcattattgcaaaataaactattatgtccatccttgatcagtgcaattctaccctataaatatgcgttcatccatgctccatctccatctccagcttaactcaagccatcacaacttaattaagcagcagcattagcagctcaattactgaaaacaccaaagttgatattctttacaaggaacttctaaaccaccatcttcttcaaggtttcagcca

SEQ ID NO: 34747 - DNA, 1501 bp, Oryza sativa
acttattgagtagtactactaccactccgtttatggcgggaaagagagaaggaatccagagaaagatcactgggttgggagactttaataggagcatttaaatggtttggcatttttggtatgagaaaactttgagcacccgcaatgaaaaaaataaggtactatctatatgtatatctcagcaatagattagattaatagtaaatcacctcaatagtatgtctacatgggtatctatagcgctataatacattgcctcggtttttttatagactatctccagtttagtagatagatttgttctctctcttcatttaatctctttcaggtagaaaaatatgctgacatggatctcttatagagagcctatagattaccattgtggatgctctaagagggtgtttgggaactagggactaaactttagtccctctcataaaaatataaaatataagtccctaccctacttatgtatttgcccaaagaccccctaaaactacgagtatagtacacgtactccatccggtagtggggcccgggctccggggttgggcacgaacagttgcgcgcccgatccggccgtcgccatatcggttcctacgtggcctcgtgtgggccccacccacatggaagtggtctacagtaccactgactacaacacttgtcaaagtcaagactcaaaactcaaaagaggacagacctcagctcactcatcatcagcgtgtgttccaagctaaaattagaagtttgattaaaatttaaagtttgaaaaaaaaattagaagtttatatgggtaggaaagttttaatgtgataaaaaaattagaagtttgaagaaaaagttaggcctgagactctcgcgtcctcctgatccaaatactccctcgtgaattttctgtgtctaacgtttaactattcattttatttaaattttttattaatattttttattaatatttttttattattagatgataaaatattaatagtactttatacgtgatttaatttttattttttataaattttttaagtaagacagatgatcaaacattaaatagaagttaacggccgtacttgaaatgggaccgagggagtactccctctaattctattttaactgaagatagaggctaatatcttttcaattgaaaaattgacgttttggctcatcgccggtagtactaatactacctccgtcctaaaataagtgcagtcatgagtttcagcgcccaagatcgtccgtcttatttgaaatttttttataattagcaattttgttgttataagatgataaaacatgaatactactttactcgtgacttatgtttttattttttttcaaaattttttcaaataagatgagtggtcaaagttggacgcgaaaaaccatggctgacggagggattaattcataatttatgacaagaaaaactaaggttgtgttcagatgcaggggtgaaaagttttggcttgtcacattgggtatacggacacacgtt

SEQ ID NO: 34748 - DNA, 1501 bp, Oryza sativa
gatcaagaggcacgaggcgggcctccatggcgagccgccggcggcgaaggcgaaaggaatgatcagcaaggtgtcgagcagctcgtcccttgtcaccgtcgaacaccagctcagcagccggggcaacgcctcgccgtcgttcacgcccaccaacaatggcagcccgctcgtcgacgagatgttcgtcggcggcggcggcggcgacccgttccagctgcttccgagctgcgtcccgtaccatggcggcgacgcgtgcgggttcgacttgccgccgctgtgcatgcctcagactcaggacccgttcttctccgacgccggcttcacgcaggcagcgcctcctctctacggcgacgtcatgggaagcgtgtcggagcacgagctcaagtgggacaccctgggcggctactccggcggcggcggtggggagctctggaacgcggcggcggcgccgctgctgtgcaggcaggccagcgacggcgacgacctcacggcgtggttcacggccgccgacgacaacatgtccgtcttctgaacgagtcaaccatgacacgtgtgctcccgggttagttacacatggcggtatatttttgagccattcctaactggggccccacgtgtcagccactacagacatatgtcatctattatatatgcataaatatgcctataatctgtatggatacagaggtgatgagctttcttttagttactggctgtaatacatcttctctgtagcatcatacagcagagctgggttatgtatcctcttcagttaatgtacttgtaacactgatctgtaagctaaaaggtagtgttgctggtagatcaatcttcatctcaaacagtgcagtttcaattcatacaatatatatattataaaagttccaattcatagtatgtctataagctcttgcctttgttttctgttttctgtgtgcttagcctgacattagtcagatattacatttactctttggtacagtgtggatacggtgaggctgaagatattccaatttacagcctgaaatggattacagatttacagtgtagtagggggaagttaaattggaatatcttcagcctgaacgtatccactctgtacaggtcacagatgcatgacagttttctttttgacttgatagcagctagtagcaggtttaaccaaaagtaacagcaacgaaaggacaatgattacagtagtagcagtaagaaattgtgatgatattgatacgtgaggttaggaacatcgcagcagcaaggagtgaagcagtgccttgccgaggcgccacgaaagatgaaaaggggagaccattgttaatgttaacatgaaggaagagcattgataagatgccattgctactgccgcaacacaaaaatggccaccgtcattccaagaatagaatcggatctcttgaatctttgatttgtatggccagacaaacaaacattagaggagaggacggcgctgccttttcgaattttcctcttaacttttctcgtt

SEQ ID NO: 34749 - DNA, 1501 bp, Oryza sativa
tcattttaatcaccaggatggcttttgttttttttttttaaaaaaaataccagcgctgttggttctggtgtatggaatcgttttcttaaaagcacacttgttttttttctcctggtgtgtttctagaggttgagaagtgctgactagtttcggtcaattcggatgaagatgttgggtatggtttggattttaaacgaaagcgatcttgtaattgaaagttcgatcttgtaattgaagcacttttgctagttgagaactcaacatgtggaggttcaaatgcacgccttgctcaaaattttcgaattgttttgcgctcggctgaaaataaaataagtttaaggctgaaagcaaatcctaaaatcccaagttgaactgctcaaattttctgcctacgtatcctaccgtgttgctctaaaaaaaacataatgtaacacattttatcactcgccggcatcgggcggcatcacgcaaggctccgacacggcggggctcgccgccgatgcctccaggaaccgcctctgcttctcgccggcgaggcacagcaccgacgcctcgcacacctcctgcgccggcggccgcggcggcggcgcctccgccggccggaaccgcatgagccgcgcgtactcggtgagcaggtggagcatgtagtcgtagacggcgtccatgtcgagctcctccatcagccgctggccgcgccgccccaccgcctccgcctccgccgggtgcgcctccccccactccacggcgtccctgatcgactcgcacatgccgccggcggcgacgtcgatgtgcaccggccagaagttcacctccggccgcagcccacggctgaagaagtcctcgtactgcgggtcaatcactagcgccatggacccacatgacagtatgtactttaggctcaccgaccacgcgaacccctccgcgtatattttatacctgaaacaaaggtttgggttgaattgatcggtgcataaaactaaatcatagggtttttttaacgccacgacaccgttgcgttacctatgggtgcattggctggagagcttggagttatggtacccggacttgacctcctcatcccaattctgcattcatcataatgttagtcagttttattaacctttattactatcttagttctaaaatactttatgttctaattaataggtaaaagttacgatactttatggcataggtagtacaatgtaatactttcggttatgattaatagctaaaagttacgatattttaggatggagagagtataatgtaatgattgatcacgtgtttatttatgtgagtggaatatatacttggcgcatgatctcggcgtgccacatgttggtgtcgttgcagttaagcaatgcgaccctcaatggcgacgccacgtcagggttgcccttccagtacgccgttgccactctgtcttgccatttgattgccttggccccttccttgatgtccctgaactccttgctccacggctcgatgttcgtttcag

SEQ ID NO: 34750 - DNA, 1501 bp, Oryza sativa
ccccaatcaacttttttcatcatccatgcattcgttacgctcggtctcttttcctttgcccaagcaagtacctctgcaaaaaaaaaactcacgaaactcattgtgtagcaaagtttgttcaaatatataacatgtaaatctaatatagaacatatgcacctttggttgattaatacataaggtagtcatggttatatccgagctagttgtgtcttcattacgttggttccaaagaggagacaaatgaatagtgttgacaaaaattagcgacacgagagcgagtggttaccctctttctaatgtcaccaagtatgttgtcgacgggatgatctctttggacggtgtgatgtatccttggatggtgcactgggaggacctaaccctgattaagatgctctacagtgccctcggcatcaatcccattcacttgtgccgtaggcacgccttgactatcatcagtccggaacttccgggctgatggtttcgaaacttcttggcatggagaggcccggatgttccggtcctcagtccccggaacttccgggtctgctgacagtggacttgatgtagggctattgggtgtcgatgacggaggttgatccctatcttcttggtcatcctgtgtctcgactggtcgtatatctccaatagccttagtaccaattgctttgctaggatccgcatcatctacaacatgtacaacaacatgctctcgttgggagccattagattcatcaaatgtcacatacgtagtaacttcaacaatactggaggttttgttgaagacacgataggcatgtgtatttgattcatagccaagtaagaatctcttatccaccttaggtgagaacttagatgaacgaggcctcttactcaagatgaagcacttactcccaaaaacacgaaaatatgaacatttggcttcttaccactcaagagctcatatgaagttttgtcacatcctgattttcatcttaggatttataaattatttaagaaattattattagaatttatattaaatgttcattaatttacaactgaagttaaatgtgggaaatcaaatttcctaaatataaagcatggttggatttaatttttattaaattctccatgattaattatactctctgaaattttttcggatttttcggagctcaattcttaattttaatcatacaaagaacatttcagtaattattcacatattaaattaatcattaaatggtcttcttataattttattaaatacttatagtgttcaagtactttcaggatttttcttgaaattatttgagcaatataagtatttttaacaattcaaggatcatttcagtgattaatttaattggaaaagtaattaaaatccccttttcattttcgggctgaaactggaaaagtctatccgtcatcctcagcccgtccttcctctttgcctgtctctgcttcctgtctccttctttctcgaagaagtctattacttatccctctcttcttttct

SEQ ID NO: 34751 - DNA, 1501 bp, Oryza sativa
atttcagatactacttcagtgcagaaaaaaatatctagtcaagtgatagagcttattcagaagcaggcgtgtatcatgtactaggacagtaggagaggtcaattcataacaatttcagaataaccataggtcaagaagaatcgtcgccactggaattccctgtcagtactgactatgcataggaattcacaatcggtacacatgacgtacgtgttcgatgtactggaaactgaattcgtaattagtttcagcgggaaatcaatcagcggaaatgtttagtatgaaggcgagctgtaaaaacatagtaaattcggccacgaaacttatctgaacacccgtaaaagaagatattatccgaagaaaatcaaatcagtgaactaaaccgaacggctaagcacggatcaagggtgacgcagacaagaattcatagacaaaacaaagcgcatatgaaacaaaatttcacttttgggagaggctgcttgctagctgcatgtacgtacttccccccttccctgaatggtaagacagtatgattcttcagagaagaagaagaatatatcaccatgcattacatatgtcagtgttgccattatccaaaagcgatgtcattaatcatgcccagatatctgatcaatcagtggattaggcgctgccctaatcacagaggcaacctgacacgtcggtttggacaggagctaatcagagagaatggaagatgcagtagtaaagctcgagtagtgtgtgaatgtcttttgcggctacttggagttgcaactaccgtggtagagtagaggacgcttcgaattgcttcgctcgtacgaacatcatcgccgccttaccttagctttttctcctctcaacccctctatataaactcccctaccgtgtcaccttcccaactcccccaattcacaaaacgaaacccaaacactctcctattcctcctcttatttcttaattggtcagcacctagctagcaagaatctctcaactcttcttcttgttcttcttctcgtccataattgctcctccaattgatatctctgtacgtagttcagttcaagttcatcaaggagcctgaactgaattccttggttgtttagttcttgctagctaggggattgaccataggataatgatcttgaactccggaggcagcttcatcaacacctgtccgctggattccgagcagctcaagaccttctacttctggatcttcccaatcttcaatagatactgcctctgccgcctctaattgacaagcattcaaccatatatatgtgataaattgtgccaatctgcctcaagtattagcatttaggcaaattgacactacatctagctagctagctagctttgctccgattagtagtattgtttgcctcttctttccattgttaaccttcgattgaacaattaggtttgcgcttgcttgcccaagatatttgaataggttttgcaagtgtacatttgtctgaaattcagtcggttgatttgatca

SEQ ID NO: 34752 - DNA, 822 bp, Oryza sativa
agaagatctaattttaaataataaattccaatataaaattttattaaatactttacttgattctatagttcctagatttttcttcgatttacttgagccaaggaagtgtttttaataattggaattgcatttcatgaataattgaaattgaaaaaagttttaaaaatcctccttttggctttgggccgaaagtcggcccaaaaccctctctctctcctccccggcccaagtcggcccgcagccgagccaccgcccgctcgcgcgcgcttctattcgctgacaggtggggcaggacagaggtcccagttcggaagttccgaccatttggaccgaaagttccggacctcgacataccactccaaagacgctctctacaagaccatcgctacaaatccaaacaaagatggacatgagcttggtttttctgatgaaagtcctgtgtccaaacgtgttgtggtgaatgggaagattttcttgatgtttgtaagagaaggaaaggcttcacaagcaagtgaggtgactctaccctttgttggtcagagactcggagcttccggacaaaatgtccagaacttcctggcaggacagaggtcccggtccggaagttccgatcatttggaccggaagttccggacctctggcaagacaaagaggctgacaggaggttccgggcaaaaagctaggaagctccggccagctggtctgtactatgtatcatatgtaatcatcaagaatcttgagggccgcgaaagggcctgtagcctagtggttacaagagcctcagtagcacctgatgtcctgggttcgactccccatgggagc

SEQ ID NO: 34753 - DNA, 1501 bp, Oryza sativa
cctaggacaccagagagaagaggggaaggaagaaggaagtttaccggtgagaagttagccactgaaggggacaaccgccggaggggaggcaccgcatcgccgtcgcctcctagtcgcgtcatcgcctttcagtagttgtggcgccgccgcagcgtgttgcgcttgcgcgtcgcctcccggctcccgttgtgaggatttttttttttccacacctcaggagaagctgatttttttcccgggttggggtgaggtagcacactgattgggtttaaccgaacacgtattttcttgtgggccggcattgaatccgcgttgggctgatccacgggattgcagcccaaccccagtcattcccggaccaaccgaacaaggccgaaacatatcaaaccgagccgggaattggaaacgaatccgatccgtaccagtggtgttcatccaagtattcgagtcgtgttcactgttgaggcgcacgcgcgcgcgtctcccttaattatcacaacccactcccagcttgaaatctgcatcgtgattcgatccgttcttcttccctgcactagtgcaaggtcgtcgtcgagatcgatcgatccatggaggaggagtggggggtgccctacccggactgtgtcttggacaacgccggcgctggcttcgtgggcggcgccgccgccggcacgctcgcccacctgttcacgggcctccgcgacttcccctgcggccgccacctcgccggcgccgcccaggccgtccgcgacggcgccccctgcctcgccacccgctgggccgcccgcctcgccgtctacagcgccgcctgccacgccctgtcgtcggcgaccgacaggcacgacgacccgctcgtctccgtcgccgccggcgccgccacgggggccgtcgcccgcttgcgccacggcccgctcgccgtgggccgcgccgcgctcgtcggcgccgccacgttggccgccgtggagctcatgatcagggatagcgtggaagagcacgacgatgacaagccccgtagaaaccagcggcctttgccggcgaagaccaaggaggatgacgtcatcctgcggataacgccggcgattgaccatttcccggtgcctgacccatttattgctgcctctagaggtagcctcctccggtttcggggttaaatttgttagtgctatatataattatatatacatacttagaaaaagaatgttactaataaagctcactcgtctaataatttaattagttggaagttatacaagattcaatcatattggctgttcatttcattcccgattgttttccaatgtattaatattcatttgtgttttaccttttgattcttttttttcaaaaaacactatatagttgtaaattagaaaaataatttaagcattttcttcccatttatccctagtccagccacccatgccgccttctcatgcggatggatccgcgagggcccctaccctcctccgccatgctagtacgcgtgagtacctggtctatc

SEQ ID NO: 34754 - DNA, 1501 bp, Oryza sativa
catggtcaatgtcgttgacaccatcatattggaccacgataccgatgatgtcggcaacgcaaaaagggttcatttctagaataagttttatccagaggtttatttatgaaataagttttcaaaaagaaccaaaaagttaaaaaaaaacagatcgtttctacactgtccatccaagctgtttatagctagaaattgattcttagggtgtgtttagttcacgctaaaattgaaagtttggttgaaattggaacgatgtgacggaaaagttgaaagtttgtgtgtgtaggaaagttttgatgtgatggaaaagtttaaagtttaaagaaaaagtttaaaactaaacaagggcttattagaacagaggggcatatatgtttgctgaaaaagtaattttataatatcataatctttggattggggctcataaatatttcacagtagaaattagtgatcagatacatctttgaaaaccatgtcgatgtgcaaaacatgtttttttcttgtgagaagagaagtatacgcacgaaatcaagagagggagagagcgcgcggcacaacacacctctcccgttcaatactacaacaagaatgataagaaaattaatcactgcattggtgatgtaaaaggctttaaagcttattggttccatacagataacaaaatgaacctgtctctatgttgcatgtttgcctgcccaaaaaaagatctgttgttaaaaacaaaagggtatttaattttcaagacaaactatagtgatgtttttatcttttttagataataaatatgatgtttctctcgtttgatcaaacataataagatttgttacatacacacactaacaatatgtgatgactgatgagtgatcatgctgattcgcatccaaacaaaaatgaagagccaatcaaagaatacgattgatgcaggactgttctgccgaaagtgcagcacaccagaaagtgacatgaattctaatattctcaaaacccaaaacctttttcttctccatgcatatatattggctgctaatctccagttagtctgtttcagagaatatatagacatgctcttttcagcagccaaatgcgccgaccatgcattgcgatcatagacttattgctccaacactatacgacttgctggctcgcaatgccattataaaatttggtaaaattttggcacttgcattgcgaggacctgttcgaccgtgtaaaatgtatagtagtatagtacagcacttgaagaccatatagtactagtcactagtcaaaccttattaccaggcgttccaggaattcgattgagaataccatgaacttttttgcggacttattttctaaagtcaaaaggcaggaactttgcagagatttttttttgtcataattaagttttcaagagagacgacatcaccagaattcagcaaggcctaataagtacgtagttgatgtcataaaagcttgattataagagaaaaaaattctctttaataaactttatgtctcg

SEQ ID NO: 34755 - DNA, 1501 bp, Oryza sativa
catgttaacttgtcgtttccgtctacatgtttgtttactttatatgtactgtttatttggagtttcttagtctttttcctcgttttgcctgttagcttgttgtttccgtcattgcgaaggtttgcgagtgtgttggaagtgttctagaagattaattgatgaccgattattgcaaggcaagtcacacatatcccaaacacaatcctttcagcatgctgatcttatatttaaattttctatttatttcaaatgcgcatttattttcgaatgtcaccggctggtgtgaacctattcctttgttatggccactttgcattaattactctattctttgataccttgggttataatttgtctagttggacttatatattagtttagctagatattagatataattgcttagccatgcttagaaatattagcacatgattgggataactaatgtttcactattacttaatgatggatatttaatggtagctcacaatggtcaatcatgattggttaattaattaattgccaactacttgataatggtggattatgagcacatggttttgatggtcgtgctcatgacaattaaagaccggttcgcgagcttcggttgtgaaacattaaccgtgccaaccacaagccagcgtgggcaacggctttaccttttgattgtcacagtttatacgaataaccggcaccggtttttcaaccccaggcagatccatcaaaagatcacaccaccattctacctcaacaatagttgtatctagtgccatcagctctgctttcatggttgacctcgtctaaatggtctgtttgcaagaattccatgaaaaagcacaaccacctagtgtgaaaacatatccactaatggctttgatctcatctacatcagagatccaattagaatcactatgtccctccagtaccgcaggatacacagtatagtgaaccccaattccatagtacctttcagatagcgcatcactcgctcaagcgcacgccagtgatcatctctcggattagaggtaaaccgaatcaacttgctcacagcaaaggagatgtcaggcctagttgcactagctaggtaaataagtgagccgatgatttgggagtattccaattgattcctagcaattctcttgttcttgcgaagcaacaagctaggatcataaggtgttggagaaggcttactatcaatgtagccaaaacgattcaggatcttctgatgtggactagggttcccgatctttcaaaaggttatgataaacaaatcgatccgacttctgaacgaatacgctctttgttggtatttcttaatgacattactagaaatataattcccagcaatggcgcaaaaatactcctggtatattatggttatagagttcatctgcaagcgcacaaatataccattgtagcatttcacccgagagtattccaagggtatcgtatttattttatcccgtgggaagatcatatagagagaacatgactaataatt

SEQ ID NO: 34756 - DNA, 1501 bp, Oryza sativa
tggaccacatggcacgtcgacgaagaacacatgatgaaaaagaaagacattccaatttgccagtcctagctatgttgcattagggatgatgtgaaagacaaaaacttttaatcaacacaatattgaattgaattgaaatctttctcgtgaactcgagaaatctccaaattaaacatcatatattatcagttccctcacattgttcttgagcaaaacatgcatgcatatgaaacggtcagcagccacacaattgtcaaacatggatgatcaaccgtgtgcatctatatattggaacttttttaaaagtttttcataaatatgttactagaactactatagcgcgcgtagctgcaaagttgattttctcactgctcgatcttcaaatatcactcattttttttacggtgatcgttgaaggttactacttactagtcaatgtacacgtgttgcgtgtgttttgtggtcgaagttgtatcctttcattctctttaaacattatttttcttcttatttttaaagaaaaagtagcaaccaagcgttaaaaaagacgacaacaaataagagtacataaatttgctaattcctgaaaattcatatttttggctctagtagatggggataacagtcctaaagggcgtttgcctacatctggttatttggtgatgaaaccaggatttcttaattttatttggtgcaagggctattaggccaaattttatttaaattccgataagtacaataactactattgaaatctcaaactatgggagatgcctacctacggcccctaccatgccctataggttatttttcatgaacattgggaaattataatatattcttttttaaaaaaaagtgcccccaatttcatttgagaacacaaaaagctgagtgaaaataatcagaaaacagttccaattttgtccgatgcagaacaacatatcatgagtcgatatcctctctctgcatcaacttgttcggagatatatcaatcatcctttatgacttgatttgctttcttcatgttgcatcgaccggtagactagactctttgagtccgtttatcaatctactctttagaagagaagtcatacaaatggacaacacaatgactacgttgtttgggttgatgagaaaaaaattaaagtcattgataatgacaagtaatcaatcaaacaatggtatatatgccaaatctaattaagcatggcacatatccaaccaaatacttggcaatctatccaagcatcctggggtgcgctacatcccagaaacttctaatttttgccacatgcagaaaattatttattatttacagcagccaaccagctgattaattggcctataaaaccctcattccctagctccatttgaagccatcaactgcaagcttacatcacactagctaattagctacttactcttcttcttgctagcttgctagcttctgcatttagacattgcaaaatctgaaaaaacttgagaaattaactaaacaaaa

SEQ ID NO: 34757 - DNA, 1501 bp, Oryza sativa
tcagctggtagcttgttgtctcggactgatcaaaagctctgacctcaacacactactgctggagttgcttccgctacattcgaccttgcatcgagctttgcatctcctgcatcaatacgcccatcatctgatcttggacaccaaatgttgatcacgagcaagggttcttctggcattggggtactttgttgctttcaactgaaccgttgatctgtgactttaacacaccatcgttgttgttgctcttctctctgacactgaccatctgctgccaggatggaagatagatggaaaagaggggttgctaaaggtaagaccttaaaccacttgactactgatctgttgtgagtagacttttattgttcaagttgcttaaggaaacaacctagtatggtcgcatccccaccaatgatgcaaaccatacccctacacacaagcaaacaacacatgatctagcagctaacgaaactactcttccggggaggattgggattaggaaaactctgggaaaacttcacttgaccttcgtggaacgacgaccctgaactaatcttctcgctctttgcacgaagcttgaggcttgacttggcttgacttccgaacagacatgaagctggcggtttatcctccagggtttaacaactataagaattggagggacagggagaagaattttgaaaaaccgttttgcaaagaaatgccgaaggttttgaaaaaccgtttcgcaaagaaatgcccgagaattttgaaaaaccgtttcgcaaagaattttgagagccttatggcaatttaggaccggtttacgggaaaccctggaagacatacagtgcttgccacaagcgggagtgggtaactgcttgatctaaagtatagctcgaccctttcctaggcaccggtggcgagggtgggcgtgatggagttgggtcggccggtgtgtccggttgtccagctgccggattcaccgcggcgaacgaggggactgcccgctgccttgcgaggagtgggggtgaatccttagcgtggtatggatggttagggagggttatatgaagggtcttgtcacaatcactcgacatggtgacgtgttcatcatgggcgcatgatgacgcggtgacatgccggtggattgtgccttgtgggtacagttgtgcacctctggccagagtaaaattattcgaatagccgtgccggcggttatgggcgatcgaccagattcaccgtgattagtttcacccttaataaatcgactcaatgcacagtagttcaggtgggttggttgggcctgttcaacgtggtgtagcgttgatcagtggagatttaatgttactttaatcactcaactgttttactgttttgcttaataaaatgttttacatccgcctttatgcaaatagccacaaaccgtccttgtgttccccttgcacgtctgcatcattggtgtggcttgctgagtacggtggttgtactcagccttgctattgttccactgctgagctgaaga

SEQ ID NO: 34758 - DNA, 1501 bp, Oryza sativa
aggatggtgtagcggccttgaaaaatatattgcggtgtacctgaaaaaaatatgccaaactcaatactattagaaaagactatggattggttacattttttcccttcaaataacataatgctgcaagcaatttactgggttaatctgttttgcctcggtttcccttctttttattagtatttttttatctcacaaagtgtacatgaatctttaaattctactacatttcaatataaatattccgaagcaacccgcgcaggatatcatctagttttaagtggtggaagcataagtaaaggtctggtcaaggatgaaactgaatacttgttccactgctgatgcattccaatatcatgtgcgtctcaattcttaacagaaagctattctacactatacagtttactctagacagctcagcaggagtcatcagtcttgaacttttttgatatcaagtgccacctagtcaacttaaatgaccttggaatccaactattcgcatccttcccagtaaccatgacgtgactcaaggggtatacatcatcgtggccacgttgttaactctttttaatgaaagaagcatgttgttacttgtattctagatttgccaaaggccgataaaccaggcctctcaatttctaaaatatagagcagatgcaaaaactataactcttgacaattggcacgctaagtcaaattaagccataaggggaagaaaaaggcacaaaatgcacaaattaagttatgtgactgaattactaaaacaagtacagcaaaaaaccttatggagcttcagggactaatctgcgcagctggtttttttgctttctgaatagtttcaccttccttgtatctcttgactcttcctgctaagcaagaaaatattaccacaataatatcagtaaataaaaatgtgttacatatattatccattacagattatatatacatgaacgcaatatattcaggtttggcacattagcatgatggatatgatcaagaacaagggtcagtttttcccccacagtaaccagaatgaggcacaaactgacattgtcgccacttctcacttctaatacaagagcaaagagcagtaactagaatataaccatataatacttgctgtaagacagtttttaatatggaagcagtaacatgctatcatacaaatgaagttacacacagaaatgaatcttaataggtcttgcataactagaaatggaccttacatgacaaaattacatatatacacaccaaaaaaaagggacaaaaaaaacaagaggaaccaaattatccacgtttcctttctttgcagacctgagtaattcacaacatacatacagatgatgaaatgcttcagttatactggcaatcccacttcttggttctttttgcaacaaccaaacagcgagaagagccaggtccagaagcttccccgatctgttttcttctggtttgttcctcttgcagcattcaaatcattcatatacttgaccacagcctg

SEQ ID NO: 34759 - DNA, 1501 bp, Oryza sativa
tcacaacaaaatacaggcaccagagctatttccgcactcagcattgctgtctctttatgaagaaaatataggtgctatgcgatttagagttgcccaggtaattaatttgttacaatgtccataaggaatacaaagacccctctatccatttcctctaaaaaactaaggtgttatgacagtcatgcagcatggtcttatttccctcattctgctgggtcgaacagaagcaatgcattatatcgaatcaaattaccttgtaaccacttatgtccttggtttctcctggatggctgctcacaatggcatgcttgagctttcccttctcttaaagacagagcaacgaatattacacagttgtgtgaatcacagttagtgcaactacagtatcaacagtaataagctgcctcacctgctgccccaatcctcccaattcgatgcatggcattgacgattgctgacttcccaacattaggaataccgaccaagaggacggttccagtgcaatcgctctcaccaagtttaatctccctgatctttgcccgcacagcattcaacagctatttcacagttaaattagcacccaatcaaatcagccgctaatgtaatcaacaggtaagaacactagaaacagcattacctacctccttgatgccctccctgctgtgcgaattaagagcgacgcaggagcagctcgtttgcttcatgtacgccatccacttctggagaacaccaacaccaatacgaacaacgctcgcgtgtgtgtatcagatcagaactgatcacttacccatctcggggcagtcaaaatctgctctagttacagatgagggttgggattagggttacctcggtttgagaggggtccgcgaggtcggccttgttgagcacgacgaggcggcggcggtcgggctccggggagcggcggcggagtggcgcgaacgccgaggcggcgggtacctgcggggttagactcagcaagcaagcgcatggggggaaaacgatgcttgactctgtctggagcagcggaagacaatagagaggaggtggagagcagtgggcgccatacccgggcgtcgcggacctcgaggacgaggtcgacgagggggaggcggctgcggatggcgcggtcggcggcggccatgtggcggccgtaccaggcgccggagagcccccgaacggcatcgctcaggcggcgcgagaaggcctccgtcgccgccgccattgctgacgtgagccaaaggcatagagacaaggaataagtccactttgactcccttaaaagtggcccaaatctaatccatggcccttaaccgcaaaaccggatatctcgaccctcaaactattgaaaccggtgcaatttgactcccttggtggttttagatggcggtttcgctgacgtagcaatattgacctaggatgtgggttgacgtggcgctcaggtggcatttgaattaaaaacgcatacgtgggacccgtttgtcattcacacatattaaaaatt

SEQ ID NO: 34760 - DNA, 308 bp, Oryza sativa
atctgtagtgaaatcagaagattagaagctaagggaggagtttttaatgttttgtgttccaaataaattgccaagtcctttaaatacataaataatctaataagtggcttgccttgcaatgaaattggctgaggccaaccatagcagaaaatattatcagtttatgcatgagcggaataattcaatcattaatgttttaaaattattatctcaaaattggctgcatgttccaaggcatgcttcattcattatattttactcctggtatttcttgctacaatgacatgcaatgatggtttgctcttata

SEQ ID NO: 34761 - DNA, 1501 bp, Oryza sativa
ctaaacgcagtagcatcatttcagatcactgttggacattctgggactagcaataagacagtaaaagcgccgaagaacttcactctaaaggccccaggtccaggatatagttgcggattagcgcaagaagtgaaacctcctactaggttcatttcactggatggcagaagaacaactcaagctcatggtaagtcatttcagtgttttttgtctttctggcgtcacaattatgacaccctttcttcctttttttgcagtgacttggaatgtgacatgcacatattcgcagtttgttgctcaaagagctccaacttgttgtgtttcactttcatcgttttacaatgagacaatagttaactgcccgaaatgtgcgtgtggctgccagaataagaagccaggaagctgtgtggagtaagcactgttgctttaggaagtctatggattaacaaactaatttcccacttctgatttcttctatgtattttcgttggtaggggtaattcgccttatttggcgtctgtggtgaatggacctggcaagggcagcttgactcctctagttcaatgcacaccacacatgtgcccaataagagtgcattggcatgttaagctcaattacagggactattggagggttaaggtcacaatcacaaattggaattaccggatgaactactcgcagtggaacttagtagttcaacacccaaattttgaaaacgtctctactgttttcagcttcaactacaaatctttgaacccctatggagtaataagtgagtatttgcttcaacttctgagtaagtttgacaattttaatgtgaaatattttggctaacgattaatcttttgcttcagatgacactgcaatgatgtggggtgtcaagtactacaacgacctgcttatggtggctgggccagatggaaatgtccaatccgagcttctattccggaaggaccggtcaaccttcacctttgacaagggttgggcttttccaaggcgcatatacttcaatggcgaaagttgtgtcatgccttcaccagatctgtacccatggttacccccctcttctactcctagatttaggactgtattccttctcatgtcattcctggtttgtggaacattagcattcttgcacaaccacctagttttagacaaaaactgtggaaagtgctgaccacattgggcattggctgttgacatactgagtcttttggaagtttagggtgtgctcttgcatgaaaagctaattcgcgtttgatttaggttgtaagtttaggttcctcgaaatcattaaagtttgggttgtacattctgatggtgtgtattcttggtctgaagtgtgaagactaattgagaaccccaagtcccaacattaattgtctagagaaatgtttgccatctcatctgattgcaagaaattgcattttgtagttggtcagtaaatgtggaaattgtttcttttttcctctcaattcaaggtcaatacctgcatacatat

SEQ ID NO: 34762 - DNA, 1501 bp, Oryza sativa
tcagcaagccaggggaaataagtgtttaatgcaggcttcaaggaaaggctgttgttttcgtaattgattttgtttgaactcttttctaaaaagtctaagtgagtgcttctcaaacgacacggatgagacagtgcgtctcgtccggtcggagtatgtgcaatgtatcagtctttagatcttgaaatagggttggcacccggccaacagcttttcaaacggccacccgggccaacaacttttcaaacggccacccgggcctagctgatcccgtcagctgctgatttttcaaacatcgaacccagtttcacaacagcaatttcataagcagtagtcagacaaaactacgctaggaatcacctcacatccgcccatgaccgtgggcacggctattcgaacagttcaatgacctctgcagaggggggtacactttacccacacgacattactaacccgggtcacccagcccgtagggatcagccacgtcgggagacctccaagctttcatgacaaggcatttcgaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaattccaaggaatcggtccttaagtgcgagagcgggaaaccgtacacccggtacgttccccggtccgcggttttggaaattcatttagttcgcaagcaccgacccaggtgtcgggttttccaagtcttttgtaaaactccagttttacccaagttgtttctcagattttaagtttgaaggcgaccgtcgatactcgcacagagtgcacgaatatcgaggtgcaactgggtggttacaaggggacatggtataacaattaataaaggaatgatcaaatgcaacaaattaggtaggtctgccaatctgccttgcagacgggacaacagattaagtgtgatcctatcaatgcataatatttcgcaagcaatataattaaattttaaatataggctcaagatgttcaaaggtggcttgccttgctcgagatctggagcttaatcctcgaaattctcgcactgcgggtcttcgggctccgaaactacacgcgaaacgggacaactcaacaaacggcgaaaataaagccctattaaagacctctaagcgtgccactagatagatctcgagatttgggaaattttagaagttgaacggagtcaaacggaattacggttgggaagatattgaatttctaagattattggatttttggtctaaaggaaaaggatttaattaaatcctttttgaaaaagaaaagaaaagaaagaacagagggatggaaattagacttttcctcgggtggctagggcgcggtccaaggtaaa

SEQ ID NO: 34763 - DNA, 1501 bp, Oryza sativa
ccatgtacaaatatttggctagagccattaggggtgggcatcggtccgatcgaaaattttggtctcggtcttcggcctttcggttagtttggtcattgaaaagtgaagaccgaattttaacgtaaaaatgtcaagaccgaaaaattcattattggtctcggtccagaccaaaattcaacaatagtttcatatatgcgatcatagaaattttcaacacaaaaatcacaaaaataatactttcttcgtttcacaatgtaagtcattctagcatttcctacattcatattgttgttaatgaatctagacattaacaacaatatgaatatgggaaatgctaaaataacttacattgtgaaacggagggagtagtacgtatgagtaaagactttttttttcatgtctagaaggaatagagatgtgaaaaattagaatttaaccctattgaactcagtggatcgtaagttgcatttggacatttttttttgttaatttggtcttttcggttgaccaatgagactagccgaattgaccaaactaaattcggcatttcactacttaggaccgaattgctcggtcttgatcttgtcttttcggtccggtctttttctgcccacccataagagctacagttgtagcaaggttcttttggaataaattagatccacaccaattttacattgctccattaacttgacaacaccatcaattttacattgctccgcatgacttaaccatctataagtctaacaccatcattgttataaccgtatacacatgacgatcacttaccctacactggctatgcttcgggagagggttgggaagcctaactccctagcgcgcaaaacaaagcatcgtttagtgcataattaattaagtattagctaaaatattaaaaatagattaatattattttctaaagtaatgtccatatagaaaatttttgtaaaatatgcacgtttaacaatttgaaaagtgtgcgtgcgaaaaatgagaaatgtgagttaggaatgtagagataagagctcaaccacctttaagggaaaaaatgaattttatatttttgcaaatagaaaagaaacatcgaatgaaatctgcagtatttcgaattcgaaagatttcatttcatacgcattttgtcttttttcttcacccccaacaacacgcatccggctggctcgatctcgacacaccaaccaaaaatcgaatcgcgttcgagccatcgagccgacaaggcgacaacagccacaacgcctcactccccccaccccacgcgctccgacgagctccgatccgccgcccacctcgccgcccgccggcgatgagcaccgcctccggcgacggcggggacggcggcggcggcggggatggcgcctcgtcggccgcggggggcggcgggaggcggatcccgcccgcctcgtccatgccgtgggtccgcaacctccgccgcttcgtcggcacgggcgccggcctcggatccgaggccttgatgggtcagtgc

SEQ ID NO: 34764 - DNA, 1501 bp, Oryza sativa
taaatctaatactaacattccctttgctgtcttggtaacttatgaagttttcaggctgactcaaggttttattttttataaattcactaattggccatttttctcctgctctttcttcagagtctattattaaagggctcatgaattttattcctttagaatgcattttttctatcacatcatttacattgattttgtatttggaggcacttctattagtcaatcttcctataaattctatacttattaataaatttgttcccttaaactcttcgtatccttttgtttggaaaccaaaactcattttatctatgaattcatttacaggcatcattaaatcaggcgctatataggttatcaacatattttcattcatatctccttctagatagcctaaagatgctttgtttattgtgtcccatcttttatctaataaggttattagcactttagctcctaatttctttcttgtcattcctttgattcctattatgtacataccttggtgaatatacttatatcctgaatattttaaactattttcaaattctttagctactatttttaattctactggctttgttagaacacttaattctacttctctagatattctataaagcccattcttattctcaaaaaatcccatgcagtatacttgttgaggccttattgcccttaaagtatctcgttgatatctttcgagctgcttatctacttgtgcaacatctttcagctcatctatgtcatcatatttgcctttttgtttatcagaacagttatcatctctgcttgctattcttctaaagagactcctagatatgtccatttttcagaattaatggcttgtgaagatgagactatgccagatgaagccaaaactatttccttacctttactagagttgattttgtctagtaattctttaatataatcactattctgtgaaattttattttgccttatcttataatcttctaataattctaatgtagtatttagcttattattaagaaaagaatattgttctacaaattgcttttgttctttatatatatcttctaacttttgctctaaatcttcttgtctcttactccaatttatatagaaattatatattaaatctacaattaaatttagttggctattattagagtgccaactatgttcttcagtatggcttagtctacaccttatgtcgatattatctttggtatttattaactttccaatattagcttctaaatttagcttctctatgattaccaggctctgataccacacttatgcttcagacaatatacaccacacctatgcttcagacaaacctatgcttcagacaatatacactgttcaaaacactatttattcggctgaatactattcagtttactgtttattcggctgattactattcaaaaacactattcagtttactgtttaaattactgttcaatactgttcacttcgagagatattttaactttaggatctttgcagg

SEQ ID NO: 34765 - DNA, 1501 bp, Oryza sativa
tatacacaatacgagttcagtagaagtagaaagcacggaaccattcattcctctccgatgatccagccaagcagtaagatgaagcatcacacctgacagcaacccctcttatttttcgtaaaattatgcaaccactcttaattttgatgagaaattttcatttacctttatactagtatatactgtagtaacatacaaaaacaagaactcccttaatttttaaaagagtgttgttaccatcctgcgttttgtaccgtgaggtacaggtaccgcgcagtaccaaaactaatccagccgttgattaagcgggggtaggatcggaatagagaaggaacagacaaacccgatgtggcggcgcggcagagaggtgaacaaggcgaagcggcagagcatgattcggcggcatggtggagcccgacgcggcgacgcggctgagcatgaagcagcggcgtgcatgggccacctggtctccatgatcgagttcggcaaggtgttcgccgcccgcggcctcgccgtcaccgtcgtcgtcgtcgacccaccatacagcaacaccggtgcaacgggggctttcctcaccggcgtcaccgcggccaacccggccatgacgttccaccgtctgccgaaggtggaggtgccgccagtggcgtccaagcaccatgagttgcttaccttcgaggtcacccgcctctccaaccccagcctccgcgacttcctcgccggcgccttaagtcaaattccgcggctgagcacgacgcggcggcgcggcggagcccgacggtggcgcggcggcgcggcagagagctgaacgcggcggcgcagagggcattttgcgatgcggtgcagatcgtgctaatgttcaaagactaaactacccttccacctctactgccaaagcggtactgcgccaaggagaaaaatggtaccgcgaggtaccatgcaatcctagccgttagatcaattcgaacgaacggtccagatttcgtacctcggtggtacctcgggggggggggggtgctggacgattaaaaaaactatttttaaaaaccatcctacaactaccaaactaccacatgggttgttatatatgcacgtggcaccatcttgccagctccgtgtgcaccggccgccgggggcctgtctaggcctccgcctccacgcaccttgtcgcgtggccaggcctctccaccgcccgtgcttcgggaaacagattcacagagagatggggaggaagatgagtggaaatagaagagggtgaaggaagaggagaaggggtaatttagtaaaaaaaaatgtagaaaataggtttaaagggttagtagtgacatatgttaaagaaaaaagtctgacttactcccctgaactattgggtgagtatgaattaccctgataaaccctaagactagacatctttcatcctcaactattaataccgtatccacccagcagttttgcaggcgattttggtcctacatggcaccaacatggcaatccaattaggcaa

SEQ ID NO: 34766 - DNA, 1501 bp, Oryza sativa
tttgtttgataaagatattagattttacttattaactattgcttatccttttcactcaggcttctgttggttatttgtttctctttatatgaaaggcatataatgacattcttgagagcaagcatgtgtggctttctggtttgtacatgcaggaagaacacttcttttctttgtttttttagcacttctgttcagggtgaagacatcctttggagcaagcattggtgttggatcttatatgattgaatttttgactgatacttctaccttttaactgagacatgtctactcattttactgcttatgtgattaaatcattagacgtgcatggatagttcttgtcagatctgtcaatcttgtgaactaattatgttcagatgggcaagcgattaattatgtgtctgtgtgctgatgagtatgattaattgtgtgtatatgtgctgatgagtatgattaattcgtgtatatcagtatatgtgatgttgagtagatgcatatggccatatgggataacttgtggtgatgctttcccggtcctaaaccatatagaggttttaggagagggattaggagaagcaaggggattcatcccccacagggtttgagtgagacgggagggattccctttggggtaaaacccaataaactgaacaaggccttcctgtgatacagcttgaaccacaataccttgggttttgtgtaatttactcttgagcaaatatcatataaccctaggttttggaaaactagtttcacagaaccacgtgttttgaagttttttttccacgaaacatgcgacttggagctcccgacttactcctactctctccgtcccaaaaaaagacaaactctggttttcgtgcccaacgtttgaccgtccgtcttatttgaaaaatttatgaaaaaaattaaaaagacaaatcacgcataaaatattaatcatgttttatcatctaataataatgaaaatacgaattataaaaaaatttcatataagacggacagtcaaagttggacacggaaacccagggttaacggtagagtaacagtggtgggttaagcggggaacataacatatgcacacaaacttcctgtggacactccatccacaccaactagctaatatcatagaaagttctaggaaaaattggacacatacttccaatagtattacacctatgtgtgaaatcttatcttcaaattcattatattttagctgtaacaaaaaagacaaaattctgacatatttttaccctttaaactgtcagatttttcaccttttcgctacggctaaaatataataaattagaatatgagacttttcagatatgtgtagcacaattaggagtaaatgtccatttttttctagaagttttcgtgacatttgctagttggtgtgcatggagtgtgcgcgggatgtttgtgtgcatagaatattttctatgtcagcgttacggataaggtataccctctacctctggatatatgccgtatactgata

SEQ ID NO: 34767 - DNA, 1501 bp, Oryza sativa
ctccgccaccggcgcgcgcccggagcacgccgcggcgacgagcaccgcggcggcgacggcggccaacgaggaagccttcatctttattgcttttgtttcgcttgatttgctactacttctttggaaatgaatttaattaagctaaaatgcatcaggtgtaaatatatttatatatatgcatgaattttgcatgaaagtggtagggtccaaacaagtgtgcggctcagcaaacagttgttctactttgtgcttgtacctcgcactgcctctgtttctagtttcctccacaacatccagtaattaggacatatgatcctagcctgttcacaacgaatttcaataatgacatgaacaatggtagttatactgctttgtgataaaaaaataataggtgtcatgtacattgacacattgccaatgccgtgtacactgtatagtggtatctcctctgttttattcttctattgatagacgcacaataatgcatagtacttcatatagtaattctatatgctagcgaactgacactgacaagtgggtcccaaccataacctaagttaacaatacaatggggcccaactgtcattgtcattaacgccaagaggtggagcttcttcaggttgatgtcacagggggggaaagagcggccaccttcctcaccgccggcctcgcgagcagccgctcccaccatgcttttgttggaattaatgaatgggccttagcccactcgaagattaattctttggaaaatcacaaaagcccacctcatgggatggcatgcatgtggagtttagtaccaccttgcttattctaggagagggggacctccttaaaagggaggatgccctcctagccacttgaagcatgtgtggtggagagaagaggggaaacacgcgcgcgcgctcgctcgcctcgcctcgcctggcctggcctggcagggcagggcagggcagggcaggcggcgcgcgtgcacgacgtacgcgtcgaatggtccgaaaaattggctcctcacccttgcgcagatgcagtctagggtttgcctcctactctgtactgcgccgtcgctcgtagactactccatcccgctcgccggcgtgcacctgcgatcgggagagcaggtctccggaacctctgcctttgacgtcctgcaccgggagaaggcggcaataaggtttttgggaagcgcttcgcgcgactgctccctgttcgttcgcgacggctcgccttcctcttcgctcgcgtgtttcgtgccttcgtagacacctgcgaaaaatttcgaccaagcagccggtcttttcgtcaccttggtacgtgttcaatatgttgcgcatatttgatctgttcatgttattctgcgtagtttacatgtgtagatctaatgatgcgttcatgctagttttcatctgtaatgtcatgatttatttatggaataaattaaatccttatatgcccataatctcaacaatccaaaaaccttattataggcactgtgattttacta

SEQ ID NO: 34768 - DNA, 1501 bp, Oryza sativa
tcctggcgatcagacggggcgcgcttgacgccggcaaccttggcggaggcggcggtggtgtcgccgggcctcgcggccggcttcttcttcgccggcggcttctggccgtcggcggcggtggcggcattgggcttagaggccttgttgtcctcgggtggatcgttctcatggctcttcttgaaagacttggagcggaaggcgaggaggaaggagcgagcttcgtcagagatgctgcggcggccggcgacataggaggcaacgagaggaaggctttgaagctcggatattacctgcttcagatcatggtctaccttagcaggcaataaccccggcttgccggcggcggcgaccgccacgccgttgagctcggcgagcttcttctttttcttcttcttaggctcgccggcaacgccgcctgcggcggcagcggcggcggcgtcagcgggttcctcgcgctcgcgcttgcgggcggctgccttcttcggcttggtcgccttcttcggcgccgcggcggcggtggcggcgtccgtgggcgcgccgccgtcgccgacctgcccggcggcggcgggaggaagcgcgagcggggtgggtggcgcggacagcagcggcggtggagtgcgcctctgcagcaagaactcctcgtcggcggcgagggtgctgctggggagcggcggcgtcgggggatcggaagggaaccccggcgggacgtcgtcgagagcgggggccatgggcgccgccgggaaggcgtccggcatggacggcggcggcggggcgcgcgcgtcgtcgcggcgcttgagcaggtactggtccttcttcttggccctgggcttcatcgccgccgcgctgggcatgatcttctccatgagcctcgccgccgtgctggccgcgctgcccttccggcggcggccgccgggattctccgccgccttcttgcggcccttcgccggacgacctgcaaacgcatcgtagccacacatcaagaccaagtcaacgcaaatggttttccatttttatatatatgaaatataaaacaacaataaactaatttaaatattgtgattgagctagtggaaattatatcaacattaaaatagacgagtgtttttggatttgaaagaaataggatttttggaagaaaatgcaaagtactatactagtataataaaaatgaaaagaatatatgtactcgtatatactgtacattacaatcctgcagaagttgtatttgaaatatataaaacaacaataaactaatttaactaatgatattgtgattgagttaaaatagtcggggtttttttttgttttgaaagaaattggatttttggaaggaagaaaaatgtaaaatacaaaataatacaagtataataaaaatgagaagaatatgtacagtcgtatatatactgtacagtacaatacctgcaggagttgtatttgaagactcgccctgatcatcctggggttcctcctgtgttttccggtcccaccaaacacgtctctt

SEQ ID NO: 34769 - DNA, 1088 bp, Oryza sativa
tctccagcccaaaattgcaagagtattagctttgggatcattcggaacagaattcctgagtattaacagtatgaccaaaaatttcgtgattttagcctttggcttgtaattttgtgagcatagcctcgaacaaactttcatgactactaaccttttccctggtccaaaaaatttatgagtactagccttgggatcaatgtgcacaaatttgtgaatattaaccttatgaataaaaactccatgttttttaacttttggcctaaaatttcatgagttatagtcttcagccaaaaatcgtttgtatcaacttttggagaaaataaacttcaatatttttctccttttcaaaatttcatgagtattagcatgggatctttgggtacaaaattcattaatattaaccttaaaaccaattacgtgattttctagccttcagtctatatttccgtgcctcggaccaaactttcttgagtatgaaaggttggcaaaaaaaaggcacgaatatttctattccaacctaaaattttatgagtattagccttggaatcattgtgcataaaaaaatccgtaatttttagctttcagtccaaattttcatgaactatagctctctacaattcatgagtatacctttagaaaaaaaagcttcaatatttttttttcaaaattcacaagtattagcaatttagcattggtatcgttgggcagaatattcgtgaatattagttttacgtgttagcgttcattgaaaattgatgggtattaccctttaataaaaaaccattaatatttgaaacattagctttgagatcgttgtcctcaaattcgaaaatattaaccttatgactatgggcttttatgggcctgaatattttgaatcgtaccgttagtagtcgtttttttcgattttggggtaggtgggccatgatttattgactttgggccgttagttgatgttagaaggaccgttcatcttctttgagccattagcgggctaaattttctttatgacttattcggttattaatcccaccatgtgaaaggaatcgagagggattaaccgaacaaggttttcaacactttcgcaa

SEQ ID NO: 34770 - DNA, 1501 bp, Oryza sativa
attcatgatgcgcatagtatgctactggttatgttaagatcactctacactgtttatgccatggttattgctttaacattttggattaaaatatgccgattcatgactatatttccaacaaatagatgaagcaaaagagcatggttgaagaaattatgttcctcagatgttttttgctattcgattgggaaatggataatagtgccacctcctgagtatttctttgagaaaaaaagtctattttacaaccctaaaaactttcactcgcaccgagttgttaaatcctgaactttagccaagtggcatactccccttttttttacatggcatactaaaatttgatacaaatatgcaaaattattagtcgtgcttaaagcacctaatgataaaacaagtcatgtcgaaataaatgatactccctccgtttcaagttataagacgttttgattttggtcaaagtcaaactattttaagtttgactaattttatggaaaaaaattgtaatatttttaatccaagactaatatattatgaaagtttattcaattatatatttaatgaaactatgctgatgttgtaaatattactatatttttctatagagttagtcaaatttagagtaacctaaaacggagcgagtatttacatagttcttttaataaaataaatgaccaaatgtgaggtttaaaagtcaacaactttatatttttcaaaaccgagctagtaagtagcccaacaatgtcacacaatccgtgtacagtacaatggcacttgtttagaaggtaatccaacaatcggaaacgatttagtaccatgaggtactggtaccttgaggtacttcttgttggaccggagcaaatctcgttgcataaaccaccctaattgtcactctagttttgatattctaccctataacctatttcgttgcaaaagcccacccaccgtacacacgtgagtagcttatttgctccatttcttctgacatggattcgcagtgaactgtataagccatgttgtgttcatctaatatggctatgaggtgagtttgacttgagctcgttcttaggtcctgtttgggagagcttaagattctgagaatctactggttgatagacagcttatgagaatatggagaagctactaaacatagcttctgaattttagtttattttttaagtagaataatagattctcaaaatctatgtgacaatctcgattgtttggggagagtttttgattctgggagaaactgcacctactagaaactccccaaaacagatccttatactagttcgaagtggcaagaagggtggaatgacaatcaatggcgttgatcggcagcgaatccatattgaaagaaatgggccaaatcaactaataatgtgtatggagggagtaattttggcctttggttgcctgagcttttgcaacaaaatgggttacggagtagaatgtttaaaacgagagtgacaacggaggaggtggtttatacgatttggtc

SEQ ID NO: 34771 - DNA, 1501 bp, Oryza sativa
ttcaaggttctcgcctggagatctcaccttccacctcactacagttacgtgttcaactgtgaggtaaagaggttacatcatatggtcaccagaaagaagagatctcagaagctctgtacctgaccatctcattgttctctgaaactgatgcataatgtaattatcttaaattttaatataaatctgagcatttgtgaaatagtttgacctactgtctgagcaaatgcgtagtccaaactcgtatgtaaaatgtgctatttgtaagagattgtcaaactgaagtctatcagcatctactaacattctatatttgaaatctgaacatgtcaacattcgtgagatgaaaatacattcattgcttctggcatgaactaactgctcctatcttaataaaagatacacaaagtatcaagtgctgctgttgacttctgaccttttttttttttttttgaaaccgaagactgcatttgctggtgttatattaagtaggatataaattaattgcttgttgacttctgaccattcagtgcttgttgtaatttgcaagatacacaaagtatcctaatccttaatagaagacaatgcaaacactttgtagcagtatcagaagctataccagctatggataacacgttggtggcaacgtcagctagggttcttccaacaatgttggcaccggatggcgatgcctccttgctgtctgtgtctgctcttgatccaggtacttatttttcaaggatatgtagcataacatgaactttttattgtcccagataagtgtattgatcaacgaattgaatttcagaaaagttggcttccgctcaaatggttagccataaatctattgttgaagaaatgtagtacctagtaaactgtttaaggagataacaaccggagttggaaaaacaatttgctgaatgtcacttttccggcctctttgaatcgcaggattgagaaaatgtaggaataggaaaaacataggattttgataggaatgtaagtgcaaaacagatgattgcaaaacacataaatggccgtttgattggaccacaggcaaaacacaggaattagaggagagataaatactcaaagaaaagtttccatgaaaattcctccaaaacttgcatggtattaggcatttcataggaatttcataggattctataagatccatttctttgattcaaaggactatataggaaaaattcctataggaatgggatcctctaaaattgctatgaatttcttttgaatcaaagggggcctaaatcagcaaatagcttggcagagtgataacatggtgctagtgtgctacaagcgacaacaagatcatcagatttttgtttgtctccattgtagatggtgctgactgatcaactgaatctgtacaattctcttgctttcgttgtctccaccacgtggtcagcctcgtaccgttatattaatgcaaactgtagagagaaactgacactttgaactcaaaacagttcacactgaaaaa

SEQ ID NO: 34772 - DNA, 340 bp, Oryza sativa
aaaaaacccacgaggggtcggggtgcctcggccctcggggccgaggggggtccggcccgaccccctcggggggactaagaggagggcgaacgcatcaccctcgggcccgacgtccctcggggccacgtgtgcgattgtgtctgcctcaaacctctagtcatgatactcctgatcccatgtcaccgacagaccccatgtccgatagtcgatttatttgtgttgcaataacatctatttctttgttgattttattgggggtggattagagttctccctatgctgattttatttggatggatttgagtccgatttgactaattgaagttccccctcttccagt

SEQ ID NO: 34773 - DNA, 1501 bp, Oryza sativa
gaaaaacgagccaattttaaatgttaaagagaggttatatacctagttttgtagttgagagagatgagaataagactcatcacgtcctccgcgacaagcccgtgccgtccgatgccccccgactcggcttttctttttctcccctcaaatcttaatgaaattcggtcaccggtctttggctgacccggcaaaaaaaaaaaaaaagagagagataataagactcggcccatcgatgagggatgagcaatggactttctcataggaaaaggaccacgcgcaaactccgttcggaccagcccatctaccagcgggccctccttcccacttcgccggcgttggcgagctgctcgtcggcgggcggcggacggcggcggcgctccggtggtgggcgccctagtaggctagtgctctgcctccaactcccctgatttggcagcgattgatgccgtccgccatgaagccgagctcggccggcggtggcaagtggccgcaatagccctggctggatctggagacgtcggcaacaatggcggcgccggacggcgatgccactcctccgtcctgctcgtctaattggcgatccaaaggttacttaattttcaaggatttatagcatattctgaatattttatttttcccatagcagtcaactattgatctccaaaaggaatttcagaattgcggctaccataattcgttgaagaaatgtagctaaaaaaaaaaaagctctctacctttttcagtcaaaaaaaaaatgtagctaatcagctgattaaggatgagacagcaaccgcagttcgaaaaactattggtcaagccaacaaaacaaaaatgtattttgtatttgggcataacagttgtgctactactactagacaacattatctgatgatcctggcttggaataggatgggaaattttcaacagttgggaaaattggttggtaccaatggttttaagaagaagcatcaatatattcgttcctattacgtcaaaacaatgaaggaatatgactgcttctggcaatactcaaatgcagaccaataggcatcactactgctatctttgccagctgtgctatcagcagtttccatttttatcagttttaacatgctggctttcataataaaatggtttaaacatgtattttcctcatgtttgtcaggtcattttgtctagtatgcagactgttcaactaaaaatacacgtgcttgtgaaacttgaccagagatctatggtgctgaactaaacttgtagaatttcctttgctgctgtcgtcgtctcagctatgtggtcaatcttcgacggttatattaatccaaaccgcagggaaaaatacaaacttgaattcaaacagtttacattcaaaagcatatctaggttcagacacattaaaaggtatacggtatatctatgttctgaaatgcatctctctttatggagacgtggagctactcgagtttgacgctgccttaatctctattcctattacagattttca

SEQ ID NO: 34774 - DNA, 1501 bp, Oryza sativa
cctattgcaatcttttccacataataaaccatcatcatccacaaaaaggcatgataccattccccaaacaccatacatactgcataatcatcctaatttattccttccacaatatatactccggacccagccaaaagcaccatgtagatcttgtgcctacaaagattcttgcaaaaagaaacttaaaagccaaaatcccatgagtactacatacgaaaatctccaacccagattaagcttcaaaacggaacaaactttatcctgctttgggcaagacatcctcgatcttgtttggcaaaagtttaaggagagacaaatgaaaatattccttggactccaagattatttctttgatctcttagaagggagagaaagaaacccagccatacgagtaatcatatatatgctccctctcttaagactagatgatcaggcaatttctgacccatcctatagattcctggttctcaaagctgagataaatcttcaaagattccggaacctacccacatacaaccatgaagaaatatctctccaaaccattatagatcatggtcttgtgaattccatatatgcaaccctcgatcagatccttcatctgatttaggaaacgctgtgaaagatgtatgcaggagacttggacatggaagatacaggattatcttctcctcaataccaccaaaattcacaccacctgttcgtccagcaattcattatatatatatcatgaagggacaatttaattttcaagaagacggtcctagcaaactatcggatgaagaggaagaaatatatacaacagttgctaatcatgaaaattggagattattttctgaagctgcagaaattgaagaagctatcaccacagattatgaatatcagctggttttccaaaacaagatcacaaggatttttatcagcaaattctacaaccaaagttatgaatacttcaagggagcagggcgcataattaaaccggattttggaaatgaatgctccaagaaaagttactacagaagcctggctcagtggtttcagaaaacagagccatcagagattgacacggtgcaatcagcaccaatgataatcaacgaagataatgaataaagatcttgtcatccccgacaaagatcactattcaagataaggaatctacactattccagataagtatggatcttggtggtcatgggcagccagatgaatagaattctttaagctaaatatgtttttcaatatatattgataatagaatatcaataatttgggcgtggaagaagaaaaaaaacgaagatttcagaagactactcaaggaggaatccagaagaaggaatccagaaggacaccctataagcataaaggaacaatatagggtgcggtgaatgacatatcactgtgaagagtaaaactttcggtgaaaaggcctcgactttagccagctcccgtgaagatacagtagcgaagagataagcaggaggcacaggcgacgccatccctggcc

SEQ ID NO: 34775 - DNA, 1501 bp, Oryza sativa
agagtagtggcttcctcgaattgcttctgctgttcagcagtaagaactccttcaggtttgccagtactcacccagaagcatttcatagctgtcagccacagagtgaccctgatctgccatctcttaaaatgcacaccggtgaatttatccggcctcagtgcatcggcaaaaccagccatagtaaaatcacagtgcctataataaggtttttggattgttgagattatgggcatataaggatttaatttattccataaataaatcatgacattacagatgaaaactagcatgaacgcatcattagatctacacatgtaaactacgcagaataacatgaacagatcaaatatgcgcaacatattgaacacgtaccaaggtgacgaaaagaccggctgcttggtcgaaatttttcgcaggtgtctacgaaggcacgaaacacgcgagcgaagaggaaggcgagccgtcgcgaacgaacagggagcagtcgcgcgaagcgcttcccaaaaaccttattgccgccttctcccggtgcaggacgtcaaaggcagaggttccggagacctgctctcccgatcgcaggtgcacgccggcgagcgggatggagtagtctacgagcgacggcgcagtacagagtaggaggcaaaccctagactgcatctgcgcaagggtgaggagccaatttttcggaccattcgacgcgtacgtcgtgcacgcgcgccgcctgccctgccctgccctgccctgccaggccaggccaggcgaggcgaggcgagcgagcgcgcgcgcgtgtttcccctcttctctccaccacacatgcttcaagtggctaggagggcatcctcccttttaaggaggtccccctctcctagaataagcaaggtggtactaaactccacatgcatgccatcccatgaggtgggcttttgtgattttccaaagaattaatcttcgagtgggctaaggcccattcattaattccaacaaaagcatggtgggagcggctgctcgcgaggccggcggtgaggaaggtggccgctctttccccccctgtgacatcaacctgaagaagctccacctcttggcgttaatgacaatgacagttgggccccattgtattgttaacttaggttatggttgggacccacttgtcagtgtcagttcgctagcatatagaattactatatgaagtactatgcattattgtgcgtctatcaatagaagaataaaacagaggagataccactatacagtgtacacggcattggcaatgtgtcaatgtacatgacacctattatttttttatcacaaagcagtataactaccattgttcatgtcattattgaaattcgttgtgaacaggctaggatcatatgtcctaattactggatgttgtggaggaaactagaaacagaggcagtgcgaggtacaagcacaaagtagaacaactgtttgctgagccgcacacttgtttggaccctaccactttcatgcaaaattcatg

SEQ ID NO: 34776 - DNA, 1501 bp, Oryza sativa
ttatagaatgcttgcatactgttggcagctcatttgtcctttttttcctgttatgtatttggaaggtgttgactgaagtcacagcatttggtatgagaagggactcgaagattcacccctaaaactttattcaagtataaggtaggtattgaaaagttcattaatgactgctaattgttatctgaccacatctttttagaggttttactttccttctaactatatagcagataataactgatttttgctactatagtggttgaaaaactcagtttgccacctggccaattgtccgtttatgtttctttcctgccattttctctgtctagcacaatttaatacgtagattctcctccctctttttcccgtatgctatatagatttcaccgttagtatttactagtttcagtttcagctgtccaggtttcccccaagcatttttcccaaactatttacgtgcaacatattaaatgtttcctctgttttgcgtttatgtcatcttaggtccctctttttcaaattagaccacagtatctaatgatgttctattcgagaatgaacagcttgtaatcacaacttcaaacgaacttgatcctcttgtgtcctttattctttgaatttcttggtcattgctgcttatagttcctatggatttttattgaagttcctgaaaatgatgagatttattgaagtactcgtttctatgtatatttcgcatgtggacatgttgggcttttgttcaaggtggtcaagcactgaagctgctggatgtcagtaggtcatggtatggactctctatacactttattgaatagcttcatgcctgtatatccattggtttctattcatcatatgtcaatactctagctgctgaaggccatgtgtggtcctgatatcttgtatatgcaagtgaatgttctcactattagcttattttttattcttattgtaatccaatctgcagtagtgtggcacagcatagctgggtgaattatgtataggaagttcgcatgttatgagatgtccttctgttatctgggcccatgatattggttcagaatagggcccccaaaattctgggtattttattttcaagctaggtgcgctgttgtttgttttcaagcattgtgcgtatgcactatgcactcttgctgtactgtttacgacagcagcttttaacgtgttgaaattacacattataaggtcttggttggttagttgatcagtttgttagagtacctatatggaccttttcagctagactatatcatgcttaggcacaaacccaagcaaaacaaatatgcaccgtttgtctaatatatgttgtataatagttggtacgaggtaccttgtcctagtgcttattgtttttgggtagtaggatgaacacgattgattttcatcagctcataaaatatgtccgtgtcccaatgcttcaacgattcatcccaacgatttgtttatttgtcttgtttctaggcttttatgcttttattcttgt

SEQ ID NO: 34777 - DNA, 1501 bp, Oryza sativa
gcgcgtgcgcgccgccgccgccgccgccgtagggcgagccgtggtggtacgccagcgttggcgactgcgccgcgccgcggcggccgccgctgtggcgcccggccgacgggtacgcggtgatcgcgctgagctggaggcccttcccgctgacatgccgcgtcgacgacgcgccgcgggcgccggcggcggacgccggctcggcggcttcgtcggtgatctggtacgatatgtggagcacgccgcacttccggccgctgacggggcggcgcacgtggtagctgaggtgcctgtgctcgccgccctcgggcgccgcggcgacgaggtccttgaccgggacgaacacctccccgacgtcgctgtcgccgaagacgcgctcggcgcggagcagcacgtgcagcgcgatggcgcgcatgtcggcgccggcgtcggggatggggaagcggagcggcgcgtgccacatggggctccggccgccctcccggtcggcgtgcgtccggtgcgtcggcacccgcgggtcgccgccggagatggacgccacggcgtacacgcgcatcttggagaacatcgtcaccttcttgaggttcttggccgagaccagcgtcacctccagcacccggcgcgccatcgccgccgcggcgaacagccggccggtcactgacggcgaccgatcaaatgaagccgcaaatgattttttctctcgcaagtgttcacgttcttggattaaggaaggacgatgcacgcagggtggttaattgcaaacaaggttaattaagatttgagggcttaatttgtgtttacgaggtgtaattaatttgtgcggcgagccgttcatgtcggtggcatatagtgtcatgggtatttttagtagtagaggtttggagagcacaaaggtcatttctctgttggtttcacctccattgctgtggcaatgtgactggatttgaattctacttgaggatatgtgttcaatctttttaaaacataggcagaatttttgcctcattttgtttgatagagaagagatacacaacaccaacaaagaaagggctccctctcaaacactaatctatttaaaactcaaaagcacctcaagcacaccacataaactacaatgatatatgatatatgttcatgtttcacttttaggtcatgtttggaacagaggaatggaaaacacataaataggaaaaaagaacataggaaaacaatggaattcaaaacacaggaagatacattttggactgtttggatcacatgaaaaaattgacagagaaacacagatgcaagcatgaagcaaaggaaattttcctttagatcaaagtagatgttttttatttcctatgaaaatggaggaattactacctttccaaaggaaaccaacaaccccattcatttgttccaactaacttcataggaaaaatttccaaagtattataaacgtaaaaaaaaatccttcaaaaatcgttcctaacatggacttagaggttgcgattatttagaa

SEQ ID NO: 34778 - DNA, 372 bp, Oryza sativa
caaccaccagtaattccctgttactgctacattagggcaagacgacaagttttacagcggatgtgattaccacatctaattttagctatgtcatctataaatttattaagatgtaacatgcatattatgttacttttagtacacaaatcctaacattttcttgaattggtccactctcacactattccactttctttttgcctcttgcatgagagttgggttatgttctcttttcacttcccttcgatctccacctcatcatctaatttaatgtgacacttttaggggtaacacataagtccttacccttaaagtcccctatctaactactttgctctttatttatttatttgtttgtttatttgtttcagg

SEQ ID NO: 34779 - DNA, 1501 bp, Oryza sativa
agcaggaggatgtgaaggtgatgaatatgattctcttccaggtttgcatactggagtggagtactagcatagaagacaggggagggccttcctctgctgtctgtcttatcattgccctcaattcccgaggcgatagcagttcatagtacatccccttttttctcatgtaggtgtggcaaattatggactttgcatgtgatgctgctgggttgcaagtgcaacccccatgcatatacatcttctgtgctttttctcgatgaaaagcatgtagaaattccgtttgattactcccttcggactgataatattagtcgttttggacaagggtgaagcaaactttagaatttttaactataaatatttaaaatatttatcttagaaatatgaaaaccatatgtatagattagtcttaaaaagtacttcaacaaaatcatatatttgttaatatttctatataaattataatagacaatagttgttaaagttactttttggagattgtgtccttatctataacgacaagtattatcaatccggagggaatacatttttagacaatagataaaatggtcgctgcatgtagctgtgtactcatagtttccctctgatcatatatattttagaattccgaccattaattttatattagaataaatttatgatatttaaatagtacttttcgaggtaaatctacataaatcatttcttttgttttcaaactaagcatatttgagaaactattgatggtcagaattttaaaaggttgattgaatcttttgctaagcatcaaatatttacgaccggttggagtaagatgtgtccttcagatctatttgaaacacatgaattgagaactgtttcctgcgaaaattcatgcgttccaaacagggtcgcaaaaaagaaaatgcgagtaccttgaacattcaaacaaaaccaggagagtgagaagataaaaggctagttattgttgtgaatgcattttcttgggcatctggagatgtggggaataaatacctcatcaataccattccctcctcccaaaaaacaaaaagagaaaaagaaaagaatacaaaagaaaaccaatagaattgttcccttttgctctctgatgctatttagtcatgtccctcctcagggccaaacattgccactttgttctgcccccccctctctctctctctctctctctctctctctctctctctctctctctctctcttcttggtgacccctttcactccctcaaatacttgcaccaatactagacactagcacaacattatattctctcttctcctcacttctgtcatcatctctctcagacttctctttctctctctgtctccagccatggcagctgctgaagaaggtccagagccactcaagtatcaggtaagcagtttagggttcttgcaatcttgttggcagatatgcagagctactggtcattcttctgcttgtaggaagatgctgatggtgttctttttgtctttggtttgtg

SEQ ID NO: 34780 - DNA, 1501 bp, Oryza sativa
ctcaggaccacgcgaggtgagcccggtccaccggctccctctctcctccccgcccgcgcgcgcgctctgggccgccttgttgggccgaccgacccatttagctcggccgagccgccccttttctctcgggccgcgccctagcctcccgagggaagtctaattttccccctccttttcttttcttttctttttcaaaaaaaggatttaagtaaatccttttcctttagaccaaaaatccaataatcttagaaattcaatatcttcccaaccgtaagtccatttgactccattcaacttccaaaattcctcaaatctcgagatctatttaatggcacgcttagaggtcattaatagggctttattttcgccgtttgttgagttgtcccgttttgcgtatagtttcggagcccgaagacccgcagtgcgaggatttcgaggatcaagctctagatctcgagcaaggcaagccacctttgaatatcttgagcctatatttcaacttaattatgttgcttgaaagattattatgcattgataggatcgcacttaatctgcttgtcccgtctgcaaggcagattgacggacctacctaatttgttgcatttgatccttcctttgttaattgttataccatgttcccttgtaaccacccagttgcgcctcggaaatcatgcactctgcacgagtatcgacggccgccttcaaacttaaaatctgaaaaacatcttgggtaaaacttgggttttataaaagacttggaaaacccgacacctgggtcggtgcttgcgaactaaatgaatttccaaaaccgcggaccggggaacgtaccgggtgtacggtttcccgctcttgcacctaaggaccgtttccttggaatttcatccgaacataagacaagtacgaccacatgggtggaatgggacacccctggctgagtaactagcttatcaggggagccttgatgccgagagacatgtgaattcatcggggtggtgtcggggaggacccctgggcttcctggcacagtatggtctgggacctaacctgttgttggtctgggacccctctcgtcggcatatggtaaacctgtgtcggctttggaaatgccttatcatgaaagcttggaggtctcccgacgtggctgatccccacgggctaggtgatccgggttagtaatgtcatgtgggtaaagtgtaccccctctgcagaggttaacaaactgttcgaacagccgtgcccacggtcatgggcggatgtgaggtgattcctagcgtagttttgtttgactactgcttgtgaaattgctgttgtggaaaggggatcgatgtttggaaaatctgcagctgatgggatcagctaggcccgggtggctgtttgaaagttgttggccgggtgccaatcttgatcaattctaaagaatgatatatttgcacatactccgaccggacgagacgcactgtctcatccgtgtcgtttgagaagcactcacttagttgttttc

SEQ ID NO: 34781 - DNA, 1501 bp, Oryza sativa; identical to SEQ ID NO: 31402

SEQ ID NO: 34782 - DNA, 240 bp, Oryza sativa
aaccactgtcaacacagcttcagcgacttaccatcacaaagtgcccattgctagcagactggttggaagtccaaatttcgcaccagcaatgccaggtatagatctctatcaccatctacgtacaaatactttatgctttaagttttattagtgcatttgcagtactaggaccactgtttattttcttagttcctttttctgaattttttatttataataattaatgtcccttctctcagt

SEQ ID NO: 34783 - DNA, 1501 bp, Oryza sativa
agctaattaagctaacctcgcatcgcacacgccggggatcgcctactgacgtgactcgtaatccaccaagccactagtagctgtggctgttagatacgctttcaattttaatccctttatttacttaggctgtgtttggctcctgcagggttgggaattttaattaatttagcaaaatgaaacatactaccagttagcgcatgattaattaatttacagttatttttttaaaaaaatgaattaataaaattttgtaaaaaaaaacatacctttattagtttgaaaagtgtgcatgtgaaaaacgagataggtgagttgggaaaaagaacaaaacaactaagccttcaagcactagtgtatcttcctcatcatcactagtactttctccatctcaaaatataactccttatattccttatattttggaaggaagatagtagcatatattaaatcgccatatcggccggatatgaatgttgtgccggtggtgacgagcgcggatctgaggcgggatcggttaacatagggagtcatcccttaaagattattgcggtgatctaagctaagacttgtcaaaaccggctagtgtacctgacggagcgtgaggctcctcaccgggagaccgcgcaggcccccctttgccggttcggccgggggccctgggtgagattctaagctctcggtgtgtggaaggttcgcgagaatggaaacacacaagacacgggcgatgtatacaggttcgggccgctgagaagcgtcataccctactcctgtgttttggtggatctatgtatgaagaagctacaaaagagctggagaaccagagagctcttactctctccctctctgatcgttctggatccgaaaaatcccccttctaagtgggcaatgtcctccttttatacctcaaggggataccacatgcaccatctctctcttttttgtggggacttatcctatcttttcatcaacagacggagacttgtatggttgtcgtccgaatgaccttctgatgggacggcccatacctacctccacttccgccggaagcaggcgcgacgtgggaacatggctgtctgctgacgacatgaccagtgtcagaccggtcacaaatcggtcattcttgtccaccacgcgtcagtttatcaatctgcatgttcgcccctcttcatacaatgtcttgcttgtaatggttaggatgaagcctggtatatatctgaccgggaccaacgtgccatctccaggagctaacacgccggctccggctagggacgagtgcttggaggctctcatcctgacgggatggggcgaggcgtgcgttagaccgcctgtcgccacctaacccacgatctgatcggtctgtgactggtcactgaccggataaacgagcgcgctgcactgcgttacatgcggcgtgacgcgctcgtccaaaccgcaataaatgtggttaggtgagccccgctatgctcacctaccacatatacgcggcgcaaaacccaca

SEQ ID NO: 34784 - DNA, 1501 bp, Oryza sativa
aattcagtgagactgcctagggagggatcgatttttcggcatcaccagtgttaggggggaataatagcatggagaatcaagccacccaatgtatatatcttcaccatatgccttttagttttttttcactttctagatagtgctagagggatcacatggagatctaacacaagatttggacctgtatgaagatcagattaggtacacttctttttcattatgataatcaactactgcagggaaaaccggaggagggtccatcagggttttcaattttgaaatttctttattttctgaggggggccgaaattttggattttttggctgaaattatttgaaattttgactgattttgaatgaatttgaataaaatttgaccaaatttgcaaaaaaaaaaggggaaaattttgggtgagatatgagcttgccagtgggagacgaaatttcagaaatttcaaaacgaaatttcaaaccctagggtccatcaatgattattactaccttgttagacgttccacactcaaaataaagtgatgggggtagtatttctttaaagtggagatcatgaaaggggttaataattatttcatttccttattacccgaatattgagctaaaatttctgcagaggaatatcgctgaagaactgaagatgatctagctcgctcatgaataaatttgcatatttttttagaggacagcgcaatacctaatatatcacccacacatatactccttttttttttctctcttttgtatttttgtttaacttgagaatatgtcgataattgaaccttgagatgccgcagttttcagataaaagagaagaggaggcatgaaaagggtctctcctatcagaatcagcctatggagataagtttgagagggaaagaaagaaataaaggttccctttgcttgtattgacatcaaagaggctgaggtcaactaggcatcaaaaaaattggccaggaacaaaaacaaggtacatccatgtatctggccatgtaaaacacccaatgcattgcatgaaagaatgcacggtgagagcatttgtggcaatgtgcatgacatatgattgaaagcaaattgctagctgcaggattattcagataagtctttgcaatctcaggctatagctgctccatccataacctcactgaaaaaaagttactagagaagcaaagagaaaagggggagcaaaagaggggagataagtgacatcaaatcatgccttgttctgatcagtgagtgatccaaggagacggcataagtttgtttcctcatcagataatattgctctgtgcatggctttccctgcagtgcattgtttgagcacagttatgcttgtcatggtgtcatgttacatacattgtatcaatcaggggattctctacttttgcagggaagcatttcggtgtgccgtgccctggctacaatgccgacatttaattataaacatgcatggtacaaacgcacccatatacatcctattcctatgagc

SEQ ID NO: 34785 - DNA, 717 bp, Oryza sativa
ccccctcggggggactaagaggagggcgaacgcatcaccctcgggcccgacgtccctcgcgggtaccaggccacgtgtgcgattgtgtctgcctcaaacctctagtcatgatactcctgatcccatgtcaccgacagtagcccccggcgttatgccagggcgatcgccctctttaagggaaacggtcgggcgtgacgccactcctaagacctggtgacaggtgggaccggtctccacaattgggcagaaacccaacggtcacaaaccacgcacatcggcaatggtaactcggctgtcaacaatgagcggtctcttcaagactgccacattacttgagtagcacacgaatctggacatggcgattcgtttcgtctgaagatatggtaacgtcgcttcggtcggcaagcgtaattaacgcgcgcacgatatgatctatctcgactgccacaaccgcatatccacctcatgcgccgcaagcgggcgaatgggattagtggaagcgtgggcgcgggaaacgagggggcgaaatagtgggcgcgagaagcgaggagccgggcacagcgttggcaagagtataaaggcactgaggaagggatctgtttccttcctttcgccattattccccttgtcttcgccgcttgcgccctaactccttctttcctgtgccctaccttcgccacacgcgctcgctcttaatcttctcttcctccggcgcca

SEQ ID NO: 34786 - DNA, 401 bp, Oryza sativa
ccacgacatgaagagctatttaaatcaactcggcttggatcgcgccgaattctacaagtcccatatttcctttgtaacctgtgtttcccaccatataagcccatatcaaatggattaggactattacctgtaagggggctgaacagtctaaatctagtcttttgattacttgatgtcgtactacctagatccttgtaccaccgaaccccaataccctctatatccagcctaccaacaaaggcgcgccaagtaggggcacttgatactaatggttctactactatgccattaaacttcgtcgacaacaacgtcaacaccagctccagacaagcactctcagctttgattgtgctggcatggactcaaattggacgaaatcttatgcccggttcacaccacca

SEQ ID NO: 34787 - DNA, 1501 bp, Oryza sativa
agggtggccatttccatgcgcactatgctgaaaaccggctatggctgcggctaatccttgcaagatttgtgtctgaactgccattaagtgctgcatgttgttttccacatgaggtggggaagggaggcgttcttctccagaattgtgactagcagtgcggtgagagcggtgagactgttccatctctgcattacgggaagctgtgtgatgcgagcggttgctgcggcggggttgctcaacttctgcgttgcgggaagcagtacggtgcgaacggttgctgtggtgagaccgctcattagctgactcatgattttcttctggctcaactctaccttcttcaaaaccgaagcgggctggcgcacgagcagcacggcgggggcggctagccatctaaactcccagaagagggcggggtaagaatcagataagcacttaggagggcaaggagcaaagtaaatagcaactcagatagcacacactaggcataagctggatttttcaatcataaaaacacctaatacaacgggtgtggacaagtcacagagctacgccgagcttgactgtacgcacaccacctaggagaaccagactaccaaacaacacccacaacaaacacacgcacgcactacctcgccacgactccaaaagagttggcggcgaaacaaaagggcctaacacacggacggctgctgaagactgcctcctctactcctcgtccgtctggctgcctcctgtagtcggctcctcagtcgaagaaacgtcaatcggctgacgcgaagggaccggcggaacctgtcgagggccgatagcagcacgggccgctggcggtgggggagctgggtagtcgaatcggaacacggtggaagaaccaacaacacgcttccgcgcagtgcggataaagtgtgggccacggtgggaggaagcaactggggtgtgtccgggggtgtaggaggggctaactgggtgtgggtagggggagtacactggtgagtacggcgcacgtgagctgggggagcgcgggccactaggagtgcgagcagagccgcgggagctgtgggaggacaggtggctggcgtggcagaggcggcctgagtcccaagagacagtgtcaactgaggtgacaccctcctcggccagacgggcctccagagcggcgtagcggcgggcaagggagcggtaagtctcaaggagtaggtagtgctgagtggcctgagcctccgaaagctcaaccatgcgagtcagcactggctaagactcgctgtacggacaagggtacctggcgtctgcatggccagaaggaaggcgtggaagctgccggaaggcagagcccccgagacggtggctgtagtcgtgggccaagcgacgaagcgcagtccaggagaggtcctggtacgcgatctggagagtgggcctggccacagtaaagtggtgtgggcgaaggccggctccgtgtatacctccacgagggtaaaggtacacagagagctcacagcgaggggga

SEQ ID NO: 34788 - DNA, 1501 bp, Oryza sativa
accatcatccccgccgggatttcagcaatgccatgaagcaccggagtttcctatccaagaacggcggtgtctaccttgtctgctcctccggccggaccggagctgccgccgccgccgccgccggctgatcgccaccagcgggagcggcggcggctttgcctctccctgcacctccgaaacgccggagttgggatcgatacgaagcacatagcggaggcgccgcagagaacggcaggccacctcgccgcagctgagcggcggccgcccttctccggcggcggcggcgccgtctacggcggagacgacgtggcacgtcgtccaccgtccgatcaggcgcctacggcccagatgaatccgcgagatccctcgagggcaccctgagccactgacagcgtgggcccacatgtcagcgacagaatcgcggggtttcttcctccttttccctcgcgcgattcgaaaccaaaaacgaaaccctcgccgccggggccatcccaatcctcgcggcgagcggcggcggcggcggcggcggcggagggcaaccgattgtggccggtctatcctcgtcggctcgccattccttctcgccgcgccaggttcgatctgaccaattccccaagaatcgttcgacctgaatcgatcgacgccgcgtgttcctgccatttcggcgtgcttgattccctcaaaatggttttggtctagggatcgtgcttagctattggtggcggtgctcctctagcggcgggttctcgacggcagaatagtgcgttgtgagggagcctcggtttagttggttctggggatggaggacggcgccgcggggggcgatgtgtccgccgaccgtgtcatcgctgagttgctcgacatggggttcgagttcgacgagatcagccgagcgatcggtgcagtcggcacgcgctgcgccgatgtgctggagtttatgctgggtggttcaggcaatgggaaaatgaaaaaggcgagtagggaaacacgaagccgtagttgtgtctcatctaatgcagaagcacgcccgagtgatgatgggaacaaattggttaatcctaggaaaagattaaagcaatcgagcattaccgatcatcttgcatcgaataccggctgcagaaggggatcttgtggtgagaaagctagcacgtcatatccctgtttagcggcttccgatgatcctagagcgccagtggcagtcagtgctgatgtgtgttctgcattgaagcctgaatctcaatttttgcttgctaattcaagaagtgagtctgacctcggacacaaaattagtgctgttctgcggaaacactttggattttcctgtgtgaaaggattccaaaaggaagctttggatgcttggtttgctcacaaggattctcttgttctagcagcaacaggctcaggtattctttaaataaatgctttgctctttatctttttgagtaatttgggggcttcctccattgttatgcaactagcagttttgatgtgatggttgagt

SEQ ID NO: 34789 - DNA, 209 bp, Oryza sativa
gcaaaccactgtaaattctagcactataatcaatatatgtaaaaatgatgaagaaatgattaatgcattgtctgcctcagttggagagaccatagatttaagaaattctgcaatcctatgaaaaaaaaaattctgcaatgcctattttgactagaggttttcttttgacggatgacaggaatggacaaatgatcaagttgaaaatgaaa

SEQ ID NO: 34790 - DNA, 1501 bp, Oryza sativa
gtatgaagaggggcgaacatgcagattgataaactgacgcgtggtggacaagaatgaccgatttgtgaccggtctgacactggtcatgtcgtcagcagacagccatgttcccacgtcgcgcctgcttccggcggaagtggaggtaggtatgggccgtcccatcagaaggtcattcggacgacaaccatacaagtctccgtctgttgatgaaaagataggataagtccccacaaaaaagagagagatggtgcatgtggtatccccttgaggtataaaaggaggacattgcccacttagaagggggatttttcggatccagaacgatcagagagggagagagtaagagctctctggttctccagctcttttgtagcttcttcatacatagatccaccaaaacacaggagtagggtatgacgcttctcagcggcccgaacctgtatacatcgcccgtgtcttgtgtgtttccattctcgcgaaccttccacacaccgagagcttagaatctcacccagggcccccggccgaaccggcaaaggggggcctgcgcggtctcccggtgaggagcctcacgctccgtcaggtacactagccggttttgacaagtcttagcttagatcaccgcaataatctttaagggatgactccctatgttaaccgatcccgcctcagatccgcgctcgtcaccaccggcacaacattcatatccggccgatatggcgatttaatatatgctactatcttccttccaaaatataaggaatataaggagttatattttgagatggagaaagtactagtgatgatgaggaagatacactagtgcttgaaggcttagttgttttgttctttttcccaactcacctatctcgtttttcacatgcacacttttcaaactaataaaggtatgtttttttttacaaaattttattaattcatttttttaaaaaaataactgtaaattaattaatcatgcgctaactggtagtatgtttcattttgctaaattaattaaaattcccaaccctgcaggagccaaacacagcctaagtaaataaagggattaaaattgaaagcgtatctaacagccacagctactagtggcttggtggattacgagtcacgtcagtaggcgatccccggcgtgtgcgatgcgaggttagcttaattagctggtctgtccatgtcgtgccgtcgcggcgtcgccttcttcgccttggcaacggcatgcatgcctccgatcatccgtaaacctcacggcggccaccataccacacgtgcgtacgtacgtccacaccacgcccaacaccgacgacgtcgatcgagctccaatccatccacccccacccatggccgcgcgcttctcttagctggagtaattaaattaagtcgatctccccagcgcgcccccatgcaccaatggccgctcccacgcgccgcctcctcctcctcaaccacgaacccaccaccacccccgcttcgtcttcttcgagttcgaggc

SEQ ID NO: 34791 - DNA, 1501 bp, Oryza sativa
tcatctcgagaggatgatgtgtttcctataccactaaatataattaattctaattctcttttttcttatgaaataatatcacctcaattgctttcatttagatcaatttatctatggtgcaaattgtccatatatctcatgagccatgcatatgcatatcatcttcattttgtctagcttttttttagcacaatcacctcaactcatttttagcattcttttctcttatgaagcgacatcgcgatatcatttatatttcaacagttggatgttctatttagatgttattgtgtaaagcatgtgaaatcaaattgtcaatgtacaaatcaattctatattgtacataatgtttacatattattatataattttccgcataaatgcgtggggtttcatttagtatgtacgatgttcaagtgaaattgtttggtttgtaacaagaaagcatgattataaatatttttggtgtcaaacaaccggacatgtgaaaatattgacaataattggatgaagataaatgttcatagagaattaacacatagatgcacttgaataaaaaagaaacttgcatgacttggtatgaaaatataggttaagaaaaggggcaccgatattgtttatggccaatacaccatatcatgattacctttattgttttttgtggataagaagtgaaaaccaacattcttttggtaagtcaaaataaagttatctatatttagctatgctacacctcgctacttttctcgtattatgccccaaatacaataatagtataacacatatgataacattagattgagaaaaacaacaatggcataaccaatttctctaaacaaataaatgacattattacaatccataatcccatataacactaagaattgagtagcaatgatcaaatatcggcatacttgctcatcaccataaacctaacctaaacacacagctcactccacaaacaatcccatcacaattggtccaagctaagaacaaagaggcacaccccttcctacccccactcctatcactattcatcccaacattttcacctcatcatgctcactccccaaaaacttacccactgaaaaaagcctttcagcacaagtaaataacactaaaaataaaaataaaaatagaataagtattgaggcaggcagagagtgatcacctccatgagatgagcaagaaaaaccaaatataaaaataaaacaaaatttttattcacaaaacaagtgagagaaagagaaagagaagaagaagaagagaagtactactagtagtagagaagtgagagcaagagagaagagaggagaagaggaggcttcaccttcccaaccaaacccaacctcgagcacaagcggagcagatgccgccgccgccgccgccgcgcgcgccgcgccgcgccgccgggtagctcagcgcaaaaaagccacagccgcccgcccgcccgatccgttgcagcatggggcgcggcggctcgcgcgcggcgtgcgccgcc

SEQ ID NO: 34792 - DNA, 369 bp, Oryza sativa
aactattggcaaaatataatttgtaatctttagtcataaaattgtatatatcatcttcattaagtattaaaaccaatataaaataattacatcggctaatttagaggtggttttagctgacatgacgtctacgtggttgcctagttattaaataaataaataagatatgagatacatataactggctatgtcttcatcttctttatccacatctctcccttgggtacgctaccattgagaatctagaaaatttaagtacaatactatatattctagtctttttaagtgagaaattaggagtttgggggttcatgtgcaccccccccccccactcctcccccaaacactatatagcttcgccactgtagg

SEQ ID NO: 34793 - DNA, 1501 bp, Oryza sativa
atcattatggtttttttaaaaaaaaattgatcaagtgaaactgcaactatgagaaaaaactaaaacttatattgcactgaaaattgaagcttctatatgcactaccagtagattttgagcttgttcctttatttgtatacaaaattatgtctcttcatttaaatcaaaatgtcaagtgcatacatgcgcaaagagtcagtttccattccatgttgtgaatctatctggccttaatcctgcataagcttgtaagatcctggtagaatttctgctgtcattatctatccacattatcaactattatttctttgccattctagccgttgctactctgatttgtaccactttgctaacttatctttgtgtgctgtccatgaataatttgactgatcatgtccatgtccatgtctattgcgatgaccttagttgtaacatcccggcccagggcttaataggattaatagaatactcatatcaacaagttacaactttttttctagaagccgatctctaaagaactataaggttaagcgtgcttggcttggagcaatttagggatgggtggccgatcgggaaattcttcctaactgcgcacgagtgaggagacgttacacaaaaacatgcatgaaattcttcccgagtgcgcacgagtgatcttgtattggtctatgagggaagtctatgacctatgaagtgcgcacgagtgaggagacgttagacaaaaacatgcatgaaattcgaaattcttcccgggtgcgcacgagtgaggagacgttagacaaaaacatgtatgaaattcttcctgagtgcgcacgagtgatcttgtgttagtgagagcagtctatgacctatgaaagctaccagatgtaagtgggcctagcctaggagagctgggacgttacacaaaaacttaatgtgcagaaaaaacttgtgttggtctgtgaggatagtctatgacctatgaaagctaccagatgtaagtgggcccagcctaggagaggcgggacgttaaacaaaaacatgcatggaaaagtaagcccctgtttgattcagcttaggaatattataatctagattattagtagtaagctgaaacaaacaagtagattattatgctggattattataatctataagccagatagtataatctaataatctcctctaaaggagcttttttcatattattgagtggctaaaggcccactacaattagatgcctcaaataatccagagaaacaaacaactcgcagcttattttatgtcagcttattataatccaccttagagtaatctgatttaataatctagattacagtaatctactaatcttaagctgaaacaaacagggccacggtcatccagctaactatatattgtacgccatcgtgcaaggccaccaccaccacctgccctatgccaatgcattattgggcctggcctaggagaggcaggacgttacacaaaaacatgcatggaaaagtaagaacggtcatccaac

SEQ ID NO: 34794 - DNA, 1501 bp, Oryza sativa
taaataaactgacatctaggataaaaaataatatggcaagtgaataaacgagaaaaaagaagaaaaccatgtcttggatgagacttagtttctacacaatatctaagatatcatgtgagataagtagcattaaatttaagtatggaatagtggtgtttgcattggaagagtaatgtttagtactagtttctcgatgatgtggagtttatagaaactatgtctagtgtcttgggttgagaataaccttaattctatcactattcactcctactcctctagtagcagtggttagcacttagctctcgcctaatgctgctctccgagcttaagcttaagctcaagcttaacccatcctcctctcctctcctcccactcgctctctctcccgcagcgtcagccgctttgccgcactagcagcagtagctactactaccaagcaagcgtagacgacagcagcagcagcagcagcctgcgccgcgatcccacccacccggacgaggaggaggaggattttttccccctctctccccttcgctttcctggagcttgaaggatagggatcgaggaggaagaagacgaatcaagaagcaagcaaggttggttttgctaacctctcgctgtgcttggggtttgttttcttgattggcttcttcgatctgggtgacggggggtttcgtcgatcttgttggtggtggtggtgagggtttcttggtctcttctccggcggcggcggcggccatggcgatggctgggctggcttcgtggagggtccggctgctgcctccgccgtcgcgggattttgggtgttaccccagcgcctgaatttgattagtgtgtgggtttaacttcaattaatcatacgcgaatttggtttctggattttgctcttcgtccgggctgtgttcttgattttattttatttttactgcggcgttgcattgattgggtggagctgaatcagccgttcttgctgtcctccggttgttccattgactccgctgctccggtaccgatgagctaagctgtgagccacaattgttctggataattgcattgatctcgttcccgtacgattgttaccgcgaacgctagcattcggtttattgcgtctcttaaatccgagaattatgtcatcatctgcagcattgcgagtacaaacagatgacacttttcctctttatttatgtagtactgtgttgcagcaagaagaggatagcaatggcaaaagagaacttagagagagagagagacagagacagaggagatagtatgagcaaaagcagttctcaactctgaacattgatagcttcatcttcatagcttgatagaattatatccgaggtatgtgcctcttcgcgtcatcggtatatgctgtttttgtatcattgagggaacaagatatgatcattctccaccttttcgggttgcaattaccgacctgtaattgtgacgtagtttctgagtgcatttttttgctttcttggtgtgcagcttgcaggca

SEQ ID NO: 34795 - DNA, 1501 bp, Oryza sativa
attgggtgcatcgaggtggtgggagctcgatccagcgaggttgcatcgatttctccaatgagatcgtgtcgattttgtcagcggtggcctgattagcttcctgatcccctgatctattcaccggagtcctttgtctgttcgacatactccatgtctctaggtgtccttacttttccccattctccctctctcttcctcctctctaggcctggaccaccgaaggcatctcccatctagaggcacgcgtacctcccacaggggtacgcatgtccccgtaggggcacaactccgtccttgccggcacgaatatttggctagggcaggctgaaaccacacgccatgtaggaacgtttggcatggccttatggagccactaggatgaaaccacacggcatgtaggagcgttgggcatggcctattttctcctggatatgaatacggatatgttatcattgtttccgacggatatggataataatataaatttttggtgaaccgtgttattcggatatccgctaaagtcatgagaaatacatcatttttttataactctacaaccttcaatctacctttttagattaataatagctcatctcttaacactagtccacattattaatattatttaaaattttgaatatttttataatttatactatattttataatgtgctaattatatatggtggtatttgtttctattagaagttgaggtggtttccgtgttccgagaaaaaaatatttatgtattcgtgtctaattatattcgatccttattcgtatttgagataattcgtatttgtttctaaatctgagctattcgtattcgtttttatatccaaaaaaatagaaacaaatatggtatgggcagtatccgtctgtatccgcaccattttcatccctacaacacaccagtaaggtagcatatttttaaaagtactaggtgcctgtgctctgctattgccacagataaaagaaaaatgatcacaatattgttgactatcataagtaaaagtattttcttcatgaaatatgttgccccatcttttatgtaagatactcaccttaatttaattttatataccactatctatttacatttaattgctatataatattaagcaattcaagaggtaatatgctcaaactaaaatatgagtagatggagtagcagattcactgctatcaccaaaaattaaagcctctaaaagagtattggatttataaagttcattgctggaaaaggaacgatcaaagcttgaaaataaacagtaatctgtgacaaattcttgaataagtaccaactctttaaagatagaggtggtatctctttttatcgatagtgcttatctcttagcatgtgtttggtttcgggactaggtgggatgggatgaaaccatccctgattttgaggttggaatgattccactcacatgtttggtttgtaggatgggacaatcccaattttttgtttggttaaagggatgagggagagatgaga

SEQ ID NO: 34796 - DNA, 270 bp, Oryza sativa
ttgcctgtatcgccgtggttcgctcaccgctcgccgccgtcgtccgccgtccgttccggccggcgtcatcgtctacctcccgccggcccgcgtggcagccacgtaggcgccacgtcggcgccagctcagccaagaccgggtcgagccgaccccggtcagtccctccccgtgcgcgcgttccaccgcgagccgtgaggctgcgcgtgggcccgccgcatccgcatccaccgcgaaccgcgcgcgtgcatcgcgtccctcccccaccctagt

SEQ ID NO: 34797 - DNA, 1501 bp, Oryza sativa
gtggtaagtagtaccattccccaaaaattattgaaatatgtttaacaaataccacttgatactagaatactagatagctagggcacaaaaagatgttgaaagctctatgcactcatcaaaatttactgaaaatgataaatgagccaaagatgactggttaggtgcatgttttaacagcttgaccatttttaactactttaaatctgaaatctgaatatgttgaagttccaatagagaaaagcttttcttaataatcctgacaatgttcagctaaaggaatgcactacatgatatcttggagttcatcaaggctatgaagatgggaatgggacggcaagtcatcactaccaggtctcaaaaacagaaagtatttcgcatattacagaaaaatattggcactgtactgttgtaacaaatgacaaatggttagcagtaacttcccttaatggaaagtatggggttagcatatttatccaaggaagaatataccttccacgtgatttcttctctgtcgattggtttcctttcgcaaaatgagcaaatatttcagtttgctgcaggagatacttcagacgtcccttccccttgttgttctgtccatgaatttaatattctaagctaccacagaactcaaagccatgaagtgaacgcaaaaaagcacagaagatttagatcacatgtcaataaggtattcctatttggaggttaatcgctaggagatatgggaacttatcaaaccatgtcagcatcaatggccttattttgggcatccagtatttcctggattttgtgcttcttcagcttttgcatctccctgagctttgctcgctcccgcttcccgatctctgcgtttccagtagcatcttccaactgcaattgaagacaagcaactcagtgatgttgagtgacactcagagtagtcactccccttcaaaatattttgaaactcttttttagaactaacaatcactcctttgataactgtaaaccatgctgattggctaattgcgataaaaaactacttcagtagcacaaatataccacgaagctttaaacattttgctacagcacacttacgcataaagaaaacccaaacggatacaggaatcctcaccagatggaccaaacaagaacaactttactaaaatttacaacctattgcacgggagaggactgcctctctttctaaaaaaaaacaatctacaattttaaatgaacactaatatcatccctcaaatgtctacaggagtatagacgcataacagattactttacagctaaacagagggaaacaggaaaaaaatctgtataatcaacggaaatctgctgatttcgtttcagaaaaagagaaatcatagcataatcgctaccacctatcaacagattcaaacataaaccacccaacccctaccagcacctagatcaccaaaccgtgccacacccaccttgtcgccatcttcaccgccgccatccttcccggcggcgacctcgtcgtcctccg

SEQ ID NO: 34798 - DNA, 867 bp, Oryza sativa
tatgcggcaagaatattaaaatcatggttggagaaaagatatttgataaatacatggtatggtagagtagttgctgaaagtacaacatctaacaaggacatgttaacaaaatagcactattgaaaacgagttgtcgtcattggtaggaaaaatgagttgtacaggacaaaaataacgtgaggtttcttcttatgtggaataggaagttgcactgattgtcctgtgaaggggttgccaccaaggtgtattttccatcatatatatactacctccgtcacataataactatatttctagaatttaaatttgacccaaaaagttgtcataatagagtattaattgtcctatcaatcacttctcatccaaatttctctctgttctaccctcagccaccctcccacttttatctatacactattcaatgaggggcatcatagtctttttttctcaaacctttatatatatatatatatatatagtaaatttgtttggtgctccatggtgcccgggcaccatgattgaaatttactatatacccaattcaaatgagtatgaaactttttcaaatatttaggtattaacgttaactactttagtaactagttcaaagcaagtttgaactgaattcaaacttgcttttgttagattttgattccaggtatatagcatccaaacatataattagttaggtatgtaataatggattgtgaaataaagttaaatttgagttgttttgttgctaggtataggtatgaatcgaatacttataagtaggtatatactcacaatttgaaaattttgaaaaatttgggcgaatttgtgtatttcataccatggtgcccgggcaccatggtgccccatatgagt

SEQ ID NO: 34799 - DNA, 1501 bp, Oryza sativa
acattcgatgtgacagtgtaaaaacttttgtttgtgaactaaacaggcccgtagttaagctgaaacaggctactcctaactttttgtaagaaggtttcgaacttgttggcgtgttgctcatgccatcgccttccattttgctggattgagatcctctgcagtcaaatacacattgcttttgtcactgatatttgggtccaggaatcatcgggtccacatgtcaatgataaagtcccatgacttcaactgcagaggattctgatcccgttttgcgtccttccgaatgtggcaacaacttcaaatccaacggctgcatatatatatgtatgattaattcctgaaagaaaattgaggaacaattaacgaaaggtccagcttcatcgatgatcaaagtggctagctagtggatgatgaactgttaggtaagctttcttggggcctctcaccacgtgacttgtgcaagagaggcttttgtctcggaacaagcgggaattagttagttgaaaggtgacgtctgtatacgagtggggcccctctttcgttgcagtccaatcgtgtcgtataatatcatgcgaacagattgtccgcacaaaaaaggacatatactgatgagctcaccaaaactaatttctggattttttttttcgatggtggaatttaaatctagcctcaaaattaatttctagatgcaacaccaaaataatagtaaaatttatagttggcacctaggggtctaagtgcataatagcccataatttagtaatgatacataaaacaggtgtataataatcgcattagaattaaattaaaaccacacgtacttgtatctgtctccattagcttaccatctcccgtttggtgggtctggtgcaaagccaacacgcatgtggcgattactttgtattttagtttgcatattactttgtattttagtttgcatatgcgccacaagaatctttttttgtaggcttagtattttatttttcagggggttgcatgacaattcgtcatagtgtgtaggttatggatacctcgtacctacacgacatgtatatctgactgagtacggggtgccatgtatagatagaatatctttaaagggattcgggttaagttctaaacatgtatgtcaagtaaatacctgggatcctagtcggttacgattatattttatctgtaactacctattccgttagggatatggactgtactttgtaatacggaccccttcccctatataaggagcggtccgggtgcttctaggggcacgattttcacccagatcatacgatcaataatatactcggcggatcaatccccggacaggagtagggtattacttcttgattaagaaggcctgaacctgtataaaattccttgtctctaaacccatccacttttccagcttgatagtcatccccttttagtattgccgaaatcttgtttcgacagttggcgcaccaggtaagggaagcgtcaagttcttcgtcgactagtgcga

SEQ ID NO: 34800 - DNA, 470 bp, Oryza sativa
tatgagagtcctcacgaagcatttattaaaattttttgtttttagtaaataggaaggggttgtagttttatctaattttttcgtactctcctgttatttcttcctagatccgctattggctggctacgtggcgcgatatgatagaaagatggagatgtgtgtagtaatagtagtttgtatggaccataggaatgcacgtgctctcccgcaatgtgggggggtcgcccaaccatgcaatatgaaaattgcacccatgcattcaatgcctttgcttgctactcttaattaattaagtaggtacggtacgttgttgtgtatccaatctaattaattaataatcacctctcgtgatcgattatatcaaattaaattaacaaatactcacaagctaatattagctgctgatctgccctatccatgctgtagatctatatttaatactctatatatgtgtcccttctccatactgt

SEQ ID NO: 34801 - DNA, 1501 bp, Oryza sativa
aaattacatttataattttgtcaacttaattattatagtctcatgagccttaccgagaaattttttattattttacctttttaattttaaaaatagattctcacaaaatttattttcagttttgaatcctttggcacacagtctcggtgatgtggccaaacaaaattgccacgtcattgtttcgcagccaccgacacttgtatgaccaaaaagttcagaattagaaaacaaatttcaggagagtctacttgtaaaattaaaaaggttcaactttttgaaaaatccatttactgatgcatgctacatgtgtggatgcatgttgttcgagctaagagagatggctttggatcaaaagaatcccatcaaataattctggatgttcacataaatttcaactatgtatggaatacctgaatagaaaatcaaatcattttactttcataaacattaattataactctctgcagttttttaaatacacgtagaacaaaaaaatattggtctaattaaggattttgaagatattgttaaaatagcatattctcatgatccagataccaatgactacttattaatttataacgtaatatgtttttatgcaaatagtactacatccgttttaaaatatagtgacctaataaactagatatttctagtactagaatatgtaatatatcttatcccgtattagatggttatattttgatatagatgaagtagaacactaaacgctcgtcagattaaaaaaaaaaactctggcagccaaattagaaacttaattatttctcaacctggactggagatcgatatacgtgatgccagtacgcacaaaaggaactgttggagttattttgcatttaaaacggtcgcgactgtacttcttgattgcaatgaaatactcctgccagcccaaaaaagaccattgaaaaaggaacctaaaagaggaagagaaatcaaaggggcgatgccctgtagcagccacgtgaacggtcacatgcattgctgctgctgcacggcgatcgctgaagaagctagctaggcccccaaaatgcactgaagctgcatacagatacagatacatatacagagggttgtgggcacaatctgatcgaactctgtagtctgtaccatgccgatatcaagtacctcctggcctaaaatctctagaaaattaacgtcatcgagcttcgtgtatatgttcttggaaaactgtacaacggataacgtattcgggaccatttagtactactgattaatttttagaaaatataataacggagtatagtatatattgttgaataataaaatttaagtgatctcgatgatggtgtagtctaccagtagtagttggtgatggctcatgtgacacgctttgtgattttcaatttgtgccgacgatttgtttgtgattttctaaagttggtagttatgttaaaattaatagaaactatatgcggataacttaaggtagtatttggttggttggtgggatgggatggga

SEQ ID NO: 34802 - DNA, 1501 bp, Oryza sativa
taaggcttaaaaaaagtagttggcgtttttaagtggctgccttttctagtacacgtactcttctgtggagtgaacaatccttgttttccctccgacgactagttccaaagacatttccaaagcttttagaactggtatgcccatacttgcaatttgactatgcaaaagctctaagcctagaaggtttgttttttttagctatagggcagatctgttgtgccaacacaaaggagtagggttcagttcataaagccatatgaagtatgcacttgagaaagataaatactggtcatatgaaaccatataaaggattgatgggtctaaataaatagtaatgccttacactacaataatttgcataagaaggcaccaagatagaatgactcgagtaacataaagacatatgctttggaaatgtttgagaggataccgatctcagggatattttcagactagtaggagaagccttcctcagggactggattgcagaagcaacccattcatcagcaacatttggagcctcttgttcctaacatgatacacatcaaatttagcacaacagaactggtgagtctatagaaagcaaagacttagcataactcacaagagaggctatgatttcttctactgttcttttggaaaagcatttgttgatgatttccagcctggaatcaaaatgatggaagtagcagacatggattaggcaataaaagttgatctgagaatgaaatgagaaaacaaaaccttgcaataaaataggaacaaatggaatctccttgacaaactaaaataagtccttccaagttacaatgcataaagataagccttcttggccttcaaaccagattaagaaaagcaatacataaaatgagttcaaatgatctaaaggtaacgagattgtggcatagggaagccactgaccataaagatgaggagaatatagaaaacacacaagtaacaggttagggcatagggaacggcttatttaaagccaggccagacaaccgttaccaagcttttttataagttgaagcccatccatctattgaaaggagacacaagatgtgggaagtgcatgctgttgcttccctacatttccccattccaattccttacatttctccacctgccctccattacaagctaatattatttcaaaaggactagtctatctatctagggcttgtggtagagaggacccaaaagaaagttgtttggagaagataaataggtcaaacacgccccaaattgaggagagtttcctgcatgaactttatatggatgttataactatggaactttatgcagctattagtaacttaaaaattgtagattaatcaatctaagtttaacatgccaaaagaatttatacgacaggataacttggtgtgaaccagaatatcccacctgtcaaggatacctcatttttacagggtacacaaaggaagcagaataagctcgacatgcatgaatagataatgtctggacaattgcacgctta

SEQ ID NO: 34803 - DNA, 338 bp, Oryza sativa
gtccggggatgaatccgccgagtgtattattaattgtatgattcgggaaaaatcaacaactgcccctagaggcgcccggaccccccttatatatgggaaggagtccgggttacaaaagataatctatatccctaacggaatatgaaaatataggtaagatacagtcgtaaccgactaaatttcagggtgtttccttgatacacaagttaagaaacaaacccaagatacaaataagatattctatctacattaggtatccggtacccaatccaaataccgtctccgtgtagatatgggttacccataatctccacagtagcccccgagtcctttgcagt

SEQ ID NO: 34804 - DNA, 1501 bp, Oryza sativa
aacaagatttcggcaatactaaaagggaatggctatcaagctggaaaagtggatgggtttagagacaagaaattttatacaggttcaggccttcttaatcaaaaagtaataccctactcttgtccggggattgatccgccgagtatattattaatcgtatgatctgggtgaaaatcgtgcccctagaggcacccggaccgctccttatataggggaaggggtccgtattacaaagtacagtccatatccctaacggaataggtagttacagataaaatataatcgtaaccgactaggatcccgggtattttcttgacatacaagtttagaacttaacccgagtccctttaaagatattctatctatatatggcaccccatactcagtcagatatacatgccgtgtaggtatgaggtatccataatctccacagtagcccctgagacctttacagtcgacgaaatagccttctctcgtaatccaaaacgataacctgagtacctcgactccttctgccttgatctcccgaacaccaaaatcaaagacggtaaagggctgaaaacaaaaaatcgggtgcatcgactagatgcacctaattaggtgtagcccccgactatgtgattagttaaaaactaaacatatagtcaaggtgcaaataacatccaaccgagtggttttacaaccgaattatccaaaatatcatacagccaagcacatgcgacgtttaataaaacaaaacatccagccgactgctttagctttaatataccaaaaatggagatataaagaggcctgagtaaaaaatactctaaaggtccataaatcaacacatatgacaagaatccgagtaaaaactctcaaaagatccatcaaatgtggtataaatatgatatcatgataattgatgagtctaaatagcctaggctatgactcacgccataatcaaaataagcatataacatgccgagaaaatgattgttcaaaaaccagtcatctcaacaaaacccaaacagcctttgcagcctaaaaaggctcacaaaagtagtataacacctttctatcgggcacctttttatttgcatcataataattccgaggaattatctaactgcgtcaaaaaggattttaacagcattgggccatactgttgtaagcaaaaattgccgaagcaaaaatgcctaagtccctaaggatcacaacttaaccacgccgataacaaaattgggctgaagtactgttttaggcccaggcccattagtattcccgatacccaaataacaccaaaagccaaacgtcgcttcgtcttccccgccgaaactctcgccactttccccattctctgctacagtgcaaaagccgcgccggcgaaactagggttcaccgattcgctccaacccatcctccaaaattccacaaaaacctcccatgcaaccaccgcatcaatctcccatccattcccagccacatctcggatcaaatcacaccatctagttcgtatcca

SEQ ID NO: 34805 - DNA, 1501 bp, Oryza sativa
ttttgtgatatgtgtaaaactatatgtatacataaaagtatatttaacaataaatcaaatgatagaaaaaaaattaataattacttaaattttttgaataagacgaacggtcaaacatttttaaaaaaatcaacggcgtcaaacattttgggatggaggtagtaatagtatagcatagacaataattaaaagtacgcctctcgttggatcatttccaaccagagccagtgatcataaaaatttgagggaaatttaaaacgttggttccggttaggttacgctctcaagtatcaaaactttactcttgttctaacacaagtcctaaagaatttatcagaccatgacgtttggacctgttagatcattgaagtaataaatgatgacacgggcagttagctgacaacttaattagctccgtatatattcgaatgagatgagtcattgagtcactctgaaagtataatagcctcataaaagctctctcttagagcaggtacaatagcatgctataagccggctataaccatatatcgagaagaaaagagaagagagagaagaaagcgggctacagatttgtagccggctgcaacacggactccaagctgttatgtgtgtatgagaggtaggaccgaatattaatggtgtagtatatttttatagttaactattgtatgaatgaactattagattggctatagatgttttggagccagtagttggctatactattgaccttgctcttagagaggctgggttcgcttgggctgttgggctggagctattggcggcttgaaaaacaagaattaattattagtgcatgatagggttttcaatttcgatttatgtcatttcggtataaccgaaatttcaacacaatttaactgaatttaattgaatttaaactaaattcacaaaaaaaatgagaaaaactggaaatgtctgagatattgacttggcgggggggggggtgttccgaaatttcggaaattttgaaacaaaatttcaatccccgacgcatgattaatcaattattaataattacaaacttaaaatgaatttatttgatttttaaaaataactgtacatatttttttaaataaaatatatcattttatcagttggaaaacgtgttatcggaaaacaagagagttgtcatcagcataaacaaactcagccttaatcttacagagtattaattggcactgtattgtttatacacgggtgtgcacacatattttggcatgtatatagaagcaaattgcctctttttttttcgaatcacttagggtgtgtttgaggagattgggaagatacgcaaaacgaggtgagccattagctcatgattaattgattattaactattttaaatttcaaaaatggattaatatgattttttaaagcaactttcatatagaatttttttttgcaaaaaatacaccgtttagtagtttgaaaagcgtgcgcgcgtaaaacgagacacaatctcctctatctccccaga

SEQ ID NO: 34806 - DNA, 1501 bp, Oryza sativa
aactttgcactcttgaacacaagcagcacatatatatatagatacaagatacaactcgtgattcaacagtgtgagtaaccaatcatctgagcagaggaatccctgaagatgatgaacggaaagaacagtcgattgatggcagtttcagagatcatgggatgagtgtacactcaagtgtacaagcatggccgacaggatgggttcttctgctgctttttttttcttgtttcttttttttttcttttggtggttttcagtaggtattgtattgttttaggggatcttttctgttttgtggtcgaaaagatccctggaaattacccataaagatggagaaggtgaggagggaaagagtgaaaggagagggagatcgagaggggtctccccccaccattcttggaaagatgttcatcaccgtttctgattaattttctctggaataacataataagaagctcatcttctcttaggttgctatctccctttcttttcagcaggaactcgtccccaagtatttacagatgtatattgcatttgtaacacactttgtccaaattaccgcatgaaataaaacaaaggacaaaatacgtacgtctccaaaaacattgaaccatggcccgcctaggatgagggtacataaagtgttgaaaacgataggaaaatagcctctaccatttcaataacttttttttttataaagaggtgccgctgaaacgaaaatgatatcaaaaatattggaaaaaataaaaaggaactattttttgggtgccgttggaattcggtaatcatgatggaaattctgaactatgtaatttataatgactatataatatgaccacattagttcatcctacaattagaaaattgtgaaccgctttcttttggaccttattatgtcaattcccgtgagggagggattaaagagtattcagagagattaattctcaataggtgtcgaattattcttccccaaatcttctaatttacatgtagatgagattaaccaaacaaggctttaatgattacactaccgtaaatcatgcacggcctcccttttaacttcgtcgtagaaaggggtttatagtggaataagttcactttaggtccttcaatttgtcgccggtctaattttcgtcctcgctcctgaaaaccggacataagcatcccctaacttataaaaccatgcagatgagatccctcgacagtattgtgcccggttttgaataacgtggcatctacgtggctcctttaactaggtcctcgtcctatgtggcattgacgtggcacttatgtggcaattggatcccggaaaaataattaaaaaaaaaccctagaacccatatgtcaattacacacaaaataataaaaaagggtaggcccatgtgatctcacatgtcatcctccctcttctctttatccccctctctctctcccctgcagttctgcactgaaggaggagggcgagcgggggtgggcggcgcataggggtgatgagcggagc

SEQ ID NO: 34807 - DNA, 231 bp, Oryza sativa
cgagtgtcatatctgtccatctttttatctacctgatgacgccgtcactatctactactccctccctcctataatataaaaaaaattaactttttcttacactgtttaaccactcgtcttattcaaaaatttatgcaaatataaaaaatgaaaagttgtacttaaagtactttggataataaagtaagtcacaaataaaataaataataattttaattttttttaataaga

SEQ ID NO: 34808 - DNA, 1501 bp, Oryza sativa
gtgaagatcgaagaggagattgatgctgagagtgacgatgactgctgcgagatagaccctgacgagttcgccaggaaagttcagctcaaagtatctgatgaagtcatcctggtagctgccaaagggcaggtagatattctttcctatgccttgttgatttgttttgttccatcttctccagaaatctgatgatcattgtaccattgtagttcagtttaggttttatctttcttttattttgttgatgcaaaacctgtgtatccatcagacaccttaggaagaattttcaaaatacaaaatatgcccccaaaatatttgtgatatgaaaccatgaaccatcggaacatttctcgtgtcataatctgtagatcaaagttgatgcgaaccaaccggagggctttggaaatttgttggatctctctgactctgacaacaacctacagccgcatcatgaatatgctgctggagatcgcatggatcatccatatgagattgatgaagataaaaccactctagaaaagctggttgatggcgaggacaagtacagagctgatgatctccaggtagacgaaggtgatcgctgccgtgaggaagtcatacctgtcaagatatcggtgaagagcgaacctgaagaacacggtgtcattggggaagaagatgcatatgatcttctcccggagatcaatggcttcagtgagcagctgttccctgatgaacgcagagtatttgatgaggaagacgacgatgacgttgttgtcatcgggagagattctctgtaaacgggttccgtttctatgtaattatctatgtttcttcttcaaatgagaataccatcttgcgaaaataaattttgtggtactgtttaatttttatgttgtttactacacaaatacaagggcatgaatgagcctctgataccttctcttatctacaatgatgaacatgtaggtggcactgagagacttccctcatccaagacacttgtgtgcaaaattccccttcgataagacttctcatgagagcagctgcagaaaggtaattcgattttatccgtgcaacttctcattttttcacctcatctatctgcagacataatactagttgtgtcgtgtgcttgcatattgcagtgctattgctctgtgtgtgaagttcctgtttccagttgtctcaagtggaaaggatcagaagggcactgccatgcaaccaaactaacctagctatctcagaatcctccactttacgattgatctatgcatgatcagactgtactaagttcactagtttttcctcatgggtataattctgcctatcaagaaaacaaggttcatatcgatttatgcatgatcaggattgtactatgttcttgtttttcctgttgatataattctgcttatcaagcaaacaaggttcagatcacaagtaatagctcagtgcatggtactatgcatatttgtgatgtgctgaaaaagacatgtgattattttgggtaacaaagcagctt

SEQ ID NO: 34809 - DNA, 1501 bp, Oryza sativa
catgaatacggtcgcatctgtttacttttggcttattagtcatagcgaaaatttgaatttgaaaatctaattaagttagagttaattttaagggttttccatattagtttattttttttaagtatttacttttaaaatcaacacagatacaaaagttttctcatataaattatcaaactattttggttccttcgttcattttcatggcttatcagtcaagtcatggagtaaaagataatggagaggcgtagtaaaagatgatggcacaaattgatactccatccgtctcaaaataaatgcatacatgatttttcgtgtttaactttaatcgttcatcttattttaaattgttttaaaaaactaaaaaaatataaatcacagataaaatactattcatgttttatattctagtaataataaaaatactaatcataaaaatatttcaaacaagacggacaattacaattggacacggaaacttatggctgcgcttattttgggatagaggtagtactgctttcaaattaatactaaaatattttttgtgataaattttgatgacactattttcacataacagcattgcatgattgctcttttttttttcaagaactgcagaagtttggtcgcatgctctatagaagaggtatccatttttgaactgaacatgacaagagaatcctcatggggtgtagcaccacaactgtatctaattccctcaacacatgggggtggtgatctactgagtactactgaccctcgcaaggtgaacatgccattgacttgaccacacaaaataagggggcaaaacagccatttcaccctccaaactcaccttagcctggcttaattaccacatcagctcattaatggcgcttccactacaataatccccacaagaggagaccaaagtttaaacctaacttaaccacctactacttcagctaaagcttaaaagaagctaaactagctaagctaagctaagctggccggagatgtccagaccggaccaagtggcgaaggccgaataaatctggagcagcgccaccaagaatcgccgagatcccttccctcccccggactccactctacacccttcacgcgcgcgagcacgcacgcagttggtgcatcctttccctcgtctccatctccatatcagccttccccttcaccccaaaggcacctgccactggcagcaggcggcttcaagaaccaaagaatcttgacacacagagatagagagagaggaaattaaaggtaatattagtagtagtgagtagtgacttgatcttgacaaaagttagaggagcagcaggaggagcaggagggtggagggaccatatttctggttcttggagtgtgatcatgaggtctccgagatcggggagacaggatccataggtgagggcgtgtgaattggagactgattagagagctaggcgagcgaggaggaagaagagatcaggtgaagatgagcttcaacaagagcagggggggagca

SEQ ID NO: 34810 - DNA, 1501 bp, Oryza sativa
tatacttatatttgttattaataaaaaaagactacaacggaaaaaaaaagctaacataaactctcaaagatattcttttttaaaaaaatatttttttttactactcatgttatctagtagtatgattctataacaaattaaaaagcagatgaattgaacattataaaccttcatctttgaaataataatatatatatccataatataaatttgcacatttgtctgctggatcgggtggacagttcggcccacccgggatgtggtcgggcccgggccctgcctccgtgtttctcaggcccaccaccgcccatgcacagggaccaaccaaacaccagcagctgaccctcgcagcgggtcccacatgcagggacaggtggcagccctcggaaatcgcagcaagaggtcgcaggcggtgggtcccacagtagtatattttatcggtctcgggacggatgagatggtcacgtgatgggcctggaatcctggcccggggccccaccaccagcctcaccacctctgactcacctccgtgttcacacccgctcccggctgcgtcgctgccatgtgggccccacactggccgcctgccgaatagcctcgctggtacgtgtccgtccaaagtaggcaggctgcagcaggcgccacttttttttctctctcttttgtaatttcttttttcccgcgagattattatatttaaaaaaattgggaagggtagacgtcgtggaaaagaggcgagatggcgcgagtgagaaagccgagacggacagagcaaaggataaacaagaagcaaaaagaaaatcaatttgaactggctgattgattcctcctgcaagcacgcccaaaaagacaagcccttttttaaattattgtaatcacagtggtaggagtactagtcccaagccatcaatactcgaccactttactttatcccaatttcctgcattttttactagtaggaggagtacttgttactggtactactgtagtaccaccattatatacttgtactactagtagtactatatgggtcagttattgaattttttttttttgaattttgaattgaatgggggcggctgggttttaaaatgagtaaatagcaaatacttaaacaggaggaaactgaaagctcttttgaattttctattgttagcggtggtgggatggagtaaaaagttgggaaaggaaagccagtgatggtttttatgacttgcatcttcacgaactccgagccaaaaatgctttccccccccccccccccacctcctctcctcccctttttatttattgctgcagtagccgtgtatgtgtgtgagagagagagtgaatgctggtgtgtacgcataacaaatttcctttctccacccctttcttcattactactactacagctactatacgtagcagttgctttacctttaataattcctttcctttccagtaatttccctggtattttcttctcctctctgccttgctttgcttcttcctcctcctc

SEQ ID NO: 34811 - DNA, 875 bp, Oryza sativa
atactaggtgctgtgtgactcgacccgtgcagtgctgtactaacgcgttgtcacgcccagaaatttaacccaaatttccagactattttgcgtattaaatccctgtccaggaccagccagggtacacaaaacgacaagtaatatacagttccaaacgtaaataaagcgtaaaacggaagaggcacttagtcctcacaccgaaacagaacgacagcagcggaaaaaggcgatcctagcggggcttcagctccactccacaggcaaaactcaactggggtctgagccttggtcctctaactccatcttccgctcagaagcactacacttctgaaaaagggggaataatagcaaaactgagtacaaccaccgtactcagcaagccacaccaacgatgcagatgtgcaaggggatacaaggatggtttgtggctatttgcataaaggcggttgtaaaacattttattgagcaaaacagtaaaactgttgagtaattaaagtaatattgaatctccactgatcaacgctacaccacgttgaacaggcccaaccaacccacctgaactacagtgtattgagtcgatttattaaggtgggactaatcacggtgaatctagtcgaccgcccataaccgcgggcacggctattcgaatagttttactctgatcagaggtgtacaactgtacccacaagacacagccccacgacacgttcccgtgcaccgacatgccaccacgacataccggaaagaggccgtgacaggacccttcgcataaccccctctaaccaagcacaccacacctcaggtttcacccccactcctcgcaaggcagcgggcagtcccctctcgtgcctaggtgaatccggaagccgcatagg

SEQ ID NO: 34812 - DNA, 1501 bp, Oryza sativa
tgcttaaaatactttggataataaagtaagtcacaaataaataatgattttaatttttttcgagtggtcaaacagtgcaaacaaaatatcaaaatctcttatattaggggacggatggattactttgcatcatgttgcctccaaattaatttcacttatctagatgtaaacaattgatcaggacgattagggttcaaaatcgtgaaaagaaaattattttgacccaatatgaccgatgtatggtaactaacctgaaccccacgagtatatatccagtccaaactccaaacgcacttgacttcctcctcgtcatcgctgattgcattcgctccgagatggccacgccgcctcccaccgactccgaccaggttcgtccgctgcttcctcctccttcgccgttcactcccgcgttcgattcctgcttcttttgcgctccgcctcgttgggctcacggatccaagcccaatcaaccatcccgcgaattagctgctgctttccctcattcgattcgctcatactcagattgattgatccagttaggttgttttaacatgctcgattgcgtctgtagcagcaatttgatcgattccgctaggtttgcttctcccctctaatttgattgctgatgcgactgtgtacaactgtaatagacaatcgcccatgggtggctttttcttaatcaccaccatgaatgttttattagtccttaatcaccgtggcgattataggcgcatacatggtcatatttcattcattgctaatttctatactcttgtcgtagttcacaggcaattcagaaattcgactagtttactgcaaacagattatgctaattacttgttacatctgggtaggtcagttttatctcggggttcaacttcaaaccattctgccgtagaatttctacagataaaaaataatagcactgtcttgtgtttgacgaccaggattgtttccgtatcctctgttcgtctcaactggcctcaacaacacaactattttaaggaatatataagcagcatggagagtttaaactccattctaatttggttcggttttgtctgttgtgcgtgtaattaggcatttaaatttcctatttcatgttcgttgccaaacggccaaatggctacactctggtattcgatgtaacaattttatcatatcgggaactgttgttatgatctgtatcttcttcgtgtgctgtctactacaagtcttctctgtacaatgtcatactttttatgattggttctacctgctactgagaataccttctgctatttctctgtttgccaggttttggtagaggcaaatggtgtaacacggacattgcttatgaataggccaaagcagttgaatgccctctcctctgcaatggtatgacttctaaagaaaaaaagtgacaatgagtcaataagtaatggagcatatatggtattcgtggctacatatagggtgcaggaacactgatacgagaaatttatttttgctttcattttct

SEQ ID NO: 34813 - DNA, 193 bp, Oryza sativa
atctagaaatttagaccgccactggttgaatttgaatcgcgtatagcgatcaaatgtttttttcgttgtattgacagtttggctggcagcgacacctgtatcgtttttccattttagtccctacattatattagatcgctatattggttgcgatccaaaaaaattttcattctagtccttggtaatgaactaa

SEQ ID NO: 34814 - DNA, 1501 bp, Oryza sativa
tcatcatccactttaatgtagtactctgcatcccacatggacaaggctgtcacaaagaacgatttcgtctttgcagccaattccagatacccttcaacatgatcctgagtgatcaaaaaatattccaagatatttcagctttacagacaaataaacaagccagtaatactgtactatatgccagctagagtaagtcctatggtaattaccaatctcatgaagtcaccatgtttcctatgcttctgcgtctatagctctatcgagtatgccaccagatgttgcgctgtcaatttagaaaggttaaaatttcagattctgtgagctcaagatatcgtcttctgacattgctgaatcataactggtactaactcttttgtctaatataatagaaactctcccttaactattgtccatacagatcgcccaaagtacatgttttcttgcactaacctatgaccaatgacgaatcggatgataattcccttttcttcctcaagcttccttcttttttcacctgtcgcaaacacagaaacaatatcaggtaacatgttttactgtgggaaaaaaaattctccatgcaaaagaatgtacaaccttgaggcatccacgtagcacgaagtgaatctcttcgtttccggctgctgaatgcggtgttgatgccaatgaccatgaagtatctccgtttccccgtagattctgatagcggcgctccattgagctcagactcctcctgtgacgcctttgctgatgctaactccatttctaagtttgatattgttttgtccaatgccctgataacaaaacagattcttatgaaccttggacttataaatttgaggttaaaatcagcagcataaaagtaggctatcattctctcaacccttttggtacttactgtatagcatcctgagttcttgggacctctccaattatatctttttgctccataacctgcataatatgcaggaaaaataacgatgctcgtgaaaatgcattgacgacatttgttaattttctcattcttcttactaacagtagaggtcactgtaaatgatgtttgcaaagtaatctgaaaatatttgtgtgacagttaatgcttacacttttcggagcacagtcaccagacaacaggttcatcttgttcacttctagagccgatctcctgatgatctcttttggttctggcattgtccacatcctgcaacaaatatttttttcttatttcctctgctccaaaatataatcatttttagaatagtgttaagtcaaacatttttaactttaactattaatagcaaaagaataaaaaagattaatcacgtaaaattgatgtactagatttatcattaaacaaactatcataatatataactctttttatttaaaacatcttaatgttataaatattattggttataatagcattttgaagactacgtcaaaatctaaaaatgtttatattttaggacggagagaatagcattttttaggacggttgcgg

SEQ ID NO: 34815 - DNA, 1501 bp, Oryza sativa
ttgcagtttccagacggaatctgtaatttattttatgagatacagctgcttcgatcttccatcacatattcagaccgtacctaatctgaaaggttagtaatttgaactgcgtagtaatgctacaaggtaaatcaatcatcatcatcttgaattggttcctcttatagcactaggtaaaaagacaagggtgcattctggctgggctgtgttcgataaaggagtttgactgagctagttagtggcatgaaaaccggaacaggtgaatagtacatgataaactcagtattacctattataaacttgaaaactaaatttatttaaaattttaaagactagcaaagtaacgtgctctgcaacggacggattttaaaagatttatgtgaatttcttgatttagaaattgtatttgtcaaacataattgcaatcaaacatccaatagaaaaccaaaccacacacaaagatgtatttatgtagcattagaagatctcaccaactctaaatgatggtagattcaccatcaccattaaattcttttatatagtataaaaagattttgtacgaaacacactgtttatagcttacagtttgagaaacgtgtatgtttatgataaacgagggtgtagctgagccatagctagctagcacaaagagcacctcgttcttacagaataattaagcagcctgaaattaatctgagaaacaagaaagaaaatgcagagacgttagctgcaactgcaagcatgtcaaactttggccgaccgatcaagagaaaggggatgagctaagctatcgatggcagcaattcggcgccgttgaaatcaatcgaagagatatgatccgatgatctgatctgatctgacgatggacatgcagtgatggcacgcagctagtgagcactgatgaagtgatgacactccatgcatccaatccaggcaatgcatgtatttcctttccacacgaggggggcccacatccacctcaccttatcctcgtccagttcctgtgggacccaaccatgcagtatggccacccgggcccaccagtcagtgtgtggcaccggtctccggtaagctcaccggggaggtcagtgctcctcaccacctcccgctatataacctttaggcaggctgtctcaccgagcaagctggagagctagcagaaacaaacccctctcactcccagatacctgctgctgccactagcccactaccatggatccttgcaaggtcagtcactcagtgactagtgagactaaatctacttaatcttgtagttaataattgaggtttcatttagctagttgtgtagattcaagagagagcttaacttcttatagaatatttggtcgattatcagaaacttcctgaaataacctagattatcgactagattctacgaatatttcttttttagtctcaagctcttcaaacatgcatggctggttgattcagctagtcgatcattaagtatataattaattaattaattaatagtaatacg

SEQ ID NO: 34816 - DNA, 1501 bp, Oryza sativa
agcattagaaaggcatctaaagaaaatgcagcattctttaggagcagtagagtagtctctctgctgtctacagattacatataatcagaaataatgttcatagctttgcatgaagaatctctctttcctgagggaatactgaagaaaacattgagaaagttgaggggggtgatggaaaagatgagcaacaattggaggtagctgagggccttgcctttccaatggagagtggtggatgtcgacatacatacatggatggatggaaagtataagacatatcacatatgtggattggagaatagagatggaaatttctgaaggctttgcattggcagcattctgggatgggcaaccaaaacctcttcttgtagtatctgctagactgctacagtacatggattgttccaaatggaaattcatttggaaggctattgcttgtcctggggctcaatgttcttcagtactggagtacagtatgtttcagagaactaagccatctaatagtcttctttttttctaaaaaaaaacgatggaataaaacctggtctcaacatctataaagccatactataacactgtttcagtgacttgtatctgtatttgtagaaagggattttccttgagatgaggattatctcagcctggagcaaacgagttgtgatgaaattaggagagaaaaaccctctattattagtacgagtatattgtagggttggtcagctagtgtgctctgctgtttgaagagaaggtccaaaaggcacaagaagaagaagctggtagtgtagtggaatgtcaagagcaaataacagtcgatcaagtcattgctgtggcccgcagatgggccacgtgttaagctcccattggcctccgttgcctggctcggcggctactgggtattggtggggccctctctctcctccgccgccgccgccgccttcttttcttgacccgttttacaaatcatcaataaataattaattgttttaaagaaagaaaaaaaatccatcaataaatgaacattaatcctcccgcgaaagaagatgtccgttggattgggatcggagggggaagggtgggcagcgtattccccacgcgctcgtgggccaccaaagccgtcggtgacgtcatgcggtgcgtgagcgggcgggtgcgatgttgacgtgatatcgtgtgcgtggaagaagtttctagaaggaagaggaggaggaggagcaccaagcgagcttaataagtactgtaatgttcctgctaattgctactctaagcaagcgcacggtcgagtgcgaaaatttgtacagactacagtagttagtacatgccaacctatctaccgaccgaatgcatgagcttgataatgttgtcatatataattaaatcaggacaggcaggcacatatgatcatttggtcggtatgatatagatataccatggctttccctcattcattgattaattagccggagatatggtatcatccttgattgcgagatagtatacttat

SEQ ID NO: 34817 - DNA, 1501 bp, Oryza sativa
gaatagcgagagagcaacacgtgcgtggacaagtagtgtactgtagcgcgtccggtgtctcgtctggtcggcacgcacgcgcaaatgccctccctccatcccgcttttggccatttcggcatccactttccccttgtgttctccaaaacaaaccatcacaagagattaaggtcacatcaaaaataaattaaattaagcagtaataacctaatagaaagggcattggttcaactctagcttcatctcttttagagctgaaacacaaccaaatagtttcagcttcataaaaaaagggcttcagcttcaaaaaaaaaaaattaaactgattgaagtgctcttataaaataaacaaataaggtaaaactggatttagatagcttcacaactttatttcatatctaacttttaaagtaaaatttaaaattttgtgccctaccaaacaaccctattagtgctaatcaacaacaacccatgcccattgattactcagatagaggaaagagccacaaatcgcataaatttactagtaaatattattactgtcactgacaagtggtttatttaaggaggatgaaaaaaaaaggcaaaaaaaggaaaggaaagaaaaaagaaattacttgggcgtgtcgagggggataggaaagaaggaaggagttggacgactcctacaaagacgacgacgactcatccgcttcttcttcttgtttccaccgagcccaagccgccttcgccttctcgtctcgtcgataaaagccgcgagtccacccacccctcctcctcctcttctgtttttattcattccttttgcttcttcttctgccattccatccatccaccgccgcctccgctctctcttcttcttcttcctaccctttgcctagttgcattcggagaggagaggactgattgattgattgatcgatcgatggccatcgaccacgagtcgccgttcaaggagctccgcctcaagaacaggaggatcatggtatgtttatatgctgcgccattccgttctcttcttctttttcgattactccttgtttcttgtgtagtactacatgaatgaatgaaggaatgagatgcttctggagtttattccccttcgttgttgtttcggttactgttgtattgggcggccgatttctatgggcaatggcgccagattgattaaaggattcttcttcttcttgggttcttgcttttgctgcttccctctgtgcgttggaatccccgcattcctttcgccgccaaatccgtgggtttttttttaaaaaaaaatcgcttctccgtgatttccaagaatcaagaaacgcgctgtgaattgcgtgcatgaatcgttcaaaggagaggggattatcttggtcaaaactgcctcttttcatccaatctaatatcgagttgtagtttaggaaaggaaactgacggatgcgttggtttattgaaacttgcagggaggaggagggcctgagccggaggaggaggaggcggtggcgcacggaga

SEQ ID NO: 34818 - DNA, 328 bp, Oryza sativa
accacatttattgcggtttggttgagcgtgtcacgccgcatgtaacgcagtgcagtgcacttgtttatccggtctgtgaccagtcacagaccggtcagatcgcgggttaggtggcgacaggcgatctgacacacgcctcgccccatcccgtcaggacgagggcttctaggcgctcgtccccagctggagctagcgtgttacctcccagagatggcacgttagtcctggtcagatatatgccaggcttcatcctaaccattacaggcaagatgttgtgtgaagaagggcgaacatgtagattgctaagctgacacgtgggggacaagaa

SEQ ID NO: 34819 - DNA, 1501 bp, Oryza sativa
acaaaatttattaaaaatttaaattattttttaaatttatttaaatttaaggaggttaccgtggtattgtattaccgtacctcgcggtaaggccggtaaccacggtaaccacacggttaccggcggtaaggtaaaccctacatcgacacacatggaggcatacggctacagtttaacagctacttaggcaggaatgtacgtatgtgcgttgaagagtttggcatgtttggacttttggacgttggacagaagaactgaaagaaaatttaaacaaaaaaaaaataagagaagaaacagaagttgctgtgcagttaattagcgtgaagattactagcacgggtggttgatgcggatggccaaaccattaccttttaccaatgctgctgtgagcatgtgaattactccctcattctttaaatgtttaacgctgttgacttttttaaatatgtttgaccgtttgtcttattcaaaaacttttgtgaaatgtgtaaaactatatgtatacataacaataaatcaaatgattggaaaaaaaattaatagttacttaattttttttaataagacaagcagtcaaacattttaaaaaaagttaacggcgtcgtacattttgggatggaggaagtatatatttcctccctatgtcactgtcaatgcaaatgggtaggcaaccataattacccaacccagtcttttgttggtccacggcagattggcagtggcaccatattcctacctctatatttcttctgcgtggacctggaaaaagacagcattcgtattgtattttagttgacagtttttaaccaaaacaacaacatcagagtggcgcagcggaagcgtggtgggcccataacccacaggtcccaggatcgaaacctggctctgataattattttttattttattttaaaaaacatcaatttcatcacttaaatggctaatttttaaaatttcaatcccgctatcattttcttattcaatttcatcacttaaatggctaagttttaaaattttcatcccactatcattttcttatttttttaaaaaatcaatgtttcgtcacaggctaatttataaaatttcaatcacaaatcttatatggctcaaagataagtcagaacttagctacttcaattttatctgtaaactaaagggccgtgtttagttgttttagcaaaataattttgagcgtatgaacacacatttgaagcctaattaatccatcattagcaaatatttactataacaccatattatcaaatcataacgtaattaggcttaaaagattcatctcgcaatttacatgcaaattatgcaattgtttttttttcgtccatatttaatgctccacgtatgtctaaacatttgatgtgatgaaaaagttagaagtttaaatagaactaaacacagcctaactcattcaggaaaaattcagaacatatcagcaatagaatgcctagatacaccatcagcatgcaagaaaaatgaacaatcacac

SEQ ID NO: 34820 - DNA, 1455 bp, Oryza sativa
aatgtgcgataccgtgccatgccgatttcattagcgattaattaattattgattaataattatttaatcattaatcaggataattaatcactaattattattagttaattgttaattgagtaattaatcactaatcaaaaggagctgtcagacagtgtcgctcgttgctttagcgagaccgttcggtctcgctattccgttacgcgataccgcccacgacgtcattcccacatcatttttgcgcaacagttgtgcgagaccgacggtatatttctgtaaaaaattttgcatcccgaatatttttgagaaaaaaatgaatgaacagtatattttaaaatttaattcgtgaacgactcggttctttgcgctgtagtcaattgatgaaaatttagactgaggtcattaaatatttttgcatcacacgttttcttttatgaaacttctactgccttagtttcataaaaattgaatttctacctttaaatctttgtcccataaaaattttatgtctactaatgtgggacctaacaaaacaaattgattacatcaaaatttgtttccttgtaatctcctttctttccatttcatctcttaacctcttgtctcaaccttatttttaatcaagtttatatataatgtgtgtgcgtgtactgtgttcattaaataattaaggttaatgtgatcatttgtttatctttataatttgtccttaatttcatagaaatttttttttatggaggtagtatagtgttttcaaaaatggatgacttttttttgcccgtgcattgtataatcacacaatacaatagtgcaacgttttctccagttagtttgcacacgtttgccacgttgagttggccggctgggccagatcagcacgagcagccggtcaagacttatctctctctttctcgctctctcatcgattcttgttcaatctctctcctagctcgtctctcgtcagtgtcaagagaaagaaagggagaaggtgaacgtacccgcatgataattaaacctaaatcgagaaggtgagtagccggtggctgcgggttcgccacctccttctcctcctcccgtcctccgcctcgaccctcccatctccactcaaggtctgtggaggcctacagcggaggacggctaacaaggcggagatagacaatgggcgaagagcggcgagcaggactgaggtcggtgactaacccatcttctgtggatctgggtataggcgacagtggagagagggtgcaattagtgacggcatggccacggaatcaaatggtcccttaaagcgggaccagacccccatcgatcaatcctaagcctgaaggaggtcaagatggagtcgtatatcccatgggcatgttcgactgccattcctacgacagtgctacggctgcagcgcttgtgttgtgcagctgcagctagccttcgtgcagctgtaaaaaatgccagtcg

SEQ ID NO: 34821 - DNA, 1501 bp, Oryza sativa
aggctataatagtaattgctagtgagtgaagatgtggcatgcttgcatgggattttaaatgggttagaacagtaattgctagtgagtgatgatgtggcatgcttgtatgttgagctttagcttctaataattattagtgggtaccaactatatagaaagtatagattgtttcacctgcttcctatttgaatgacctccaataattagcagtgaactagaaaatggacaatatgccactctattcgtgtgatttcaatgaaatgccacatgctagaggaacgaaaactggagtcctcatccctcttgggttttcgaggcatcaacggtatatgaactaaagtccctaaccctcctaggacttcagggcatcaacagtacatattcaagagacagacaatatctatatactcaagagatttatattatctacatcttcgaggtgtcgagaagagagtcgagatctatatgatctagctatgtcttcaaagagttgaagatacaacttgcaatttttggcatctccttcaagctatgttcataactccttcatcaacgacatcttcgagaaactcgtccaaatcaacaagaaaacctatgacttggccattggagcggccaaggattccccgggcatgtagtgtgccccggatcacggagcccgccccgaaacaagttgcaagcgactcagggccccaggctagggcccaagcacaccctctacctgggctctccgtggagaactccgcccatttataggtaatggtgggtccggaggataaactttgaccaacaccatgatttaactgcagagtgcagcaacctggaaagcagctcaaccgcatgcttcaaggacgtggcatcgcacgcgggctcccgcatgcccacgtcaactgaaggaataggagggacgtgacatgttgcccctcgttctctcccacttagtctcacctcggcacctcgtggaggctgactgatggcccatgacagccgggcatagactttcttgcatgcagctccacttgtcagccgctaggtaaagttggcatattttctaatcaattatcttaagtttggctaagtttataaaaaaatataataatattttcaacacaaaatatatatattatgaaaatatacacaatattatatttaatgaaactaatttggtattgtagatgttgttaatgttttctataaatttaatcaaatttaatcaaatctaaagaagtttgattcagaaaaaagttaaaacaactttgcctgtttcctgagagatatggaaaaaaaaagaaccaaagatctttcagcacaaggagctctcggcgtctagcccattctccaaagtcagcgaggaggccaaaatgtaggcactcatggatgctagaaagctcaccgcttggttaactttgtcgctagaccggatctccggtcctaacttgtagatattttgtctctctatagttttctcatgctcttttaatgaaattggtggctcatcaat

SEQ ID NO: 34822 - DNA, 1501 bp, Oryza sativa
acggctattcgaatagatttggtttactcacactgcagtggatgtacactttactcgcactccgcaattgtccaacacatgagcctcgtcccaacacatgagacgcgtcacgacaaagcttttcgataacctcgcattggcagtacccgctccatgaacttaaatcctcatgcactctaagtgtccatgtttctagcagtgagaggagttctggcgctcccgggaaagggaagtctcatacacatattaaattaagattcaagttaagttatctctctcacacactcatggcagtcctaccaatggcgacaccgatgtagggcacgcctctcggccctacctcaacggttgtcccacggtagcgcacctgcctcactcaggggtgaaccatctatgcagggatactgcctccgctcggctatctaatccgctaggtctatacccattcgagaagtacggttgtacgggggtcgtttcatgcttaacttcatggctcggtccttaattgaccggggacggtactagccttttccagataccacccaaatcctccgtccgccccagtcgaaaacagttgtttagttttatttctccttccacaaatcatgtcatcaacatcatggcaatatggcgctcatgtctccacatgccgcatctcaattaccttcccaaaggtaattgcccaagcatatagcatttgataaatatgagtatgcatgattctagaatagcatttctaagcaattgtcataattgactagggactcatacgtaaacatggttacgaaggaataagggggtaaacaataatcaaggcatggcataatcacaagtaggatgttcctcattgcatgcaattttatttgtaaacaaaataatttcgcaattgggatcaacatgttcaaggaatagtgatgactttcctgcgcatgatagtatcttatcatgtcatagtgatgacttgcgcatgatagtccttattcttgatataattattgttcaaccttcacctcctggaagttgtagacgttgccttacgactgatcgatacacaatttctataatacgcaagaaaaaccaatattcaagcaacaatcaaatatgcacaaacaaaatatatttgatgaggtcgaacctagggttgctcatattattcgcgcttgctgatggattccaacatgctaagggctaaagtttcttaatctttctgttgtcatggtggtctatttaggagctagccaacgtagtataaacgagatacatatctggctaatatgtggtttagtctagctaatggctatggaaggattatggctacacatgcattgatctaaataaaatggtcatatactagaggttctgttgtcgtcggatggatttgggatcaagcaattaatcgcagggaaccatttgtattattattttattgatggaggctttgctttaattatgaaaatattttacttgtcacaataaattagaaaaggttaataattatcca

SEQ ID NO: 34823 - DNA, 175 bp, Oryza sativa
catgaaagtaacattttccttattctgatgttctctttttttccttctgtttttgttagaaatttctggtcacactgtttatctcctgtatcaacagagcatatatttaattaagtctatcgccactttctcatctgttctcattctctttaggacaattgatgacttctgaaat

SEQ ID NO: 34824 - DNA, 1501 bp, Oryza sativa
gctttgttgttgacacagacaattcaactgaatgctcacggaaaattcatgctgggagtacaatgatgaatcatcgccacaagagttttgtcaattctgaattaactggagatgcagatgttagttgtatcaatgatagatagattgctaggacggcacattacagaaagaaaagtactcctagtagaaaagaaaacaacggccaattccatgccaatccaatgcttgatatattgatgaatgcaaactgctttgctgattctcatttcctgcaatgccagcccaagtagcagtacattattacagttagatatctgttcacatattgattgaatggtgatccattcacatcaaaactctcccagctgcattgccgtacgatgctgggaaccatgattaagttgtgcgtgttagcctcctccttgcaattagctaagtattaattaactaggcaagtagtttcctgtggtgtctgaataattcctgtgcctttcaaattcaggcagcaaggcagagagagggacaagaatatatttgtgtgtgttgatggatggagattggagaggaggaggaggataaggaggaagaagggtatatgaaaaagcagggaatcattggtggccgtccgttggttgggctgtccaaatgtgctgacagccacgccgatagatggaatggatgccatcctcctccctctttacctaatcaaatttaagcatctgtttcaaaggaaccattaaattttaagcaagtggaggtagctctcggattggccaatggcagccaaagtaacgaaacaatcaggcaggaaatgcctgatgccgttctgttgctgggggaatcagaattcagttaaatttcaagctagtagctcacctctttaatttcaaagtgaaattttcactctgaactagaagtagtatcctttttgcaagcaatgcatcagtgcaccgatgagtgtttactgtgtctgtgcgtgtgttggacgttgatgcgacaaggattaaccgcacacactgtcactgattccgagtaatcatgttaggacaaaatatccacacgctgccgacgaccgagggctggtcaaatggaagacttttgattcttctcttttcccagaagatggagctaaacttctgctagtgttcaaagcctggagagatacacacattcagatcagatgcctcttttttctctactttgctcaggtcgtcgttgccggtcgtcgaaagcaacctagtacaaactacagatagtaggagtactattcacaagtttggggctttttttagaagtacgaagtagtttgtgcatttgtagcatgatgatgatgatgatgctggctcatcgctatgattacatgcacattcatagaccatcctgtctgtattctgcaccgaacgatagaagctacgcggatcaccaccaagaaaggcaacaatcaggccaaacttcgttcagaaaataacaagccatcttgtgacaaattaccttccatatg

SEQ ID NO: 34825 - DNA, 1501 bp, Oryza sativa
cctaacaccttaatcttcaggccatatctccagctaactgtctattaatttgttcgttaattagtactcctgctgtagtatgctagtagcaaaagcgaagcaacgacgagctgcaaagcaacctgcaacttgcaagcctctctgcaattcttgcgacccaaaccaatactgacactactactaatactgatcgatgatgcgtcaaggctcgtgaggctgctgcgtgcaaggaactcgtcgtcgatataattattgctgcaatgatccctgagcaatgtgctcccaaaatcttaggactgattctgacagattcagtcgtaatcagcaatgcgtgttgcaatcttactcctgtgtagtaacaattagtgcagatactgcatgcgtgttactgtcgattacattagcagataaacagcctctccatcatgtcaactgcatgccttctgaaacaattgatgtgatgtactttttacatgaacgaattcctgaattcctgatactgtcaactgtcaagcattgtggcctgatgctaatgctgcgaaaagttttatgatactactagggttgtgtttagatccaaactttcaactttttccatcacatcaacctgtcatacacacataacttttcagtcacatcgtactaatttcaacccaaatttctaactttagaaggaactaaacacagcctagcttctctagcacagcagcatgttcacttcttaattagtggcatctgaaccatgtgatttttgaaagtgaaactattattaactgatcgagttgccgagataaggacagctccatgttaaggtggggcatcacattctccagcctttcaagcaaccccaaaccatgccgaaaacacacatcttctacaatttgtgagattaaatgtcagggaaccgaaattcagtcatgcagatgtggattcagccacattttacggatctgaaactactgcgactgatatgtcagcactctttgttttcgtactagcctgcacaaacctctttttaagttaattcagtcggtaccagatgtcagaaaagttcctttgaattaaatctcaagatgtcaccagccaacagaccaaactgatcttctttgtatttttcgacttgggcaaatgtttgcccatgcaatgccatcaaaactgagccgcaaattcagttggtcaagctgaattctgttactaattctgttccgatttccactcgagcagagaaatagaaccgtaagtagtagtacaatacgaatttaagcggaatcagctcagattccacacgaggacaaattcgtattcgagctcgaaaaggcaaaaagaaaccaaaaacagaaaaaaaaaagaaaaggaatccggctgtgcttggattgcattggaagcaaagttcgtttaaaaaaaaaaactaaaactaataaaccagtccgtttcaaacaccaaaaccgcgaacgctataaattcggagggaaaacctctccgaatctccaaactcctccaa

SEQ ID NO: 34826 - DNA, 383 bp, Oryza sativa
caccacccctagcggcgtgtcggcggtgaggctgagtacccactgctagagcagcggctgacggccaacatcactagagtttgaagagctagggcgccgccgaatggctggagaaaggatatagtgatggtttgtttggggagcttctaactgctgcaacttctctcagaatcagaagctccgcaaatagaccaacttttggtccagattctgagaagatgtagttgtagaatccaaaagctcccctaaaaacttttggaacccagcttttccagattctcaaaaactggctaccaaccagctacttctcagaacttaagctcccccaaactagcctagggagggtagctggagagggccgggatttccggtcactggcgaga

SEQ ID NO: 34827 - DNA, 1501 bp, Oryza sativa
cccacagcttagaaaaccatgcaaatgaggtccctcgacagtattgtctccgattttggctaacgtacgcctacatggcactctattgactaggtcttaatcccacgtggcgcttacgtggcaattcgatccgaaaaaataataaaacccgtgagacccacgtcagctacacacataaaaaatgatggtacccatgtggcctcacatgtcatcctcactaccctcttctttgtatctatctttttcttttctttttcattcttttttcttcttttgcttcgcgtccggcgcttggtgggagcgccgtgccggcggagagggcggccgacgggagcgccgcgagggaggcggcgagctcgtcgggccggcagacaggagaggagcggcggcgctcgcaggccggcgggagggcgggagaggagcggcggtgcgcggggaccggtgggagggagcggcgtgcggaggccagcgggagaggatcagcggtgcacgctggctggagggtgggagggaggggagcggcggcccatgccacgccggcggagagggcggccgatgggagtgccgcgagggaggaggcgagatcgtcagggcggccgacaggaaaggagcggcggcgcgtgggagccggcgggagaggaggcaacgcgcagcggccgacgggagggagggagaggagcgacggcgctcgccggttagcaggagggaggtaggctcgccggcctctccgccctggttggcatgtctcccccctccccgcctgtccctcatttactttttagttttgctcatttattttttttcaggatttaactgtcacgtatgcgccacgtcaatgacacgtgggacgaagatctagttaaagaagccacataggtatcacgtcagttaaaccggggtcaatactactgagggatctcatttgcactggttttgtaagttggaggtaaccggttttccgtaccgagtatgaaaatcagactgcgcgacaaattgagggaccaatagtgaacttatcctgcaactttcagccaatttacggccttattgtctcaggcctaaccatcttcgtttcggaagaagaatctcggcctggaaaaggcccggtccaagaacgggaggcgagacggaccagcgacgcgtctgtgcgacggcatgtcctaaccgcgacgtgagcgcctttttgttgaccgtgcgtgcgaactgtcgcaagatcgcccgtgcatagacgccaatctccggatttgctgtcgtgaccgtgccatctgcggtgaggcggtgagcgacacaagcatttctctatcgtacacaccacgcctctccaggatgcctgcaagaccagtacaacatccaagcacaataagaacagcactcgcccagagaacacagcaaattaaaccaccgatatccgcttgatcgcaccacccatttttacacttttccgcgcgtgtacttacactgcctgcgaccgccgcgatcagacacatggactgcaccaagg

SEQ ID NO: 34828 - DNA, 1501 bp, Oryza sativa
aaagctttcaatttgtttgtgtgctccaagtcacgtaccactcccgcgcaaggccaacaaatcaggcccaggaaggcaggaaactcaaagctaagcatgcgcagctctatatatatttgtaaactctgctttccgagagatcatacctttgagctcaaacacagatgattgttaatcggaccacaccaaccacgcatgtatattattgacaaaagctcaaagtaaacaaatgcatttgtgcatgacataaaaaagggcccattactagttcttacacgctaaaatatatagtactacacaaaacttggaatatacagaatatggcccgactggaacggatgtacacctatcaccaagcaacatttctaatttcacaatcacagaaaaataggatttcatgctgagcaagtttcattccaacttgaatcatctactggtactattgaaactaataaaactacaccataagtaaataaataagaggcaatgaataggagcaaaaaacatacagtgcaccctgttgggtcaattcattccagagaactgaatgaaacaatccacagttccaaaatacaagaggcacaggggcatgggtggtgaattttatatgactcaattcaccatgtcaataatagacaagtgcacgttcattccctatgccttagctcagtggaacttttatcttatgtagactctaatgtagaactataattatagatatcaaaatggcacaaatatgtaaacttttcggctggtagaactaaaaattctgaagcataagaaactactcacacagaaatgttggatacaagtccacagcctgctatgctacatgataaatggaagtgcggagaaatcaagggtaaacagaagtttaatgtttgaataaaatctaagttttttttttttacgattataagtcattaggtttgagaacagcaccaccttgtgaaagtaatagaaaaaaaagatccgtaaaattcttaacttattaaagttttaccaaaccagtactcatcgcttattagtggagcaccatctgttctgtccatcaactctacatatctaacctcttattgcacgatgtaggcatagtctgaatgaagtgcctgataaaacagcagcagttgaattgcaatcactaaaaatgcacattattgtctcatcatggctcctgggtatgatattatactacacttatctttattagttttttaatcaatttattggagtgacactcaacatggcagacgttttcaggtcatacctacaattctctagtcatgactcagcataaatccacaatcatattccacgcttgcaaaccacataatggggactaaaaacatatagtaaaaatatgaatctggcacaatctaaacaccaaactagatgttttggaaatcaaacaatgcatctattttaagatatgttgtgatcagccacactatggcaagaaaacaacatatcacagacaataagaatagagaaatataattta

SEQ ID NO: 34829 - DNA, 1501 bp, Oryza sativa
caacaaagacaacagtattatagaaccccggtggctcagaatcatggttccgcacataaggaaataacagcagtcactatgcataaccaggtaaagaataagtaaatcatcatcgctgatgtgttggccctcttcatagccttttacaatgccaatggtgctggcatcacatatctgaaccactatgttctaatataccaagattgtctaacttgacaggcaccgtgatacttgggttcttgatataactggtggaaatggcgaggtaattggaagtttctacaatccacatcacaccccaggtggtaggttgcatctatcaaccctgtaaatttctgggttctctacagattcaaccatgataaccctagtcctacaggaagctatgacaagtacaacacaaatcaccaaggtctactgcaccatagccatgccactgctggatcccaacactacccaacgccggagaggaaattttaaggctgcattttgagtgtcccttgttgctttccatccctaactactagagctagatccaccaagctactgtaaacatcaacaatggcagtaacaaacaggagccgaaacgcacggcggcgatagatagatagggagatagaggtttcctcaccgctgcctgtgcgcacgccgccgcctcgccgtcgtgcgaactccggcgagaatggcatcgccggcggaaagcaacaaggaggaggcgtgtccgcgtgtgggggccacctgtcatcgagccagaggagaagagcgtcacgagtgggccagcaatgtcagcccatcagtacaggcccaacttaaaaattgctcggcccattttcggcctgcgaaaaagcccacccacccaggctctagggtttcggcgcgaccgcttatgaaggcgaggaggaaccaagagccccagtcctcactccccgccgccgccgccgccgctccatcctcctcacggagaagcgcgggaaatcacacctcgtcgcagccaagatctcctccagtccaaacgcatcaaagattccaaggtgggcatccaatcctcgcttgcaaacacaaccaccatgcccaaaaccgatgcctacttaggagttaggaatatgtttcttcgatttggttatcgcgttggtaattcttcgctttcgatttgagcagttaaaagcatgagatagtattaaccaaatcgatcctgatctgtgcgtttagattctgggcttgtggtcagtgttcgttgaaacagcacgaaattgttaatagtctaagcagtgtggatgtcgtatgagttaattgtagctttttttcctagtaattttagctctaattccaggttgtgctgttcgggagagcttcttgcgttgaggagaggggggatgaatagaagcgtttgccaccaccttctcacccagtgcaaaaccataagagagctccaaagaatccacgcccaggccctcacacacggcctccaccccaaccagcagtccatctcctgcaaaatctt

SEQ ID NO: 34830 - DNA, 1501 bp, Oryza sativa
tctacatattatgggtaacgtaggagacatccctattttcccccgggggtcttaattaccactgcttagctttcaattcgcctctgaccatcaaattaaatgtgaataacccgtcctcctctctttgaaacaaggggcgcttccggttctgtgcgtgcttcaaacaattttgtcttctccatattaccatatctctagagtcaataattttctatgaggaactcctgaactcaatcacttgctgccgttactcaacagttttctgttgaggtctatcctgtagaggtagtcaaattgaatcagtgatcgatttctaggtttcgtcgtaaacctaattggttacttccaattacgtaaatcaatagttcaaaccgcactcaaaggtagggcatttcccattgatataggaacttttgtaccagaaacaatagtatctccaattatagcccctctgggatgtaaaatatatcccttctcaccatccccatagtgtatgagacaaatgtacgcatttcgattagggtcgtattctatggttacgattctaccagatatgtctttttgattccgtcgaaaatcgattttacggtataggcgcttatgacctccccctctatgccttgcggtaatgattcctctggaattacgacctttaccacaacggtgccgtccatggatcaaattatttcgtggattggatttcacttgcctatctatggttcccttgcgtgtgctcgggataggtgttttgtataaatgtttcgccgtattattaagtattctcctttagtttttttctctatctagaagtggaatagaataacccggttgaagggtaatgatcatacgtctgtaatgcattgtatgtcctagaatagggcccattcttctaccctttccgggcagtcgatggctattcacagctactaccttaacaccaaagaagagttcgacccaatgctttatttcagtcttagtgaatcccgattcgacattaaaagtatattgattctttcccaataaacgaagacttttttctgtaaatactgcgtatttgattccatccataaatcgactttctctcctatgctctgagttccagtatcgataagaattcgagttcttattgttcttatgttatggtatgaatataccataccaattcgttatgtatggatgatggatgagattccatggatagagagccagttccaatagacttatggaacgttccggttcacgtgcatccagcaggaattgaacccgcaaatttaccaattatgagttgggcgctttaaccatttagccatggatgcttaacagggatcatcgtacatcgtaaataaccaattttcatatagaaagacatatcatagaaaaatgaaatcgaaaatattcggagatggcaaatattcggagatgactatgaaaacacctctctggatcctcgaattgaaagagagattgagagggatccagaatcctaattctcgctatttgg

SEQ ID NO: 34831 - DNA, 1501 bp, Oryza sativa
caagaaagaaagcaatggattagagccttaaaaaacgaaaacaatggatggtactgtacataggactgaacattaaatttagtggtccatgatggagcatatttggctgttaaaaaaaaagaaaaaaaatacaaattaaatttagtggactttactaatttaatttcgtggtccatgacgaagcatattaaaatctagtggatttggctgttaaaaaataaaagaaaaaaatgtagattaaatttagtggacttcgctacaagaaaaaataggaaaaaatgtttggctgttaaaaaaatgaaaagaaatgcaaactaaatttagtggactttgctaatttaagatttggcaaagaaaaacaaaataaaagaacatcagtaaaaatggtgttacccagactcgaacaggagaccttaagtgcattaggctgcgttctttctctcaacttggagtgaggtttttagctacgtaaaatgagaaagttcattagcacgtaattaattaaatattaataattataaacttgaaaaatagatttacttgaattttttaaacaatttatatatagatttcttttgccaaaacacaaacaatttttttgagggaaatgagtgctttattgattatgtaataatattacaatcttacttcagagcctgcatcacacaagacgaagcatggtcacgccaaaccgcgcaatatgcggtccgtttagcaagttgagtaagttcatcagcaaccctattacatcctcgttttctatgatgaatgcgcactttttaaagacttcttattactaattttatcgaccgatttagaaacgtccatcttgatctttcctctactttggttgacattctttcaatcgccgtagcacaaaaaatttaacagttttaaaaaacgtgttaacggaaaacaagaagttgaagtttgaagttgaagaaaagagaccttagactgacgtaataacctactataccacgacaccaattgatattaaatattttattctatttttttaactctagtacttgattgaaaatcagagtaactctaattccaaagtatcacactgccaaaattagctggcccaaattagccgtctgcaaatggcacgagattgcatgttgcatgacaaccgtccactactcaccccacatcatgaccgcaagaaaaaattccaagttattttttttaaaaaaggaaaaaatgaatgaaagaagaagaaacaacagaataacaaaacatcattactactgatggccattttaatcaatcattttttggcattactctagtatagttgagtaattaacaattttttcaaaaaagtagacactttaattactcacagccactaatcacacaagtttgcgtcatctcccccatctccgggtctccggggccggacagagatcgacccagggaagaagctagccctcgccgccgccgccgccgccatcgtcgtcgaggactcaatcaatcaaccaaccaaccaatc

SEQ ID NO: 34832 - DNA, 449 bp, Oryza sativa
aggatttcttccatgaagttttacctcttgttaaaattcctccaaaacttgtatgggaagagacattctataagaatttcataggattacatagggttcattcctttgattcaaagggctttgcaagaaaaattcctatggaaatgaaatcctctataattcctatgaatttcctttgaatcaaagggggcctaaatttcctccaaatcttgcatgggaagaagcattccataggaatttcatgggattacataggattctttcctttgattcaaaggactatattggaaaaattcctatagaaatgaaatcctttaaaattcctatgaatttcctttgaatcaaagggggcctacgttggtcatgtaccacattaaagcccctttgaatcgtaggaatgaaaaaacagacgaatatgaaaaacacaggattttgataggaatgtaagt

SEQ ID NO: 34833 - DNA, 1501 bp, Oryza sativa
aggattggatgcccaccttggaatctttgatgcgtttggactggaggagatcttggctgcgacgaggtgtgatttcccgcgcttctccgtgaggaggatggagcggcggcggcggcggcggggagtgaggactggggctcttggttcctcctcgccttcataagcggtcgcgccgaaaccctagagcctgggtgggtgggctttttcgcaggccgaaaatgggccgagcaatttttaagttgggcctgtactgatgggctgacattgctggcccactcgtgacgctcttctcctctggctcgatgacaggtggcccccacacgcggacacgcctcctccttgttgctttccgccggcgatgccattctcgccggagttcgcacgacggcgaggcggcggcgtgcgcacaggcagcggtgaggaaacctctatctccctatctatctatcgccgccgtgcgtttcggctcctgtttgttactgccattgttgatgtttacagtagcttggtggatctagctctagtagttagggatggaaagcaacaagggacactcaaaatgcagccttaaaatttcctctccggcgttgggtagtgttgggatccagcagtggcatggctatggtgcagtagaccttggtgatttgtgttgtacttgtcatagcttcctgtaggactagggttatcatggttgaatctgtagagaacccagaaatttacagggttgatagatgcaacctaccacctggggtgtgatgtggattgtagaaacttccaattacctcgccatttccaccagttatatcaagaacccaagtatcacggtgcctgtcaagttagacaatcttggtatattagaacatagtggttcagatatgtgatgccagcaccattggcattgtaaaaggctatgaagagggccaacacatcagcgatgatgatttacttattctttacctggttatgcatagtgactgctgttatttccttatgtgcggaaccatgattctgagccaccggggttctataatactgttgtctttgttggttcttctttttttttaagctatgtattttaagctccaaaagtttggagttagggccatgagttcttgtttcagtgagctctcttcatttgaactaaaataaatgtttaactcacttttatttcagacgataaactctatattttgcactaattcaagagttggggggcttggagctatgtaacaaaacttaattctttcaaccacacaagcaagttttcaaattgtcaaagttatttgcgaacttaaaaaaagcttgacatctagtagttgattagaataacggtagcctaatgcatacatagacccactacatagctatataattagctaattggttaactgaccaaatatatatgttaagctgtggtattggtggtggactgactacgccaaagcccctagcaactactgggaaacgggcttactatttctgataccaattgaattatgta

SEQ ID NO: 34834 - DNA, 1501 bp, Oryza sativa
gtgacgacccagccctttccgccacaagccgcacaggtgccggtgtacttcaccgggcagcatcaatcacctggccaagtgccacaaacagtggcggaaggggcttcagctctgcagacgcaacaccaagctttccttcagcaactcaaccaaccctactacatttcaagtacaaccccatcggctcacccggtggggaatacaagttaaggtgcgcctacttggttgccaccgattcagtcaggctcgggagcttcgccgtagaatcagggaccgcagttcgactgtgccaacgttgcttaggcgccaaccgttcggcagcaagctccgaccccaggcttcggaacaaaccaagtaccaatccaagctgccatgacgtggtcgcagccaatttttgacccatccatagcggctcagcaagtgcctccagttggagccgggcagccgaacgccatggcccaacctcacgtacaagctgcgatttcgcccttcgccacaccgtacccgcagcaaggtgggtaaacagggcgggaggcgaaaaggggctaccgctgagtgggggaatcaagactcgtccaattccaccccagttcaagttcccacccatcccgcgctagtcaggcgaaactgacccgaaggagttcctctccatctacgagtcagcgatcgaagcggctcatggtgacgaaaataccaaggcgaaggtaatacatctcgctctagacggcatcgcccgttcttggtatttcaatttaccagccaatagcatttactcatgggagcatttgcgcgatgtttttgtccttaactttcgaggcacctacgaggagccgaagacgcaacaacacctactcggcattcgccaaaggccgggggagtcgataagggagtacatgcgtcgcttctcgcaagcccggtgccaagttcaagacataaccgaggcgtcggtcataaacgccgcatcggctggtctgcttgagggcgaactaacaagaaaaatcactaacaaggagccgcagacgctcgagcacctacttcgcattattgacgggttcgcaaggggcgaggaggattctaggcgacgacaagctatacaagctgagtacgataaagcctccgtcgccactgctcaagctcaagtgcaagctcaaattaccgaaccacctcccctctctgttcgccagtctcagccggcgatccagggatagccgccaaggcaaggccaagcccccatgacttggagaaagttcagaacagatcgagcgggcaaggctgtgatggctgtcgaagaagtgcaagccctccgcaaggagttcgatgcccagcaagcaagcaactatcagcagccagcccgcaagaaggtccgaaaagacctctactgcgcctttcacggacgctcttcgcacaccacggagcaatgccgaaacattaggcaacgtggcaacgcgcaagacccaaggccgcagcagggggcaactttcgaagcaccccgtgaagcagt

SEQ ID NO: 34835 - DNA, 470 bp, Oryza sativa
attcctgcagcccccaaaattaaaagtggatcttttgttaaactaccaatagaaatttctgtttttttcattccacacccagcatgctcccaacataaattttcagcgctcgcacacgtaccagagattgagagtcgctctctcaccctcaaaatccatggggaaggagagagaaacacaccaactagagatggggagttgctctcttacctttaaatccacatagcaagatatatggggatagaaaatccaaaactactgcagtgctttttggatctgttggatcggattttttcactgaaatctctcgaaatcaattttgggaataaaataggatgattgttggtgatattaatcccttgaatttgttcgcttctacaccctcgtatttcaaaataaatacatctatcgaaaaggttattctagttaaactcttctagtacttcttgtatgaaagttagacccaacaa

SEQ ID NO: 34836 - DNA, 195 bp, Oryza sativa
aatattgcatacaggtatttgagcagcacaaataaactactatttcactgccttatggtgatgaaagcacaaatgagtaaataattctctttgagcagccattccttgtcgtttggataatgcaatatttagattaaaggtcccaaaaaaaatggcagtaattggttgcagcacctagtttctataaactaaagg

SEQ ID NO: 34837 - DNA, 1501 bp, Oryza sativa
aacaccactaaatgcctagcagcacatggaaaagagtcaaaagaccactctcatcgtcccctaggagaaggccactatgcatcactttgacaacctctgtgtgctcgaaaggtacctgcctccaccatctccaccccatgcgcccacgctctcccatctcgattcataagttctcctgctcgtctggcactttggtgatcaagggtggagctcaagctatatcgtcggtttgtcattaggccagagttccactactgcgccattgccttcactcttacttggccgagagagatgaggggcacaatagacatttcatagggctattgtggtaaaagaatatgaacaatgatagaagtggcatttaaagaatagcacattctttgaggcaaataattaaattttccccttatcatttgcctaagacctatacccatgaaaaaacagcaccactacaaaaatgcccataggtgtcagttttccagccaacaccaatgacctagtgtcattggtgccggtcgtagaaccggcatctttgtgctctcctaaattcaaaaaaaaaaaaggagaagccggctctaagccgagccgagcttatgcttacgagccaacccattccccggtcaataacaatcacagatcaacgcagatcaatcacatgtcaacaataacaaatccatcaataactacacaagcaagaactgcacgagcaagaacaatccatgcacgaactcatcagtgatgtcgccgccaaaaatccttggccacccaccgctgcctcccttggccaccgccaccaacccaccccgaccggatctgcgcgccaccagtggatggccgatggagagggagaggaagaagtcacttgggaggctgcatgttgccgccgcctcccatcccaccggatgtggtggaggggaggataatgcagccgcccaccgcctctcatcccaccggatctggtggaggggagggcgtcgcccgctgccgccgttgtcgccgtcaacgccaaatgcgggaaggaggagggggcgagagagaagcgactgtcaggccactgccgtccacaacctctctcaccaccctgtcatctgcaccactgtcgggcctccatgtcgcgcaccgccaccatccatccacacggtgtagaccagctcctccattccttccacgtgcttgcccctcagctaccccctccggcagtgcgttgtcgagaattactttgaaaagtcatttggaattagaatagggctgtgtttagttcacgctagtttggaaatttggttgaaattggtacgatgtgatagaaaaattgtgtgtgtatgaaaggtttgatgtgacaaaaagttggaagtttagaaaaaaactttagaactaaacagggcctagaaaatataagcatgtacatgtttcatcatataaaacgcccattaattgtctaggctagcttgaaggccaacatttgaacttacgttcaatagctttgatataactaggtgcaaag

SEQ ID NO: 34838 - DNA, 755 bp, Oryza sativa
atattgtggctaatgaagtagcttgatttggccatgctttctgctcctgctagcaagatcaaactgcgatgattaatgttattagccgggagttgtctagctaggacagtgcgttgccttcggggttaattaggaggtgacaatgacatgtggggccctggacgggaggaaggccaattccagtacagtagcccggtactccatgtcactatttatcagggtcgttgtgagtggtttcgagcctcgaatatgtgatatagtacgcaggaaagagacggatcactggattgacgctttatgtggctctgccgcttcgcgccaccaattggttgttttcagaggcaagtggccagtttggtttggtgcttatccttttgcaactaaacaattacggagaccttaattccatggcctatctatacgactatactgtatctgctttacatattcaggggtttgtttaacgcatagagcgcctagctagtcacacgccacaatggccgtgcacaaaagcatcggttaatttccggcaatcgcatgcaaaggcaaaggaggttagggggaggaaagcgagcattaagccattaattcccctgtgattgttgtgccctgtttcgtgatcaagttgcaatgagacgggaatatgccgtgcactcgtgcaaccctcggcttttgcacctactcgagaacaattaagaaaaggcaagtgtctgtctggaggcactagtagatagcgtactcgttgcgtgcgcagg

SEQ ID NO: 34839 - DNA, 458 bp, Oryza sativa
agaccttaaaaacaatgaaatctaagttcattccctcaaagatattacctaataacctgcaaaaacttgctctgctaggtaaccaaattattaaggcacattccactggtgaccactataagcctttaaggatcccagtacaatttagcatccctgctttatcaccttcctttcatatatatgcacaacagtgcttaccctttacagcccgggcgagagagagttatcagagtcttcccatggatggcatgttcgttcccttactcccactgttcatatgggcttctagtttttgccgcactcaacatgcagaccatatcagattgcttggtctgacattttatgcaaacagaaatggatattttttagataatgaacagaaatggatatagggcataaactttacaaaacattgcaggatgctaatttttcttcttcttcttttttttttttgcagg

SEQ ID NO: 34840 - DNA, 183 bp, Oryza sativa
gcggtgcacaacgtgcgcgcgctggggcgcggcgcggtggcgtccatgacggccgcgtccgcgccgtgacgtacgtccggtgggcggcgacggcgcggcgggtggtgacgtcggcggcggacggcacccaccgtctgtgggcgctgccggcgccggcggcggcggagacggcggcgagggagg

SEQ ID NO: 34841 - DNA, 1501 bp, Oryza sativa
aatctctaatttaagccacatatcttattttttattgttattttaattttgacaaaataagtaatttaatatctatgttgttctatgcgccatatgctttatatggcaactagataaaacaaggaaatatttttaactataaaaaagttaacagcatatattattttactttaagtaattctacaaacaggtgtctctaaattatatccactatatccaatctatctataaaagtccatcaaatttccaataaacataactaaataccatgtgacgcacatataaatgctcctataacgccacgtgacgttctaataaattagataaaaaaaacaaattttcactaaaacagctagctctaataaatttctgtttaatcgttctctcattataactaaattaacaatataagattcatatgcctatattttgctatataattatagcatttgggcacagttcacctgtgcactttgcagccatctaaatactttaaagtcttacaacaaatattatatcactatgaatcattctacattctataaacatgcatagctaaattaaatctatagtatcgaaatagaaataaaaaacatattcaatttgacaatagaaaaagaaattgttgtcgaaacgacaaccgcatacgtcgaaagacgtggttactcaacagtggttggaaaaatgaagtgtattaaattttgaatttcacttggggatcccccgcgtttttactaccagggtttaggttgtacaggggaatttacatgattacccttatgaaagggacatttacaggggtacataatgtcatagggctcatgggcccctgatgggccgtctggcgatcgtcggcctgatgggccggaggggcttcctcagccctcgcgggagcgaacttgtcaaggcgaagtcatcctcctttggcagacagtcttcgccttgcacccttcgcctgagacgcctctggcctggcgctactcttcgccttgcgccgttcttgctccatagccttcgccatgggtttcagtaggttgggtcgaagggcctcatgccacccgccaacaagcccctcacgggcaagggtgagattggagcttcggccgagactgtgcaaactatgtggtatggtatgcggcgccccctttcgaccgatgctcctgccgaaacctacattattcctgcaaatgaagtttgttatttgtgcggctggtattatcttgccgcgcttcgcctcgtgggattgatagttatatatattcttttttcctgggccgaacggaacagtattgggccttcctatcttgggctttttactgtgccgctcggtcgatggaatttaccgtttcgcctacccttgcgatacgtgacactttattactggtaggtaggcgaacggtcgcctgggcgggctatatattcccgttgctctttccttttcaccgccacacttgccattttaccgtgtgcgctttctttctccgtctcttcctttcacagc

SEQ ID NO: 34842 - DNA, 1501 bp, Oryza sativa
ccttcctcctctcctcttcctcctccccttcccatccggtgggccggcggccggcggggccgcaggcggcggccgtgacgaggggcggtagcggctttgtttttttttaatttgtgatacactgagatgtataaatttgtgatttattttatggatttgtgatatatttgatttgtgtataattatttaggatttgtgatgtatttgatttgtgtgtataagtaactttaagatttgtgatgtggattttgtgatgtgaatttgggatgttactttgatttggggatttggggatttgcatgtcacttgattcgggagaaaataaaaaggaaaaaagaaaagaaaaagggaccatctgatactgctgctattctctctttactcccggttggtaacaccaaccagaactaaaaaagttcatctttagtcccggatttctactcccagttggaaaaccaggactaaagagagttaccaaccagtagtaaaaatgggttctccactagtgcaacatccgtcggcccggcacagtctgaccgacacaccgtgttgtgtcatgccgtgtccgtccacgggctgcacctacgcctaggcacgacataataagactcgggttgtgctgtgccgatctgaaggcacgaccagcccaccgtgttcatcctcgaaataaatctattttgcctcccttatctctttgggccgtgccttgtatggctgaaataagtctattatgcctccctcatctcttcgggcccgctgtcaacggactaccgcctgaggaagcgggggatgtcgggtcacggttgtgctgattgttgggtcatgccgtgccggatcggcacgctgtgccaaggaagaggcccagccgcccaggcacggtccaacagtcgggtcgggctagcacagtcgagttgtgccatgtctgatcggatcaaatctctgtgctgtgggctagaccattgggctacgggctttctggccaactacagctgcagttttatggagtatgaataaagtcggaataagttcaatttaggtccaccaatatggtccatccccaaattacaatactatgtcaactttcatccctcgatcatatgatggccggtttcggtagacgtagcgagtagaacccatgtggatccacatgtcagcgaccaaatcttctctccatttttcctttcttccccatctctcatgaacagcaaacctccgccgcaatgcacgcgctcctcgcttcacgcgtcgctccgccgacgcacacatcgcctccaccacctttccagctcactccatcggtgccgtcgcctcagggagagaggacgtcgtcggggaggtccaccatggccgggggcccggggtgagcatggcgttgttagcaataatcttgtcattagtgtaaaagtatgttttttgtttggtcatatgcatgtagtaagtggtttgtataggtcacatgctagaagctatgtacgtgaggtacatggacgctgcatagtta

SEQ ID NO: 34843 - DNA, 1376 bp, Oryza sativa
ttaagattaagattttcgtggcatgttttttaaactactaaacggtgcttttcgtgtaaaaactttctatatgaaagttgctctaaaatataatattaatatattttttaagtttgtaataattaaaactcaatcaatcatacattaataccatctcgttttgcgtaaaaaacttaatcttcatctttaggataaaagaacaccaccaaagtatatatattttgagacgggaaggagtaacaaaaaatcgatgcatggatgcatgatgtttagattccctgtgaccaattgtatacttgatttaggtaaggaataagttcacgttaactctctcaaatatatgtcggatttgatttgtatccctcaatccgcaaccaccaagctattgttcctaatgcaaccgagatgcacctactccgtttcattatcaccaagttgtttgcttggtactacaagttgtgttgtgctctgccctcccagaaagttgtgttgtgctatgccctcccagagtccaagtgtcacatcctgacacgaaagtctctctacaggagcatctctgtaatcaattcttttagccaagccaacgtcacacatgggcatgcttgtgatctatcgacttttggataagccaaatgttagtaatatgtcggtaagactgaggctgtgtttagttcagcataaagtttggattttggttgaaattgaagatgatgtaactgaaaagttgtgtgtgtatgagaggttgatgtgatgaaaaaggactgaagtttggatccaaactttagatctaaacacagcttgagttttggttgaaaaaaatctctagtttaatgtgcgcacgttcccgaactataaaaattttctatatagaagttttttataaataaaataaatttattttttaaatttgtaataattaatacttcaattaatcgctaaagtactttcagtttttatcagttagtcatcgtgtctatcggctatataaatgggttatatcacttggcattgtattaaaattaaaaaaaaatcacatgtctgatattttacacatatatatgttacattctaaaatatatattttttatagtctatatagaaaatatatcaagatcaatgtccactcaccgccaaaatatgatatttgtgaaaatgacattccaaaaatgatacaaaatgatatatcgctttttcatagtctatatagaaaatatatgttacattctaaaatatttttttgttatagtctatgtatagaaaatatatcaagatgaatatcgactcaccacccaaatatgatatgttctaaaatgccatttcaaaaatgttattttgctaagtgatataaaaaagatattacaatatatatcgcttaa

SEQ ID NO: 34844 - DNA, 740 bp, Oryza sativa
ttaagattaagattttcgtggcatgttttttaaactactaaacggtgcttttcgtgtaaaaactttctatatgaaagttgctctaaaatataatattaatatattttttaagtttgtaataattaaaactcaatcaatcatacattaataccatctcgttttgcgtaaaaaacttaatcttcatctttaggataaaagaacaccaccaaagtatatatattttgagacgggaaggagtaacaaaaaatcgatgcatggatgcatgatgtttagattccctgtgaccaattgtatacttgatttaggtaaggaataagttcacgttaactctctcaaatatatgtcggatttgatttgtatccctcaatccgcaaccaccaagctattgttcctaatgcaaccgagatgcacctactccgtttcattatcaccaagttgtttgcttggtactacaagttgtgttgtgctctgccctcccagaaagttgtgttgtgctatgccctcccagagtccaagtgtcacatcctgacacgaaagtctctctacaggagcatctctgtaatcaattcttttagccaagccaacgtcacacatgggcatgcttgtgatctatcgacttttggataagccaaatgttagtaatatgtcggtaagactgaggctgtgtttagttcagcataaagtttggattttggttgaaattgaagatgatgtaactgaaaagttgtgtgtgtatgaga

SEQ ID NO: 34845 - DNA, 1501 bp, Oryza sativa
tattctctggttaggcagggttcctgttcgattatatgtgcgcagtgttcaagaagacctttatgatttagaagatgcactacctgttggtgattgggaaagcatatcctatattaaccgaccattcgaagtacggagggaggaaggtatgtagcattgtaattaacatttatatcttttggatgacagtagaacaaatttggtcaagcgtttacttgtccttcatgagtggtttgcataccgtttttgcatgcttcaaagggttcgttcaccaacctggaagtagtggcgctcttttataatttcgagacagtagtagtgccctattgttgtacatttcatttcccctcattcctgtgaaacgtgtggtgtagggatagagatccagatgctatgaaatatttggtttcactaaagggttgtggttatcccccaaaaaataatgcttacaccattatgcttgatattgtggtgctatgattcagaatgttttacggtgcagtatcagcagtgctttcctgatacatttctttggtgcaggtagaagctacatcaccctggaacatgcgttgaaaactttgctacctgagttcttcagctcgaaggcatcacgtatacccgacgattccgaaactgctcctcaggcaccagattcagcccctaatgatgattctgatgtcaccccaagaagttgtgagaagttagagtcgtctgcttcgtcgagcccgcaagaggcgaatgtggccaacaagggtaaaatagtgaagctagtaagggtgcaaggcattgaggtcgacatggacatacctttcctttgggttgccaacaacctgaagaaccctgaatgttacctccatatttgtgtgtatgtcggtacaagaaaacgagagcctaaggatggtagatgaaatgttagaaacacaatagggagagcgcattccaggaaaaatctggtcttggttctcatcttggatgactcctagacattaatattaattctttgtacagatgctgaaatcttaatacgttttgacgtgctgatcaattggtgtaagatattggattggaattagatgatgaatgaatgaatgaatgaatgctcaatgttttgaaatgaagaaaattctgaaaaatgttgatatgcttgaacagaagagaagtgctgcttcaccacaaaagcatatacctcgttaaaaatagcagtaataataaataaataactctaagaaaagcccgggaaacctgtgtccaaaaaaaaaaaggagggaaatggaaggtaacaaacaaaagaggaaagtgtaaaaacgttgggtgctcccgcgttttcgccgcgtcgcgcgcattgtccgccattgctttcgtttcctcttcatgcgatgcgagctctcctctcgtttcctctcgtttatttataaaaaccaacaagatcgagctttctccgatccgatccgattcatctgtctcatcagatcagcgtgaagcagcggcaagaacacaaaaa

SEQ ID NO: 34846 - DNA, 1094 bp, Oryza sativa
gcatgaacctccagaagatccaacacctcgtccaggcggatcaacaactcttccagacgaacgaacacccccaaagaacggacaagagaaatgcaactgcagaaatttcatctcatttcttgatcacaaggagccaccaaagaagaagcggtccttgagtttgacgccgacaacgccattgagcaactttactgcccttgaaatagaaggacctgtgaggacagtcaggaatggtagtgtcgttgacatatagaactagtgtgtgtaaaaagctgagatgttatatattttggatctgagatatgccatctttcggtcaatctcctcaattttagttgagagaaaatataatcagaggctgcataagatgctatctgtagatttcaagcaaatccggtgatgggaaaaattcatttgaggccagtttggcaactgaaaaactgtatagaaagttattcttgtccttgatggtattttgaatggaggaaatatatacgtctgtttgattaattttttcatgaactttctcttgtcatgcttgatgtgtaccttgtccctgaatctatgtgagcagtcaagtcttcaacttttctgtctaaaccatatgaaatcgcaggtgtctcgattttgaaatgctaaaggaatctgttgtgcacttgtgattgcttgaggtgtactgcacataagagaactataaagcactggatgcagaagtcctttgctgctgggaaaagctcccatttttttgaactgaatttgcaggctatatgtttcaaaaaagaaaaaaaaaggaatttgcaggctcataatacataatccattctagttaaatgtatcagaataaaacaggtcactaacaagttttgtagttgcaacttagcacttattattagtttgagtaattagctgcaatacattatgacatataagaaaatcaagttaacaacgaaataataacaattggaaaaatataaaaaaaaggggggagatggcttttttatttttttttttgaatggaaatggaatattctgaatttctgaattattctcggtagacaggtagcatctttatggatatgatatgcgcgccattt

SEQ ID NO: 34847 - DNA, 1501 bp, Oryza sativa
tttcaaatcaagccagctttccaatgtgaaattttttacttttgccttgcaggtttcggaagctttgaaattgccatcatccccaccggattgcaaacatgtttataagagaggctctttgctttcgtttgaacagcgtgaagggaattgttcagaacgaatttgagatgactcgtttcaactgcagttgaaccccaaattccaaaatgaaacgcagagaacaaaacatgcaatcaagtttcatgaaatttcgccaaaaaatacgaatttttctatccgcacgttcccatatcaactcatgcagtgtgtaacttgacaggtcaagaattcctatgcatacaaattagaagcactttgggcattctattcgctcagcaatacgcttgagaacaaacagcacaaatgatgaattagaacagcactaatgatgggaaatacacacacaattagggaaccatggggggaattagagattgcttggcagagactggatttcacctgtgctttgtcgccagatggttctcttcccccgccccggcgaacggcgcgagcaagctcactggctggtataggttgctgacagctgcgctctccctggctggtctctactctgccacacgcagcggctgcagactccagcgcggcctttcttcgcgccgctctgagcagccgagtcgccggcgaggccgccacgcgtgtgcggcggcgccgacctgggctcctggatgagatgccgtcaaaaaatgcagaaatacagttcaaatcagggagcaaaatgcaaaaaatatccatattgggccctcgtggcaaaatgtcgtatcacggcccaaaaaatattgtcctagacttgggccatttgttcggcacacggcccacttaggcccaacaagtcaccctcgtcgtcttctccgatatttaattgtgcagctaattcagctgggagtagtagcctagtaggagtattaactgatcggcgatgacctgacgaaggctgtgtttagtttagcgcaaagtttgaattttggttgaaattggagatgatgtgactgaaaaatgaaaaattatgtgtgtatgataagttgatgtgataaaaaagactgaagtttggatccaaactttaaatctaaacacagccgaagaagaagacgacggaagctaagctagaatgtcacatcacgatgcgtgcttgctactcactgggcttgcctgccgtgcgccgccgtgtcaccagctgccgggcgatggtggaggaggagggccttggccttggaccaggacgcgaggaagcgaagcggagctcgacggcggcctctgggccggactcggcgaccaggaggaaggaagttggtgacgacgtggagtctgctcgccgctcactgcctgagtccgcctcggcgccatgctcggccgcgttgccctcagagccagctgccagccgtcgccgccttgaagcggatggagggatatgtattaggttagggtttttgttgttgttgatgtg

SEQ ID NO: 34848 - DNA, 1501 bp, Oryza sativa
agtataatttgacccatttgatagtaataaagttataagtgtgatatttcaaaatttctcctagtataagataaaagggaaactattttaaactcttgaggggacatcccctcgttatttgcatgtcacctaaatagttatgatttttttaaaaaaaatcaacaagattgattaatatgtgataaatcgctccacaaacatgcaatgtcaaaattaacttctacaggttgcaacgaaaaacaaatttgactgcgaatatacattaactagccacaatttaattttttttccgttgcaacttgtagaagttaaattttaacttacatatttgtgaagtgatttttcatatattaatctatcttgttgattttttatatttttttctcgtaaccatttaggtgacatgcaaacaacaagaggatatccatcgagaatttagaatccactaccaataaattagtgatatgcttaataggattaaaaaaggaggcaacaacaacaaagccatactacatcacctgcaggaggaggaggaagatggttgtaaccttctatcaatgttgtattgtgtagtcaaggttgtcaatagctagattttggataagttgtgttaatctttcaatttcatgggaaaggtgttaacagtgaaatttggtaatcggcaaagacgtcatcggcttagaatcattatcggctgcagcatctcggaatcagccgatgggagttatcaagtcgccaatagtcggattcctgctatattcggttaaggaaatcaatctattaaaggaagcttatccctaagtgaccgagtttaaagaggatgcggcgtggcaagttatctattaattagaaatagtttgttagtttccttttatctttaggaaagtgtgtttagtgtccaataaggactttatgttttccttttatctttaggttagtttctttcttgtccgacaaggacttgtatcaacccacgggtataaatatgtacacccggggcctatgtaatctatcctcacgatcaatacaattcgtcgcattgccaccccttttaccttttctactttattttattgtccggcgggacttggcacctgacgcggggctgcatcgatgttcgatctccagcgaaggggtaagtccaatgttccgtcggcccaagcaattgtctcatctatatcggcgtcgttcaaggctgcatcagtacattcgacctcttggattgctctggtttcgatgatatatttgcctacctatttatcatatgtctctgttaatctagtcttagcatatcaatttagctctatcggttgcttctcgttttagggtttctgccggtatcggctaaatcgtgttgctagattagattagcttagacatctaccactctgaaaacttagtcaacggcttgattgtctagatattatgtttcttttcatacttagtgctgcatcagttgagtttgatctactaagtcgtgtttagaaccataatctctagc

SEQ ID NO: 34849 - DNA, 316 bp, Oryza sativa
taatccattcaaaaagtttcagttttactgcataagaaacatctcagtaaaaggaccagttgcttctggtaataacatatcccaaatttctgtcaaattccacggttgcagtatgagcagactgtactgaactctgaagatctcaagaaatctcaaaccgatcatacgcttgattagcagaacgatatcttcttcatggacaaaaatgagtgagcagtcagaagtctttctttcagacgatagcagcctcctactgatactgttcatgcatcctgcttgtgcgtttggatctccttcctgcaatttcatcttcagt

SEQ ID NO: 34850 - DNA, 1501 bp, Oryza sativa
ctactctacctcctcggattctctgtgtgtgtgtgagagagaagagggcttcccatttctcactgcttccagtagtagtagtccggtgctggctccagccagcggtccagcctccaatctgaagttcgtgcttcgttcttggctgtgtgtatctggaaaggggaagtggaagtggaagaaaggtctcttctccggggacaagatcaggtggcttaattattttcttctcttctcttgttggtttgtttcatttttctttcatgtactgttgatacgattgcgatgttcccgtttgttgctttgtttctggaggcttgtgatcttttgtgctcgtgacctttcaccaaccgaggtttcttggaaaggaatggaattttaaccgtgaggggtgatgggagtgttcttcaaagcttgcttgtttatgactccaaaacaaattttaatttcacgtttcactcagaaacaaagcccatcaccatgctcttgtcctcctgtttcacgtttctcattgctttatattcagtgaagttttaactgtcggggaacggagttcttctgatttcctcatgattaggcagcgttagtattggggatttgtcctgatgttttgagaggtaactgcttgatttgcttgttcatctttgtgttgatgtgctttcatgcgtagcccctttgggttttcttgcttgaattcctcttcattcttcttacccgttcggccgttcacctcccaggcatttcttcagacagctctccgccacctcgggttatctgatagatttctctcagattccctgaattgcttggttcttggatgagcgcctggttcctgtttcttggatgtttgcagatttgcagagtattcggcaagctctttgaactagtagtatctgaatacttttgaactgcatttatgtcccaaactgttattttgtgatgatgatttgggaagaaccagaaaggtcgatgctttaatatcatatttggctgtattctacaaatgtggatgcattctttatttctcatcattttttttgcggggaattgtatttctcatcattaaagttttctcagctcaaatttattacctcctaaagatagaagttaagtgaagtttgtgctatattgtttgaagggaataatttcttcaatgttgatatttcagcttcggttaagtgcttctgagaaagtgagaaaagtgtcattggataataagaaatcagatgctagagcaccgaaatatgtggccagcgagcctaaaaggcgtggtgattctgttaatgctcatggttttcaatgtttcaggtaacagcacatttgtaacttaacttctatgaatatggctttattgtaacacggtgctttcaattagggttgatgctttattgtatttattcaatttgcgctttgatttgccaagttgtgcgagagatagttttctcgaatacatgcgaagagttaagctagtacaccaaacaaattactgctttgaactgcaaaa

SEQ ID NO: 34851 - DNA, 1501 bp, Oryza sativa
gacacaggggaggctttcctcggctgggagcctgggattccctccaagggaatggagggggtgtgaaaattgacattgtgctatcgtcaaaagtgggtttcgcctaaatgccattccgcacaatggattcgataaaatgccactatcaacacatgtttacacgccaaaatactttctaggaccaaattaaccttggcttctctcatcgccatcttctcttccaactccggttgctcctcaccgtacgcccacccacgtgaggatgtgccttccccgagcacagccattgccgtcgcagcctctaagcacggccgtcgctttcgccactcgtgcagtccccaagctcggccgccagtcgccgctcgcgcggtcctcaagctcggccgacaccgtggcagctttgagatgcagccaccacgctcgagccgccgattcaacctccacccaccattgtcgattggtgcagcctttacgggaacacaagcacggtagatactagctagcacaagcaggacacactcgattcgtttataatcgatagttcgatacacactaaaacagatcgatactagctagcctagaacagaacgaatatgcaatgtggccgtcggcgagagccactgcttgtcaccgactcgccgtcgtagcacaccgactgctgcgccacgccagccgagtcaagcctcgcgggcccctcgaacaaccgcctcagcgctgccgtccgcgacctcgtcgtcgggaataccggctgcagaaagtccaggtacggtgcagcgtcaccagggtaaccacggggtgcgcgccaaggaggcccagcacgtcgcctcgacgggttcccgatgtggctccaccaggttgttcgggaagaacaccgtgtccgggacatggccggtagatgagagcaagggagcgtccaggacgaaggtgcgcgctggggagtcgcctgggaaggagacgttggaggcggcgccgcaggcgaggaagtaggggaagacggctgttagatttaattgggtaattaatccatttaaatcaattaaatcaaataaattccaaggctcattatgctaggaattcatgtgaattcattcttctatgggatatcaatgggatgaagagttttgagaattaatccatttgattaaggaattggtaacttatatcaattagtcctaattgatggatggttgatggttgtgtagtggaggatggttcatggctagttgatgacaattagttgctctattcctcttcctattccattggtaacttacatcaattactcttaattgattgttggttgatggttgtgtagtggaggatggttcatggctagttgatgacaattagttgctccattcctcttcctattccatgactcttactcttcatcttccattcctcttataaaatgggaatggatttgatctcccgcgagaagaagaagacacactttcatccattttccaaagctgttgttgctacggtaatcccatcccga

SEQ ID NO: 34852 - DNA, 1501 bp, Oryza sativa
gtaattcttctaggttaagggacgtaattttaagagtaagagatactatgtaaatactctcttagataaaaaaagtatcatgacatttgagttttttatagtctttaaggtgtgactttaatcataacattctgtataggtttgtaaactctaatccttttattagttttcctttttgtgaaatacaataaagatgtattccagaggactttgttattgatgggtacatcatatatcactgaaaaaattagccgtgaatatgaacatcctgaacaagtctaagacttcaaccaaaatgggcaggttatactaccatgaacctaatcggtttaattatgctcacttcactaagtttattaggttatgaaagtaacttttcatcaaaaatctacacttaccattttttattttgaaactaagtttttttttagtatttgttgataatcaaagtcttgcaagtttttttaagaaaaaaaaatcaaacatcacgtatatttttttatcgaatagaggaacaagatcctatgagtctggtctggtttactccctccgacccgaaaaaagtaaatctaaaactatatgtgacatatcctagtacaacgaatctggacagaggtatatctaaattcgtagtactaggatatgtcacatccagtactatgttggttttttatggaacgtggagtattttaagagtcgtatgtgtctactctcggaatataatgttcctgaggacttctaaaaagctactagtattaagtatgactattacatctaacaacctatccatatttttcacaattacacatatataatttttgctccaagttccctttcagaggcactttgtcctttctggcaggatgtcttctcaactcataaatcaataaatcgatgtcagtgggacatatatatattttctagtactactgccctggttagttccaaagttttttttccaaactttcaactttccatcacatcaaacctttcatacaaacacaatttttctatcacatcgtaccaatttcaaccaaacttccaaacttcagtgtgaattaaacacaacctatattttaagttctacagatactactgttctgtccaagttcttttttaaagccactgtttttgcggttttgccatatattatatattttaagtagagactactgtttctacagagacttagtatattttaagttctacagagactactgtttttgccctttcgacaggttttgctctatgtcagttgatatactcaatattaaaagagaaattaaaatctcacccatagaaattaaaagaaatgtgaagccatatgctttgaaaagaacacctgccttgcaaacccaacgcaactgcaaaaggcgacagcatcaaaaaccgtgacagatcatcaaaagagcagaaatatgtgatgaagtacatacttgttggcatgttgcatcctcaatcaagagcacctcacaaacatcacaaactcaatttttttttc

SEQ ID NO: 34853 - DNA, 555 bp, Oryza sativa
aggtcgtcgaccgcgtgaaggaagcgctcgtcttcgtcgtcgtcgagttccgaggccgagccgcagcaacagcgccgcctctccatcgagctcagcatgccggagatgagaaaggagggaggggatgaggatggaaacggagacagcgtgagagaggagacggaaaaaggggcgagagtggcatgattctcattttagaaatttctagtggcatgtagccgatatgaagaatagtagtggcatttttttaatttcacaaagttgcagtggcatagatccaattaaccaaggaaaaagaccctgggaaaaattcccccgaggggattttttgggtgacatgccctaccccctccgagaaaattgacattgtgccatcgtcaaaagtgggtttcgcccaaatgccacttcacagaatggattcgataaaatgccactatcaacacacggctacacgctaaaatgctatgttggaccaaattaccctccactcctcttcttcctccttccaacaccatcggctccacccgtaccgtccgcacaccactaccgcctcaa

SEQ ID NO: 34854 - DNA, 1501 bp, Oryza sativa
ctgagacaggtccagcccgaagatcctcattgaacaactcaaatatgaatgtgcttacttgattgtttggctggccaggagtaccagaattatttaatacatggcgtatgaggtttgtattgtaggccaaagcattatccacattagcagccttctcattttgcccaccatgcgatggccacccagaagctgtgaccataacagggatcccagtgaaattcattgcttgcattgagttgtatgtagcatcaaccatagcatcaaacatattggtatagaacaaatttgtgttgggatctgaaatttggctatcagggttgagtgatcgaaacagcgcatattctaaggggaatacgccttgccctttgacatagtcataataaggttgggcgttcagcatgaagggagatgctgtgttgttcagaaattgaagatactgaagcattattgagctccatgtcgaattgaatgtagcagtagatggaggaaatggcttagagatcatgtctgttgaatgaggacttgaaattttcacctgggtattgagatttgcagccaaaagcgctgactgtaggaattgcaatgcaggtacaagaacaagagctgcatttggttctgtagtaagaacctcattccctacagcaatatgcgttatgttagtcgctggaatgtatgcagcaacattcttgttaatccaatcagcagctgtagaacgagattgccccactcgaagtagctgatcatttggaaccccaaccaccacttctattccagtatttgcaagggcagatagcatctgatggtctgaatcaagcagacgaacatgttgaatcttcttttctttcaggatagacactgtgtctgatgctgatggtgggttcgaaatatcagtgccaacattgataccaacaaatgctcctgtggaagtgaataaaattgttccatgaatatatatatggcaacagtcataaagcaaccattttgcagttcaaagcagtaatttgtttggtgtactagcttaactcttcgcatgtattcgagaaaactatctctcgcacaacttggcaaatcaaagcgcaaattgaataaatacaataaagcatcaaccctaattgaaagcaccgtgttacaataaagccatattcatagaagttaagttacaaatgtgctgttacctgaaacattgaaaaccatgagcattaacagaatcaccacgccttttaggctcgctggccacatatttcggtgctctagcatctgatttcttattatccaatgacacttttctcactttctcagaagcacttaaccgaagctgaaatatcaacattgaagaaattattcccttcaaacaatatagcacaaacttcacttaacttctatctttaggaggtaataaatttgagctgagaaaactttaatgatgagaaatacaattccccgcaaaaaaaatgatgagaaataaagaatgcatccacatttgtagaatacagccaaatat

SEQ ID NO: 34855 - DNA, 256 bp, Oryza sativa
tacatgttacggtgattacctacactaaaccaattgttagattaaaaaagtaaataacagatgataagagagttcttgaaaagtgaactaccttgatgagtctaagatagttcagtgttaacatgcagattgattgcttaacattcttttcaaggccaagtttgctatattgatttttatagggaggataaatagatgtattatatggcatggtccaaagagtagggacgtaaaatagacttattttagctatata

SEQ ID NO: 34856 - DNA, 904 bp, Oryza sativa
ccataccttcaaactcagattgagttacataatagaatccatgtttgcactctctaagtgccttaaatctacaagcttattcatagttaaacctgaatcatttgtgtttattgctggcttgcttccagccagaatcactgctttagcaaagaatgcctcatctaggcacaagctttcacaaatttcgagcaagagataacatatgttgtacaatgttggctctggaactaatcaaaccaaattagcttcaaacattcatctaagatgcagcacaagatcattatgtgtgccaatgctacattcagaaaaagaaacagcgacattgcatgctccagacgaaatatagtgaaatgaagtgataatgtagccccgaaaaatgaatatacacttgcttcgggagttcgggtgtcacactttcctgctagctaacctagcgagcatagcagccgaacttgctgcggcacactggcaatgtcacttactatatccccaagcatacctaggctctccgcaagattaacaacttattacaagctgctcatgtttaatcgatccaattagccttatgtttttctatctgtaatcaatcagagcaatagtacacaaaaattactcgtgctcagcggcaggtaacatcgcattgacgttttttttagataatgacctcgcattgactaactaataggaaattatggaccgggatttggcaagcttacccgcacggcgtcgcgccggctccagcgtgcggcgttgcagggggcacgcgggaagcgcgccgaagcggaggagaggagaggggaagcgggcggcggcggagggccgaggaggcgcggagcaggacgcccgctgcggctggcggtggcggcggcgcggcaggggagaggaggggaggcgagggaagcca

SEQ ID NO: 34857 - DNA, 800 bp, Oryza sativa
agagaaatgccacatttgtcacttgtgcctatctgacccaaccaatcttgccgcgagtctgcaacaaccgcagctcatggcgcgtagtggtggttactggttgctgctaccaacgttcagtttgcagcacgtttttttctctcctgttccaatgatatggtacatcatactacagttcaggaagagtacaattgtacaacgaacctatcatactgtcatgtactcctgtctgtccacgctgacctccagctaacacacatgcatccacacaagttgaggcaggcaagaaacactaaacaacatcgccgtgttttcctcatggaagtgacgctgacatgcgtcgatgcaatattaattatagtgtgtctgcattagacttgtgtcgtgggagatggaagagccgtcaagccaagccacaccttcttaaagacggccaagctatgcgggtagggatcactagaagtgaagtcattgccatcaggcacagccgcacaggcagagctgagagcttaggagcacattggtttcttgcaagtaaccataggccagaagtagacgataagctagctagctaatccaagcctgtgactgtgaaggagtcgagtcgtctttgccaagtcgctgtgccgttgaaagggacaagggtctcctggacagagatctcgcccgttaaatttgcctctcttttgcttctttccctccgatctctatagctgtgcaagtgaaggaagaaaggaacagcctgaattatttctccggttagtccccgtcctgtgtgtgtgctatgcgaaggagcaagt

SEQ ID NO: 34858 - DNA, 1501 bp, Oryza sativa
agtcgaccgggaacaggtccttgcggaccgactgcgactgcgattgcgcctgctcctgcggcggcggcgacggctggtcgacgatctggacgccgccgtgcagcggcatctggtcgacggcatggacgcccagcgaggcccagaagttgatgctgtcgtcctcctcctcctcctcgaggtccaccacctgcggctccatcatcccgtcgtgctcgtgcccaggctcctgcccgtcgatctccatcctggagcatgcagattcaactgaacccccaatttttttccaaaaaaaaaaatgccattagtaagtgcttcaccaaagcacgcaataaacgaagcaaatggggatgaactgggaggtctaattggagcgaaatggatcgattcgagttcaaatgagtcccaatctacccaatccagcacacgaagtggcgcgcagaggagggagggagacgagaagaacggataccttcagttcgattcgagccgagatgctcgccgtcgccggccgggcgcgcgaggaggcctgagaaggcgagggcggaggtggtcggggggaaaggagaggagtccgcccacgccgtggctgcggggccctgcttgccggccgccgcgtggcgaggcggcggaggcagcggcagagaaggctgggggatagcggaaggaagaaggtagctggagttgtgacttgtgagggagacgactggttagtgtggctcagtgctactatttccagtggtttcggggttgtttttgccaaaaaaaaaaaaaaacccagaaaggaaaagtcctatacttattaaaattttatcttactgaacttttactaacactacatatcatgttatgagtacatttagattttatatatctttcatctacttatattatggttgagatcattgtttataagagttttgtaaaaagaaatttagtgcgtgtagcagtgctcaaacggaaaatatgaaaaaagaacgtgcaatttcgctttagaagaagaggagagttgatctcgtttattgaaggaaccggattaaaagaacttataacggtataaggtattttaaaggaaaccggtgaaaacctgacattgttaccgtgaacaccgagcttaagaccagcagtttatcgagggaaactcataagacgaagccacgccgacgtaaacggtaacaaagcccgatccaaaaagaaaaggaaaattggatgtccgaagtctgaactctgaaagtctgaagtctgccgaattccactgcatgtccgtttcgtttatttcaggctactttcagcgacacaactattttactattgctgcatcaccaccatacaagctgatcaagaaaaatagtacggagtattaatcaatatgggaaacttggcaatggaaaattttcaagcaatctggaattctgcatgcaaaagttggcaccatcaaagttccccaaatagacagacaagcacaagacctgaatgctacagaattcagaagattcagttactt

SEQ ID NO: 34859 - DNA, 1501 bp, Oryza sativa
aacagtgaatcctccaagtcttattaatctcaaaatgtccccttttatagtggggatttacatatgcacaagcctaggatactcctaggaatcaagggtgatttaagccactaaatatggctgattatgtgtcacaaattcaccataatatggctgttacaagtcacttgaatcctgccattgttgctctttgatgagtctttgatgagatcaaaaatgtctcatgatgcttttgtaacacttaactcctgcaatttgcatcactgctgaaggttgaaatacgcatgattctgaattctaatgagttatgaaagtaactgaatcttctgaattctgtagcattcaggtcttgtgcttgtctgtctatttggggaactttgatggtgccaacttttgcatgcagaattccagattgcttgaaaattttccattgccaagtttcccatattgattaatactccgtactatttttcttgatcagcttgtatggtggtgatgcagcaatagtaaaatagttgtgtcgctgaaagtagcctgaaataaacgaaacggacatgcagtggaattcggcagacttcagactttcagagttcagacttcggacatccaattttccttttctttttggatcgggctttgttaccgtttacgtcggcgtggcttcgtcttatgagtttccctcgataaactgctggtcttaagctcggtgttcacggtaacaatgtcaggttttcaccggtttcctttaaaataccttataccgttataagttcttttaatccggttccttcaataaacgagatcaactctcctcttcttctaaagcgaaattgcacgttcttttttcatattttccgtttgagcactgctacacgcactaaatttctttttacaaaactcttataaacaatgatctcaaccataatataagtagatgaaagatatataaaatctaaatgtactcataacatgatatgtagtgttagtaaaagttcagtaagataaaattttaataagtataggacttttcctttctgggtttttttttttttttggcaaaaacaaccccgaaaccactggaaatagtagcactgagccacactaaccagtcgtctccctcacaagtcacaactccagctaccttcttccttccgctatcccccagccttctctgccgctgcctccgccgcctcgccacgcggcggccggcaagcagggccccgcagccacggcgtgggcggactcctctcctttccccccgaccacctccgccctcgccttctcaggcctcctcgcgcgcccggccggcgacggcgagcatctcggctcgaatcgaactgaaggtatccgttcttctcgtctccctccctcctctgcgcgccacttcgtgtgctggattgggtagattgggactcatttgaactcgaatcgatccatttcgctccaattagacctcccagttcatccccatttgcttcgtttattgcgtgctttggtgaag

SEQ ID NO: 34860 - DNA, 246 bp, Oryza sativa
agattaatgagaacttttattttattttactatcttgtgcataaatatttgtagggctaaacataaataatatactctcgtaaattatatctattgcttgaatgcagctcttttctttactttctttgtgatcatttacggtttggcaagcaatagcgatcataacaaccagcatgacgcaaaagttttaaaaagttcgaaatttttagtgatttttattgttgggaattttcaggatgttacact

SEQ ID NO: 34861 - DNA, 191 bp, Oryza sativa
actattttacctccattggaatgtaagacccagtgctgctctagtagcatagtacacaccaaagttgagaagaaaaccacggacctaataaaaattgaatggtggtttgtcaaaatatatatatatatataatgaatgaaatattgaaaaataaatatgagttagtaatcaaatcatatgcagcataaaca

SEQ ID NO: 34862 - DNA, 622 bp, Oryza sativa
ttcaaaaatggtaaaggtggtgcctgatagatccgaattccaatatgaagcagttcgcataagtctaaagaaagcaatcttgcggatgttcttgtagtgattgagacatttatttttcttgagccaattgttttctagcaaatagtcagtactttaacagaactgtgagaattagtgttaccagatgcagggttctaaaaaggcttagatatgttgggcatgatctgttgggtatttggccttataacaagtatgatggctgagatgacctgtttaaatgcattactctgctcaggcatattattcatgatagctatgaatgaataatatgcctatgaatgcattactctgctcaggcatatttttgttacttattttctatgcttatttaaaaacactgtgtgccttgtatgcataacgatgttgaacctggtacaggtttgctctcaagctggtgcagctggaccagccccattatcgaagacattgtcagacctcaaggattcctgctggagatttttacggccacatacaattcgaggaactgccttgggatccatgtgtggttctagttttccttttatattggtcaaatttgagttttcatcttttggtgctaatt

SEQ ID NO: 34863 - DNA, 573 bp, Oryza sativa
ctaaaaagtcttataatatgaaacggaggaagtagctcctatagcagctaaagtggatacaaaagtgtttgactatattggttagctccactccaccacatcccttgttggcatttcatcgaacacctcgttagcatcgcctcgccgacgccgctcagctcgcgctgccaacgccgctgctcagcacgcgcgcgttgccctccgctgccgccgccgatgctactcccacgtgccgccgcacgcccatcgccgacccgcgccgccttacgacgctgccactgtcgacgtagccgcatgccgatgccgcgcgtcgactgctgaccgtgcgccgacgcgccgtcgcccccgccaccgtatgctgccgccgtaggcgccgacgcgggcggccgtcagaaggaggttgggaggaaagatgaagtggccgtcgggaggaggttagggaggaagatggagaggagagagaacaagaggagaggagtaggaaggggtagttcaatggcatttttgcataaatacactaaaaaattagagggtagtgagtcttagattgtagtagagctatggagcagcaaa

SEQ ID NO: 34864 - DNA, 305 bp, Oryza sativa
aagggtaagaaaccttctcaccgtgccactcgttttgtcaagaacaatggtaagtattgctccaagtgtcgtgaggttgggcatttggtgaatgattgccccggtggtaagcctcctaagacatgcatgtttgattctcattatatgcttaggaaggctcatgatggtagcattgttgctagatatgtgggttcccctatactcggtggtaaaaagaataccatttgggtgcccaaagctttggtctctaacctccaaggacccaaacaagtttgggtacctaaaagagcttgatcttcttttgt

SEQ ID NO: 34865 - DNA, 1501 bp, Oryza sativa
gtgcctccctccccctcttcaaggatcctctaggtgaaaacctcatcctttcgggatgggcgatggcggcgttttgaatgtcgtgaccttcttgaaggcatcgttttggaggtggctgtgtgttcctctcggtgtggtggtgtgtaggcacgtggcggggtgtgttctcttgtccggttcccctgtcccctgctgcttttgcctttggttgtaaatgtctattttactcctcttaatgcaaaaatacgcttctagcgtattcccgaaaaaaaaatcgatcaatcggattgaattgctctggatctccttctcccccacaacgaacaactaggctactactctgaagaatcagaagagatctagatcgatgggtgcctcccacccctttgggttagggttagagacagatcaacgaagagaaagtagtaaaacttggtatttatttgtcttcgttttggactagaacttcctatcccaagcgaagccaaatgatctttctcgttgcaaatctcaccttagcagagagagggagtggggggagccgcccaaccgctactcctcgagcgaatcggagagtcgccggcggcggacagacgacgggaaggggatggtggaggaagagagagagagaggtggggagggagttggctccggcagcggtcgttctggtggcggcgtgagtgcggcctgcggcggcgtccggggagcacgccgggtgagttagcgaattttttttatttttaattttttttattaaaagttttacaaaaataatttttcattttgaacattgccagacacgtggtcgcctcccgccgtccggcagggcgattttgcaccactccgccatcgtacagggcgcccaaactgacgtggcagacggccgttcgctctcgaggcgacggccgtccaggaaatttgcaggggcgcccccttgccgccctccgctagggcaattttgtagcggccggggggccgcctgcaaatgggcagcggggggcctggaattttgcaggcggcccccttgccgccctgggggagggcgatttttgcctccccctataaagcccagccctctctctgaaatttcattatattcagtaaaaatccaaaaaaaaacgaaagagagagaggggagggcagcagaaggggagcggcgaagccctgctggttcgctcacttcatcacaggtttgctcccatacatcttttgcatttgtactaatatgttatgtttgagtatatatgttgcgttttagttttagttccatatattttagcagatctgtagcacacagcacatatgtgtagatccagagcatagaatataatagtatgaattgagacatagacagtagtgttaattgtaagatgtagtttagtttgatctggagaatgtaacctacttttagaattttggagaacaatattgtagagaatgtaacttagggcgtagtacagaaatgcgaggttaacgcagttattgttttcatcaggcacaa

SEQ ID NO: 34866 - DNA, 171 bp, Oryza sativa
ttcctgcagcccggcagaaggcaacgcgaaaccctaatccccaaattcgctatctcttggctctgccatcgaaattcgaaacccgcatagctttggagcaagccgaatctgcaaccaatccatcagattggagggcgaggcgcagggaaggcgatcgatcgaccgaagcca

SEQ ID NO: 34867 - DNA, 981 bp, Oryza sativa
gctgcctcgtgggcctcgtgggcggcggccggcggggaagcccgcgcgctgctcctctcctcgccgcccgcacgtcgcccctccctcgctgtccgcccgccgctcctcccaccgccgccgcctcgtgggccttgagggcggcagccgatgggggagcccgcgcaccgctccttcccccgctcccgcgcgttgctccgccgccacccgcacgccgcccctccctcgccgcccaccccgcagctcatcccccaccgccgtcgtgtcgcccgtcgccggctgccgataccctcctcctctcctgcctcgcactgccgcacagaagggagagagagatgaggaagggagagaagagggagaaggatggtgatgacgtgggtcatgctgacaggtggagtccacgtgggtccaacgctaactcagccgccacgtcggataaaaccgagggcaaaataaccgaaggacctaaagcggacggttttgtaagttgagggatgccttatatctggttttgcggttgggggacgattttgtaactcaatgacaagttgagggacctttggtgtactttttcctattatgtcacaactcaaagaagagggaggagaaatagacttattttgaaaaatagtacgatgggttgcccgtaccttcgggccagcccggcacggcacagaggtggagcacgtgggctggcccgacatataggttgggatgtgccggcccgacaaatcttgtaccggacacgaccaggtctggcccgtgccatgccgggcggcccatatggccaactataaccccccggctaactcacgaattttttttatttttaattttttttattaaaagttttacaaaaataatttttcattttgaaaattaacagaagtggtcgcctaccgccctctgggagggcgatttttaaaaatcgccatcccagagggcggcgaaagtgacgtggcagacggccgttcgctctcgggc

SEQ ID NO: 34868 - DNA, 1501 bp, Oryza sativa
caagtttataaaaagaattatcaatatttttcaaaaaaataaatatactataaaaatatatttaattatgggtttagtgaaatcaatttggtgttgtagatattgttatattttttttttctgtttctataaatggtttgatcaaggacaaacctatacttataataatttagagcattaaagctataccattgaaagttcatatctgtatattttgtctcgttgtcttatcagctactattgtttacattcgttatatattcaactaaccattagttcttattttaactcttcttcatatatattgcagtggttcgcgaacactgttgctctcgtgttgcttgctttctttgttgtcccgttagttccacggtgcaacagtatcgagggggtatttgccatcgttttctgtttggtcatccttcttgggatacctgtcatgggtcattgtacgctaaaagagatccacgaagaaatgaaggctagagagggaggccgataataattagagtcctatttgtgatcaatctagcccttttacattttctctcctttttttttgaatgctaaaaaacatgaattcttttacttgttgtgcataataaaattttcagtttgatatagggataatagctaataatgttttgctataggatcaaattttatccctgatatgacatattgtccaaccgagcatttgaaattaatttaccactagcaaaatatctgtgtgttgcacgaaagagagatattgcaatgatgtcagatgataaaacgcgtgtgatggaaataaaaggtaaggaagttgagcaaagggtaaagcgttgttagagcaaagggcaatagcagactattagccggctacaaacatatttaatgagataaaagatgagagagaagagcagcgggctacagatctgtagccagctgcaacacggactctaagacgtattgtgtgtatgataggtaggaccatatattaatagtgtagtaagcaactattatataaattggctatagatgaattagagtcagtagtgggctatactattaaacttgctcttagaagacagaagggtgacgcggcattgtgcaaagtgtgcaacgaggggttattgtcggataccggagaaagacacggaacatcggtcaaacctaaccatttctcttcctccacatgttgtcggtgagcggtgactgggaggaggaaggaggcgctcatcggtgttgatgtcgacaacatcagcatggcgcatggcctcccgaggtaggcgccagtcactcagtcactctgcggataaatgggtctcacatatatttttttaattctaacaccacataacgcgagttcgtcttggtctaggtctagaactatcttcaacggtttgtgtagccataaattctatttaatgatttgtgttgactttgtatactattccattgtagttgtaaatacacgatcttttcgtagatccattgtaatcttgaaattctataaaaa

SEQ ID NO: 34869 - DNA, 1501 bp, Oryza sativa
tcgaagaagatgcattcaaagaagacatgatgccagcagatttaaacacagtgttctcaggctcagtttttgtgtttttggtgttctctaccattcaccccccctctagtactgctacacctttttttttgtgtgttattttcatttcaagaaatttagtaatttttgtcttgtgaaaaaaatacattccagttttgtgccttaagcaacgctccgttattataacaatccacaactctctctctctatataaatattaatgtgtatacacaggcggacgacgagatttggaacaaaaggcaaatcggctacgtctacatcctcagcacctctttggcagttctgtttcttgcccgaccttttctgccggctggttatgacggctggatgctcgccgcatttgcatctgtttggggtctgggtaatgtatgccttccctgtggcatgttcggtgagaggatttgcaagagcttgagtcggcatgtgggtcatattctctacatgacattctcagcgctggtgatttatggcatatatctactggctgtacatgctgatccgacccattcagcttcagttccagctctagcgctgccgtcattggggttgacatgggaaggagtgttcggtcttattggtgttctagtttcatttggacatctattcttttgggtaaaggtacgataaactgctcgatcggttacctgttcttgcgttattaacagtatatagtccttgcaataattaatttggcattcttaatttgcagtgctgctacactggtgttgaccgtgaccgggaggcatagtctcacgttagcaatttggcctgtttggcctgtggatttgggcctgtttggttggctacctgagtgatgtgcctaagaaaactacatgcctaagaggcattagctatcctgtcaaaacttgcctgatgaggctagcctgagcaaatgttgtttggttagtagcctaagcctgaggaaactaaattgagattagatggttcataattacatggttaaggtagatattatttaaataaaacggtatctcatatcctaatctatcgcatataagcaaatgttgtattttcggttcgtttgcaccaaccaagattcaacaataaaatattccaacaccttttgcatgcacagtcgtgggtccgtgacaggacaagcttgattagcgcgttttgttttgtgtaactagactgagccaggcgctcgtttttggtggcctgagctaggctaatgaacctatcaggtttttcaggtcaggcagggaatgaaaccatcaggccaccaaccaaatgacacaggatatccctcagggacatatcaggccaggctcttttggctcagggcttcaaccaaacagcccctgacatgtgtttcctgtccagattcttgcctgacatgtgttacaaattagcacttgtcggcccgattggtcaattggtcatcataccctgtgggatatattaccttttactagtatat

SEQ ID NO: 34870 - DNA, 396 bp, Oryza sativa
caaatgtccatcttttccgcaaaaagaacaagggtacttctcacgacaagtttgtgaagtagatggttttgaaatcaatgattttgcatcaacagaaggttttgcattcacaacatttgacttcgaagaagatgcattcaaagaagacatgatgccagcagatttaaacacagtgttctcaggctcagtttttgtgtttttggtgttctctaccattcaccccccctctagtactgctacacctttttttttgtgtgttattttcatttcaagaaatttagtaatttttgtcttgtgaaaaaaatacattccagttttgtgccttaagcaacgctccgttattataacaatccacaactctctctctctatataaatattaatgtgtatacacagg

SEQ ID NO: 34871 - DNA, 352 bp, Oryza sativa
aaacgatcacgtttcgagccgtcggccatcgtcacagtgccctcctctgcagtggtagtgcatcctctctgttctccttcctcgctccatctcctccccttagactcgggtagtagcacgagtagaccccccgtagctagctgggccgccccaagccttgtcgccgctcgctgtgtgctcgtcgccgtcgccgcccgtgttcggtagccgcctctcgtcgccggcctctcccgtagcgtttccgatcaatccggcgcaaggaatggattcctgaggttccctagatgctctagcccctttgaatccaaccctagccgtctcgtcgccgtttccctcttctctcgccgccagt

SEQ ID NO: 34872 - DNA, 1501 bp, Oryza sativa
agccaggcccgggtggccgtttgaaagatgttggccgggtgccaaccttgaatcaaatcaaagactgatatattgcacatactccgaccggacgagacgcactgtctcatccgtgtcgttgagaagcactcacttagttgtttcaaaaaggagtttaaataaaatcaattgcaaagacaacagcctttcctttgaagcccgcattaaacacttaattcccatgacttgctgagtactcctgtactcacccttgctctatataaataatccccccagttgctgaagaagatgaagtagatcccgctgatgaggagttcttccaggagcaagtcgactacgatgagttttagggtttcggcctagttcccaagtcacgcctgtgatgattggtccaagtcttggcttccgctttcccttttgtaatgcagttgtgagctcgggatctgtccgcagcccaacatgaatgtactcctactctgtaataaagagacctctgttgttgtgatattctgtcttcctgtgataccagcactgtttcctaggactggtatcgattaacaggttaatttggagcgtcatgggctagtaccgttcggggctagttcggggcgtgacaattatatgaagttatagaagaatatattttgctattgagacttaacaattacacttgatataattgtgttttatgatgaattgttgactgctgaacttgagaattggacttgacaaaagtttgaagctcagtttgaggggtttctgtatttcgataaattttcgttaccgtatccgtgccagttcattttcgctccattttcggtttcgataatattcgttttcggggtttccgattccgattttggaataaatatgaaaacgaaaacgataaaggttgtttccgtccatttccgtaccattttcacccctaaatataacggtatccctgggagtatgtacgagcatgtgtgaagatcgacatgaaatcatgctaacatgtcctaggaatcgtgttgtgtagtacgaagaatcatatgatctgggcaacgacgtacatgatatccacatggactcggcgagtttcattcacttggtatccacatcaaacagagtctctttcgtagttcactctcgagtcgtgacttcgcaaagaatattatgcatgacgggaatcggatacggatgacgtaccatagttttgacaaaacatcttcaatttttaaatcgcgggcgagggcgatgcagtcccaagcgaacatgcggcaagggcaaatcacacgcgcgagggcgtcgcgggcccaatcgagcatgtggaaaaatcgcgtgcgcgaggacgttgcaggcctaattgcggcggcacgcaaatgcgcatgtggaaaacggactcaggcgcgggcctgattgctgcgtgcggcaaggggtgcgtgaaaatgtgcgggcccaattaattcgagcgtgtcttagataaggacactctagcgtaagaaaaagaaaagaatttgac

SEQ ID NO: 34873 - DNA, 1501 bp, Oryza sativa
agtcaacacaaatcattaaatagaatttatggctacacaaaccgttgaagatagttctagacctagaccaagacgaactcgcgttatgtggtgttagaattaaaaaaatatatgtgagacccatttatccgcagagtgactgagtgactggcgcctacctcgggaggccatgcgccatgctgatgttgtcgacatcaacaccgatgagcgcctccttcctcctcccagtcaccgctcaccgacaacatgtggaggaagagaaatggttaggtttgaccgatgttccgtgtctttctccggtatccgacaataacccctcgttgcacactttgcacaatgccgcgtcacccttctgtcttctaagagcaagtttaatagtatagcccactactgactctaattcatctatagccaatttatataatagttgcttactacactattaatatatggtcctacctatcatacacacaatacgtcttagagtccgtgttgcagctggctacagatctgtagcccgctgctcttctctctcatcttttatctcattaaatatgtttgtagccggctaatagtctgctattgccctttgctctaacaacgctttaccctttgctcaacttccttaccttttatttccatcacacgcgttttatcatctgacatcattgcaatatctctctttcgtgcaacacacagatattttgctagtggtaaattaatttcaaatgctcggttggacaatatgtcatatcagggataaaatttgatcctatagcaaaacattattagctattatccctatatcaaactgaaaattttattatgcacaacaagtaaaagaattcatgttttttagcattcaaaaaaaaaggagagaaaatgtaaaagggctagattgatcacaaataggactctaattattatcggcctccctctctagccttcatttcttcgtggatctcttttagcgtacaatgacccatgacaggtatcccaagaaggatgaccaaacagaaaacgatggcaaataccccctcgatactgttgcaccgtggaactaacgggacaacaaagaaagcaagcaacacgagagcaacagtgttcgcgaaccactgcaatatatatgaagaagagttaaaataagaactaatggttagttgaatatataacgaatgtaaacaatagtagctgataagacaacgagacaaaatatacagatatgaactttcaatggtatagctttaatgctctaaattattataagtataggtttgtccttgatcaaaccatttatagaaacagaaaaaaaaaatataacaatatctacaacaccaaattgatttcactaaacccataattaaatatatttttatagtatatttatttttttgaaaaatattgataattctttttataaacttggtcaaagtcaatgatgattttacttgaaacaaactgatggagtacgatttaaagccacataacttatagatggcca

SEQ ID NO: 34874 - DNA, 1501 bp, Oryza sativa
ggctgcggctgcggctgcggctgcggcggcggccgccttatgtgctcggccttgtccacgccgtggcgtggcgtggcgtgcctgcgccggaggaggacttgttggtggagaggaaggtttggaatctccactttgcacgctgatcatacgacagaggaggaagctttgcttggagggttaaagaaatgggagcaaagggagaattctgatcctgggctacctcacccatgcaccaccattgctgccatggccgccgccccttttcgcgacacacgggctagcttatgtcgcgccgcgccattgatgctgctcttcttggatgcttttctttggttgcacaagccttttttttttttttttgcagttgcagtgacactgtcagtgcctgactgatgagaggagctttgaacagaggtggcatgctaatggcattggcaattgccattgataaccactcaatggcatgattgcaaagcaccagatgcctctttttctttcttcctttcttctccctttcagttgtttaagctaagaggtgttgagtggcattagcaatgcttgccttttttagtgcttgcactagggattgtcaaaggggaagaatatgctacttgatcaacattcatctttctttaaattttgtcaaggatcccaaaggtttcacaaaaaaaatgggggaaaggcaagcatctaggcgtcagttgcgtgttctttttttagtggggaatgtttaaggtgaactgtaccttctattagatcaaaatcacgattaaagacatgtctgaatgctaattccaaatgctggcaaaatctactttgagttgagaaaaaaaaaacagctaacttactaagtaaatcatttttatttcctaaataattagttcttttacttttaagtttttttttggctgatcttaaaccttagattaggtggacctaataaaacttggttacagatggagaaattgtgcctgtgatctgtaattttgaagtgatgagctgaatttggctatggtctaatctaatgcaatcagcttctatctggcgctttaagcctatgattttgaagtgatgagctgaatctggctacggagttaggcttttactttctgtagaatttggtcatacctacaagggtaaaagtgatgtaattttttgaatggaatctgaaagtgatatcttcatgcaacagcaatgttgctacttttcatgtgccattcctatagcacatagctgatactgaaacatgctctatgcatttctttctggatttgctactatgtagtctttttcatagttccatatcacttggagcatatactgtcataccatacactactattggaagaattttaagatcagctgcacacctagtgctaatttgcagaattcatttcttttcctacaattgattgttacatcaaattatatctgacttcaatgatttgtgaatttttcagcatgtgccatggaagtagctaatcttcagtgacacgaagaa

SEQ ID NO: 34875 - DNA, 1501 bp, Oryza sativa
gatcgttgaactcgacggtcctgaccatcttggccagctcccgccgtgcctcctcccgcatcagcgagatctccctcgctctcgccgcggccgcgctcagcgcgtcttgcgccgtcaacgagtccggtagcgccgccggaggcggcgtcgccggtggcgggacgcgcggtccgctgatcgtcggtgcgcgccgctgcgagcggcgcccgccggcgccgtccttgcgatccttgttctcgcgtcgcggcgcggcgccgccaccgcgggcatggctctcttccttggtgcgcgagcgcgacgacgacgcgcgccgcgtcgtcggtctggtcgtcctgttgttcggcatgcgcgccgcctgttcagcggccgcctgctgcttcttcttcttgctcgcacgataggcgtagtcgtcgtcgtcgtagtggtagtcccggcggtggtgttcgtcgcggcggcgcttgctgtgtagcggcggcatcggcaaccgctcgtccccccggcatatcggccgctgcttgtaattacctcctctgtgggcgtcctctgccgtcgcgacagaggatgaattgctgacaatgcgtggcaacgccggagtgcggtggatcgcataagagcggcgatcctccatggctaccgtgctcgttttgttcatcactacggctatgctcatcgtcctcacgtcttcttgctcgcgctaggggatcggatcgccctagggttcacgtgttcttgctcccgctaggggatcggatcgttatagggtttattaggaagtagttgcacttgattacgcgatgatttcagaggtcagagctcgctcggtcgctagccggtttgcttaaaagaggaggaggaggaggaggcgcttcaagtcgtttctgatccgtattccgtacttcgatgtccacgtcggagacgggggaaggcgggagaagagatcaagagatgcgcgtttgactaagtcaataggtttatctcgtccgtcgtccgatcggaattcggaagtccaatgtatagtacccgttggattgtctttagattgagccgtggtggcaaaactgcagaatgcagcgcggcttccaaaccctaatccccaaatccaatagcattcgatccagcaagccgcatcgacaatacatcaatcggattcgagggcgaggcgcaggggaggcgatcgatcgatcaaaggccatggccgccgccggagaggataaaccgtgttgccgaggttcatatatacttgagtcttttaaaaaaaaaatcccaaagtgaatggaagatttatgacatctactacgactacaagggagtggatgtgtggaggggttggagttggaatgtgagatgaagatgaaaatgaaaatggaggaagatgaagatgaaaatggaggagccggtgaaagaggaggagcagcaggtgaaactgaaagaggagtaggctgggagccgtcagatgcatcccgcgattggtgccggttgtaaagtggtcgggacgtatttc

SEQ ID NO: 34876 - DNA, 1501 bp, Oryza sativa
gaagcaaccgcagcaagagacattatgtagcagttgctgtggctccgatgagagctgactgcaatcagaagagcaggtcgaggttctgcaaccggagtgtcagctcaggcagtgggtgggggtggcaagcatccggtgagaaaacttgaaggcaaggcccagttgtcagcttcgtgtgctacctactgttcgtgcagagtgagaggctcaattgtgagtatgatatggtaacaagtgattcaattcaactttaaactctgtcctctgtcctccacatttttccaaaacaaactagtaagaaaaaccgaattgattttcagaacttacttttcactttcagtgccagcaactgcctcttgatgctctttcttgtgattgctaccaagtttctcaacagccagtagtggatgtagaattgcacggctgggtattcgaagtaacaaggtattattcaatatgaaaagttcacagtatcatacatcaaaatacaaacagtttgtatcagtggaatctcaactaatattaacaaactacaaaataattaagaaacctactttctccgttttacaatgtaagactttctagcattatccacattcatatagatattaatgaatctagacacatatgaacatctagatccattaacatctttatgaatgtagaaaatgttagaaagtcttacattgtgaattcacggagagagtaccgtttaactttgtgttttgtcatgcattgtaatctagaaatgatgtcatcatcctaaaattgcacaatttgacaatcaacaccaccgatcaaaatttcagtccacaatgacatgaaaattatcacaggagatagatggattgatgaacaaccgtaacattcattcagggactacacatttttttcaaattttcaattggagaatgggggggattcacggatttcatccactcacctcagaactctcacaacaatcagatggtcctcggccgtaggtccgtcctgggctccgagccgtggccacgccgcagcgcccgcgccctagcagctaggagttgatacctggcgcccccccccccacccctctcccacgctgccgcgccctagcgggctggacggctggaccaccgaaggcttgccggctcctcctcagctgtgggcctagctttttgaacttgtgtattcaaaatgacaagggggtaaaaaaaatttgttcatacacctaatagcctaaaaattagcttgtatagtactccctccattccaaaatatttgatgccgttaacttttttaaacatgtttgaccattcgtcttattcaaaaaaatttaagtaattattaattcttttcctatcatttgattcattgttaaatatactttaatgtatacatataattttacatatttcacaaaagtttttgaataagacgaacggtcaaacatgtttaaaaaaatcaacggcgtcaaacatttagagaaggagggagtataacacactaataattacaatat

SEQ ID NO: 34877 - DNA, 1501 bp, Oryza sativa
gctgatggcgtcgggggcaccgagatagcggccgtaggcgccgcggaggagcacgtggcccgggaggaggacgccgtcgccgccctcggcctcggcgttgatcgtcttcgctggcgaggaggtacctgccgacgctgccgtccacccgcgaccgaagccggacggactccacgtcctggaatacctccattgctcccgccgccccgccggtggtcgcctcgcgcgcgcgggcgctcgcgtcaccaagcgggctcctctcctctcatcggcgacggcgaggcgtgggcgcgtggcgtgcggaggaagacgagaggaggagtttgttagcgacggttagagctgggacatgggccgttccgggctaggcacggcccagcgtgcttcgtgccaaatcgggccgtgccagcacggcgtcttcatggacgccgcccaagcacggcccaatggcccgatgggcctattcgtgccgggccggcacaagcacggcgcctgatggatggatgagaaaagcccatcgggccattatcgtgccatggaccatcgggccgtttacgtgccgtgccgcccgtcgtgcccgttgtccaggcccaggcacggcccacgtacgggctgtgccggaccgtgctttctagcgtgccgggccgtcgtgccttgggccggcctgataaagcacggcccaagtcccagttctagcgacgggtgcgacggggaggtgggcatttgaagcgtcgcgaagcacagcacagggctctgtctgtctgtgcaggtgggcccagaaacggtcaagtctggtcaactgcgtaactgacaggtgggccaccccacaactagccatagttcggagtggatgacgagtgcgcgcgctgacgagccgccgcggccgccacgacgacgagttcgtcgccttcgaggccggccgccgctcgacggcttcctccaccgcgcggcacggaggcgccgccacgctcgcgcgccccggcttccctgcgctacgcctccgccacggctgcatcggccaggtcgcgctccgcctccgccacggcctctcctgatctggccgcatcggccagatcaggaaggggctcgacgagatctcccccaactatgccgcctacgacatcgccggcctgggatgcccgtgctccctcttcctcctccgccaccattctcgccgtcaggtacgctctcgaactactcatcgttgtcggggaacagggcgatcgaggagggtggggtggaggtgggctgagtgcgcggcggaagccgtcggggtcggatgcggcggagatagacgagcgcggatcggacggatgcaggtggggaaggagcggcggcggaggaggattgaggtaggagttcgtcgcccggccgccggccagcttgatctgacgaccagcggcaatcccaaaaatttgacgaacctgattttttttcaaatacacccctggtttggattgctgtcattggaagcgacttggaatttctcaaaattgctcgaatg

SEQ ID NO: 34878 - DNA, 1501 bp, Oryza sativa
ctgcggagaagcagacgggccctcccgagatgtagctgcggatccgcgcgccaccaccacctcctcatcgccgccatcatcctcccgagaaccggggccccggcctccccgcctgcctgcgccatcgggtgcgcctccctccacaggtgccggagcagccactcgtcgtcccccggagcatgcaactcgtagacgatggagtagtagccgtcctggggctcctcgtcgtcgcgcgccggtgccgccatggccatcgccggagttgggggaggggagactgggagagggtaaagcagtagtgcagaggagtttgcgaggagagaagaggagaggcgtggtccgtgagacctgaaggcgtgatttgtatcctcgagcgctgtgccacacgatcgtatgggccgtccgattagcttccagttgattgtgaccgtcggatcaaaacggccacgcacagttcgatttagaacctttacacccaacaatcctacccctgtttcactgcatgtgggccatcgagtctggagtccggtgacgtatgcatgccatccacccccaccgcgccttactttttcgtgccagctgttagaaaaagaacagaggttagcctcaggcttctcctggaagcttcgcaatcaacttctgaactaggctgtgggtgtgttcgccatgaatcgttgcgaacaaaactgagcggttcatcagagcgagtgcaatagcagactataaactagctacaaaatatattttaaagagataaataagaagaaagaaaagtagcgagctacagatttatagccagctgtagcatggattccaagacacagtgtgtatatgacaggtgggactaggtattaataatgtagtatgtaactattgtatgaatgagttattagattggctatagatgaattgtagctagtaattagctatactactattaaacttgctcttaacgcatgattaattaagtattaatttatttttaaaaaacaaaccgtttagcagtttaaaaagtgtgtgcgcggaaaacgagggagaggggttgggaacaaggggttgcaaacacagcctgtttttagtttcacgctaaaattgaaagtttaaagaaagtggaacgatgtgacggaaaagttgaaagtttgtgtatgtaggaaagtttgatgtgacagaaaagttagaagtttgaaaaaaaaagttgagaactaaacaaggccctagtagtaaagtaatccaaatggaatttccacaccccagtccatgttgttgtgggatgagtctcctctgatgtaaagtcagagggacattgtcactgacatgtgggacccataagggttgggcccacacgtcagtgacccacgtccctatgactttatgtcataggagtgtgatccgttgtggggatcgttgagcttagggcaagttttatagtggaggtggatgtcacatctaatttagaccatgtcatattcttattaattaagaggtaacacatacaacatat

SEQ ID NO: 34879 - DNA, 479 bp, Oryza sativa
ctggtttccttgtgtgctaaaattttttcaattcacttgcccatgttccagactaactgactgacccataatttgtagcacttttttttagatatcggattaaaccggcctctggcacacagccaaataatttatagctaaaattattgggttattgttctactaaactgatttttggctagctattttgaagcttaatttgaagcctaacttaatttgaagattgtgaggatgactaaaaccaagaggcttggagggaatcttctacttgtttaaagttgtcgagtcgagtagatgaccaattacaatgtagaagagatgggcaattttctgaaggaaaacctttgcatgctatctggtcttagtcttatggcttactggccctctattcagtagtacactattagctaaaaattacaaaccacgaagatgattgtattgtttgactacattttcatgctgaattaaatttagtgcaa

SEQ ID NO: 34880 - DNA, 1501 bp, Oryza sativa
gggctcattaacatgaggattttcttggccgtgttgtttttgcaaaacaaataaaattcgaagtctgaactccaaagtcatacacaacattcaactgcaagtcattttgttgccatttcagtggtacatttgcttcaaggtgatataatatacagtagcaaacttggccacgaaaaaacttcaagcaatatacaagttaatggtgaactgtcttgtttgtgttatgtacggagtagtacttttgcatcaaacaatctgtttagagtaatcaccgcaataggtaaaaactaccaactactcggtacctaggtagtagaagcaattactcctgaaccattatctaaaaaaagcagcatctgaaaactggcaccatccaacatattgctaagtagaaatatattactgctgatgctaaacttggtagaaatatgcatgatgtgactgaattctgatgaatgattacagtaactgaatctcctgaaccattcaggatttcaggtagtatccctttctgtttgggaattttgaaggtactagtttgatatgtggaatgtagttaatttagtaattctttttacttattccagtgattgctctaaaccaattgctggagagttcttgaaaagtttaaacatgcagatttcttgacagtttgtcatggccaagcttgctacactactacaatgtattgtggtgctgctacaacggtgaagaatcactgaacttaaactgaaagtaacaaaatggcatgcagctgaaatgtaccagtacatgattctgaattccaactgaatcttctgagttctgacttctgaatcacagaaccgatcgatcgaacatccatggtttgccactcaaattctgtaaacagagtcgttttgtttgctgcagagatgagaacaagttcagaactctcttcttttgaagtatgaatcttgcagagtccactcaaacccaatcctgattaacctgcgccgcttcatttgagaaaatcctgtaccatgaaatctgccgcactccctgttctcgggcccacccgtcattgagtacggttgacgacagttgactgtgggacacacgtgtcagagagtgacctgcgtcttctcgcgacgccttcaaatgccactgccgcctcggcagaatccaggaggagaggaggattggagcatcgggagcagagatgggactcaaccacaaacccgtgcatcacctatagaaaacctagaaaaaggagaggatgtgaagagcagctcaacccagatcttggaggagggaggcttggcgctgcatctcgctggaggggaaggactggcggcggcggcgaccttcgttcgcgagaggggaatcgtcgctgcggcacgcgagcgacgcgacgagattttccacgtggatcgggccgggaatttcccagctgatgggcttccaaatggtccggaaaattggcccgtggaattttactgcccgggctggccggccagggaataggccgggatccagtatt

SEQ ID NO: 34881 - DNA, 1501 bp, Oryza sativa
taatttagtaattctttttacttattccagtgattgctctaaaccaattgctggagagttcttgaaaagtttaaacatgcagatttcttgacagtttgtcatggccaagcttgctacactactacaatgtattgtggtgctgctacaacggtgaagaatcactgaacttaaactgaaagtaacaaaatggcatgcagctgaaatgtaccagtacatgattctgaattccaactgaatcttctgagttctgacttctgaatcacagaaccgatcgatcgaacatccatggtttgccactcaaattctgtaaacagagtcgttttgtttgctgcagagatgagaacaagttcagaactctcttcttttgaagtatgaatcttgcagagtccactcaaacccaatcctgattaacctgcgccgcttcatttgagaaaatcctgtaccatgaaatctgccgcactccctgttctcgggcccacccgtcattgagtacggttgacgacagttgactgtgggacacacgtgtcagagagtgacctgcgtcttctcgcgacgccttcaaatgccactgccgcctcggcagaatccaggaggagaggaggattggagcatcgggagcagagatgggactcaaccacaaacccgtgcatcacctatagaaaacctagaaaaaggagaggatgtgaagagcagctcaacccagatcttggaggagggaggcttggcgctgcatctcgctggaggggaaggactggcggcggcggcgaccttcgttcgcgagaggggaatcgtcgctgcggcacgcgagcgacgcgacgagattttccacgtggatcgggccgggaatttcccagctgatgggcttccaaatggtccggaaaattggcccgtggaattttactgcccgggctggccggccagggaataggccgggatccagtattattcaggtggtgtttggatccaggacttaactttagtccctatatttagacactaatttagagtattaaatatagactacttacaaaactaattacataaatgaaagctaattcgcgagacaaattttttaagcctaattaatctataattagagaatgtttactatagcatcacataggctaatcatggattaattatgctcaaaagattcgtctcgcgaattagtccaagattatggttgggttttattaatagtctacgtttaatatttataattagcgtccaaacatccgatgtgatagggacttaaaagttcagtctcatctaaacagggcctcagtctctgactcggtgatggcctgaacagttcgatctcggactcggccgttttatccttttaaataggtcgatgtgcatgcgctagcgcgaccgaaccatccgagcaaatcgcaatcgcaatcgcaaagcagaggaagaaaaaaaccaattcatccgtttccagtagggctcccggccgcctccggcagatccgtcgccatggaggaagaaaccgccg

SEQ ID NO: 34882 - DNA, 1501 bp, Oryza sativa
cctattgacttagtcaaacgcgcatctcttgatctcttctcccgccttcccccgtctccgacgtggacatcgaagtacggaatacggatcagaaacgacttgaagcgcctcctcctcctcctcctcttttaagcaaaccggctagcgaccgagcgagctctgacctctgaaatcatcgcgtaatcaagtgcaactacttcctaataaaccctataacgatccgatcccctagcgggagcaagaacacgtgaaccctagggcgatccgatcccctagcgcgagcaagaagacgtgaggacgatgagcatagccgtagtgatgaacaaaacgagcacggtagccatggaggatcgccgctcttatgcgatccaccgcactccggcgttgccacgcattgtcagcaattcatcctctgtcgcgacggcagaggacgcccacagaggaggtaattacaagcagcggccgatatgccggggggacgagcggttgccgatgccgccgctacacagcaagcgccgccgcgacgaacaccaccgccgggactaccactacgacgacgacgactacgcctatcgtgcgagcaagaagaagaagcagcaggcggccgctgaacaggcggcgcgcatgccgaacaacaggacgaccagaccgacgacgcggcgcgcgtcgtcgtcgcgctcgcgcaccaaggaagagagccatgcccgcggtggcggcgccgcgccgcgacgcgagaacaaggatcgcaaggacggcgccggcgggcgccgctcgcagcggcgcgcaccgacgatcagcggaccgcgcgtcccgccaccggcgacgccgcctccggcggcgctaccggactcgttgacggcgcaagacgcgctgagcgcggccgcggcgagagcgagggagatctcgctgatgcgggaggaggcacggcgggagctggccaagatggtcaggaccgtcgagttcaacgatccgtacatctcacccatggacgcgctcaagccctgaccatggcgtacgtacgcctgacaatttgttttagctcttcttaggttgtgtttggtacgaggggtgcacgtaaaacagaactactcatcaccgatgattaattaagtattagctggaatatttaaaattagattaatattatttttataacattttttatatattttttaataaacgtaccatttagtaatttagaaaatgaatgggtagtgctgaattcagccttactgttggacacgcgtatatgttaattcagcatatcaatttgtttagccaatggcaaaatttagaagtcctatgttgaacagctgtactatttttgtgaactgaacgattggtctgatctatctttgaaaaataagtgccgatttatttttgtgaagcttaattaggttgatcgattggtcagaactcgggtgtaattcagcgtagagttgaagtaggtgatcatcagcatcactagttcagtacttaacaccacgcacatggcacatgc

SEQ ID NO: 34883 - DNA, 1501 bp, Oryza sativa
  unsure (1)..(1501): unsure at all n locations
caatgggtgatcttcaatagcttacctccctcaagaacaagactgctacgacaatgcatttaacatatcaacctttgggcagtgagactaaagcccaatggttgacatgtaatttctatatggaaacaggtactttctgccgccctatatgtcctctaactatttgcatggtcattcaaaaatgacatgccaaatatattatatattcaggactcaggaggggatccccgggtgaaattaaaagaaacatttcactacacaatagacctacaggacaagtgatacacacaccttgcctttcgcgattccttccttcgccagagccagcagcgcctggaaatgcccttccggatctccactctcctcaaactcctagcattcaacaaagcactaattacataaaccaatcgcgaaaggcatgtgccaatctcagatgccagcaatgaaacaggaatgatacacaatccacccctaccccacatctcgtcgggtgcacgcccaccgtgcagaacagcctccctgcatcgtccaagcacatcacagcttctcgggcacattacaacaaacaccttgaaggcaccaagcataacatagtcaaaacaacccgcatccaagcagctgagctcaccgtcagtctcggcgatctcgagcacttctctagattccttcagcgagcctccggtgaccttccgcccggaccaaaccaaagaaagcaagagattaagcacaccaaagctgagccaaaagaaagtagaaacaaagcaagaaagaagcgaaagggggaatggccggcagcaaagcagcgtacgatgatgcggtcgacgccggccgcccacgcgcgggcgatcacggcggggatgtcggcggcgtggcactgcttgccgtggtagatgcccctgaacatgccatcttcagttcgttcgcagcagcaagagcaagacgccaagacgcgagtagaaagcgtgagagccaggcagtgaaacgcgaaaaacgagataagagtcgggaggaggaggaggaggtgggtaccggtgaagttgacggcgatgtctgctcgtcgcggtggcgccggagatggagaagaagatgagaggaggagtagaagaaggccgggtcagtccaggtaggagcatgagagccgcgagcgagagagagagagagagagagagagtagagcactcgccgatgagcttgacgccggtggacgccatcgccgccgccgccgagatgggggagagtccgaattgggccgaggccggtcttcgtgtttgggcctccaaggctccaacaaaacttgagtttcgtctcgttcttttaattttctttaaatttaaatatataaataaatttattttttgagtttacaataattgaaacctaattaattatacactagtagttttttcctttttttttcgcttccaaatattgttcggattcggaattgagcccttctttatatnnnnnnnnnnnnnnnnnnnntgattcgttcaagaacaat

SEQ ID NO: 34884 - DNA, 1501 bp, Oryza sativa
gtgttatactccctccttctctaaatgtttgacgccgttgatttttttaaacatgtttgaccgttcgtcttattcaaaaacttttgtgaaatatgtaaaattatatgtatacattaaagtatatttaacaatgaatcaaatgataggaaaagaattaataattacttaaatttttttgaataagacgaatggtcaaacatgtttaaaaaagttaacggcatcaaatattttggaatggagggagtactatacaagctaatttttaggctattaggtgtatgaacaaattttttttacccccttgtcattttgaatacacaagttcaaaaagctaggcccacagctgaggaggagccggcaagccttcggtggtccagccgtccagcccgctagggcgcggcagcgtgggagaggggtgggggggggggcgccaggtatcaactcctagctgctagggcgcgggcgctgcggcgtggccacggctcggagcccaggacggacctacggccgaggaccatctgattgttgtgagagttctgaggtgagtggatgaaatccgtgaatcccccccattctccaattgaaaatttgaaaaaaatgtgtagtccctgaatgaatgttacggttgttcatcaatccatctatctcctgtgataattttcatgtcattgtggactgaaattttgatcggtggtgttgattgtcaaattgtgcaattttaggatgatgacatcatttctagattacaatgcatgacaaaacacaaagttaaacggtactctctccgtgaattcacaatgtaagactttctaacattttctacattcataaagatgttaatggatctagatgttcatatgtgtctagattcattaatatctatatgaatgtggataatgctagaaagtcttacattgtaaaacggagaaagtaggtttcttaattattttgtagtttgttaatattagttgagattccactgatacaaactgtttgtattttgatgtatgatactgtgaacttttcatattgaataataccttgttacttcgaatacccagccgtgcaattctacatccactactggctgttgagaaacttggtagcaatcacaagaaagagcatcaagaggcagttgctggcactgaaagtgaaaagtaagttctgaaaatcaattcggtttttcttactagtttgttttggaaaaatgtggaggacagaggacagagtttaaagttgaattgaatcacttgttaccatatcatactcacaattgagcctctcactctgcacgaacagtaggtagcacacgaagctgacaactgggccttgccttcaagttttctcaccggatgcttgccacccccacccactgcctgagctgacactccggttgcagaacctcgacctgctcttctgattgcagtcagctctcatcggagccacagcaactgctacataatgtctcttgctgcggttgcttctccacatttcccaccgt

SEQ ID NO: 34885 - DNA, 1501 bp, Oryza sativa
  unsure (1)..(1501): unsure at all n locations
gaactgacataacagaatcagaaaaacagagacactgcccactccatgccatccgttactagctttcacagcaaaattcagaaccacataaacattgttcagaaaattcagcaacattcatattgaacataggctgcttacattcggtgttgggcctgacaaggacgatctgcagggtctcccggtggcgaggaaggtcgatgagcagaggggtgaactgcccatggcggccggcgctgacgcacatcgtgaagtcgtcgtagcccacatgcttcgcgatcttctctctcaggagcctcaccgacctccctctgatctcaaccgtagcccagttttctccctcgctgatgttgtcgaggtcggcttcgtccacgaactggatctcccgcagcggcggggggaagcacgccctgacgaagaacccgggctgcacaaaatcaacaatggtagcagtaggaaattcgatcaatccacatattgtactacacggttagttcttgcaagaaatcaagattaatctccgacgaaatcagcatcaagacacaaaacaaaaaaaaaaaaaaggaatcgcaagaagagaggggaaaaggatcggaggagctcacctgagtggcgatcgggagctccggcatgtctccactcggggggacgcgcaccacctcccacagcaacgtatcttcgtcctcgaagttggcgtcgactgagatgctgcggcggcaagccaggatgctcttgttgcagcgcaggtagcgcccggacctgtcgcgcagaaggacgacgccgcgggcatcgcgatcctcttgtacgtcttcgctgccgcacctggttgccagccacatgatggcgtcgaccgccggctcctcctcatcacggtcgcgctgcgtggcctccaccaagccgaaggggagtcggcagcagcagcagcagccgcagcaaccctcgcgggcgtgtggttggcggacgtcagagttggcggcggcgtcgcgggcggcggcgttgcgggcggcctcgaagggggccgcgtcggtggcgccgaggtaccggccgtaggcgctgcggaggagcaggtaccgcacgggggcctcctcctcgacctcctcgtcctccccctcgacgaggaactcctccacggcccacaccgcgttgtgctgcgaggcgccgccgcggaggctgccgtggtagacggacctcccgtcctcgtcggcgtggaggtacgagccgtacatatggctccgcagccgcgcgaacgccacatcgtcgaaaacctccatccccacccgatgcccgcgcgacgtcccacgtctcgacgccatggcgagcgccgcgaggcgtggcgcgcgcggcggcgagtggctactcctcggtggcgtggcgtggggaggaagacgagagaggcaagtagccgtggaagagtttgttagccgagggaggcggtggcatttgaaggcgtcgcgagaagacgcaggttgctctctgacaggtgggtcncaggtcaaccgta

SEQ ID NO: 34886 - DNA, 1501 bp, Oryza sativa
aacttggcatggatgttggcgctggtggagatcagcgctgatctttggtcaatacgatcggcactccaagggacggaagagattggctgccttgtttatttcccttgtgtgatcaagctttttgttttggaggaatgagactgtgggggtgaagttggagatcagttcatgtacacttgtccatggcgctatcacctgtactgtctaaatttggtaagagtatttgcaatccactgcatcacctcctgtgtaatcttctaattttcttctgttagattgaaaattttgcgcgacacttgcatctgttgtacgcatagaattcatttagttgagcttatatagtagtataaatgttcttatatagtcaaatttgttgagtttgattcatttcaaatagatctcatgaaacaccggcagtggtttcagtgattgggtttattgtgccctttttcatatgaaatttctcttactgtttaacttgattcttcaaacacatggatgtacaaccaaacaaatttgaagcctacattccttctgtgtttctcccatttcaaattccaacaaatgccgattttattcatagtcttgacgaaaagatgccaagatgccgttgaatttatcagaacggtatttctcccgctttcccctgctcttctccgcctccccggcgaccggcgacgctgtcagccgtgtctccgcggcattccgtcccgtgcttaacgacaaccatgcacggcctggatgaggtaccagatacctcgtgtggcatatatgatcagaacaatttttttgatcatgaacaggaaaatgaaggaattcctatattttgatcaccatctgtaggcacgagcacatgatcatctgaatttttttttctttggtaagatactaattgcgttcagacaaaacaggacagaagtgaactaatgctcaagcttgtcagaacaaagcagactttagagttttcttttaaggggtgtgggggtaaagttttagcgtgtcacatggggtgttcagatactaataaaaaaactaattacagaatccgtcagtaaacaactagacgaatttattaaacctaattaatttgtcattagtaaatgtttactgtagcaccacattgtcaaatcatggagcaattagacttaaaagatctgtctcgcaaattagtcgtaatatgtacaattagttattttttagcctatatttaatacttcatgcatgtgttcaaacgttcgatgtgccagggcgtaaaatttaggatgggatctaaacagaccctaaatttcatatattcttcgtagctcattttctttgacgtgtatttttgtgtcttacatgtaaggtcgtagctcaattcacaatccatgttttcttctctcttcagaccggtggtttgttactcaaaaaatatgcagtgctaacttggcaacgcttccatagttccatccggaaatggaaagcggcaaagcgccgacttgaagcatcaaacgtctccttc

SEQ ID NO: 34887 - DNA, 1501 bp, Oryza sativa
ttttacaaattagctctgagcttggctcgttgttctttttacttcatgtcatctagcagcacaaactttatatatatatactccctctatcccaaaatgtttgacgcttttgacttttttaaatatgtttgaccgttcatcttatttaaaaaatttaagtaattattaatttttttcctatcagttaatttattgttaaatatacttttatgtatatatatagttttacatatttcacaaaagtttttaataagacgaacggtcaaacatgtttaaaaacgtcaacggcgtcaaacgtttagggaaggaggtagtatatatatatacgggttacaaaagaggtgatcatgagcaagcaaacagcacaaacgcatctccgctgtttgctacttcttcatctagccgcccgctgccaccggccgcaccctccgcccgccactagccactccacccgcatcgcgccgcctgtctcgtgagagaggagaggtgagagagtggagaggaaatacgaggagagaaggtgagagagagatgagtaggtaaggatgaaaaatttgacagtgttgagagggaaatgagtaggtaactcagactttaggcggatccttaagaggcccaaagatgagtggataaggatgaaaattttttaagtgttgagagggaaatgagcaggtaactcagactttaggcggatccttaagaggcacatctatgaaaatatattttcgtgtgtagtcctctaaaaggtctgcctacaaaaataggcttattttgcgtgtggacccttaagaggcccatatgtgaatcgatttttgcgtgcggtcctcttaaggagctgtacacgaaaatagaggatgatttttgcatacgcgaccggttacggtctgtctgcaatctaaagaaggtctccgttgcaatctaaagagggtctccgtttaaaaaaaatatttatgtagtagtggttggtatgagctaactagaaagtttgcttagctgcaattagtagtagacgagtttaattcaggagatgttcagttgtactgctaacatttgggtgataaatctgaatcacgtaattattgagccgtatgtcatgaactgatgaacatgatgagcacgttggattaattttttttaataatggagcacgttggattaattctgaatatgttttgttttatctatggggttctctgaactacttgttccctgcttgattgagaaatgagaatggtaaagtctactcaacttagcttctctgaaatatcagtgttagtatggggccgttttaaattgggatttacttagattctagcagaaatttcagaatgtgtgctttacggaaataaaatatgagaagcagctctaaagcctgtttggattttattttcagattactgaatcaattcaaatatgcaacagtatgaattttgagctttcgaacttcttggctctacattttgaccttgtactagtatcaactgtggggtggggtctatag

SEQ ID NO: 34888 - DNA, 1501 bp, Oryza sativa
gtgggccgggccgaaggtaaggcccagctacgctcgacgaaacctgattagaatggaaaaagtacaccgaaggtccctcaacttgtcatcgagttacgaaatcgtccttgaactgcaaaaccatatacaacacatcccccaacttacaaaaccagtgcaaacaatatcccacggtagttttgactccggttttatcctatgtgatggctaaatcagcgtaggatctacgtggaccccacatgtcagggtggccatgtcatcatcttccctctttcctcccttctctctatgcctctctatgattttcgatgaatgaccctatggtaatgcttttatctctattctatggaccagtcaacttcactaatgaaaacggattacatctttcaaaatattatttagtactacctctatctaaaattctttatattattggataaatggagtataagattaggtgataaacatgaatagtattttatgtgtgactaatttttattttttttataaattttttaaataaaacggatggtcaaatgttggacacgatacccacgacgacacttattttgggacggaggtagtaatagtaggcttgttctattagggcaagtactataagcccctacatactgctcctaaatttgctacataagattagatgatgaggtggaggagagaagttaggagagagagaatgagccacgcctcatgtaaggagtaacctctacacaatctccaagaaaagtgcaagatgatgtgagagtagactaatattggagtttgtgtattatatgtgatatgttgtatgtgttacctcttaattaataagaatatgacatggtctaaattagatgtgacatccacctccactataaaacttgccctaagctcaacgatccccacaacggatcacactcctatgacataaagtcatagggacgtgggtcactgacgtgtgggcccaacccttatgggtcccacatgtcagtgacaatgtccctctgactttacatcagaggagactcatcccacaacaacatggactggggtgtggaaattccatttggattactttactactagggccttgtttagttctcaactttttttttcaaacttctaacttttctgtcacatcaaactttcctacatacacaaactttcaacttttccgtcacatcgttccactttctttaaactttcaattttagcgtgaaactaaaaacaggctgtgtttgcaaccccttgttcccaacccctctccctcgttttccgcgcacacactttttaaactgctaaacggtttgttttttaaaaataaattaatacttaattaatcatgcgttaagagcaagtttaatagtagtatagctaattactagctacaattcatctatagccaatctaataactcattcatacaatagttacatactacattattaatacctagtcccacctgtcatatacacactgtgtcttggaatccatgctacag

SEQ ID NO: 34889 - DNA, 1501 bp, Oryza sativa
  unsure (1)..(1501): unsure at all n locations
cactgtacatgtctgccgtagaagtttgctcagcttgcaattagtacatctaggccctgtttaggttctaatttttttcttcaaattttcaattttttcatcacatctaacttttctacgcatagaaactttcaactttttaattatatcgttctaatttttttaaacttctaatttcgacgtggaactaaacacgggaattccgtagctaaaggcacgagatgcgctagtttaatgttggcgtgatctagacaggaggtggccagttcggccaaggctgcgacggcgccgccacgtcatcttcgccggagaccctttccatctgacctctccatccgtaataagtatcaagttcatgcatatattgcatatatacatgatgacatcaatcatggagaccacatccacaaccgttatagtaacacttagctaaaaacacttacaagttgatcaaacaaccaaaacttaaattacaagctcttctgttctgtctatggggaggacaggtggccaggcaggggctcccaatgcttgcaagctagctcctaatttcatcttatgagttaattcctacgcttatgtgcgataaatccactggcatatactaagaacagaaaattagcaaggaaacgcatcctccattgtatcgtaaattcttcatcagtactgcaaagcacaaaaagagaaagagagagaaatgttatgagactgcaaaatttgtacttgagcaacataatgaacacacaatcaacatagaaaaaaacaagtagagcgcatgggctctagtatatgatttacttactttggctctggagtccttggatgccaagattgacgaaacgaatggctgtccttgatgatggaactggatgaaaaaggtatcttagccccattaagagaattcacaaatggtgtactcgtgtggttggttttagccaaggccatgccagttcttgctacctgcataataaagatgaaaaccacaagttaaataagcaaggaaaactggccagtcacatatgacatgtcgggacatgcattggtaatcaacatgatgttgaattgccacttgtaaaattcgggacatttaactttttaccacttttaagatgtaacaattaaggatttgccactcgaagacttaaagtctataacatgtgcatcattatgtgtctaaggtatgtgggttcagtggtaaatctttaattaccacacctgtactagtggtcaatagttaattattccgatgatcaaatattactagggtttaatctgtttgtcgtactgccatcataaagcctaagaaatttcatgaactactacagtatatactacttaccgatgatctgcacagcagcggcgtgaatttcttggacaggatgcggatgccggacgcggcggccatctcagcagtcgatccgatcaaaaaaaggattggattttgaagagtattgttcttgaacgaatcannnnnnnnnnnnnnnnnnnnatataaagaagg

SEQ ID NO: 34890 - DNA, 1501 bp, Oryza sativa
  unsure (1)..(1501): unsure at all n locations
gaaatggtttcagacaatccattttaggtgacagacccaccacaacaatagtcctaggccagatcacacaatattaacataccatttagctactactactagttcttcttatctacatattcagataaaatcctattcccaagaaaacataatacaccaattgcatacaattttcttgtgatgcctgacttgcattccatcaacagaaagttcctcacatttgttagcaagtaaaaacaattcctactacaatgttctcttctgctgttctactacaatgttcttcagaaaactcctaactcagcaagtaaaaacatgactgcatttgtcccttccacaaacagtgcactgagaactggaaaaatcgacggtgctgagataaccaaaaggaccagaaaaggagatagtacatggcattcaggatccgcgaatgtaaactcattaaggacaatgatagcacaaactaattatcaatgatagtttgtaatttgtaatttttactacaaactaatcttctctgtaattaaaatgatagcacaacgatgacgcaaacaagttgtaaaaacaaatgtaattacaagttgtgaaatacctattgtattgtttgtgtgattagtgtcccgccgtacgtcgccggctgcggccagctaggtgcgcggccggaatatggcttctgctgcggtgatgactcccacgaagacggcaaacgcgtagagactccatatcggcgggggagacgcctccgtcggtgggcgtgtcggtgatgaaggacgagacgtcgtcgggggcgcgggcggcgtactgggaatgggagtcgccgccgtcgacggtggtggagtcctgaccgctgatgtggaagtcgtcggaggcgcaggcgtcatcgtgttcggtggcgcgggctggagggtgggtgtcgccgccgtgggtaggagagcctgtgccgtggatgggggcgatgtcgtcgccggcgtcgcggtcggtggcgcgggaggcagatacatccatcgatcagatgcatccatgtcgtagtactcgtcgcaactgaggaccgggccgaggcgtggctcgctccagtggttggcggacaccgccgtcaagcccgccgagcgctcccaaacaatgagacgagctccggtctgctcctccagaacgcgggaaaccacctccaacctctcctctcgaatccgccgaaactccggcgaggagtccacgtcaagatgatctagaacccgaagaatctgcgtcccctgattcttgatgttgacctccagtgcatcccaccaagtgaacgcggcgcgtcgggcagccatggacagggggtgagtagcgtggtggagcggagcggaatggaatcgagcgctaggctgtgggagctcgaggcgagccgcgagcgaatggagaagaagaagagaggcagcgctctcctcctgtgttctttttatattgactacggttgacctgngacccacctgtcagagagcaacctgcgtcttctcgcgac

SEQ ID NO: 34891 - DNA, 922 bp, Oryza sativa
attgtattcatgtgaggttgcgtagaacctcttacccactctacataaaatgttcatagatagaccacctctcaaactacatcaatcatactaggctatatagaatttagtggagcttcatgtctgacccaatttatcctctaataaaccatgataatatatatgcatttagaaaaaaaaaccttacttttactttatgcttacttttactttcggtgacatattttctaaagaaaattagtctaccttcttttcaatgaagaagattataaataattgcttatagatattacttatgtaaataaaaagctaataggttagaaaattataaaagcaattaatgccaatgaaaaagacggagaaatcatggcatatgttctcctgttaatatttcgctcttataagtatctcaaacttagtgtacgatgcatgcccgcgcattcgcgcgggctaacttcctagttatgtaaatttttgaataaaacgaatgaacgtgtaaaaaagagccaacaacatcatctaggtaatagtactaattttcaagctccaatgtactcttgctaattcaatccgactgcattatccatcgtcttgccacgcaagacagttgtggttgttgcgttttggatgaagacacaatcgacgcttccggtaagtcaacgatcaattgatgagttgtttagtacagcacactactgccactgaaaaggatatgaggacacaaggatgaacaggcggattgcaagctgaaagaaaaataatgcatatttttcctcaaccttgccattctaagcaagaaacgtcaaacatcacgcttacgctgctcacattccgattgggcccaggaaaccaatggggataatcagtgcactgaagtaagccacaggttaatgtgaatatgtgatgttcacatctcacaaga

SEQ ID NO: 34892 - DNA, 1501 bp, Oryza sativa
  unsure (1)..(1501): unsure at all n locations
taattgttccataatttgacaatgtagtgctgtagtaaacatttgctaatgacggattaattatgcttaataaatttatctcacgttttactgacggattctgtaattggtttttttattagtgcccgaatatctcatagaacaccctatataatatccgaagtgacagtaaaaattttacacccttatatctaaacaccccctcaaacaaaaaaacatcgcaaacttttgacaggaaaactaattagcgcgtacgcgccagatgagttagcggcacgcacgtacacgtgtcgctcacacagcgcagcgctaccgttattataagtaaaagccggaaaccagaagaaaaaaaggtgatgcgtggttttttttttcagattagcgagattagtgctgattttttccagaataattaggccgtaatctgcattcaatgattttacataattcaaggatttcaatgatttttaaaaaatcgacccaaaatttgaaactttcaacactaatttaaaaactttcaacttatatttaaaaatttttaaatcatattaaaaactttgaagtcaagatttgaaaactttcaactcaaaatttgaaactttcatctaaaaattcaaaaactttcaactcaaaatttaaaactttcaactcaaattttgaaatctttcagctcaaatttcaataactttcaactcaaaattcataattttcatctcaaaattgaaaacttcttatttgaaattcaaaactttcaacttaaaatttaaaacttttaaatcaaatttcgaaacctttccacttcaaatttaaaactttccactatttttgaaaagttttcgactaaattaactatatatgctttttaaagactaatgctaatgatggtaattaacgctaattgtcgtaatttgcggcacgaatgtcgtagcactgtagcaggggcgcgcgttggtgggctgaatgcccaggagtcggaatgaggctgctccactggtgtaccgtataataaccaaaaaagtgcgcgctacatattctactcgcgaatccgcgcgaactaggtgtcgcgagaggttgatacgcagtcactgaagtccccgttcgcaaaagagcaaaaacattaaccgcacgcgcaatcacaacgaagcctctctggtcaactctcacccgcacgtacgactaccnanncanncanncnnancgnagttactccaaaccaanataaccaccgnncccccacgcgtcatcataccgcgcgtacgccaccgtcgcgtggcaaaagttctcgaccaatctatacctcgctcgctcctcgctagtccaccaccgcacctaacaaccgccaacctctccctcgactcgtcgtcgtcggcttcgattcgatcgatcgaggcgaggaggaggaggagctagggtttcggatgggaggaggaggaaggttgtaaaagcgcgggggcaggctgcggtggatcgtcgatgggggagcagccggcgcggggggcgg

SEQ ID NO: 34893 - DNA, 1501 bp, Oryza sativa
cacgaaatcaaacacttcggatcagatcactaaaccaatcatcagctaacatcgcgggagcaggagtgtactggctttctttgcgttacgacaaacacatgggatctcaacaaggcacacgagattattgatttatctttcaattaattaagcaccttggtagcacgcgcggttcagtaaacttgcgccgttatgcaaccaaacaatagaggcgacgaagcgataaaaaactaagagcgtctgaacctgaaccgtaccgaaagccaatgccaatcggctactttttgcaatagtttttggttcagaaagcaaaatgattcgcattagttggcgatgaattagcgcaaaggcatttgatctaagctgagttaggggttaatctctccagcctgatcaatggaattattccttcccttccccgtcaaagctcaaagccgcatacttctctgtcacacaaagcggtgcagctccacacggcacctgcctacctagggcgcctatgggcaggatagcttggttgccccgctcgccgcgccagctcgctctcgcgccgtctcctataaatctctcgcctcgccgcaccagctgcggcgaaaggttggctagagatttcgacaggcgcgcgtgcgatagtttgtcgcatctgtttccgctcctgctcatagcgctgatactagctgcttgtaaccgcggagtgatcgatcggcgagcgatatggcggcgtcgcagcggagcgtggccgtgtcggcgaaatgcgccgccgcgtcttgggcggaggagcggcgtccgttcacggacccgatcgagatcccggcgccctcgggcgcggcgacggcgaggcgggaggacacggagtacggggagggtgactacggcggcagcggcagcggctgcggcggcgaggtggtgccgccgcacgtgctgctggcgcggcgcagggcggcgttctcgatgtgctcggggcaggggcggacgctcaagggccgggacctccgccgcgtgcgcgactccgtcctccgcatgaccggcttcatcgagagctagcgcgccgcgcgggcggcgggcggccatgcgcgcgcgcgcgagacttggcctggccgaaatggtcacgcgaccagattaattagttggtttattatgtcatatctgcgagacattttcctcgatgacattttgtaaaattggttcgaaatgtgaggtgaatatatatatgtctgttgatggctgcaaacgtatcgatgagactaacgaatgattgtcaaaaaatataatgcaagttgtggttaattacggggtaatttgtacccgcgtacgtgtacacgttgctgacttgctgctgattcagtaactgtgactcgcatgatgtagttcaggaatgacgcattcagacagccaagatatctatgggcacttgggcagtaataacttctagccctccccaactattattaaatcacgacacgcaaaatatatgactggtcgctcactcactcgagctgtg

SEQ ID NO: 34894 - DNA, 1501 bp, Oryza sativa
atcgatgcagaacagcagattacacacaactcatcaaagaggatgatgatccgcctgtttattctgatcctgatagatagccttgttaattgtgcaaagttgtacagtactactatagggataaggtttaggcagtacttgccaatccaagccatccatcaagaaatgagcgttcaggattgcctggctcgatctcctcgttccttttagctactattccgtcaaaaaatcgaagtcctagctacgaacatcgattggtctctctttttacgtaggggtactccttagtccttgctccttacctgttgattgtgcaaatgtgcacgggagacacttagtgcgagaatactgaagcattcaattaactttaaaatctatgataaattttatatggaaacaactaagggatccaagctcactcttaaaaaccttgtttctgtaggattagacacaagcaactaaacctaccagagaggctaaatggtagattacgtcagtgaaagtgaaataatcgaatcctgatagatcaaaacacaccgcaatctcaaaaaccaatgaaacacacgttcggcggtctatccaacctaatagggtcggtctgtccgaggcatggccggtctgacaataggtgactcggcggtctgaccgtcaatctaaaaaacaacacaataacgcttctataaaaactcaatttctcttaaaccaaccatttggaacaagttgtaaacttgacagaataaactagacaagctaagaaacaactccaccggagggatttgtaaaataataaacaatttaagagaaaacatcctcaaaagtcagctgtctcagaatttcagcaaatctgaataaaacctaaaacttaagtaaattcgaaactagcaagatccaatcaacaaagctttccagatctgatcattgaagtattagagaggttttggatggattaaattgaacagaatcgcagcaaaacaagcaatcacaagttaatgtcaatacccgctcgactccgcgatgccggcgaacgccttcttcgccttggccacccggaactttggtcccccgaccatcatcggcttcaccgccttgttcaggaagtccgcagcggcttcgacggcgtactccaagttcgccttgttgctcaatctgatggaacaaagataacataattaagaaactaattaatggataaaaaaagattttaacacaaagacgcatgcgttttaggtcagtattaccttggcgagatgaacaagggcactggctcgcggctaaacgtcgggtgagagaggcccgccaggttgcagcccacgctaatatacacgggcttgctctcacttagtgccgtcgcgatggcagtgtcgatctgctcgtgcgcgttgtcgaggttgttaatgagcctacatacgtgcgggaggagatggagttcgatcgcggcggcggtggtactgaggacggggatgtggccggcacaggaccccgcggtggcgccgaccaccac

SEQ ID NO: 34895 - DNA, 1501 bp, Oryza sativa
agagagagggattttctttgtgagctgtgaatagaccttttttagatctgaatacaggcaccacattggcactctcggtactaaagggctacacggccaagtgaaatccaggtacgctagatgcatatcattagcatagaaacagaattacagaagtagtagctatgaccatacaatgtttgcctacatgaaaaaaaacaattgcaaaaatttaacaaataggctttgaatcattttgccattttttgggggaatacatgttgcctattgtaatgcagggaaattatgagttcactttttggtcaccccgcaactgcaagcattatttacttcttttcatgcattccttagatacagtataaaaacatgcacctttcctttgtcagatgaaactatcaaaactatcaaaaagattcgaaacaactgaaaccaccaaaagttttgatagagtcaaaagtcatcgaactcgaaagaagatatgaaggcaccgaaggattcaaaagaacaaaagaaggtactgaaagactcgaagatactgaaaagcgcaagaaagactcgaagatactgaaaagcgcaagaaagactcagaagagcagggttcactaaaggattcagatgaacttaaacaaaagagcaacaagagtgtggcatttgagccggagaaggaattgaagtgtgactgccatccaacctctgcttatcagagcacatatccgaaacacaactcatggggcctctttgctgcctcatgatctttgaggatgaatagttactgcagctagaggtctctagacatgtaagccctgaactcaacaaatatatttttcgttgcagtcttgatcatgtcaactaacttgatcattgcatttattttacgggccaaaaaaaatcagcacggtgtagagagcctctttgattaggtagcagtctccaggagccatttcatcaagaaagcaaggataatggaactcgcctccttgtcctaagtttatcctatgtcaattgttctgacatgtcatcatgtaacatatttctgcaatatacaccagtagatgagtaatgtagaaatctgccatgtttagttggtgatgaaatgatgatgcttttttccccctgaagctgtaaaccttgtctagttggtagaattgagaccatatcaatcagcattgcatcgtaatcctctctggttgattatctggaatcgtttcctcctgttgatgaatgcccggattttgttgtttataaaaataaggaaaaaagaacgagaaaaaggccatttaacgagcggtgtaaatatgacccctgcaccgaaggcccatttatgatctcgatgtgtgggcctaattcccacccgtgcgttaatgggccgggaaatctcggcccatttaacctagccctaaagctagggtttcctctcgccgctgccatataaaagctctctcctcttcactcctcgccgccgcgctcctcctcccctcgagaaacccaagctccagcaatc

SEQ ID NO: 34896 - DNA, 1501 bp, Oryza sativa
gattatgtgggtctcgttttctcttacactgataaatttctaattttgttataataaaaaatgtaataaaaatgagaaattattgtgtagatgcgatgcagcaacgtaagccggcccgctagtttctaggccagaaggcccatgaagatatcattttgtgggcctaaattccggcccatctatgttcggcccatcgatagggtttcctctcgccgccgcgctcctcccctcggttgagcaaatcaatccgcggtggcggcggcggcggcggcggcggcggtggtccacgtcagcttctactgcaattttaggtaccttctcccccatctccctctcgtcggagaacggcggtttagttagcttcttcgtcgtcgccgtcttgattggtgcttcgatttggcgcagcgatagatttagattttttttttccttttcccaatctccccgtagttgcttcggtgtgtttgtcgatgcatacggcatacgcatcttactgtcgaaatacgtacgggttctgcacaaccgagtctgaggtcatacgaaccctgatttctcatcattctctagttgaaactttgtgtggtgtagtgcgtttcaagttcggagatgtgtagaggcttatttaggacggtttgggtgataatatagattgctaatatatgttctttttgtatcgaggaatgaaggcaggttgctcttttggcatttgatcctatggagcttgaaatgtttgcactagtagaggtaggggtgatcatgtcccctcctctgttcatggttagggttcatgccatcttcttctatagcgtttggttgtataggtaggttacaccgaaatgttcagcttcattgcctgaatttcagcttgaatacaagcagctgcatagaacactgaagcctagtattacacacaccccagtggttgaataataactagtacgccttttctttttgctggtcagttcttcccatgtaaggtttggaccattgttcatggcactgctgtggtatctatctcgtgattgttctcaattatttggaaatgaccagattttagaaactttttccgtttgtgaatttcaaaagctcgtgacgagtctattgttttgtttcattttagaagtcattcagcctttactgtcctttccttttcttttcgccagaagagcaatcctcaattcctaacccttagcgcagtggacaagtctgcaagttgttgtcgggccttcggtccatttccctttctctttcaacccgtgaggccataacttaatgcatagttgtttggcagattatttatgtatctatgctttacaaattaacatgttcgataaattagtgatgcatgtagtgaatcttcctttcttgaggtatttgtttggacaactttgtttacttgttgctttattgtcgttgctattcactacagcatttgaccacgcatcaattttagtccatcctctgcgagtgggttcagcatatggatttgccaggtccaaga

SEQ ID NO: 34897 - DNA, 579 bp, Oryza sativa
gaatgtcttaccatctgcaatgaagtaataaatttgttcataacacttgacagagaaagaaaccactgtagatagtatagttgttcataagaaccaaacaataacatagaaagaagccctacagtcccaaattccttatatcctgaccccaaaaatatacaaagcaagaaagcaactgcacacacaacccagaaagacaatgcaacaatacaaataaagaaaactacagtagttgttgagattacgcccaataatagtatgggtattcaacacacaaatctacatatctcgaaattaaatccgcaccacgcaactttcaaccacagaatgcgcggtcagttcaaatcagcacgaactaatcggcatagatacggacccaacgcagtggagacgagaatatgaacaaagctacgggaacagaccgcgtcgaggcaaatcttgatccagatcatctcgccaaccgaaccagccatcgcctcatcacctaaccgccactcgctaatcaaccaagacacataagcaagaaaagagggaaaaataaaaggagaacattctctcgctgcgtcagatcgcactagc

SEQ ID NO: 34898 - DNA, 785 bp, Oryza sativa
attcccaagtatgcttctatatgattcttctacagcagcatggaagctgtatcattctctcatagtaatcgttcactgtatattcatcatttctgttgatctagcattgtgtaggcagagctaaaatgtcattttaggcacaacacatgctctatgagctgaaagctgaaggtcataatatattagtattggtcctgtactcctgttaacttcccatcatttgagtgtgcagatgctttcaagttagtctttttcgtgcatttgatactcttgttgggcttgtcaatgtcgcatttgagagtgttactcttttcatgtgtacatattacctgcgatgtttaactttgaacaagcaatttggcacgcaccacgtgctgttgctgtagttcgttactttacatgatgttcctttacatcaatgttcctttactagtgttactcttttcatatgtacatattacctgtgatgtttaactttgaacaagcaatttggcacgcaccacttgctgttgctgtagttcgttacttgcctgctgcagtgttataaatctagattagtttgttaggttgaactatgtacagcgatgatgagaacatttggcaacttcacatgattgtcctgaaaaaggctactgccacaacattctttaatgcactctaaagttactattttagaggacttgtcgaccataagttgaacgtgatgttgctattgctaatatttttttccaagttgatagcctttctgaagatcattcattaaagtttcaaaatcactgggcagg

SEQ ID NO: 34899 - DNA, 1501 bp, Oryza sativa
aatcgaagcccccaaacatcctgaatcctttcggactcagaatccgaatccgactccttcacaccgaaccatgcatgctatcaatcaaagagacaatctgaagcgagagagcatcaagttcatcatcagcagcagcgtacgtgagatcgatcgatcgatcgagcagatcacaagcaaccgagttcgtcgacatacgcactccaagtgaatactgatccatcatccatggacgcctctgcggtggcatcagccgacgaggcaaagaagacgacggcggcggcggccgccaccgccgccggcgagccgcagaagccagccgccgttgcgccattattggcgcaggggtacgtcgactccatcctggcgttcgagagggtgcaatggccggtcttctccgacgacgacctgaagcacctctcgccggagcagcgccgggagatcgacaagatggccgccctgcacaaggctttggacgacgacctcgccgtgttccaggccgaggtcagccgccaggtcgaggacaacggctgctacgtcgtcggcgagagctacctcgccgatcaggccaagctcgaggctctgatcaacgaagaatgggccaagatcgactggagcgccttcgaattcgagtagccatgagatattgagatgtgtgtggacatgcagatactgatcgatcttgtgatgaacagatgattcaactagtcattagttagtaatccaaaaaaaaacctggtcataagttcattatctagcatgatacggagtatgatatatagtatcagctatatctactgacctgtttgaagaactatgatgctggtaatatagggagatcatgtagcctatattatgaatgaattaaatgtggtataagtatttgcaatcctatcagggtttacaattttgttttgcatatttacgccaaggaggcaccaaaatttctgagatctcggaaatttcggaacaatgtcttttgaaaaaacattagacaatttttgactgaatttgactatacttttaaaaaaatataattaagactgactacacatttttaagctctacatcatgaaataaatttgtaaatgtcccgaagacccgaactaattaatgtagagcacccatttgaagctccgcgtgaaaaaaaatattttctccgtttaagattataagacgttttgactttgatcaaattcaaactactctaagtttgactaattttatagaaaaaagtagtaatatttttaacccaagacaaatatattatgaaaatttatttaattataaacttaatgaaactatgttggtgatgtaaatattactactttttttctatagagttagtcaaactgagagtagtttgactttttaccaaagtcaaagcgtcctataacgtaaaacagagtaattcgaaggtaggaatatatattagttaggcatgaagtttcaacacaaaattatgaactttccattcaaataattgttaatattttactagaat

SEQ ID NO: 34900 - DNA, 1501 bp, Oryza sativa
tcaagcacgtatttagtgcaagcagtacttttactatttttcttgttaaacaagtaggcgattttaagattttagagagatctagcaatgaaacaggagagaactcattggaggatggtgtaataatatagattgtgggatctaaatatcagtggtagggatggtgtggtaaaatggataccactacttagtaagactaatgaaaagaattaatctcatgtctaattaatggcagcaactaatctactcctaactgcaatgacagatttcttcagttcgtgaagaataaaaaaaatgaaaaaccacaagtttgatcaagatttgaactaatccactcctaattgctgtaaagaaaatgaaaattttcatcaaggtttgaactaattaatcttgatgaacatttgttcaatttgttgaaaaatgaaaacaattgcaatggattgaaacattttaaaaatgaaaaattaaaaaaattaaaaattatgtctgagcccaggttcgaactggggacctttagtgtgtgagactaacgtgataaccaactacaccacccagacaattcgttctagatatttcaacacaaataattaatagtaacttgatctgcctgttttaaaatgggccagtatttgtctaattggaacaattccacaacaactctttacaaattatccagaacatatttttaattgtttttatatagaccagaatacccatctcctacaactcaactgtactgatcagaccaaatcatatagcacaaaattgaaattactactgcaaaataattagagataaaaaaaagggaaatagcgatggagctcaccgccatgacctcaggcaccacaacgatgagcttgccgccgctaccggacatgccatctccgtggccttgccaccgccacgacgagctcaacaccgatgttgaatttgctcgcgctgtgtcttctgacccgccatctctaagacctcgccctcaatgatcgatgtgaccgccgctcctctattgtttactccaccgctcatgctgctgctctcaccattatcgatgctgcttgtacgccgcggacgtgaccaccatcgccgcccatggttgctcgctccaccaccgtccccaccgctacttgctttaccacagtcaacgcccatttcccaactggatgcagttgacgcgaccgtcgctactctttccatcccaacccctgttgctgctccgtctaccgctgccacccctaccacgctctccgccgctgacacgccgatatccatcttacgctgacgccctacgagtagacaaggatattttggttcatatatgtttcaggtgtatagcatagcatgtttcgattttaacatatttacagtggcatcgttccaattaaacgaattgcagtgacattttctaaagttataatcgcatgatccaattaacccaataattaatcttgttttactagtaaattatagtcgctgttcgcaactgcttagccattccattccg

SEQ ID NO: 34901 - DNA, 241 bp, Oryza sativa
agaatagagaccgtgaaggtactctcgtgtaattaactactgaggaagacataatactggtcaataaaatttccaagatcaaaataaacgtacacacattgttggaagtatctgatttcattctattttggctcgttaccggcgagaagaacgaacgaacaaaatcaacatgtgaagcggcatacgcttgtctcaccaaagatgccgacatgagtgacgtcatcgtcgttgttcctcaagg

SEQ ID NO: 34902 - DNA, 792 bp, Oryza sativa
cagcctaaaacgaaacagtgttctttctttctgagcttggcgaagagaaagatagaatgaaagacgagaaatagtgagacaatataatgagatgcacatacatgttcatataactattatgtttggctatgtattccttcgtggatatagaggccggattaatgaaaatccattatctaaaaaaatataactattatgtgtcttttattgcatctatcatctctgacaaaaaagagttaatctagcaaatgagcacctgcaagtactaaatcactctttgtgctcaacaagggcattgaatcacttgtacttggcagtactctgcagtgtgaaaagaaaggattgggataatttcactcagataaagttggcacaagacatatgtgacgatcctagggttcgtggctctagatttggggaatcgtcacaggaaacatggaagaacagaggaggaagaaggagaattcaggagcagagaggttggtagtagtttgttatcatatctcttcttcgataccccacttcaccaaccacgcagggtttataacacacccgtgttggtggctcggttcttacaagacggcccaatagttggcccaacacaaacaatgtcccttacaaggcccattgatcatgacattccctcccccttaaggactggcttgcccccaagccagcgcagatggaaaacgacgccatagagtcgggcaaattttcccaggtggcaagagtatcaggagagccctgaccatcgtaccagaaccagcaaggtaatggaagaaccaccacgct

SEQ ID NO: 34903 - DNA, 227 bp, Oryza sativa
attcgaaaaaatgccactactattcaacatatcggctacgtgccactgaaaattggagaaatcaaaatatcgtgctaaagagcatggaggttcgagttctcttcattggaaccgtgccactccatcacatcttccgtcaaaaatctccgttagcccccagctgcacgtgggccctaccttcctcccctctcttctcttcccccttcttctctctccaccaccataga

SEQ ID NO: 34904 - DNA, 1501 bp, Oryza sativa
gaactcgaatccacgaatttccaaacgattttagccgatgattccaaaagagaaaaggaagaggagatctcaaggatcattttccctctaaagattcggccggagaaggaaaggatcggccgaatttggaaggagacggcggcggctcgcgctagggtttcgggcggcggcggcggcgcgaggaggacgacgaccctgacaagtgggacccacctgtcagcggctgagagagagaggagagcggcggctcggcggactgggccgacttgggccgactttcggcccaaagccaaaagagacttttaaaaacctttttcaatttaaattattcatgaaatgcaattccatttattaaaaatacttccttagctcaaataaatcccagaaaaatctaggaattatagaattaagcaaagtatttaacaaaattttatctagcccaattttatattgagattcaacaaattaaaattagatcttctcttttaggcttttaaaatcatttctaacaattccttttaaacaacaatttataatttaaggatttttaaacaagaaaagctcttaacaaaaataattagatcattaatgatcaaataattactgaactgttctttgtatcatttaggaattgagctccgaaaaatccgagaaaatttcagagagttgacttaatcatggagaatttaataaaaattaaatccatccatgctttatatttaggaaattttatttcccacatttaacttttcttgtaaattaaagaacatttaatataaattctattaataatttattaaataatttataaatcctaaaacgaaaaaatcaggatgtgacagatctaccccccttacaaagaatctcgtcccgagattcggaacggctagaaagaaaaaggcataggtaaactgcagtctatcttattccataactccgataattattctaaggctttatagaaaactactgccgctttgaaactagtggctgagctgtaacacttgaagatgcaactcttgaagacacaactggtactgcattggctcctgtgacgacaatgttgttgacctgaccttgcggctgctgatgcttcggcttcggacactctcttgcaaagtggcctggcttgtaacagttgaaacatacctgctgctcccttctactactgttattctcccgagactgatcctgctgaactggcatcggctgatttatttgctcgatgttaacttcattgctttcattagtctctgatttgatctcaccagcgatattcaactgttgcgactgtccttgaccagcggaagaagattcaccaatttggagtggcttgatacgctgcctctggctactaccttgtgcctcctggaatacaatcattttccttttacggttatccatcctgttcttcttgtcttcaagtcgaattgctttgtcaaccagctgctgaaaatcaacatagtcatgggagattaacgtaactgacagttcatccttt

SEQ ID NO: 34905 - DNA, 1501 bp, Oryza sativa
gatttccaaacttatttgtgcataaaatcctcgtccaggaatcagccgaggtacacaaactgacaatttaatatacagattcatcaaattaactaaaacgataagtacttacttaagaggcactaagtcctcaccaagaagaaaactgcagcggaaaataaaatctagcgaagctccggctccactcccacaggcagctcaactggggtatgagccaaacgtcttctccttcgcaacttgtcttcaactgaggttgattgattattgcaagaatgagcatatgacatactcaacaagccacacagcaaatatgcaagtgcacaaggataccaaaggatggcataatataggctcatttgcaaaagcagcatttaacaaaacatttaagagaagtaaaacagtggagtaattaatcaaaaattttaatcaacactgaacaacatgcctatgctgctcaggcccaaccattctgaaacaaccatacccggctgtacagatctaatctccaaaccaggaattatccattccaaaccggagctaagcaaattattaccagttataacatccataattattgtgagaggtgtgagactaatcacgaaaaacattgctcaactcgtccataaccgcgggcacggctattcgaatagttttactctggccagaggtgtaccactgtacccacaagacacagcctcaacatcatgtctaccatgcgtcgcgatactggaaagtacccgaatagaggctgtgacaataccctttgtacaacacaactcaccacagtgcaccattcctggatcataatcacccccttataaaacaaggcatggactccccagcgacccccgtgggcttatctccgccacttctcagtctggtgctccgcaatgaatcatgctatacaaaaggtaaagccgttgcccacgctggcttgtggttggcacgattaatgtttcacaatagtagctcgcgaaccggtccttaattgtcatgagcacgactctcaaaaccatgtgctcacaacccaccattatcaagttttagttggcaagtaattaattaaccaatcacgattgaccatcgtgaactatcattaagccatcattaaataatgagtcataagttatcccaatagtgtgctaatgtttctaagcatggctaagcaatcatagctaatatctagctgaaccaatatataaagctcaactagtcaagttataatatcccaaggtatcaaggaataaagtaatcaagaacaaaagggccataacaaagaataggttaattccacccaatgacattcgaaaataaatgcacagttgaaataaatagagaatttaaacataggatcaacatgctcaaaggattgtgtttaggatctgtgtgacttgccttgcaataatcggccttcaattaatcttcttgaatacttccggcgcactcgcgaaccttcacaacgacggaaacgactaactatcacgcaaaacgaagaaaaaga

SEQ ID NO: 34906 - DNA, 1501 bp, Oryza sativa; identical to SEQ ID NO: 32248

SEQ ID NO: 34907 - DNA, 578 bp, Oryza sativa
tgacattcgaaaataaatgcacagttgaaataaatagagaatttaaatataggatcaacatgctcaaaggattgtgtttaggatctgtgtgacttgccttgcaataatcggtcttcaattaatcttcttgaatacttccggcgcactcgcgaaccttcgcaacgatggaaacgactaactatcacgcaaaacgaagaaaaagactaataaaaaccaaataaataatacataaaaagtaaacaaacatgtagatcataattttagatgaattatgagacttgaacggcctcattctgacttcaaatgaatttattacgaattttacaagattaaatctatttaaagcccatttaaaaagaattaaataaatttaattcaatttatggacaattttaatatgtagatctttattttatataatttttgcaacttgaaccacattaaactgagttcaaatgaattagttatgaatttttaaagattaaatcggattaaaacacttatatggattttaattgaattatgacgcaataatgaattatttttgaaaaggaaaaaggatttattgcatcagcggc

SEQ ID NO: 34908 - DNA, 306 bp, Oryza sativa
aatctttaaaaattcataactaattcatttgaactcagtttaatgtggttcaagttgcaaaaattatataaaataaagatctacatattaaaattgtccataaattgaattaaatttatttaattctttttaaatgggctttaaatagatttaatcttgtaaaattcgtaataaattcatttgaagtcagaatgaggccgttcaagtctcataattcatctaaaattatgatctacatgtttgtttattttttatgtattgtttaattggtttttattagtctttttcctcgttttgcgtgatagc

SEQ ID NO: 34909 - DNA, 1501 bp, Oryza sativa
caagccagcgtgggcaacggctttaccttttgtatagcatgattcattgcggagcaccagactgagaagtggcggagataagcccacgggggtcgctggggagtccatgccttgttttataagggggtgattatgatccaggaatggtgcactgtggtgagttgtgttgtacaaagggtattgtcacagcctctattcgggtactttccagtatcgcgacgcatggtagacatgatgttgaggctgtgtcttgtgggtacagtggtacacctccggccagagtaaaaactattcgaatagccgtgcccgcggttatgggcgagttgagcaatgtttttcgtgattagtctcacacctctcacaataatttatggatattataactggtaataatttgcttagctcctggtttggagttagatctgtacagccgggtatggttgttcaggatggttgggcctgtgcagcatgggtgtgctgttcagtgttgattaaaatttctgattaattactccactgttttacttctcttaaatgttttgttaaatgctgcttttgcaaatgagcctatattatgccatcctttggtatccttgtgcacttgcatatttgctgtgtggcttgttgagtatgtcatatgctcattcttgtaataatcaatcaacctcagttgaagacaagttgcgaaggagaagacgtttggcttataccccagttgagctgcctgtgggagtggagccggagctgcgctagattttattttccgctgcagttttcttcttggtgaggactaagtgcctcttaagtaagtacttatcgttttagttaatttgatgaatctgtatattaaattgtcagtttgtgtacctcggctgattcctggacgaggattttatgcacaaataagtttggaaattacttgtgaatttccgggcgtgacaagttggtatcagagccatctcgactgtaggataagccaaatggtcaaaccttaaggactaattttccgaaaacatgatttgtgaaagtttctcctttcttccttatctagaattctttgcaaattgtttcattgtctacttccctctctctttcaacttgagtagttctgaaactagttgttgaaacttgaagacgccaatgtggtctacttatggaggttaagtcaagtggatcgatgaataagaaggtgatggtcgatctgaagtgcccagatgtcaagatggaatgaagtttggatcctaccttagaacctatgccgccaatctatccttgaagaatagttagtagggaagagcgtttgttgtttgctttgtttgtaggtatggttgcattcccatcattggagtagttcattgatgagtgtgtaactatactaggttgcttgcttaatcaacttgaacaatataatggtctacgcacaccagatcagtggtaacctggttaaggtcttgtctttagtgtaacctctctccttctatcttctctaatatgcaataga

SEQ ID NO: 34910 - DNA, 1501 bp, Oryza sativa; identical to SEQ ID NO: 32252

SEQ ID NO: 34911 - DNA, 182 bp, Oryza sativa
atatagctttgattctaaaaaactgtagttatttaatatagaaaataaactagaaattaatcaaacgctgggaaacttagctttttcacattctcagaaattgaccaccaaccaactacttcccgtaatcttaagcaccctaaacagacgcggtgatgacatgcgtcgcttctgcttctagc

SEQ ID NO: 34912 - DNA, 725 bp, Oryza sativa
attctctaaaaggaataatagaattaattaaaattcgaaaagaaattggcaaacactaaaatacgtacaagaaaaattcaaatgtggcccggagaatttttgttaaattctccttggtctaaaaggagccctcaaattttagtggaatttttagagcacaaataataattattaagaaataaacaaagttaaaatggttttataaaaagaaaagctctaaaaagtctttttcccccccccccttccccctcttgggccggctcggcccatctccctccctctctctcctcctccccgcggcccactcggcctctccccacgcgcgcgccgctgacgggcgggcccgcccgccaccctcgctgacgggtggggcccacctgtcatccctatcctcccgccgctcccaccgcctcgcccgtgccctagcgccgccgccgccgcgaatcccgccgcctcccgccgtccccgcgcgcaataaagagggggaaatcactccccgtgtttccctctctctttccccccatttttcccaccctctctccctcgaattcgggtggaaaccgctcccctaatctcgccggcgccattgatggcggccgacctcccgcgctggtttcctcccttccccggccaccctctatcgccccggcactatttaaacccctcccggacctcctccgttcggtttcgcctctcgccgaccttcctccttgccggatttcagc

SEQ ID NO: 34913 - DNA, 397 bp, Oryza sativa
tagttcatcagacggaatctaagcagaaaagagcaaaaacaccaaaacaacacataaacaagcatgaacagtacatgtggatatttttaacatgtagatctcgattttagaaaaatttagagacttgaaccaactaaatccgagctaagatgaattagttatgaatttttgaagatttaatcggattaaaacacttatattgattttaattgaattatgacgcaataatgaattatttttgaaaaggaaaagaggatttattgcgtcagcggatagggtttgcggtggaccgggcgcacggcggcggctcacgggaacgaacggccgagattgatccatccaaaacggacggccgagatcgatcggtccacgaccggctcacgggagagggcgacga

SEQ ID NO: 34914 - DNA, 390 bp, Oryza sativa
aaaaacaaatctttcaaaaccatcttcttttaaagaaaagtacacttgttcttttttgtggtaaggatgaacatcttgatggttaaattagctcgtaaacagaaaaaagaagagataaatggcttttgcaaaatcaaagtggcaaaaatctggttttccctcgaggaaaccggtcagaccgcagtgggtcccgcggtcagaccggttactgagcggcggtcagaccggtggttcagaagcggttagaccggcccccggtgagaccggctactgtactacggtcaaaccggactcggagaaatttttctgaaaattctcaaactgtttttgcacgtggatatatgcctattggatctactggtcgtgtgtcctagattcctaaatttgtat

SEQ ID NO: 34915 - DNA, 172 bp, Oryza sativa
tttaaaatggctttgggcaactaagtgatttttaaatgccgttttctgcaaaacttaacccctatatcattattaccccttgtacccccttgcattaatcatgcatctgccggtgtggcttgctgagtactgtggttgtactcattcttgctctatcttttcccccttcagt

SEQ ID NO: 34916 - DNA, 224 bp, Oryza sativa
tagtggaatattattattgtaacaatttatatgcattgcaagcatcactagttctcctctattttgggtattattgacggtcgaaattgattgataatgacagtcaacacacacctccggtcataccgactcaggatgagcggtcagaccggccaggatcgtcggcttccggttctgttgacactgatcgagatggtcctccagagggtacaacttcgaccagt

SEQ ID NO: 34917 - DNA, 176 bp, Oryza sativa
ttcacgggagaaagctaccaggggccccacctgtcaaccaccgaaacccacacaaaatacttggctctcaactcaaccgcatatcccccccttctctccgcgccgccgccgccgccgccgctcgccggacttacccgcatccgcacagaggcgcccccgccgcagaaagccccaca

SEQ ID NO: 34918 - DNA, 157 bp, Oryza sativa
caaaatgcatatgtaacgccgtatcgcctaattaggaaatctcgcaaatccaggttaaagcaatgcgtactgcagtgataaatggtgtctgtattatcttggagatcaatgtttgaatctttatcgctgcaatattgtttcctttttctttcgaagt

SEQ ID NO: 34919 - DNA, 921 bp, Oryza sativa
  unsure (1)..(921): unsure at all n locations
cgcagcgatgtgttccgattgataattcccttctctgcaaggtttgccttccttatcatttgaacggtttctctttacttccataataattcacggcagaaatagaattggtattttattttttttatgcttggtagtatatttgggacataaattgccaaaaaaatgatattttgaatcttccacaaaacttgttatataaatgacctatgataaaaactagggttaattggatccatgctattggaaatgtatcaaattagaaaaataccactactatttacgatattggctaggtgccgctggaattttgggaaattgaatccatgccatcccgtcgccttttccgtcgttcccccgttaatttcctaactctatggtccgtgccgccgtgggggctgccgggactagacgccatcaccgggacatcgtctttgtcgccgtcaaaccggagcacgccggagcaagccatggcgccaccgtcgtcgcctcgacgtcctcttcaagaagcctcaagaacctcagccggagacacggggaacggggagatcggacttcatcttcttcaccttcggcgccgttcccatcgttgattttcacaatgccggttgccgcagctgcgggcctcgttcctcgcgcggttggccgctatgcattaccacctttctcgtcggacgccgttgaggaagaggagcttatcctcgccgtgcatctccatgtcctccacgagcagctctcgttctccatggactgcgtgcatagtggcttggtcagggagagccccgncgacgagctagtctggtggctcgccgnctcggttccccggcgaccaccacttacggtagcgacggtacacacaacagcagcagcacaaggccgtcgcggcgcagcccgcccccaacgacggcgcggcagttgacg

SEQ ID NO: 34920 - DNA, 767 bp, Oryza sativa
tttggtttctaaagtggaaaatggaaaatagggccttaaaatgtgaatggcataagtacaggttaaaccatgccaaaaagcaaccacaggcctcctatcgaagtataccaaaaaaaaaagtaggatgactttgttgacccacttatacaattttatgtacccactcaaatccagagacccaagtgacctgcaaaaatttagggaataagggggacctatgatatgctttcctcaacttcgaaaaaaaaataacaaactattctgctggtcaagggttttaactcaacaatatgccatatctctactattataaaaattgaagatgtttttgccggtattttggtatgtcatccgggtttgagtcggtttttaagttcgttcacttttagaaatacagatccgtgtttgagttggattttaagctcatttgcttttggaaatacagaaggagtcgtataagaaatatcattaaaaaaactcgcatgctaacttgagatgatatacggactcttgcagcttatgattttcaaaaaaaaatatccaagcgaattcccacagtgaattttaccctagctaaaccatataacaacaataaaattaaaatagcatttacccattgcaacgcacgggcattttttctagtatcttaaaaataagaaattatattgttgcttcaacactttaaattatgttctgtacagtacagtatgggtgattgtaaaagaaatcaatttcatcatatgaacaggaatatttagtgagcaaca

SEQ ID NO: 34921 - DNA, 537 bp, Oryza sativa
ttggcaattagtggtgtacctagaagttttctagacttgggcaaaaacaacttcagctagcatctggcgtcatcaagcgctagtggtatgacatgccctccattttgctgtgtgatggtgaggcctggtgtccctacaagtgtcttcaggccctgcatccaccactgtttgcactgtttaccttaaacttcttcaggccctgcatttacactgtttgcactaccttaaggttttaccctactattgtagttaccgaatgcataaatatagcaaacactaatttccaggatgtgatttacagtttatatattgctagcagttagtgacacagtatttggacaatatatattttatgttaaatgaccaatagtgcataacattgtttaaatgcctaataattattttgaattggatacctgtgcaaattttcatggttacataatttacttgtgggctacagtccacttaatgttctttgctgctgtcctacctgcttagatttgatgctaccttgtatgtaacatttactgttaataa

SEQ ID NO: 34922 - DNA, 226 bp, Oryza sativa
  unsure (1)..(226): unsure at all n locations
ttttcgactttagaaaccactttntagtagtccctggtacacatacttcttttttctattcctacatgagtttcacttgcgattctatctacatttgccacaaaatagcaaagctcgtaccatgaactattttatctcctgacacatttgttgtttataccattgatatgccatatgttccgtgactacaagggtaacataatctcatgctattcattcctgcagg

SEQ ID NO: 34923 - DNA, 160 bp, Oryza sativa
tctccccctgaattagaagcttgttgctatggctccatgtagataaataagcgaatgctagctgcatgcgcgcttgtgcttgcatatggtggatgtatgcccctactatgtacaacttcatatatatatgtgaaagttgcatgtgtcttctgtcgaaaaa

SEQ ID NO: 34924 - DNA, 1490 bp, Oryza sativa
agataaacttgacttgcacgcagcgggaacaccactccacaagtatctcgacgggcaggacagaagcctcttcctcggagaagcccccatcttacgcatactcaaacttctggggtttggggaaaatatagcaagactgagtactaccccctgtactcagcaagtcataccggaataggggtatgatgcagggaattatcaagggatagctataatggttcctttgcataaagcgagcatttataaatagtagttgaaagtagtaaaaccgttgtaataattaatcaatattaatcatccactgtccaatgctataccacgttgcaacaggcccaaccatccacctatactattcaattccattagactagtctagggtgaatctaatcacggtgaatctggttgaccgcccataaccgcgggcacggctattcgaatagttttactctaatcaaaggtgtacaactgtacccacaagacacagccccacgacatgtttccatgtgccgacatgccaccacgacataccggaaagaggccgtgacaggacccttcgcataaccccctctagccaagcacaccacacctcaagtttcacccccgtccccagcgggcaacgggcagtcccctctcgtgcctaggtgaatccaaaagcgacagaggccgtcgcagggcccgccccgctccatcacgcccacccttgcctggatgtgtcagctagaggaaagctacactacaagcctagccattgcccacgctggcttgtggtaagtacgaggaattcttccagggtttcccacgaaccagtccttaagtgccatgggcgcgactagcaaaaccatgcacccacagcccaccataggattcattttaattagcaacaccaggacggtggtactaatccaacatcaacactagaacctgaagtctatatattatatgatttcccccattgtgtgctagttgaactaagcatggctaagcaatccctagtccaatatctagtcatgtcatatcccaagctaacaaaggagcatggtacaaaaatagcatggctataacagtaggtaaacatcccatagtattattgtaaaacaatgcaatatttgaacaaaaacagtaaaacatttgcaatataggatcaacatgttcaagtgacaagcatgacttgccttgctctgctgctggaggaacctcggcgactatttcaaagtacaccggagcgttgggagagccggaatctaagcgacatacaaagcaaacaatacaaacaggctataagactactgaaacagagaacaaaaccatttttaatggaatctatgcatttttattgatttactgagacttgaatgggcttaaacggagctcggatgaattagatatgaattttggaatattcactgtgtttttactataaacagaaaaatccttaattgatttattgcgcaataattaaaatcctggggagagagagagcggcgccaaca

SEQ ID NO: 34925 - DNA, 932 bp, Oryza sativa
catttttagctctccaaatacctatttggccaacctaacaaaagtttagagagtcaaatttgcattctattccaacagactctccgcattatactctctattaaccaatggaccccaccagtcattctcatccccctttcttcttccttcccctctctccaatcctctttctcgtcgagccgccccgccgccgcttcctccctccctcgccacactaggagggcgcctcggcggcatcggcgccttgctcgaggcggagctccggcgtgggttcaagacgctcgccgtgacgccgcccgacccgtccacggtggtttacaaggtccgcctcaaccgctccgcccagctcaacgccctcagcccggacgccttcgcggagatcccacgcgccatggcgctcctcgaccgcatcctagccgcgcatgccgtcgtgctctcccctgccggcccgcactgccccgggaaccccgccatggcccctcctcaccgggcggcggcgaccccgcgcctgcggctggtgggctccgctgcgccatcctggagatgcaggtagcgctcacagccatcgagcggtgccggaagctggtggttgcagcggtgcacggcggcggcgtcgaggtcgtggccgcctgcgccgtcctggagaagagccgaaggagatggaggtggaatgtgtatgaggcccatggttggctagtgatttttagcttcctaatttgactagtggagggagggtgagagttttggctagccggatggcttagccatccagttggagaggatgttgaaagacgtcttttggctagaatagctaaaatttagcttagagagtcacttggagaggttgttggagatgctctgagacaacataaagaagcttgctacttaaaagaagagcaccaagcacacccagcctacatacataatgaagt

SEQ ID NO: 34926 - DNA, 1191 bp, Oryza sativa
aaagtactggagggctatagtgattcaaactggatatctgatgctgatgagataaaggccacaagtgggtatgtgttcacacttggagggggcgctgtttcctggaagacttgcaagcagaccatcttaatgagacaatggaatcagaactcacaactttagatattgccacagttgaggccgaatggcttcgtgagctcctgatggacttgccggtggttaaaaatttcagtaccagtaatcctgatgaactgtgataattaaacagtgattattaaagtgaacagttcgaaggacaatatgaagtcatccaggcatgttaaaagaagactgaagtatgttagaaagaggaaaaactccggagtgatagcatttgactataccctgacggctaaaaatctggcagatcagtttatcaaggggctaccacataatgtgatagactgtgcatcgagggagataggcttgagacccacttagagatgcacaatggtggtaacctgtccattatgatcggagatcccgtgaatttggatggcaaaacaaactattgggtaactgagagaagagaccctcaaaatgagtttatcttcatgatgtacttctcttctattctgtatggtacgatggtatacaccttaatgtgatccgagtggcttttcataaagcagagatgtcatcctacagaatatcttagaaggaacacacctatatgagtccaattgctagttatagtctatgagatctgggtaatctctagatactcatgaaaagtccaggagtatgacttatatgatccaaacagaggggatgcaaacggcagcccagtaccagttaagggtttgagtgaaacctgaatcgcacaagactgacaattcaatgcatagtccattgttcagttgtgatatggtgtagctcttttcctaggtggaagttcaacttaacagtctccatcaaaacactggtataactaacaggttcagttttgagaacatttgttgtgagccatgaaatttggtggggattgttggaataaataggctaggcccaatttaattcaactaaaatctcaagagcccacaagtaatgttagagacaataatactgccttgaaaatttaggtagaagaacctcaacttaaatagggtgatattggagattccctattgaccggttgaggtgatggttgga

SEQ ID NO: 34927 - DNA, 160 bp, Oryza sativa
aacgggggtcatcgtggcggatgggcgacaagcccgaaagttcttggaaaaggcacgggcgcggcccgccgctgtccttgcaagccggtgggcggcgagaaggcttcttcttgctggaggaggagaaggtggtcttgaagcggaagggcggatgaaggaa

SEQ ID NO: 34928 - DNA, 243 bp, Oryza sativa
atttaaatttgggttaaagtttttaatttttaaattaagttttaaattttaggttgttataataatggttgtgcttttaatttttcatctataaaaagttttaattttcacgtatatattttaaatctttggttaaaaaatccaacctcatgaaaaaagaaggaaggattttttaaaaaacataattatcggaaacttattccgtcaaataatataatctggattattttctccgaatctagc

SEQ ID NO: 34929 - DNA, 225 bp, Oryza sativa
cactcgattttcttgtacactcctgctcctttgtaaccaccgtagcccgtctctttcacgccgcatggatacaccagtgcaccttctcaaccacacatcttcctttgtccccatcgctgacgttgtgtctcctctaccatgttccatgatccactctcaacaccatggtgctccctacaagaggggccatttcactttattgacttcaccacgcggctcactagg

SEQ ID NO: 34930 - DNA, 164 bp, Oryza sativa
cttttcctttgcggtttagaagaagaactttgggggccatggagaagttgatgattagattgataaagagattgtgtttaaggacatcaagacatggacaatcgtcatatccagttatgggaaggcaaggcagatttttaagatgctatctacctttcaggcta

SEQ ID NO: 34931 - DNA, 674 bp, Oryza sativa
tatttgaacatacgtaaacgaacgaacgtgcgtgaacgaactttacttaacgtacgttaacgtggacgcacgtgaacgaacgaacgtaggtgaatgaaacgtgaacttaacgagaacgcgaacgtgaacgatcgtgaacgaaacgtgaacttaatgagaacgcgaacgagaaatacaatatatgttacttcgcgtttctcctaatacatctttttgtatgttgcagaaaagacgttgtcgtcgtcgtccctcaagccggagtggttgctagccctcgaaggaattcgcgcaggcaagtgatgtaaatatatgattgttagatttttaacgcaattaagactattagatttaatatacgacacttagacttagcattataattagagttttaatataatattttttgagttttaatataagattattagatttgtaattagacttagtatataattattgactagctagggtcctaatatacgtcacttagacttagcatagttgactattacagttttaatacaatattatttgagttttcgtatacgattattatagttttaatataagattattagatttgtgtttagacttagcatatatgattgttagcatataagattgttaaagcaaaaatgtctcatgacttaggaactatttcttgtatgaacaga

SEQ ID NO: 34932 - DNA, 1319 bp, Oryza sativa
cttagccagcagtgcagcacaaggattttaattaatcatatccatgatgcatgtgatatatattctccttgcattgcaagtctaaatgcaatgagtcaagtcaactccgatacattcatgttgatctccattacaataacagatatacgattacagtcagggtttcaaaaaccgctgggggcccggttaccgccacccggcggtacggcggtaaccgcggtaaccgcgcaaaaccgcgacaaatttacaaatcgaaatttgaattcaaaaattcgggcaaaccgcgcggtttggcgcggttaccgcgcggtttgacgcggtaaccacgcggtttggcgcggttaccgcgcgatgtgtaatgggttgcacagtaacgggccggcccatttttttttctttttccaattttcaaatttattctccgttttgctctcaaatttgaataaatattactcttttttgagaaatttcttcaccataaaacactataaatcaagcactaccttcactattttttttgatttttttctttttttttaaatttttgaatttggacgaattttattaaaccgtaccgcgcggtacgggtaaccgtacccccgcggtacgggcggtaaccgcggtaaccgcgcggttaccggcggtttttcacaccctgattacagatttacagtacgtcaaatgcaaattgattacttagcttgccaggtatttctaatcaatagtcaatggtgcgaaaaatagccctaaaaaatcataaccagccaaccaacaaattcaacaaaaggggaaaattgatggaataaattctgaaggagcccatagtagagattgcatgcatgtcagttgcccagtcggtgtgcgtgatcaactgttggctccaaacttcattaatttgaactagcttaatttggttgtcagcagggtacgataataggttatctttcaatatctctccattaacgggctttcaatggtgacatgctcctagctagccacccactgattacccttcggcttataattacgccacattcaaattttgaattttaaacatcagtttggagttgatcttatgttttctttcgttgtagtttattttctaacattttcttttaaattgctaagaaacatattatcattaagaattattttttattgctcataagcctattgaaagccaaaaggtttgtgctgggaaaatctagacaccaggtttacagcgtagggagggtcaaagccctcctaaaggaaaacagacagactccaaaacttactaccagctctaaaagcagcaacacaactaaaagaaccaaaag

SEQ ID NO: 34933 - DNA, 378 bp, Oryza sativa
agcgactcccttgtcatatccaattagatttgataagacctaaactgtagtaaaaaaaatgtaccacatgctttctcatatgtcatcaatgtttccacctattcagacaacctccctcattcagcattttggttttcaactagtatcaaacactaatgaagcaatcgccactaggtaatggggcactaccttgtcagatccaactagaattgacaaggccatcattactacaaggcattcagcttagccgtgaattatgtcggcggctacgacggtagtgcaactaaacttctaaattgttttgatctttctttggtttggtaactccatactcaattgttttgatctttctttgttttgctaactccatactcaaga

SEQ ID NO: 34934 - DNA, 274 bp, Oryza sativa
agggcttacccaaaaaacaaatttttttgtgaattaaagccatctgtgccggccataactaaatgcccgattgaaataggttgtcacgcccagaaattcccgaatagaattccaagcagaatgtgcattaaaacccccgtccaggaccggtcggggtacacaaacgacaaatttgacatacagatccacgtcttacaaacattataaaagtattacataaatgcagcggaaaataaaaagataactggagctaagccttgacttgcaccgcagc

SEQ ID NO: 34935 - DNA, 815 bp, Oryza sativa
ccacctctatcaccttcaaccccattcaacttacggggaacaatataagccgcatcataccaaactacattctccaagacaagacgccggatatcgactttaggaataagcacggctagtcccttacggtgtctttggatactgtcaggagagacgaaagtgctatctctgtcctcaccggtcttgacctcgaggagaaagcctaccctgttgtagactacgagtcagacctacagaccgccatgtcgacaacagttagataggctaccccaaatattgtactggtgtgattatggtgaataagagcaatacgggcttcggccaacaggatgtagggttattacctgacaattcaggggcccgaccctgtataaaaatcctcgcctctgtctcttttacctcaatctcacgtatgtcctagtaccgacgatccccatactatgcaaataccggaatcgcgacttcaaacgtcgactgaaatcatatcttgatgtcgcttgaaacaacatatttgcatgaagtgacacgtttgctcgacaagggcatgtcatattcacaatgatcatgcatatgtggcctttcatatgcgcttattttagtagtggatgaagaatccatgtggattgctacatctttacgtgctttgtatggtctatgattttgttgtagtggatttagtatttgccatatgtgcttcatgtttgttcttattggaattaaaggatggacatcctttatacgctccatttatatcttaaagacaaagtagcttcggatcgaatgtaagcacacagtaaaattgtagagtaccaatg

SEQ ID NO: 34936 - DNA, 365 bp, Oryza sativa
tgacggttgaagctttgtggaagtccatacagtttctcaatggcgaggctacagggtggaggtaccttggcccccacacttggggaacaacctaaactgttgcccaggtgacctgcacttacaagagatatttatgctggtccacaatgtgtggtggcgaaaagtggggatgtgaatgtgatgaacacacgtgaatgaactaaggaatcctaaaaactggacacattggtaagataaaaagtgaattactttgagctaaccgaagattatataccgacttttcgcgcagactggaggcacgattaaacacctgtgagcacctgctgctcagtgacaatctacgacatcttccagaatattaacca

SEQ ID NO: 34937 - DNA, 355 bp, Oryza sativa
ttattgagtatccttgcaaggggaatgttggaacatagtatttcatccgtttcatattataagactttttagtattacccacatatgtgtgtctagattcattaacatctatattaatgtgggtaatgttagaaagtattataatatgaaacggagggagtagtaagtaaactacccatctttacctatctacttaaacttttataatgaactagtctattagtgttgtactccttctgctcaaaatataagggattttaggtggatgggatatatcctagtactacgaatctagacatgatcctctccagattcatagtactaggatacatcacatccaactaaaatcacttat

SEQ ID NO: 34938 - DNA, 571 bp, Oryza sativa
cggtagctaatatgtaattacactgtaactggcatgtaactacactgtaatttatatgtaagtttcacataattgtgaatcgttagatctattataagatttattttgatgagaaaaaaaaaacaaatcatagcacacacatatgtgaaagattttgttcccatgacctctattttaccaaaataacatgttatggagagatttttaaaaggttacatacaagttagttacagtgtaattacatgcaagttacaatataattacactacgattgtactgtaattacatctgtcaaaggaaaaatttgtcgacaaatatatagcaaaatcgtacctccgatagttatggaattaatgcttactgtatgcatgtatactacggtggaccaggtaactacagctaatggtgtactctgcaagctataataacatatgtaattgtatgcaaaataacgggattcaagggctcaagccaccaccatggatacaccttctagctataatttcttcaattatttgcaaccactttcccactagatttttttttttgtaagtagtaaagatctcctttt

SEQ ID NO: 34939 - DNA, 561 bp, Oryza sativa
ttattaataaaaatttaaattttcaactttaaatttgaagttgatttagaggtttttcatcgaagtttattttttagcctttgtttttagatcgctaaaaacacgtaatatttttattaataaattatttttcatttgcaaatatgtcccaactgatattgctgttaatatgttaatatggtatcagagatagaggttattgattaatccgcgcaaggggaatgttgttggaatataagtaaactgctcatctttacctatctacttaaacttttagatcgaactgtatcaatgttgtagctacaaatgcatacaacacaataaatatgtgtgcttattattgttaccaataaaataagtcatgtgaacaatttgatgttatgctgtgtttgtaagtgcctgtatatataattgcactttttaattctgccttttttaacatggtgcacatagcaatactttgtgtccaggtacacagcccagctaaccactgtacaaaggccttttagcacagagactccacgagaccacgagcagagaatcaaccgacacaaactactc

SEQ ID NO: 34940 - DNA, 494 bp, Oryza sativa
acaacatctgtctttcctttcatctgcatgtgcattttgtttctcaattagtttacgaagacagacatttttttccacccatcacttgtgtatctgcaatatttgctttcacttttgaaacattgtaatcacgctactttgttctgccaaatagttaatcatgctttattgtctgtattgcagtattgcaagttgccgtgaaaggccattctagggaatgcagaaagatgtgcttgcacgccagagatatctcctatgaagagaagggcatttctcccattgatttgacatcactaattcttgatgagcgaggatttcagttgctcacctggtgcattctgcaatcacaaagtaataatgatgctatcaatgtcagaaatactgctatgctagatcatgcaatttctgatgatggttgaagtttttgcttttacggttttcctctaaaattccaataaagaattgtccgctagcattgttttgaatgatggaac

SEQ ID NO: 34941 - DNA, 167 bp, Oryza sativa
cctaaaacgcacgctagatggctagttagcgcgtctgcgctaattaggaaattcgcaaatgcgggttatagcatgcgtactccagtgataaatggtgtctgtattatcttggagatcaatgtttgaatctttatcgctgcaatattgtttcctttttctttcgaagt

SEQ ID NO: 34942 - DNA, 208 bp, Oryza sativa
ccccttctccccctaaggaattactttccaaaaccctgagccaaggggaaggaaagggagaaaaggtgcggcctcggttctagctcaaggaagttagatctggcaaggccaagaaaaaaataagggcaaaaggtcaaaaaaaaatacgttgctccacaggagttcaaactaggcatgccattgggtgaagatgacgtgcttgccacaa

SEQ ID NO: 34943 - DNA, 542 bp, Oryza sativa
taatcgtatacgaaaactcaaataatattgtattaaaactgtaatagtcaactatgctaagtctaagtgacgtatattaggaccctagctagtcaataattatatactaagtctaattacaaatctaataatcttatattaaaactcaaaaaatattatattaaaactctaattataatgctaagtctaagtgtcgtatattaaatctaatagtcttaattgcgttaaaaatctaacaatcatatatttacatcacttgcctgcgcgaattccttcgagggctagcaaccactccggcttgagggacgacgacgacaacgtcttttctgcaacatacaaaaagatgtattaggagaaacgcgaagtaacatatattgtatttctcgttcgcgttctcattaagttcacgtttcgttcacgatcgttcacgttcgcgttctcgttaagttcacgtttcattcacctacgttcgttcgttcacgtgcgtccacgttaacgtacgttaagtaaagttcgttcacgcacgttcgttcgtttacgta

SEQ ID NO: 34944 - DNA, 192 bp, Oryza sativa
atcaagtcaaaaaacactataaaatgataacataagcacttatgatatcattttatagtgttttttgacttgattgtcgttttatagttgagatatggtagtctgacacatgccaattatgcttcagtttccaatttatgaggatactcacttatttccagcacattaatctgacatgtctttttctccagg

SEQ ID NO: 34945 - DNA, 186 bp, Oryza sativa
cagtttgagtgccacatgactatagggcgaattcgagctcggtacccagcatttcttgaaacaccaagtgtggaatagaaatcctgtaaattaaaatatcaaatccatgtcaggaaactggattttctaataataccagcaaagaagaaaagcaaatgaagtaactcacagcatcagctctgacaa

SEQ ID NO: 34946 - DNA, 550 bp, Oryza sativa
cccttctaggcatgaacctggacaatcatttgtccagattcatccctaaaccctaaaccttgtccaggttcatcccctagaagttgtcatttttgggatcggatggtgtacatgatggttagcaggctagaaagataatgatatgactcatcgctcactttatacgttagtttggtaaggattgcaaccattatctagctatatttgttatgttttgtgagctattatcctatatacctatacaaatcatccccactactaggaattctctgcatcctggtgattccacgtcatcttttttctctagccgttggtttctaatcaaacgatcaagatcactgtcgcatcgactatccattaaaatttgattgacattgtatctcactaactcacgcctaaaattagggtttctctcctctaacgcgacgccttggagtttcaccctacctctccgatctgggttgattttgtcccggagtcggttagaaattcaatctatggctgctctgcaagtcgacgtgaagacgaagagcgattttactggatctca

SEQ ID NO: 34947 - DNA, 233 bp, Oryza sativa
cttgcggctttagctatattccattctagaacgctgggaaattccagcaaactgatggttgagactgaaacggtgtggccgtgtctttacctttacaacgggaaggaatacgcagggagaaactgttggtttcgcatgtgatttaggttaaacattgctaaccgccaacacttctactccaccatgatcttattatatttttcttgttacgttagattcccggccggtgagga

SEQ ID NO: 34948 - DNA, 1501 bp, Oryza sativa
  unsure (1)..(1501): unsure at all n locations
catccctaatccaagtgacaantgggcattccaatcaccaatccacnggcttcacttgcttcacagaaatccaaagaaaaccaggcctgagcacttgttcttaatcattttttatcgaaanggaaaatgnacccacncncnatcattttcgtgacatatattatatatgttggagagtattttgtttactagaataaagcctnacacttgaggtgagattgagaagaananaatcaagctgaatattaattgtgaataaatatttttatatatttagagctgatatgtgaaattcttaggatgaatgaaaaccatacnacatgtttctcttaaaaaatacngacatggttatcctagtggctatgtatcttcttatccaacgactgctatctttactctaatatgcaatctaatggttagaaagtgtttgctttatatgagttaatgttccttagtggatatcaattatatagaaccaaagatatcattgcaacggatgatcattttaggtaaactttttgcatttttagcatttcaaaaaccacaactgagtgactaaatcgaccaaaacaactttaaagtaactctgaaatcaaaattggctgctacttataactaaggcaaagacaagcaagctcaagtagttattaataagtattgcttgaaaggtaccaagaaaaaaaaaacactagtaatatatttttgcaccatcgtgtagcatcattacccttcttgattatagggcagcaatgcttaattactgtttgtcggaatatatatcagtacataacctgtattttcggatcggtattaagcttttgaattgaaatgataagtaacctcatctttttttttatgcttatacttattaataaaaatttaaattttcaactttaaatttgaagttgatttagaggtttttcatcgaagtttattttttagcctttgtttttagatcgctaaaaacacgtaatatttttattaataaattatttttcatttgcaaatatgtcccaactgatattgctgttaatatgttaatatggtatcagagatagaggttattgattaatccgcgcaaggggaatgttgttggaatataagtaaactgctcatctttacctatctacttaaacttttagatcgaactgtatcaatgttgtagctacaaatgcatacaacacaataaatatgtgtgcttattattgttaccaataaaataagtcatgtgaacaatttgatgttatgctgtgtttgtaagtgcctgtatatataattgcactttttaattctgccttttttaacatggtgcacatagcaatactttgtgtccaggtacacagcccagctaaccactgtacaaaggccttttagcacagagacttcacgagaccacgagcagagaatcaaccgacacaaactactctccatcaaatcatcaaaccaaacaccactacttttctctccaacttcacgacgccggagatgccaccggcccgcg

SEQ ID NO: 34949 - DNA, 266 bp, Oryza sativa
ggtttcgttggaccgggcgcacggccgccggttcacgcgaagggccgccggagatcgaaccattccaaacggaccgcccaagatcgatggggtccacgccggctcacgccgaacgactccgatgacgtcagcgatgacgtcaccaccgccgccgccgctcgccgggttcgggctcacacgctcgccgccaaccgccggcgcgccggcccaaccgaaaacccccggaatgaaccggccgccaagcgaacttccccgttgaccaaagg

SEQ ID NO: 34950 - DNA, 1472 bp, Oryza sativa
gtccaacttacccagccacacaggcaaatgtccaggaacacaccccctcttagcgcacatccgtacgtccagtgtcgatgccatatgccatgccttgtgcctcacacagtgcgcacatgcgccatgcgccatatgcccgcacactgacccgtacgcgcaaccgcgagggtcggctctgataccatttgtaacagccctccctccagatccgcgtagcccagcccaaccgatgagcgggcccacttacacacaccaccccacttacactttcgtccttgcttcgtgtaaaagggttaacccgggagtgatgtggttggagggaagaggcctcataagtcggttccactcgtgctaaactagcaaggtggtactaaacatgcggacacagctcacatgggctacacaggcctaatccttattgggccgggatgtcacatctattgcttagaccacaatctaaacgataggtttacggtctacagtcatctaaatgttgtttaattgtgtggtctagatggtctagttgaccgactagacggtcaaacggtctaattcacagtttaggtcctaaactagacgataacccgtcgtctagcgtctagacgcggtctagaccgtctagactatggtctaagtgaacattgccttgcctccgacgatccaactcataacgaactgggaaccattcggaaagctgctttcaaaggtaaaaatgaaaatcatggcagatatgctactgattattgttggagtttggcttcgtgcacaagagattgccaaaattctcaggatttctagctattgtttttctttcttcaaacattatcatgacaatttggattatacttgagatataaatttcagaaaacacccaagcgtagaaattcaggttagactaagaactgctagtggaacctagctttaatggtgaactcgtcatctctaacatccggcgttgctgctgcagtggtgggtgtcactagaacggataccctcatctcaatcgggtggtaagcccatctcaatcgggcatggcgtcactgatgtgaagagctatctcaatcgggcaaacggccgtcatggatgattctatctcaatcgggccctaagtaaagcccgtcaccgatagctttgacccagacgaccagtcaaactatagcccgtcacagatgacctatctcaatcgggccacaactagcgcccgtcacagatgacccttatctgtgacgggcgatagttaatgcccgtcacagataagggtcatctgtgatgggctagtcaactacccgtaaaaattattttgctatagtcaacttacaaatataaacatttcatatgaaaaatggaaaaatagtcatcggtgacgggctttagttaatgcccgatagagattaagtatatagcccgtcactgatgagtcatctgtgacgggcctagttgttatctcaaacgggcctcaagttgtggcccgt

SEQ ID NO: 34951 - DNA, 1473 bp, Oryza sativa
  unsure (1)..(1473): unsure at all n locations
attagccggaaggggtttaatattatggggggacccctggaaactttcccttccaatggacataataaaaatcaagggaaggggggggggggggaaagnatgcaagctgtagaagcaaaccgagnggttcagatttacccaaacctatctggtgaagttggcctcaactccaggggatctgaactcgcatggtagtgctttagtcctaacagtagaccactccattccatatataattctccctttagtatatggtgcatgtctttttttaacatctttaataacttatatcttttaaattacatattatcttcaagatatatttatattattgtactctacataaaatatatgataaaacaagatccatgttgaatatatttaaacattttattaatttaaaagtaatttatttaaattgtaactctctatagattagaagcaactaagttatgactgagttgaaataagaaattatatgtagagtaaattcacgagaaaaatgtagagaagatttttaattaaatgcatttatgaaagtaaattcaataaagtcttaaagtaatttacataaatcataaaagcaacttaacattgtcgatgtttgatgtcgcgattccggtatttgcatagtatggggatcgttggtactaggatatatgctagattgtaagaaaagagatagggacgaggatttttatacaggttcggacccctgaattgtcaggtaataaccctactcctgttggctgaagccggtcgttgctcttattcaccataatcacaccagtacaatatttggggtagcctatctaactgttgtcgatctggcggtctaaagtgctgactcgtagtcggtagccttcctcctcgaatccacatccgacgagatcaaagacaacgctatgtctctcctgacagtatccgtagacaccgtaggggactagccatgcttatctctgaagtcgatatccagcgtcttgtcttggcgcatgttggcttgtatgttcattttgtgtcttgatctattgttcagtgtcccctctcttcctagggggccttgtatttatacccataggtgtcctcttgtccaaatagaactagagaaaccaatatggatacaatccgagtagtccttatcgtttccatgtagaactctattcatccttccttatgcggaactcctcctatatccgaaggttgtttccgtataagacatggtatgtggtgggtcctgccgagatttagttaactactattaggtatatggtatccataaccttgacaaacataaaatggaagtaagttattacaccattagaagtaaattcgttggaaggagaaaaatatggtctatctaaaaattaaatttaaagtccagaaattatagaattgactagaataaataataaaaataatcattttagagcattatgaatgtttaagaagtaacttagtcaaatctaaaagtaa

SEQ ID NO: 34952 - DNA, 254 bp, Oryza sativa
cctgcaccccttctcaaattgccatcaacaggttagtgaattatataatatctctctaacacttgaatttaattatgtacctatcggggtgaatcctcccatcgaccaattgggaaaaaattggaaggttccctttaattttcttatttatatgtatcaaaccaagtgatttaaatgtcctcattctcccaatgtccttcttcgccctggcctaggggtaaaatttcactcctctaaaaccacccacatttagt

SEQ ID NO: 34953 - DNA, 253 bp, Oryza sativa
gtggaaaatgttagaatgatttacattgtgaaacggagggagtattagctagtcatcattggtctcttcaccgaccgaccggttgggtcaacctttctatgtacgctcttatacacgatgtcgtcattatgtgattaacacaagaacgcttgttcgtccttcgcttacaatgaaaacagaaactacaggacgcaggtgactagctctgcgtgtcgccatggtcgcgacaccatgttattttcattaccacaga

SEQ ID NO: 34954 - DNA, 1066 bp, Oryza sativa
  unsure (1)..(1066): unsure at all n locations
ggggttttaggggattttccttcgaaccaaatcatcgcggggttaaccttttaccccaaaaagggcacaaaagtgtaaatgagngtgttgtgtgtaagtgagcccgcttcttcggttggggtggattacgttgttttgtagggagggttgttacaataggccaatgcattttttttattgctggagctgaagcaacgaaacttcgagcccagaccaaagccttatggttttgaccccattccatatttctctcctctactcttggctagtcacggcaacgaaatcacgtcatctctcctctgctagtcgtcgcagtggaccttgctcccacctctctccaacccacaactttactcgagtggctgcccttatcatagcactgctagttctctaatattctgtgaaaaatgttaagcatattacgatgaatatattctgccaagaaaaatatgcatgaatatattacgatgcaaaaatatttatgtttgtaaaactacttttatgatatatgtaagttacttttatcatatatatatatatatatatatatatatatatatatatatatatatatatatatatatatatatatatatatattacttttagatttgactaagttacttcttaaacattcataatgctctaaaatgattatttttattatttattctagtcaattctataatttctggactttaaatttaatttttagatagaccatatttttctccttccaacgaatttacttctaatggtgtaataacttacttccattttatgtttgtcaaggttatggataccatatacctaatagtagttaactaaatctcggcaggacccaccacataccatgtcttatacggaaacaaccttcggatataggaggagttccgcataaggaaggatgaatagagttctacatggaaacgataaggactactcggattgtatccatattggtttctctagttctatttggacaagaggacacctatgggtataaatacaaggccccctaggaagagaggggacactgaacaatagatcaagacacaaaatgaac

SEQ ID NO: 34955 - DNA, 1501 bp, Oryza sativa
aatgaatgttaattcgtatttatatgccttgatgacctgcttctacagagatgggattaacccatgatgcatatgttctattgaataagaactgcatggtctattatgtttatttatgattaaatatgcttatttttcttcagagcaacatctaaccaactatgtataatctaagaaattgagacatatccctattgtttcaaatttcaaagagtgctatgttaatttccttttcttagattagtacattctaacctttatttgtctgcacataccaacaattcttcttgcattaatgtatagttcttaaattgacataagctttatattatgagtattacacattaaagaaagcatcttatatcagaccatactcaggcttttatgttaatttcttaaatgcaaattaatatggtgtttggttattcaaaagaaaatggaacaatgaaaacaaacgtggattttttcacaagaatttcttttttctatcgaagtgtcattgtcgtgctgttatgagaggaaatacttctctctgaatttattgatcatggcaaatggacatgtgaaattttcgtatgaatgaaacaacagaattatatttttattttacataccacctgtgatgctccacttgtgataatctagattttctatttattttatttttattctcacattgtcattgaaatgatattgtttttgatttacatatatgcacatgattcctcacttcacttccatgcccccaggtcgctacacccatcgccgccgttgccagtccggatgccccagtgaggctggtgccctcgaatgacaccacaagcaagtataatacttcatccattttcttaaacatgctctctatttgtaattcccactcatggaaaggctgctcaaggtcaagaaaatgtaacccgtgaagagactaatgcttctatagtcacacaaacctgtccaggaactaggataggtaccatgtttgtttccataaattgtggatataaactctgttaggtatcatgtttgttctgtagtaggtgctcgatggaatcccccagtgaggaaatttgttttttgttctgtaccagagaaaaggcagcgaggagatctgtgagtgaaaaaaaataacagttcaatgtccaggccactgttaacgatcaaatttggtaagccatgaactagattcggcatcgggatcgaagcggatttgatagggaattgtcttctggaaacagagtacgcatcggctacgagggcattggctgaagactgcatcggctaaatcagacagaagacagccgatgtagctgatctcgttaaggtggttatataatcgtctccgagattgatcaacgtgctgtgcaaggattaccatgattgagataagcacacggatagacaattgtatctattaattaggatattttaaaaagtttatttagacatatgcttcggcaagagtctatcgtgaagacttgttcgtatcttagagtttgttaga

SEQ ID NO: 34956 - DNA, 415 bp, Oryza sativa
gggtataagccaggactccacctaagacttcttctccaaagcttctcttatgaaggggggggggaagattgagcaagaatgagtacaaccacagtactcagcaagccacaccggcagatgcatgattaatgcaagggggtacaaggggtaataatataggggttaagttttgcagaaaacagcatttaaaagtcacttagttgcccaaatccattttataaagacgatcctagagttacacagtgttatttaatcaaggccgtgaaccctcacgaacctgccttaacccaaggcctacgatgattcagaccgaactgacaacccgaccctaggtcccagctcgtcccaagccaacccaggccaaccattccacattttagttgttaggcaggttttaagaattaaaacactaact

SEQ ID NO: 34957 - DNA, 1501 bp, Oryza sativa
caatgtgagaataaaaataaaataaatagaaaatctagattatcacaagtggagcatcacaggtggtatgtaaaataaaaatataattctgttgtttcattcatacgaaaatttcacatgtccatttgccatgatcaataaattcagagagaagtatttcctctcataacagcacgacaatgacacttcgatagaaaaaagaaattcttgtgaaaaaatccacgtttgttttcattgttccattttcttttgaataaccaaacaccatattaatttgcatttaagaaattaacataaaagcctgagtatggtctgatataagatgctttctttaatgtgtaatactcataatataaagcttatgtcaatttaagaactatacattaatgcaagaagaattgttggtatgtgcagacaaataaaggttagaatgtactaatctaagaaaaggaaattaacatagcactctttgaaatttgaaacaatagggatatgtctcaatttcttagattatacatagttggttagatgttgctctgaagaaaaataagcatatttaatcataaataaacataatagaccatgcagttcttattcaatagaacatatgcatcatgggttaatcccatctctgtagaagcaggtcatcaaggcatataaatacgaattaacattcattgacaaacgtaactaaactctgattttgcttggtgcctatgctttcttaccctgcaatgccatgatgtccctcttatctaccttgacaacgacaaaatccatttgttactccataaacaaaaataataaacaagatcatgataaaaaggaagatgatcaccaataaaccatcattgtaggcaatacatatgtcaattgtcaagtcagtgtgtagtaccatcacagttttagtcaattagcataacttccagtaaacagatgaacagaaattgtgcgacagcaaggtagtagtaaggtggctgctgctcctcgctggagtagccctgataccccgaaggagaatggtttggcaacaagaatctgaatcaatcagggagtcaagcaaaaacctgggtagcctcgtcatgggtaggatagccaccgccaggatcaccattgtatataaagatcagaaagttacctctatattggcctttgttagtgtcctcttctctcgaaagtaatgaaaaaatacataaagattttgttcatttaaattaactaataaaatgtgcattcaagggaaaacctattttctaaatatcatgccagcacgcgcatctacattcaaaggaaagcaacctaagccattgatcctgttcacttgtaaaatcttgacaaatagatattttaaatgaccatcagaatcatgacaagagctagctatatcgtttgaagatatattattttcgtaccaactatatcattttatgaattgggtctggatttttgaatttatcctagtgatcgaattgaaattttctgttttttgtgtgcatttaca

SEQ ID NO: 34958 - DNA, 396 bp, Oryza sativa
tctatgcgattaagtttatcatcactcaacgatttgtcattgacattatctatttctataatacatcggtaactgtattaattgctcattgggttggatactttttttaaaatatctaaaatactctgatggacgtaaaggtaccaattaatttatctcattcgaggtttaaaaaagtataaaagtttttagttggcctccgtatacaacattcaaattcttaagattcgtatataagtttcaagtttttttaattatatttttaaaatataacttatcatatgccatataaaataggttttttttgttgctgtttttaatgcaaattattttcatatgctacataagatatcttttgctattatgatatcttcaatttgccctcggggtattagc

SEQ ID NO: 34959 - DNA, 297 bp, Oryza sativa
gcgtgaaccgccgccgtgcgcccggtccaccgaaaccctagcccgctgacgcaataaatccctttttccttttcaaaaataattcattattgcgtcataattcaattaaaatcaatataagtgttttaatccgattaaatcttcaaaaattcataactaattcatcttagctcggatttagttggttcaagtctgtaaatttttctaaaattgagatctacatattaaaaatatccacatgtaccgttcatgcttgtttatgtgctgttttggtgattttgctcttttctgcttaga

SEQ ID NO: 34960 - DNA, 1048 bp, Oryza sativa
tcccccaaatagtgagataggtggacttttatcccatcccccaaccagaagccatcaaacaaggaaaatttattttaaagtgagatacaaaatgatgaaaaatatgattgaattatttacagtggatataattttattttaatttttgaggttttaaagtctttttttaattcccgttgcaacgcacgggcattcagctagttctgtatgaaatctgtagttatcaacctgaaactgtaagaaaaaaaatatgctgctccgttactgtgtcaatttacatatttacacttagtcactactgtgaacacataaatgataaaacaatagtgttaaatgcacaagaaaaaaattaagattttgcaatccatctccttaattatgttgtatacatctaaacagtttacgctttccactaattgttcacataacagatttgcaatttattattgattctgactattatcttgactggtaggggaaacattaaaatgcattttaccactggcatttactaaggatattaaacttcggtaatcagtgcaagaacttcactgtcctttgctaagtctattggcttatgttgatatgaaaggttaacaaatattgtctctggggcagggacatcaaaccatttgtttgttctaacacaaagaacaacatggactgttccgtttgtgtataaaggcatcataagtgtatgctttttcacggaaactaatagttattacctaaagaaaattcaaacaatctaattatcgccaagagcaatatcaagatgtccagggtgaaggatcatcaaatcgaattttgcttatccaattgaaactaaggacctaatcatcagcagtgtagagctgattatttagcattggaacttaatgatttaattgtccattagtgtcagatgttagaacatgctttttggcaatggtgatactaaaagagctacactaagaacaatgatttatagttttatgttggttccttttatgttttcctgtaaataaaattgaattttctggttgaatttaactctagcacctatttc

SEQ ID NO: 34961 - DNA, 1501 bp, Oryza sativa
ttagtgagtaatctatgccactggtctttgtttgacagcgtgttaagatggtgtactgtgtatatttttaatggtgtgtgtatgtatatattctgtgtaatagaaaaaaaaactctgtagtcctaaatcctaatacttggatcgaaatgatcaaacgaaaaaaatgtgggataagatttaaatcctacataaaatccttcattctctaaaatctatcaaaaaaataatcccccctctcccccgttagacctaagcatatatgagatgtgaagaacatcactcttctaatcaagcataatctcaaagtttaattatcaagtccttgttgtagaaaaaaaagtgttatgtttgttatgttgactatacgattgctacgcactgaaaatacacattagtgcactaatcgtgatcttatctcatgtttaccttgcagttgtagtgcatcaagatgttttatattttttatgctcgcacacattttttttaactttctacaccataagttttaaaaactactattaactcgaagttttaatattgaccatgccatccttgataataggggtggacaaaataaatcgagaaacccaagaaaacaataaaacaagatcgaatatgaaaaacttgaattcttagttgtcgattctttggttagtggtagcttcgtgaagatcaattttgccatagtctttttgctcaggtacctaaactactcaatctatctaaactcaccagtttcggcgatccttcgatatcactaatctagcattccaccaactcaaatctcttacttctaaccctagccgcctaacggcagtggctaccaacccatcagatctgctagtcacatcattgctccacttcaccatcttgtcatgtcttcctccacgcttctgcttgcacttatctctatgtcaagccgtcacattttccagactccacactgccaccttgtgcaactatcaacaccattgcctattgccgcaccacgctatctgtggctctatactatcatccgcgttatttcctgtgcataaatttagtttacttagttagacctcggttaaccaaacagctgatctacacatttttttgcaacaaagattggtttttctaattttaaaaaccaaaatttaaaatactaaaaaatattaatcacgcgcccatccataatttgtagctggcagaataatattattgtgtaagtttatagtgttgtggtaaataaagacttgtcattgtcacccatataaacaatgttaccatagagcacttattatttctagaatttttagttgaaaactaataataaggtttaaagattaaaaagaaatccccaagagttgaacaaatttgccctcttcatttttcctcgacggcccagctccctcgaccaaacagaccagtagggttttaggaggcaacacgccgccctgcgccgccgccgccgccgccgccaccgccaccgccaccgccagattctcctaagcggcgatggcca

SEQ ID NO: 34962 - DNA, 1501 bp, Oryza sativa
ttgtttcacaaacctataaatttagtgtattcgtttatcctagaactacacatttaggccccgttctaaagtggcaggttaatgtgctactacctactattcagactgctaccaattcagctcagcccagccaagtctgcactttagaacggagccttagtatcttcatttatcacaaaactacagattttaacattgctaaaacctgtagttttgtgataatgaggacactaaaactgtagtatgataaatgaagatattaaatctatagttttttgaaacaagattttaaatctatagttttgtaatatattgtgcaaagtactgtagttttgtgataaacgaagacactaaatatgtagttttgtgatatatggtgcatagtactgtagttttatgaaattcactctaaatctttataggaagaaaataatcgatgaagaaaaaaataaataaaaggaaagagaaaaaaacggacggtgtctcattgaccttgtagtcgtcgcttgctccgcctatagcgccaatcaccgttgtcgctatagtgtctccaccatcaaatcgtaaggcactgctagatgtgatggctacactccaattgccactagatacggccaaaaaagggagaagacgagatcaaagaatgaggataggagcctggtgacgaaaagtgtggagcacattgaaagccactcgtcacaattatcgtcaaatcttcacccaacccctcgtgagctttactctcatagtcatatgtccaaatatgtcaaattgctctacgctcagccctgtttttttttccaactccaaacttcaacttcccaattttccttagcacatttttcaaatagttaaatggtaagctatttcataagtcttctatatactccctccgtcctataatataagagattttagagagatgtgacatatcctagtacaatgtatctaaacatgctctctatctagattcgtttaaatatgatgtcacatctctctaaaatcccttatattatgtaacggagggagtagaagtgttatttcaaaaattcaaataaatctatttctcaaatttataatagttgatatttaattaatcatgtattaataaactttctagtttcacctctgctagtaatctccctccaacagaaggaaacgaagacgtggaatgagtacggagtgaatcaaaactcagtgacacgtgtgtgatgaggcaaaaggacatgaaaagaatttctctaggtaaaaacacagggcacgtcgggaattttcccgcagataataatacttcagcgcctacaccccataagctgttggctttgatgatgccgcctacaccccataagctgttggctttgatgatgcgcatggttgtttgcaagcaggattagattggcaaagaccttttggagccagggccagttagacaacttccctggtaaccacaagaaaactggacaacaaatcacaaaaccagaaatttcttgaagaaataacg

SEQ ID NO: 34963 - DNA, 182 bp, Oryza sativa
aattcctgcagccctattataatatatagtatatgaattgattttggactaacactcttgtgtaaattatatttctactcacgacacctagctttgtttgtggacttttcaatggatttcctaatttttaatgtttgtgttctagctggattgctcatcagaactctttatgtttaaatagg

SEQ ID NO: 34964 - DNA, 308 bp, Oryza sativa
ggtaagcgaataagccgcggacatgtgggccatggtcgcggcggagccccacatgtccacgtctcagcgcgtccacatctcaactctcaggcagcaaaagtgaagaagcgagcgagttgattgggcctttcgagacggagacgccgcctgcctaatctcctcgactcgatctttccttcccaggaggcggaggagggaggaggaagaggagctatcgcctctctcgctgacgcccgcaccacgacacggcgatagagacagaggtgggagatcggagatgaggaagctggtcccctcgccgtccctgc

SEQ ID NO: 34965 - DNA, 237 bp, Oryza sativa
tctaccacaacctccactcccacgcggatcgtgatctcctctgtgtctctctcccatcgctaatcgcacaccttcccttatctctcttagccaccaagtgttccccttactcttgtccataccaccctcaatctccacctatgcactcgtcttcgcgtcgcccctaatacgcgctgttgcaacacctaaatctgtggcgccgctctcttttgtgccgccctgatccgcgttgctaga

SEQ ID NO: 34966 - DNA, 224 bp, Oryza sativa
actactgcggctcctactgccgctccaactgcgtcaacagctgaaccaaatattatatgcgaattctccccctgaattagaagcttgttgctatggctccatgtagataaataagcgaatgctagctgcatgcgcgcttgtgcttgcatatggtggatgtatgcccctactatgtacaacttcatatatatatgtgaaagttgcatgtgtcttctgtcgaaaaa

SEQ ID NO: 34967 - DNA, 363 bp, Oryza sativa
agttgttaagcaaattttaagaagtaaaccactaacttgggtacattgttaggcttgcccataaccgggggcgcggctattcgaatagatttactctgatcagaggtgtacatctttaccttcaagacacatcttcctcacgagtaaccacgtgccacataccaccacggcatacggacgaaagacgtgacatagttcccaacccatcctagccataaacaagagtaccgacccaaccccacttacggccggaacttctgggataggcaggcaggattgagcccctagcagttggacaccagccctgtgccatgacatctcgactaccgggccgtagctcgtgtagccttcatttgtcctaga

SEQ ID NO: 34968 - DNA, 261 bp, Oryza sativa
tttctttatcatgccttttttcggcctttcagaactttccttgtagtaagtgcatgctttgcatttggtgatttaatcatgtaatggatgtgtgcatcataggtcatgcatcatagcatgcatgttgaataataataataataataataataataatatatgctatagtttcttataaccaggccggtcagtctttatgtatgaaaacgtatgtggtctctgtaggagaaccatctgaacctaaaatttttttctgacagg

SEQ ID NO: 34969 - DNA, 1501 bp, Oryza sativa
tgccatggtcagaggcggagcggcggtgcaacatctagtagcaccgacaccggcattcgttggcatcaggccgtgaccggcgtccgacaatcatagctccatgttacgtgtcgacgaaactcggctcggcatacaggccggcatggcggacggctatcggcggcgggcgctcacggcggcttcgaccctcgtcccggccgcgtgcggtagcgcgggaggcatgccgtgcgtaccggcggcgaggggaggcaggcgtaagctcctcggcatcgctacgggcgacggccgtcaattgcgttgcagatggcctcgaaaggccgtcgagtcggcgtttcagatggcgtatcgatgagtgaaagtctctggattgattcggcaaccattgacaaaggggaagacgtcatgcggtggcatctgggtgtcgctacgtgcaggcggcggcggcggcgcatgcaggtgccgatgactcggatttgttaccatctacttcatacagatagcaatatgacggattattaacatacaagttacaatcaacagtgtcccaagcgtgctgatccataagatcggcgatgacgagtgtgttaatatattcatagatcaacgactgtgttagccagatagacgacaacttctaggtgatgtcgtatgttaccgagtgtgaggtgtcgtcgttcgggacatcactccgtcgttcaattcaacggattatgtatgtgcaccttcttgtgtacacggtaagcgcgttcaggcgcgtggtgtcaaacttcgtggtcggtgatataacaagagaagagtcggcacaaaggccggacaaatacatctattcatgcgagaaaataaaacgactagaggcatgatctagcatattactctcgctactgcaaagtattagaatagatgaaatcaataacttatcttatttgacccatgtaaagtaagccggtccgcatatgcatctgcatagcgtataccagcactggcagggtgacgggcttgtggaagatctctgtggagattatgggtatcccatatctacacggcgatggtattcgaactgggtacaggatacctaatgtagatagaatatcttatctgtatcttgggttagtttcttaacttgtgtatcaaggaaataccctgaaacttagtcggttacgactgtattttacctgtatcttcatattctgttaggaatatagattatcttttgtaacccggactccttcccatatataaggggggtccgggcgcctctaggggcatatgctgatttttcccgaatcatacaatcaataatacactcggcggattcatccccggacaggagtagggtattacttcttatataagaaggcctgaacctgtataaatcctttgtctccaaacccatacacttttctagcttgatagccacccccttttattattgccgaaatctagtttcgacagttggcgcgccaggtaggggtagcgtcaagcttttcgccgatcagtgcaa

SEQ ID NO: 34970 - DNA, 1501 bp, Oryza sativa
atgtgcgtgcaaatgcacatgttgatagtaatacaacttcttgtgtatcaattctaacaactaaacatgttgcatctaggccaaaattgcttcaaatgcaaatgaccaatttactcaaaataatttacatacatccataaaaacaatacttcatttgtaaagtcatttatacgtggaagatggacataacattatcaatcaaatgaactatagacactgcataggtatatagtctttttgatagataattttggtgcagggcatattggcatatagacttctcgtctagatattcgcaaattcgatgacattgcatctacttggacacaattaatataaattagctgtagcttatcttctatgatagtcctgcactaatatatatctctaagtcaataatatactctcttcatgatgagtgtatacatttattctatacagagaatatataattgtgccttctacaaatgtggcgacaattagacaaagagaagatatatgaatattctattactcatttgcccaataaatgtatttgctacatgcaactacttacatgatgtccttttatgcaactttctaccggtttacttctagtaagtaaagtgcacaaaacgagtacaaaatagtaaataatggttttctatacacaccttttattacaatcctagcaattaacatgattttctgctattcaaaggtatgtgtaatttacagaactactaacccacagaacaatcaattaccccaaacaaacaattgccaggaaataaaccataaaatatgatgcttccaaaagggtgctaaaacaaaggttttacaagttcatggaagctctttttcctaaaaacaatgtttctaggattgattatggttattcaagaaactaactaaatagttaaagcaactaattagaaatacgggactaaggtataaatccttaatacttctctatttggcgtaaacccaattcatgaatgttcaaagtataaatggcgaatgtatattccccgtagtttctaatgtcccataggacttttccgcataatttccgagttccgcataatgccttggaaaccaaggactgttgaaataaaatgccgttttcggaccaaaatcacggttcgtgcccgactccttttaataggccaatttctacttggcccacctccttatactagctagcttgaaaatctggccaacccatctcatatgttgcccaatgggctattacgaccttctcccacaagaagtgggtgaggtatgatccagttgccatccttcaatggagacgacggatggaaccaatggcaaacgtgctagtgagccctcggtagagatggacgactatggcaagttgccatggtcagaggcggagcggcggtgcaacatctagtagcaccgacaccggcattcgttggcatcaggccgtgaccggcgtccgacaatcatagctccatgttacgtgtcgacgaaactcggctcggcatacaggccggca

SEQ ID NO: 34971 - DNA, 544 bp, Oryza sativa
agaaagaagaatggatcccctctcccttgcactagcctgccaacatggccatcttgtggcagcacaagaggactagcgtctcgattaggacccgttgtaggcctacaacacccacctcgcggtgccaccgtcgtcgccgcctaagccaggctacccacgtcgccataagccgcctgtccgcatcaccgccgcatcatccgtcttgctgccaccaaagctctagccagcacgccatgccatggcacggatgccatcccccgcatcagcctccacgccgtcagttgagctaacctccttgacgttgcccgcaccgaccactcgcaactctgattgctcatcgtgctagcctcccacagttccgccgccatcaggcttgccaccgtacacagcgtcaccctacccgcgtagctgcgcgcctctgcgatgcgccagccctcagccggaagcagccaagtcggcagaaaaccgtcgccactatgctcccagctcctcccatcctgtcgccacctccatcttcctcatctttgtcggtaccatgcgggca

SEQ ID NO: 34972 - DNA, 272 bp, Oryza sativa
aatatacctatatatatatatatatatatatatatatatatatatataacgtgccatttaactaaatggcactcctcacaccacccaaccacacccactatttgcatggataaaatttttacccctacactaactctcccactcacacatcctgctcatcttcctataagtaatgtttttaatgatacacgtctatttatattagttgctagtgctgatcaatcattccctattctctctctcattcctcatcctaatttttcggatctagc

SEQ ID NO: 34973 - DNA, 1501 bp, Oryza sativa
ggaaagactggcggtcgaagcgcggggacgagtgatgggtagaggagcatagggacgtgcggtggacagcggcgtgcggtgatcgcgcggtccatcacaaccaggaggcagtgccgattgcggcggtgatgatgaggaggaggagcccgcgacagcgccgcgcggtagaagctcgaagacaacgacgctctcgagcgagcgatggcgctcaccggctcatgcggctcccagacggtgtgacgggattgcgcgagatttcgccacccgcccgcacgcagccaagccaccatcagcttgctgcttgccgcccaccgcgctcccgattggccttcgcctccgtcgccgaccaccgccgccctcggcccccctttgccacccccaactggctctgccccctgcgtgccgccatcctcagcttgccgctgccggtggggatggaggggaggggagggagaagagagatagatttggaaagagagagaagagagagacagagagggtgaaaactgacatgtggggcccaccattttttaaaaaatgctgactggactgctacgtaggatcaaaaccaccgcggattgagtcggtgggttatttgtccggtttgtatagtttggggtgaaaatgtctggttttgtggtttaagggtgtaattcgatcgacttttatagttaaggggggtaattcatactttttccttcttttttaaaaaaaatgctgactagagtgccacgtattgatagttgagggcgaaatatatttggtttttggattttaggggtaattcatactcacctaatagtttagggggtgtgattcagatctatctttttttattactatgtgtgaaaagagtaaaaaataaattattttggaacggaaggagcaagccagcaacgtctcttgttgagtctcacgtggtatagacccacgctttgaccacaaatatcagagcaggtacaatagcggaatataagctagctataaacatatttcgagaagataaaagatgagagagaaaagcaacaggctacatatttgtagccagctgcagcacggattttaagatatatgtgtgacaggtaagaccagatattaattgtgtagtatatgtttataggtaactattgtatgaattggctattaaattgactagatgttttggacccgacagctggctattcgataaatgtcttttctcatacggaacagaaaagccctaggagtacaaggcaacaagtaccactcaaatatataaagtaatttttgttactagcaatacccatttaaggaagctcacatcaataatggcttgagagttgagacgaagtacctacaatctcgcacttgtccacactaggacaggagtactagcagtagtccccactcacacagtcacacacatccgccccccattttcctttcctcctcctcggttccttcctcctcacacttcaccaaaaccccaaccaaaccaattttccgcagccgcaatggccgg

SEQ ID NO: 34974 - DNA, 1501 bp, Oryza sativa
ccggcgccgtcgcctcctcgctcatcaccgcgttgactaggtctgccttgctcatcttcttctctgtttgggaacagaggaagacagctccacagccgctggttttgctttctcgatctgaacgccactgagagccatctatgccttcgttcttcccgtgtgtatacatgtgattcaacacagtggagtaaaaaattttattacgtgtaaccctttttatacatgtgatgtgattcactatacatgtagactgaaaaatatgtaatgcaaaccacatatacaataaaagcctggaaactgttattgaatcgaaaaatagatatatgagattcgtccacgtcactatgagtaaaagtttaactgccaataaaaattttactcatgagtaaatttgcgagtaaaatttttactcatgataacatagacaaatcttaaatgtctatttttcaagctaatagtagtttttagatttccactacacatataatttacaccacatattttccctcctataacagttgacagtggagtaaaaacataactactgtttttaatggttcaattctatcatactacgtcgtggtcaatagacctctctgtactcatgtctatcagtaaaaaaataactattgatatttcatctgtgtaagtttttgacccggtgagattttgatttttaatagtaataaagtccgtggtaaaaaaaaactgctatccacgtattgcaataattgaaattttatatacatatattcacttgtatatataatcatgggatatgtgtattttttctcctccttgtatgttatgtagtttcttacccgggagattttttttaatgattgatatggatgagtgaatgtaaaaataatatgcatcataatcttgattgtatgtgttaatatgcacgtaaaaggaacatgatactcgtattttaatgactgaacatttttacacacatttttcaatatggaatgattaagcaaatttattactaacaaaaataactacaaaaattgatgtaataaaaatattactgcaaacaaattgagagtaatgcaaaagatttacaggagtgaaaaatttactatactcctactattatcgagccctgactttgctcagtaattacgggagtaaaaattttactccatgcaaagatagacatgatttttttactctagtaacttttttactcagtaattttttttacttatggtgggaaccgatattgaaggccacgtggagacaagaagaaggaagtactttggcacgtcagcgaggaaaaaccaaaaaaaccggaaatgcggtgctctgtgaggtagccggtaattttttaactcgagataggagaggggtgggaacaaaacagaggaaagagataggaggtggactagtagaaaacgcaaaaccaagaggaggagcgctactaattccgtagcgcgtctgtggcgctgtgtgtgtgtgtatagatagatagatagacagacagacagacaga

SEQ ID NO: 34975 - DNA, 1501 bp, Oryza sativa
agggcgcgcgcatgcggctgctgcgggcggactgggccggcttgggccgggaagagagagagaaggttttgggccgactttcggcccaaggccaaaagaggattttaaaaacctttttcaatttaaattattcatgaaatgcaattccatttatttaaaatacttccttagctcaaataaatcccagaaaaatctaggaattatagaattaagcaaagtatttaatgaaattttatctggccccattttatattggaatttattaattaaaactagatcttctcttctaggcttttaaaataaattctaataattccaatttagacaacaatttatatatttgggatttttagggtgtgacaactactagggcggcactcaccatatggggggtcgcggccaagtagagtagcaatggttcctctggtcacggggctaccaagatggggggggaagtgaggtaagctttcagctgattgagagcttgctcagcttcctccgtccatataaatggcccggagcgcttgaggagcttgaataggggcagcgccctctcacccagcctcgatataaatcgactcagggcggccatgcatccagcgacgcactgcacatccctaagcttgctagggggggtgcatcctctctatcgcacgtatcttctcaggatttgcttctatgcctcgggaagagactagaaaactgagaagtttgcccgccggcacaccgaacacacacttatcggggttcagctttacgcgcgtggacctaagactatcgaaagtttcggccaggtcttgtagcaacgtgtcctggtggcgcgtctttaccactagatcatcgacatacgcctctacattgcgccctatctgattacttaaagtaatacgagtcatgcgctgaaaagtagggcctgcattcttcaacccaaaaggcatagttgtgcaacaaaaggtgcccacaggagtaataaaggcggttttttcctcatcttccctagccatacgaatctgatggtacccagagtatgcatctagaaaacacaaaagttcgcaccccgcagtggagtcaactatttgatctatgcgtggcagagggaagggatctttggggcatgccttgttgaggtcggtgtagtccatgcacatccgtagcttgccgttggccttcgggacgaccaccgggtttgccagccactccggatggattacctcgcgaatgaaatcagcctccaggagccgcgccacttcctccctgatgaaggcctgccgctccggggcttgatgccgcaccttctgccggacaggttgcgcatccggccgcacggcaaggcagtgctcgatcacctcctgtcacgtcctgataaattcatcccgaaataaaaatcatcctctaaaaagaataatagaattaattaaaattcgaaaagaaattggcaaacactaaaatacgtgccagaaaaattcgaatgtggtccagagaatttttgttaaattctcct

SEQ ID NO: 34976 - DNA, 174 bp, Oryza sativa
tatttcccccactcactccgcaagaaacggcgccggtttgacctccccacgagctccacttcgcctcctcacgtcgccggccgatcccgtctctcccagccacgatctccatccccgagccctatataaagcaccctcgtgctctcgtcttccgtttccccctcctccccgagc

SEQ ID NO: 34977 - DNA, 1501 bp, Oryza sativa
tcatcatatcaatatacatccggtggatacaatccttaaacatgagtatggtattacctctcattgagaggacctcaacctgtctaaatccttgttttcgcatccatccaattttacatcttgtgtgctacccttttttattattgtcgatttccagaatcaataatatgcttcagtggggaggcagcccatgcatattttcactaactagccaccaatctgtgttgagttgcctcgacacagttagcgaaccaaatttggatatgcatgtatagatggccaaatagaccgcttggctcggcacaacccaagtacgaccgggcccgggtctaggtcagtcgggctagcaaggccccacctacacgacgggccaggaagtgcctaccactggctgcaccaatgacccaggcacggctcaataagacttgggacgtgctgggccggcccgaaggcacaatagcccgttgtgcttctctgtataataattttatttttccttcctcatatctttgggttgtgtctaacatagcaagaataagtctattttgcatccttgtctttgggacatgcctcatatgcctaaattaagtatattttggatccctcaattatttttctttgaccgtgtcgtgccaggccagtccactctgccaaggcatcggcccagtgtcacgcccagaaatttagtcctaaatttccagactattttgtgtattaaatccctgtccaggactagccagggtacacaaaacgacaagtaataaacagatccaaacgtaaataaagcgtaaaatactcacagaagaggcacttagtcctcacatcgaaagagaacgacagcagcggaaaaagacgatcctagcgaggcttcagctccactccacaggcaaaactcaactggggtatgagccttggtcctctaacttcgtcttcagctcagaagcactacacttctgaaaagggggaataatagcaaggctgagtacaaccaccatactcagcaagccacaccaatgatgcagacgtgcaaggggaacacaaggacagtttgtggctatttgcataaaggtggttgtaaaacattttattaagcaaaacagtaaaacagttgagtgattaaagtaacattaaatctccactgatcaacgctacactacgttgaacatgcccaaccaacccacctgaactacagtgcattgagtcgatttattaagggtgagactaatcacggtgaatctggtcgatcgcccataaccgcggacacggctattcgaatagttttactttggccagaggtgcacaactgtacccacaagacataatccaccggcatgtcaccgcgtcatcatgcgcccatgatgaacacatcaccatgtcgagtgattttgacaagacccttcatataaccctcccctaactatccacaccacgctaaggtttcaccctcactcctcgcaaggcagcgggcagtcccctcgtgcgccgcggtgaatccggcagc

SEQ ID NO: 34978 - DNA, 474 bp, Oryza sativa
ggggcgccagagtggctggcgccgtcaatccaaagtctggcgccctcctcctgccacgtcggttcacgtgcgccacggtggcaggaggacggcgccagacattggatgacggcgccagccactctggcgccccaaaaaggaccatttctgggataagttttttcaggggtctatttgcgaaataagttttttaaaaggaccaaaatgtgaaaaatccaggtaaaaagggcacactgattttcatttcatttcatcattttataggcttacaatgcagttttctctttcctctttactttcttcaataaaaagaaggaaaaatggaaagatgaggtgattacataagcaagttatttgactagtttaataatgtagatcatcatttgtcatttgtgccggaaataggcatgttcaggatggatagtcgggacttgggtgtattgaaaaggcaaaattatcgtcaaggcctcgccc

SEQ ID NO: 34979 - DNA, 1501 bp, Oryza sativa
tcccttttggatgcttttttatgtgattctgaaaacaaaaaagcttggaatctttgatgtgctctcaagctctttgcccaaatgatggctgctagagcttgcagtggcaacatagcttttgctttgtttgcttcccctcacttcccgttacagttcttgtcagctttttccccttccttgagagttgaacatttaagcaaattattcttcctttctcatgctagtataatttgctggtcaaaacattgttggttctttgataatgtttttcagatgaacacctcttaatggtttttaaaaaatatttcttatttacacctttttttcttggggtttttttaaatgttcatgtctaaccattaagcagcacaatatttgagttacgcagtggcttcgtcttaacctgctatacttcttgattatcatttctgccgggctgtaatggaatagatgcttgttctgttgacagtgtattgggacttcagattttgagtgacatgagtgtatttacggttttctatctggctatagtttgctaaattattttcacaaaacaaaaaagaggtgtgttcgcaaggttagcatactatactatatctctgtcacatcataatcttgaataaatccaattgtcttctagtggcatgttccaatcgtcatagttatttagcgatcttatgctgctcaatttcttctattaaaatttctagtcttttgtttgtgaatgcatatatagtcgattagagacaacacttttttccatttagcaagcttattatctttataaaaaaaaaccatgcatattgaagcacctctctgttgctggacaaatgttttaagctcttttactacaactagtgcagatatcttttattaaaaaaaaatgccaacaagatattgaacattgtgtttccagactcaagaggtacactgtttttctaagcagagagaagcaccttgctgtgtagcgttttacttatttagtctatgtttcatcttgttgaaaattttcaggtttaacattttgttagatagcaataagctgttgtctttatcaacatatagcggtgtacacaagttattacatgttagggctaatatagatcagttgagattgaccgtatacatcatgcttaggtttcaaatatctgttctgatgaagaaaactctgacaaatgattctgaaggataaatgatggaggatatttggtagtcaaagtattcaatgcagatgtttttttttctttgccataagcccataacaagaaaatacactaaatatatgaccttccttcttacttgtaaagaattagaagctgaatcatgtttgtttattgatgtttccgaatcaattggacattgccttctggggtgccaagttgaaagttcatctcttcacgtacttcttacatagggatgctcagttggaataatagctggcattcaagttcaacagaaaatagaacaatggagagggaaattgtggcctcatatgaaccca

SEQ ID NO: 34980 - DNA, 1501 bp, Oryza sativa
gagcacggcgccgacgccgacgccgaggacgtcaacggcctcacccctcgcgccgtcgccgagcagggcggccacgccgacatgcagctcgcgttcgcgtcggcgacgcgccacgagccgcgcaaggctcggccgccaccgccggcgtcggcgatcgtgccggtgccgctccgcgacggcgtggactcctcgccgtcgtcgtcgtctcggcgagggcgcacgtcctccacctccgccgcctccgcgcgcagcacgccgcagcggatggccaacttccgcaactccctcttcggcgtcatctcctcgtcacacgcgttccatcacgaaggcggatacaggggcggcggcggaggcggcggcgccgccgccgagagggagaggtcgtcgagctcgccgccgctggtgagggtggccatctcctgcccggagtcgcgaggcgggaaggatcacagcagcaagctggtgttcatgccggagacgctgcgtggtctcctcgagctcggcgcggcgaggttcggggtgtcgccgacgagggtggtgacgagcggcggcgccgacgtcgacgacgcgcggctcgtcagggacggcgaccacctcctcctcgtcactgacaagtgggtcccacccgaaaatcgtagtaggaatcaatagccgccgtccgatccaacactcgcggcccagatggaggcccgagaagatgtatcgatgtaacaatagggaaattagcagaaaggacccagagaaagttgtatattaatagtggggtaaaatgggatcggagaagaaatctccgaatccccttgtgagcattttctgactgttagatcaacatccgacggtgcataccacgagagctggttcagttgtacaagaaatactacaaattctccattagcattccaaacaaattcttaattaattttatatataaatgagtcgtttgggaaagaatttttgaaggaatagaaatgtgagtacggaaattcctcaatttagcattgtcatatggattatggccggtcaaattaggttgttacaacaataatgtcactattcgatcagattaagattacggaagctaaattagttacaaggtgaaaatgacacatcagcatattttccggctagagcaaaggcatttggtgacgaacccttcctaaccaaggtgacctcaaacactcttaacactttgacacaaacatcttaaaaaggattaattggttacggtggttacgctgccatgaccaacttctgatctaccaattcaattcgacacgtcaaccattctcccatcccccctatataaacgaattcatagcgcattacaatcttcatcatcaaacagtaacaatttcgagttagagtgagacgtgactgttgacgttttttttttatcaacgcaagatcaccggacgatttacggtgcaatcaattacaccgcaaaacagtgacatggagctcaacaaggcggtggccgtggcggcggcggcgatggtcgccg

SEQ ID NO: 34981 - DNA, 1501 bp, Oryza sativa
accatagaagttcaagaaaactaaacaaacaccactgaagacaccaaataatgtctactataatattactcagctcatgacttcccacaaaagaatggaatttcagtacaaccaataatccaagccactggtacacaatggcaccaatccgtacacaaattctcctatacaaatcaaaacaacagcacatacacagatacactcaaacacgccacaaaaattatagcaaaataacacaaactaatttaatcgattggtcaatcaaccaacagccaaatgaataatctgatgatgagaagttgaggctttcagaacagcatggcagctagcagcagcagaaacgcaggaaaaccggcattggtggcgaccctccgtgcagagctgggcaccacctgcggcctcgtctgcgtctggctcgtcgccggcggcgtggccgtcgccgtcggcgatccggcaccggccgtcgactccggcggacttggcgctgtaaatttgacaaaataaagaaaatgatagatagtttagttcccatcaccagtaaaaattctgacaaattttgggctgtttggcatgtgttgcagatgaagttagagcggattcaggctaaatatttcttacgcagtggtggcatggccggagaaactgcaacgggtactcctgcagctggaatctgagctgatgtatctgaaaataaaaacaatattgataaattaaccgtatcttataaaccatttaaaagacacaaatattagagaatgacctaatatcaaataattagaaggggtgaggcttcaaacccaggtcatctagccgatcaccttgtggagctagctggaagactcctgagcgtttctctatcctataaacttttaaaatacacatctggctcgtttggaacatagggttctataagataacctttctcgcgcaaaacaacaatttgttttcttttaaatgccacattttaaatttaacctttctcgcgcatatattattacttatatactatctttgtcattaatcttttgcctaaatttttttgttctaacaacaaatatgaaaaaccggagatgaagtttattacctttgcattggaggggaacagacatggagttgcaggctttaggcaatgtaacggctagcgtccggttgatggggatgccgaggggcacgttgccggtgaggacgaggcaggcgcagctggcgctcgtgttgatcatcgccgccaccgactggcagcactccgccgtcggcgcgccgccgccggcggccgtgccgttgccgccgccgccgccgctgctgctggtgatgaagttgaagcacggcgtgaagctggtgatcagcgacgccgtgcacgacgccgccaccgcctgccccgacgccggcgccgccaccattgccaccacggcgaccatcgccgccgccgccacggccaccgccttgttgagctccatgtcactgttttgcggtgtaattgattgcaccgtaaatcgtccggtga

SEQ ID NO: 34982 - DNA, 1501 bp, Oryza sativa
gaggtcggagaggagggagccgggtagcacggtcgacggcgtcgaggtcggtgccaccctccccgaggcccggcggcggcggatctgccctccccgtgtgcccgagctccgcccggccgtgaccgtgccctagagccgccgcccgctcccgagcaccgcgcgcccacgctcgagagtcgccgccgcgcccgcacccgagaaccgccgcccgtgcctgagctcgccgctgccttcgctgtgcactccgtggagggagagaaggagctggaagaggaagaagagaatggggccggagcggcggtcgtatgcggcggtggccggagctatgccgacggcagccggcggtggtggagaggcgacgagctggcggcggtggagaagggagggaggagaggtgcagaagggagagaggcggactgggcggtgggaagggagaatggaaaagggataaggacggactgggcggtgggcgcgtagtggattttattcgcctcaaattttttttgtagcggtctttcttacctaccgccattcgctggcggacacttaagaggtccgcctaaaaaaatagagttttttttatggcggacctcttagcttggccgccagcaaaaatcggttttcgctggcagtccatggcctcccacccctcgatatgttttttctggcggttttcgcgtatggccgccagcgaaaataataggccaacgtcataaaaaattatttttctattagtgttacaaaatcacagtttgattaaaaactaataattaatccctcgaattttaaatataaattgcttttgtcaatggattaaacgactgatacatacttgcatcattgcatgaactttccatgtcatattcacatgatatacaaataattcggttacctatttaatttcgtacaatatattcataagattaataatttaataggttgtccattgaattgtccggcgtttaacaaaccacatccttttctctacttcctttctttttttttctaccctatcaaataacctgcgtgggatcatttcttaaagaccgatgactcaattctgtatccttatatttctcaattattttctaactataaatcttttatttttagaattttctagatacttttcacatttattttccttcttgcgtgagctcttcatgaagttgacaggcaaataaatatagctagtactgatgttggttaaagaaagagagcaagaatccaaaaaggagtactatcccattcagtttgcttgagaaacctgatcaactatgatatgagcattggatttagtggatcaaaatacttttaggtaaactagaggttttgtggggcaaaagctccaattaaaatcatgcatgtcattgatgttggagactagtggggtgtatgctgtgggaatatgccactgttcttgatgagcgcaaaaggacttcatttgatggaacaggtgtaggggaaaaggtagtaggtactactatattatacattcagg

SEQ ID NO: 34983 - DNA, 816 bp, Oryza sativa
cctatcttcgttatatgttaatttttaaatgtacgacattgttgatatttaattataatgtttaactatttaacttattaaaaatgtaaatatcatttattttgctatgacttattttgtcattgaatttattttaatcgtgacttatatttttacatttttacactaaattttcgaataagataatggtcaaacgcgcactgattgaatcaaaactgtttaatttcttttatgaaagtagtgtttcactaaacaaacagtatatattctcatctaacaataaaagaaaatcccgagagactacaaaatacagtaaattttgtcaccatatatggcacaatcggttgccctctagccctttaattaattagcatctttgttagtccttcttatgtttaaaaattaaaacgaccctctagctagcccttgactaagtctccgaacgagtctaatggcgacaaatatacgcgaggatttaacaaaaatattaattggtccaggttgggacgcaattcgaatcaaaactaaaaggaaaaatctatttggattgcgacagtgcaagtatgcgcattataaaatctgttcgctttcactgctgcaggaccgcgcacatgtacagttaagtcagcgttctcgatcatcatatatcgaagcaagatatgttcaaatctttggacaactgattattacgcatttcacaatctaacactgtcatgcagggaactagcgatgtatacatatatgtgtattaactataacattggaacgaaatttagccatatgtatgatataatttaattccttcttctttttaga

SEQ ID NO: 34984 - DNA, 853 bp, Oryza sativa
aagacattgttagacccgcccataaccgcgggcacggctattcgaatagttttactctgccagaggtgtaccactgtaccccaagacacagccccacaacatgtcaccatgtgcctcaataccaccacagtacctcggaaaggagctgtgacaatacccttcgcacaacacaatccaccacagggcacctttcctggatcataatcacccccttataaacaaggcatggactccccagcaacccccgtgggcttatctccgccacttctcagtctggtgctccgcaatgaaccatgctatacaaaaggtaaagccgttgcccacgctggcttgtggttggcacggttaatgtttcacaaccgaaactcgtgaaccggtccttaattgtcatgagcacgaccatcaaaaccatgtgctcacaacccaccattatcaggttttagttggcacattaattaattaactaatcacgattgaccatcgtgaactatcaataagccatcatgaaataatagtgaatcataagttattcccaatagtgaatcataagttatcccaatagagacttgaaccaactaaatcggagctaagatgaattagttatgaatttttaaagattaaatcggattaaaacacttatatcggtttaaattgaattatgacgcaataatgaattatttttgaaaaggaaaagaaggtttattgcgtcagcgggctagggtttcggtggaccgggcgcacgggcggcggttcacgcgaacggatcggcgagatcgatccaatccaaaacggacggccgagatcgaacggtccacgaccggctcacggcggacgaccccgatgacgtcagcga

SEQ ID NO: 34985 - DNA, 980 bp, Oryza sativa
gattgacctctagtccagattcattgtactttgagttttttttttacagagattttggatggatgggacacttcctgctccctatccagattcgtactactagaaagtatctcctccatctaaaatcccttacattctagaacggaaggagtacaatgccacagctagctagctatagctaccactaattccttctttttgcatgtataccattgatgtaattgagcatttggaataaattgaaatactacctccgttccaatataaatgtagttgtgggtttccgtgttcaacgttttgactattcgttttatttgaaaaaaaatatgattagtatttttattgttattagatgataaaatatgaatagtattttatatatgtatgtgactaattatttttttaataaaattttcaaataagacggacggtcaaacattacacacggaaattcacaaatgcatttatattgggacagaggtagtaattgtttagaaacagcccggataaattgtacggcaaattatatatttagttaatcgcgctaactgtaattaattaataatttgagtccaaagataactaactttttcctttagcccgccatcccatcttgtagtttaggatggaggaatttgaaaacaattgtatcatcctctttccttatagtgatcataaatcttatctgatcagtttgctagatgaatggtgatacatgccgtgacgaaaaatctagacatatactgttgacggaaaaaaatatgcagatactccaaaaaaaaaaagaaagatagccttgcgtgttggtcagcatggctaacccaattattccatgaaaattgacatatagtagcatgtaacatagtccatatgaactgaacttttgagaggggaagtagctcagcactttttacattttgactctttttaaaaacttatgttataaataaatctctaaacaaatttattttaataataga

SEQ ID NO: 34986 - DNA, 1501 bp, Oryza sativa
agaggttttgatcaaattttgcccgaattaatgttttcatatttacataaataaatttaatcagtttaagccattatttgatcccataaaattgcattataaattttcttatgcaaataaaatcatgtctagctaaatggaatgaacgagaaatttggctaaaatatttaagctattgcctttatcattttggcccaacggaagttacgatttaggattttttttttcattattcgggtactaatgtcaattttgattcattttggcctaatggtattatgaagtacaatttaatgctcatattaattttggtgacatatggacacttagcctcatttcttaccctatggtgagataaattgatatcttatgaaattatgcacgttaattgtcatttcatgttatatatggactatagattattcttccagtactcctatttttaaattcgaatttcattctttttaatagtatttctatttcttatgaaattatgcgcgttaattgtcatttcatgttctatatggactatatatagatccttcttagtattcctatttttaaattccgaatttcattctttctaatagtatttctatttggactctaaactcatctttcaatattccttattttttaattccgaatgtcagttctttttttaattgtattaaaaaataaaaaaaataggactattttctattaagttgtattatttatatatagagattaatctatccaacctaggaaatttttttccttgcaaaagatttgttctatgcgggtgtctgattgaacgagtttacagattgagaaagcacgcgtcaccactacgagactatgagtaaatatgcaaaagtattttttatctgtcctgattatcatttgttttatgataaacttacctattttaaatacagattttctttttgttattcacacaaattttcatcaatatgctcttgcgtgaaagtaacctaagccattcaccgtttgttcctcctatggtacaatcgtttgcgtgaaaataacgtgtcgggaacatagttcatatcatatacgtacacgtggaataatttgtaattatgattgtcatactatactgcttaaaaaattgttcagctaaaatttattcaatatgacattacccagtgtaacacacagacattttgctagtagatatagatatagatatagatgtatacaatgtgtacacggaaagattaggtgcttcccgctttctaactctgccccccgttggtcagcggcctcgctcctacagtagcggtacgtactatggaaggctggaagccccacacatgcgcgaaaaaagctgcccaagaaacactctcacctcacaaaagtgcccacgaagaagtggtcaaagcctcccgaggcgccgcgcgcataaaagtgagagtaccaacacactcggcgcgctcttgtacaccaattcacacacacattttggatctcgacacatctctgtgccccttgccac

SEQ ID NO: 34987 - DNA, 1323 bp, Oryza sativa
attatgggtaatttaatggttaaaatcaccttttacaagtattgtgttgctatatttggtataaagtttgaactctagaagttattatagtttggaatagagggagaagcaaagattccttgaagccagttccacctcattcttgtgtttttatgcttcaaagatggattcaactaccatacgatgcattcctctcccatccatccattacgatattgagctgcgtcgaacagcctatccagattcagaccaaacccaaatccacattatcatcctacggcgttagcctagcctagctagtctagtgctgcatttcactgatgttagaagtgctgtgcttagaatcgattccatcacaatacaggcattgatgctagaaggaaaaaaaaaatcaactgacgcatgtagttgcaccgaagccaagctattaaacaatgcaatgagttcattcgtcagccaacgattacgaatggacgacgactgtttttgcctttcgattccgtcaatagacttagctattccctcgttttcggaaacacacttctctactataaaccatatatagtttacaagaaatttctatataaccttgtcttttcttcactatatgaaagcaacgttggcagtatatccatcaaattgccctacttgtaaatctctctgaatatattagaccgaaattcatcaagaaatcaagacaccaaaaatgtaaaattcagcgtgcgattatacactttcgggacgcttggaacgtctcaggagtcagcgtgcgattttacacctttgtaaaattcagcgtgcgattttacacctttgggaatcttggaaagttcacgtcgaaacagatgttcaacatatctaaaaggaagatagtaaggttcggaaatgttccttgtaattcagagctcaaaatgtgtcctcaaaatgtgtccctttcaaaatgtccagaacctccaacattcaagttgaagaagtctttgcaaatacttggccgaagacttggcttaggtgtccaggggattcccattagaattgaagatggacttagctagtttggaaaatattcaagggattcttagtccttgccggagataacaaagttcaagaaaagagaagcatggacatgtccagttacctagctgtaggtggctggttcatccaggtcatttttgacaagtatctgtcctaccagcttcagagctgggcggccgactgcggcatcagccatgagatgaacagacttcgtgtcgcgctgcttcgcacgcagtctgtcctccatggggcagaggtaacaccttcactgtcttacggctccctcccatg

SEQ ID NO: 34988 - DNA, 501 bp, Oryza sativa
ttgatgccattttcaaccttaccaaattttggttaaaaaaagtggctacatttagtttgctaccaaattttggtaattatataagaagttgccaaaatttggtaaggttttttttttcatcaaagtgaacaggcacttggtattgtggtttgaggatattattcgaactcgacgtcaaactgagggacctgaagtgaacttattccaagaaggttacgttagtgggccgagcagggctgaattgtaaccgtaggcaaggcccagtcgagatgacaccaagtaaggcatgggccattggggtggcgcagcccaactcagaaatgggaccaaaccgacctatccaacggaacggcggattaaaacatactgacagcggtagcatccacaggcaggaagtctccccacccacgacgaccacccccatctccttcccctttctagggtttcgcttcgtctcccccaatggcggcggccaccacgtccggcgcggccccggcgcca

SEQ ID NO: 34989 - DNA, 1501 bp, Oryza sativa
tacaaacgggttatgtgaagacgagtctcacaaaacatatatcgcctaaattcttctatatgcatgaattgcaaaagaaagaagaaattaaggtgactctcaccaagactagtgaaaatctcacagatttatttactaagtctttgccaattagtgtttttgagaagcttgtgcatggcatcggtatgaggaggatgagagatgtgcacaaatcgggggagcacttccctgactgtgttccgttgatattgatcatgcagatcagtacatcattcttgaagaatgatagagttatccttgaagaatgatagagttatccagtagattagcttatggttgtactctttttccctttagtgagttttgtttgaagtttctcacatttaggtttttaatgaggcaacagtgcaatataagtagcgtgtactatgtactctttctcctattcatttttctcccactgggtttttggaaggagttttgatgaggcatatgtatagcacggtattcacccaagggggagtgttatgaaactgatctcccgaaggagtcggatttataggaccgtgatcatgaggatcacggtacctcctccttctattcttctgtttccttattaatgaagtgggcttataccaaatatatatgtatgtatccatataggacatcctattgtgggtataaatacaatagtgaggttgagggcaaagtaatacttgtaacagagagagaaacatcaataaagttgattgcccttcactttcgtgtccgtgtgttcgtgtgtgcttgtttgattgttgacaacgtgaattctaacactgctgtccgcatggagagaaaacttgtgacattttcttcctctcctaatcatgaatattgatgcatatccggcggtccaaaattcgaaattgtcctcctccctaattttcttgggacggtttttagcaaaaccgtttctttttgcccggttaggggaaggggctacctgacgcgtacgcgccgccgtcgctcgttttttcggcctaagtagttctactaatctactactacgatagggcatgtagcctggtggttgcagtcacctgagtagtaccccaaggtcctgagttcaaattttcatatgagcgaattttagattgggttgtttgcggggctaagttcctaattttaatgaccgcatatatccggttagatgtagaggccgggaaaaaaaataccattctctaaaaaaatactaatctactagtatattagttggatgtagaggccgggtaaaaaatacccttctctaaaaaaatactaatctactagtatattagataataacagtttatgataatgatgttactccgtcccaaaatataagcatttgtagctataaatctggacacacaggtgtctagattcatagctaataattgctatattttggggcgtaggtagtagtagataagattttattttttatgtgagatttttttaactaacaaattaaaaagaa

SEQ ID NO: 34990 - DNA, 840 bp, Oryza sativa
caatcattcatcagaggaagagttctacaatgatgctgatggtgtgaaggattaggtgtagccttggtcaagctgcctgtggagtggagtcgtctgcgccgtttatcttattttccgctgcttagatctttattgattgagaggaactatctacctctgtaatgacattttatacgcttattaattagagtaataattgtactctattatcaatttgttattgtgtgcctcggctgattcctggacgagggttcacacacatgaaagcgtttggaattttggatagaaattccgggcgtgacagaaaacaatgcataagttgaaataaatcaatagctttaaacaggttcagcatgctcaaagggttgtttgggatctgtgtgacttgccttgctggccttggaactcttcaaattcttctcctgcgaaaacagactctccggaaacgtcggaatctaaacaaaaaggagcaaaatcaccaaaatagcacataaacaagcatgaacagtacatgtggatatttttaacatgtagatctcaattttagaaaaatttagagacttgaaccaactaaatccgagctaagatgaattagttatgaatttttgaagattaaatcagattaaaacacttatatggattttaattgaattatgacgcaataatgaattatttttgaaaaggaaaagggatttattgcgtcagcggctaagggttttgcggtggaccgggcaacacggcaacgggttcacggggaaacgaaacggccaagatcgatccatccaaaacggacggccgagatcgatcgggtctaaggcggctcacgagagacgacgacga

SEQ ID NO: 34991 - DNA, 1501 bp, Oryza sativa
aattagctggctaatgatgtaattaagatcggattatagcttgatggtgtgtgagattgtgtgtttaagttggggtgtttatatagtgtgaagtgatggaatcttaggcatgtcgttggtgaccaactcttcctaatgacagctctaactaattattggacaggtgatgatgatgactaatgacattgctacatgatcaatgtttttgcatggtgagatgtacagagactaccatacgaattttgatgaatttgtttgggtgtattggcattagtttgttgattaactgttggcaattggacatatatttatgaaattttcagtgagatgcatgcactttcggtaggcaagatgcttcctcttcgtgttggaatattaggtgctccaaataccgattaattcgcattcctaacaacaaaaacaacatcggaattcactaatattccaacaagaacagtgatatgcgtccttcttccaagagggacagctagcaggcatgtcctaggaataaatatacatgttaaaccttcaacttttgaagttgtaagttactagtcatctgaatactcttgtttagtgtcaatctagagttctggagagccaaaacttactccaactttagtgttttttttttaaaaaaaagatgaactttggtactcttacttattaacatttaatttggtttcttccttaatttgtatcgattcacctagatatgtttctgtagttatctagattacaattttcttaattttatatttgtatgattcaccaaactacaaattatgttctaagttattcacctataaatgtttctgtagttatctagattagaattttcttaattttacaattgtatgattcactaaacaattgtttgtttcaccaaggaaaatacttaaacatgttgttcgataagtatacatatggaaaaaaaacagtcactaaaattgataaaaaagaaaaaaaaaatagtcacttgatgatgacaggttttcttcactattcttcactgtctataattgtcacaacatgctagtctgctaatgctgattctggaaacaacaagagagaaaagggtaaggctgtgcccaaattggagcaaaaccagaccaaaacaccccctaaatttctgcatatgcatcaaattctttccataaatagaggactgcagtaaaatggcatacatgttcattagcactatggccagacaactgtgtggccaggaagaacacatccctgcactttcccggcacagcattccttcaattccggcacgagtggctgcagcatacaacgatctcatcctccatcaacatcctcacaaaccattctcacctgatgccccaaaagcatttttactcttttttttttctgagagacatacatcaatcagttcttgatttgaccggcattgtattgttcgtcgtcgaggaggagggagggaaggagggagggaccatcgatcggcagctgacaatggctgcaagaaagtcgcaga

SEQ ID NO: 34992 - DNA, 1501 bp, Oryza sativa
atctaactccaaaccaggagctaagcaaattattaccagttataacatcaatacttattgtgagaggtgtgagactaatcacgaaaaacattgctcaacccgcccataaccgcgggcacggctattcgaatagttttactctggccagaggtgtaccactgtacccacaagacacagcctcaacatcatgtctaccatgcgtcgcgatactggaaagtactcgaatagaggctgtgacaataccctctgcataacacaactcaccacagtgcaccattcctggatcataatcaccccctcaaaaaccagaggcatggactccccagcgacccccgtgggcttatctccgccacttctcagtctggtgctccgcaatgaatcatgctatacaaaaggtaaagccgttgcccacgttggcttgtggttggcacgattaatgtttcacaatagtagctcgcgaaccggtccttaattgtcatgagcacgactctcaaaaccatgtgctcacaacccaccattatcaagttttagttggcaagtaattaattaaccaatcacgatgaccatcgtgagctaccattaaatataaccataagtgataatgaaacattagttatcccaattgtgtgctaatgtttctaagcatggcaaagcaatcatatctaatatctagctgaaccaatatatatagctcaactagtcaagttataataacccaaggtatcaaggaataaagtaatcaatgcaaacaggccataacaaaggaataggttcacaccacccagtgacattcgaaaataaatgcacagttgaaataaatagagaatttaaatataggatcaacatgctcaaaggattatgtttaggatctgtgtgacttgccttgcaataatcggtcttcaattaatcttcttgaatacttccggcgcactcgcgaaccttcgcaacgacggaaacgacaagctatcacgcaaaacgaggaaaaagactaataaaaaccaaataaacagtacatataaagtaaacaaacatgtagatcatatttttagatgaattatgagacttgaacggcctcattctgacttcaaatgaatttattatgaattttacaagattaaatctatttaaagcccatttaaaaagaattaaataaatttaattcaatttatggacaattttaatatgtagatctttattttatacaacttttgcaacttgaaccacattaaactgagttcaaatgaattagttatgaatttttaaagattaaatcggattaaaacctttatattgattttaattgaattatgacgcaataatgaattatttttgaaaaggaaaaggaggattattgcgtcagcggctagggtttgcggtggaccgggtgcacggcgacggctcacggaaacgaacggccgagatcaaccctatccaaaacggacggctgagatcgatcggtccacgaccgactcacggcgaacggctccgatgacgtcagcga

SEQ ID NO: 34993 - DNA, 936 bp, Oryza sativa
ccagatcaccatgatactggttatagtgaagagaagtgcgagcaagtggatcctaatggcaagataatgagagatgtcattacaggatatcttcaaatctaagaagcttcccattgaacttagctaagctgactggcagtactctggagttgcaagaaggcatctctgttcttatgtttttctcctcagttgtccttgttgtaatcagacctgctggtctccattcggtaaagattagcaatgaaataattcagttaggaattagctagctcaggagcaaactatctcttccttgagttaaggaaaaaatgttaatgtgttcatggtgatgacaatctccatcattttgaggtacaagatatatcagtggtcaattgctttgaatgaaggaaatcgcctttaaggagagtagctattcaactttgttttataaatgtttagatttgcataatatagtaaaactcatgctcgcatgttattaaagcatatccaagaaaaatagtaacctatatatgacatgttgagttgagtgaactagtcttggatgtacatcatctcattttcattttattgcaaggctattgttttctaaaatcatacatctaagtttgacgtgcctggtagtgttttactgaattcctgatgatatttgtgactgcatgatgttcattctgttttgttgatttactatttttttgaagatgatgtggtatcttgttttgttgcaagtgctttatgtgtaattatatctgggctcgatgtaaaactggttgcataatggttataaatcttgtccatgtaaaactgtttcccctcaaaaacacaagtataatgttcttaaagaatgtgattgaatatgcttcttctagttctatgtcttctggtctgctattttagtacattttctgcagactaatattctgccctttttttagg

SEQ ID NO: 34994 - DNA, 514 bp, Oryza sativa
gacctaaagtttatacatctgattcaaatttgaatttgaattcaaatattttttatatataatatttctatacatctaaagtttatacacctaaaatttatagacccaaaatttataagtcaaaagtttacatacccaattcaaatttgaatttgaattatatccaattcaaatttgaatttgaattcaaatattttttatatatagtattttgtacatctaaagtttatagacccaaagtttatgtcaaaagtttatatacccgattaaaatttgaatttaaattcaaatattagtttatagacccaaagtttataagtcaaaagtttacatacctgttttaaatttaaatttaaatttaatttttttatatatagtatttctatatataatttttttcaagcttatgttttttattttttaaaaatttatggtgtagtaggaagagaagaagatgaggagaaagaaaggatggggggtgttagccgcccccgcttgtatgtgtctaacgcga

SEQ ID NO: 34995 - DNA, 1501 bp, Oryza sativa
acgaacaatacaatgccggtcaaatcaagaactgattgatgtatgtctctcagaaaaaaaaaagagtaaaaatgcttttggggcatcaggtgagaatggtttgtgaggatgttgatggaggatgagatcgttgtatgctgcagccactcgtgccggaattgaaggaatgctgtgccgggaaagtgcagggatgtgttcttcctggccacacagttgtctggccatagtgctaatgaacatgtatgccattttactgcagtcctctatttatggaaagaatttgatgcatatgcagaaatttagggggtgttttggtctggttttgctccaatttgggcacagccttacccttttctctcttgttgtttccagaatcagcattagcagactagcatgttgtgacaattatagacagtgaagaatagtgaagaaaacctgtcatcatcaagtgactattttttttttcttttttatcaattttagtgactgttttttttccatatgtatacttatcgaacaacatgtttaagtattttccttggtgaaacaaacaattgtttagtgaatcatacaattgtaaaattaagaaaattctaatctagataactacagaaacatttataggtgaataacttagaacataatttgtagtttggtgaatcatacaaatataaaattaagaaaattgtaatctagataactacagaaacatatctaggtgaatcgatacaaattaaggaagaaaccaaattaaatgttaataagtaagagtaccaaagttcatcttttttttaaaaaaaaaacactaaagttggagtaagttttggctctccagaactctagattgacactaaacaagagtattcagatgactagtaacttacaacttcaaaagttgaaggtttaacatgtatatttattcctaggacatgcctgctagctgtccctcttggaagaaggacgcatatcactgttcttgttggaatattagtgaattccgatgttgtttttgttgttaggaatgcgaattaatcggtatttggagcacctaatattccaacacgaagaggaagcatcttgcctaccgaaagtgcatgcatctcactgaaaatttcataaatatatgtccaattgccaacagttaatcaacaaactaatgccaatacacccaaacaaattcatcaaaattcgtatggtagtctctgtacatctcaccatgcaaaaacattgatcatgtagcaatgtcattagtcatcatcatcacctgtccaataattagttagagctgtcattaggaagagttggtcaccaacgacatgcctaagattccatcacttcacactatataaacaccccaacttaaacacacaatctcacacaccatcaagctataatccgatcttaattacatcattagccagctaattaagtatatatctagcttgcttagctagaacacactctacagctaagctagcaatggcgcgcaataatggcgtcg

SEQ ID NO: 34996 - DNA, 1501 bp, Oryza sativa
tttgatcattaatgatctaattatatttgttaagtgcttttcttgtttaaaaatccttaaattataaattgttgtttaaaaggaattattagaaattattttaaaagcctagaagagaagatctaattttaatttgctaaatctcaacataaaattgggctagataaaattttgttaaatactttgcttaattctataattcctagatttttctgggatttatttgagctaaggaagtatttttaataaatggaattgcatttcataaataatttaaattgaaaaaggtttttaaaagtcttcttttggctttgggccgaaagccggcccaaaacccttctctctctctttctctcggcccagtcggcccagtccgccgagccgccgctctcctctctctctcagccgctgacaggtgggccccgcttgtcaggttcgtcgtcctccttcggccgccgccgcccgcaaaccctagcgcgccgccgccgccttctccttccaaattcggccgcgtctttccttctccggccgaatcttttgaggggaaatgatcttctcgatctcctcttccttttctcttttggattcatcgcctaattcggtttggaaactcgatggattcgagatcgaatcggattcttctctctctcccgaacccgatctttccttctcgtcgccggtcgccgtgggccttcgccgccgccttcttgcacctataaaaggatccccgagctctcctctatccgccgccacctttgccttagcctgccgtcgcgtctagcgccgcctccgcgtagcccgagtcgccgccggtgccgtccgttgcccttccgccgttgttttggtcaccggtgagttcgcggcgccgcgctctacccgttggtgccttccgttcgcgtcgccgcgccgtcgttcgccggcgagcatgcgcgtccgagctgcccaagtcgccgccggtgctgacgtcatcgctgccgtcatcgctgacgtcatcggagccgttcgccgtgagtcggtcgtggaccgatcgatctcagccgtccgttttggatagggttgatctcggccgttcgtttccgtgagccgtcgccgtgcacccggtccaccgcaaaccctagccgctgacgcaataatcctccttttccttttcaaaaataattcattattgcgtcataattcaattaaaatcaatataaaggttttaatccgatttaatctttaaaaattcataactaattcatttgaactcagtttaatgtggttcaagttgcaaaagttgtataaaataaagatctacatattaaaattgtccataaattgaattaaatttatttaattctttttaaatgggctttaaatagatttaatcttgtaaaattcataataaattcatttgaagtcagaatgaggccgttcaagtctcataattcatctaaaaatatgatctacatgtttgtttactttatatgtactgtttatttggtttttattagtctttttc

SEQ ID NO: 34997 - DNA, 355 bp, Oryza sativa
accaaatcttgaaatacttagtttgaaaaaataaaaatgttacgtgcaaatttttgcactgaaaacagaagtactttcgtaacctcataaacttcttagattttacaaacatattactccctccgtttcaggttataagatgttttgactttagtcaaaatcaaactgttttaagtttgaccaaatttgttgaaaaaagtagtaacatttttaacccgagacaaatttattatgaaaatatattcaattattgatttaatgatgaaactaatttagtattataaaaataagtatattcgtctataaacttagttaaaaatatcttgtaacctgaaacggagggagtacagtaaaa

SEQ ID NO: 34998 - DNA, 319 bp, Oryza sativa
  unsure (1)..(319): unsure at all n locations
ctacaatgaaacgtcttattaaaaaataaaataaaattttgtaatatatttttccaatttttgcaatgaaacgtggagtgcaatatccacacgagccacgcatcatccagcaaccaaccatccactactaccactggntacactatgccgttatcctctctttccctcctccccatccaccgagttccgctgccgccaacttcaaattacccgccaccgcagcatccatctcgcgccctcctcctccccatcttccgccactagccgctcgcgcgccgctcgcccgtctcccgggcgcgtgccgtagcagccgacggca

SEQ ID NO: 34999 - DNA, 1264 bp, Oryza sativa
ttacaaagtcatatcagattaacttagcataagcaaagtacagtatggcatgtcagattaaccaagcagcatgaaacaactaataccaaataaaatatagatgtgataactataacacgtttttatctaattaaaccctcaggttccaaacgagcataaaaatagactaatcatcttagtagcccaaaattaatgacgtcccagaaaatataaactaatcaaatgccctaccattcaacataattgtgaactgctaagtagtaacagacaactcctgacctattaagccaaatagaacacaaattcaacttaactgaaactagttgcaacaaactgacaccttgtgacatcacgtcagaataaacacagtattaggcaattaactggagccaaaagatcagccatgcaatcaacatcatcgccaattgatatataaacacatcaaaattagcaggcatttgaatcccctgtcaagttagcaaaaaataaatccataacttacaattacaacggttgtgctgttaaaataaattctaaaagttccaagcaatctaacttagttggcagacagttaataatcagctttgcggcagccttatgcacaaaaaaattgccatgtaagagtatgtaacagatcacacaatccacgacaaagaaattaaagcaccagccagtaaaccctactctgaatcccagtcactatcgaacaaaataactctagtgcatgatccatccacctaacatcacagtagaaccaacgaaaccacaaaacttcggattcaaaatgcacagttacaaagctacaaacccaaagatgctcaaattatctagaaattagcccgataacactaataaccattcgttatacctacacacaccaaacgatccaacgccacgcaccattccagcacatcatcaacagcacaaactagcacccagatcagggaagggggggcgtgaggcgagaaggttttgctcaccgcttgttcatgtcgatgtcggccttcttgcaggcgatgttggagaagcggcggccgacacccttgatggaggtgagcgcgaacatgatcttctgcttcccatccacgttcgtgttcagcagacgcaggatgtgctggaaatcctcccccgcgatcagcgactgcaaaaatcaaacacacacgcgattcctccccttagcacctgcgcaaagagaccactgcaaaggggagatgcgggagaggaacggagcttaccatggcggcggcggcggcggcggcaacgg

SEQ ID NO: 35000 - DNA, 363 bp, Oryza sativa
cccttttaatggttctcattcaaaatttattccagtgttattagtaccgtacatctattactgtactaatggcttatttatcagcaaaagttttacaatattgttttatttaatcttgctgcaataaaataaagttagcatgttgattttataactttcttttatttcttttgaaacctgttattcaaaagtacaaaatttgtgaccttgtttccaactgttttaacttatcttgcaagtttggtttactttatttacttacctttttactctgatttttctaaactttattcaaattaatccaaaaacttgtgctgttaattggatagatgtcttaactccctcctttcacttgtctttaga

SEQ ID NO: 35001 - DNA, 1501 bp, Oryza sativa; identical to SEQ ID NO: 18459

SEQ ID NO: 35002 - DNA, 1501 bp, Oryza sativa
cgaaaaatagtgccaaccttccatttgcatgctcctgcatccgcaaacatgcgagggcccaggcatacacaccctatcatcatcgttcaagcaaatctatcccttttttttcttttccaccatcatcctaatcaaacagaccgtctcgctaccaccgactacctgtaatacctttaaggacccacatgtaacacctttaaggacccacatgtcagtgccacatggagcggcaaaacccggagtaacaaatcttcgggtggttgcctgtgggggcatgcagagcatccacatcgtttggtggtgatcagctgaggccgtagaagtctgaacattgagcatggcccggccgttctgaccgcagctaaaacaaacagttcatggtggtggtgtagtggattgctgctaacgtgatccacgtccagaagcaagcttagattatatatctcatatgtagaaccggcacatgctctctgccacacgcgccgctctggaaccagggatatgtagctgaatcttccttcgtctccaatcttccccttttcttcttcttcacaggaagattgaatggcttaaccaccagattgaccaaccgctctagcattgttctgcacatgagcatacttagattagaaccaatctatatttattcgggttacagatttatacatgttagtaatacttcccactgtttacggaaaacacgccattttggacgtgaatgcaaattttcaggatgtaacttcgacaactactaatctcggtcatatgatccaatttatgaaacccaacaaaattatgatcatttttttcccactccatcaatgttaaggaatgaggttttaatcattctcacctgtatatataaccggggtcggaatgtgggacccggggacaggtctgcattccttccttaacactggcagtggcaggctctgatcgatctaggctgaatctgatctgacgggcgatgacgacgacgacggtgcaaaagcctgacaggcatcacatgcccatgcccacaatgatcagcccacatgtgccttgcacagtattgtatttgctcatttgctgtggcctccgtaggaccagccataccagtcgtcgttgctgctgcaatgcatttgcaatgccattgcacacatatcttctcgttcttaaatcaagctgctgcctctccctcctcctcttgacaagcaccattcctctcaactgaacctgtcaaacagagagagaagtagatgatagcgtgagagaatagaacagaagaaagaagataaaaaaaaagaaaaggaaaggaaagctctgtgtaaagcctgcatctacgtgctctctttggttggggtgttcttgctgctagaactagcttagcctggttctgccatggagtgaagaggcctctcgttcatctccgattcttgggggttgtcttcagctgttcagcaagagccgagagcttagcttggggcaaaggaaatgccgtcccggatgatgcaggcgttcg

SEQ ID NO: 35003 - DNA, 688 bp, Oryza sativa
agtggtgaagcaattttgggcttgtttttttgaaagaggaattttgggcttgttagctagctttttcctaggagtaagcttcttggattgctagcaaaaaggtcatttcaagtttccctgctgacatggcacactaattagggagaaaatctctctcttgtagtgtttgtgtaaaaaaaatctaagagtggcatatggatagtggcactccggaagagtggcaaatagttaaaacccccaaaacaaattatagattccgtctgtaaactgcgagatgaatttattaagcctaattaatccatcattagtaaatgtttactgtagcatcacattgtcaaatcatggcgtaattaggcaaaagattcgtcttgcgattttacatgcaaacggtgcaattggtttttttctgtccacatttaatgctccatacatgtgtccaaacatttgacgtgacggaaaagttggaagtttgaagaaaaaaattttgaatctaaacacagcctttagcttctaccaaaccgagctgaagtccaagcgtccaactttggtcactcgttcctcggtctaatccaggggcgagcggtgtgttgtggaggtcgtgacctcatttcatcgtcctaccgcgctcgccctcgccctcccgctcccgcgtgcatgagtgagtgagcacattgtcgtttttcctagc

SEQ ID NO: 35004 - DNA, 1501 bp, Oryza sativa
tggtttcgctgacatagcgcctacgtggcagtattgacctggtcttcgttccacatggcattgacatgaaacttaggtagcattagaactaaaaaaaaaaaagtgtttgacctatttgtcattcacaaaagagtatgtatgggacccacgtatcatgctctatcttcttccttcttcctcctccctctctctctttctcttcccttcggcgagcgtgggacgggggccaacaacggtaggagggcgggcgggcgagggccggatcccctttgcgagcccacaacttcgagtcaccacagcgatgccgttcctcgccatcgccgagttctgcgtcggccgtcgccgctcgggcgctcgattccctctctttcagtccccagtcaacccagccaccgccacaatcgagttcctctcttcccagcaatgccattccacccctcgctggcgcccaatcgccaccatagtcgaaaccccccaaatccggtctctgtcgatcgccattgccgagatcgagccgtgacttgccgctacaatccatcccctttggaagcagcggcgaagagcggcctccctcctctctcctgtggtcagggcggcgtgtccatcagaggttgggaaggagcggaaggcggcggtgaagagcggaaggcacataaggacgaaggcggtggccaccgctcttcccaaacgccgttctaccgctgttgctgctatccagcagcagtatctagcttccgatcaaagctactccctcaatcctaaaatataaacatttttagcatagtgacaagtcaaattattttaactttgactattgatagcaaacaaataaaaaagattaatcatataaaattgatgttactagattcatcattaaataaactatcataatatgcaactctttttatttaacatattttacttttatagatattgttggtcaaagtaccatttcagagaccatgtcagagtccaaagtttgttatattttaggacgaatggagtaatatagttttaaaaaaacagagccaatattgattggcactgaatgcaaagtgactccttcttacggttcaggaatcgggaatcctcagttccgttgcattgttcttttttccttgtttgatcggacggtctatgttgcttgtcctttttttttttcctcattggcatccaacggtgcattttattttcatgacgtggctcattccaatatcatctttggtttcacttttcactagtgaaaatgtcattatccattctggaaaataaaacgactatacatattctgtcactgcacactattttaccgacaaattggagatgttaaccgattgattcagggatcttttacctgggaccgggaggtgtttctgttcaccgtaacaatcggcatcttcctcgcactcgcggccctcgccatgatcatgaccaacggctggccgatggtctacaggacactcttcgcacctttctctgtctgtgtgatcatcctcctagc

SEQ ID NO: 35005 - DNA, 1501 bp, Oryza sativa
caaaccgccataggacctatattgcaacggctttgacaattgtgggaccagttgtatatggttttccggttgaaagacgaaaatcagattcattgacaagttagagcaaggcttataatacagccgacatgttggctataaggttctttatagacttctctcagcctacccatataatagttagctttttataattaatacgtagcccacttgtctgtctcacggagtttttttggttcttgtgtccaagccggctgtaagtttacagcccgcttctcctctctctcctctcttctctcctccacctcagcatttagctggcttataaccttctattatacttgctctaagggacctaagatgaacttattcctttatttgattcgtcgattttactttagctggagcaggatggcttgatgtgggccagacgaaactggcataggaatggtcgacaggccgagaacccagctcagtattcgcatcgccatccttcggaggattcttcggcggagttattttagtactcccaacacgggtgcggcctaccatggacgacctcgccgtcgtcagcttcgccgggggcctggagcccagccagaagccgccgacctccatgagtttcagttgccctgttcgtccatatacaggtcttgctcgcttgaatcctaccacgcttttctttctctctttggcttcagtttcagttggtgcgctactgaaatgctctggcgaaatgcgtattgagatgaatgcaaacgttccatggattaaggtggaaaaactgccaagaaatccaactgggttcaggttttcttgctttgcaactcggtgacagttttttttttggaggggagagaactttaggaattcgtagcggattttgatgtttttttaggcctgcagggattcagacttaggaggatcacttgtgcaagatgaatgggcctgaatgtccgatgactaaaaatatctcagcttggaagttggagagctcttctaatatgccaagttaatcaggtaagttgcagagctgcagtgccactgatggcacatgagcatttctgcatttgtttgttaaccaaatattgctcaatgtttcagttccttgcgttcctttgttggaacgaatagtggttgcactaaagggattttagacttagtttggtataagatgagaattttgtaggattacgattcacattatttgcgccttggtactgaaattgtaaaatcgagggttagggcaaaatttggtcactgctaaacattctaatgttaccaaatcccaactagacaaagacatcacatgttatctgtagtagtgcaagatgtgtctgacaggtggttcctgttattatgttgtctgaaatactgttgatctggttggagacttataacagatagcatctggtggtcatcctgaaaaaatataataaaatgtatgaagaaaatagaaatggatctttgtctgaccagggaacatcttcgagggaatctt

SEQ ID NO: 35006 - DNA, 198 bp, Oryza sativa
tattatttattgtactgtgacttgatttatcaccaaatgttctttaagtatgacataagtatttttgtatttgcataaaaaatttaaataagacgaatggtcaaacgttagttaaaaagtcaacggcgtcatatattaaaatacgggagtatcagatacagggtcacgtatcgcactcaccgtggtcgacaggagcaa

SEQ ID NO: 35007 - DNA, 186 bp, Oryza sativa
taccaaacaaccaagttacaatatcggagtataaaagttgacaaaagcatcatccaacaaaactgcctatcaagactgacatcattaaaacgctcataagataagcaaaatgcatatttgctgtgctgatgggcatggaatttatctcttcttggagacaccgacagtctttcccctcctgccagt

SEQ ID NO: 35008 - DNA, 1501 bp, Oryza sativa
gatttttctcaaatgtgctgatttgattcgagggatggcttgggaaaggtgagggattgaggcggtggatcacgggaaggattttgatgcacttttcggaggtggatttgagcggagttgtgaaccctagttcgccggcgcagcttttcactgtagcaaggagtggggaaaatggcgagagttccggcggggaagacgaagcgtcgcttggatatcggatttttcagttaagggtatcggaggtgctaatgggcctaggcctgaacagtatttcagcccaatacttttaacagtgtggcccattgtgttccttagggacttaggcatattttgctttggcaatattatgcgcacaacagtgttgcccaatgctgatcaaatcctttttatgcggtcatataattctttggaattattgcaatgcgaattaaaaaggtgcccgacagaaaggcgttatgctgtttttgcaagcttttttaggctaacaaaagctgtttgggttaactaggaatgacttgtttttattatagtcacttccttggtatgttatatacctattttcattatggtaaatagtcaaggcctaggctattcgacttatttattaccataatcttcataatacttgatgggtaatctttagagtttttattcggatacctgtcaagtatgttcattcgtgaaccttttagagtgtaaaccactcggatttcttttattgtggctaaaaagcagtcggctagcatgcctatttaggcgccgcgtacgcttttgtcatgtaatgcacgattgtgttattattttgtctttcaactatatgtttagtttgttaactaatcacatagttgggggctacacctaattaggtgcatctattcgatgcaccatattctttatcttttcgccctttacagtccactcggcaggttttggcttgaagagtttgaagtactcggattatcatctttgagagggctacgatggtcgactgcaaaggactcgggggctactgtggagattatgggtatcccatatctacacggcgatggtattcgaactgggtacaggatacctaatgtagatagaatatcttgtctgtatcttgggtttgtttcttaacttgtgtatcaaggaaacaccctgagacttagtcggttacgactgtattttacctttatcttcatattccggtaggaatatggattatcttttgtaacccggactccttcccatatataaggggggtccgggcgcctctaggggcatatgctgatttttcccgaatcacacaatcaataatacactcggcggattcatccccggacaggagtagggtattacttcttttataagaaggcctgaacctgtataaatcctttgtctccaaacccatacacttttctagcttgatagccaccccctttcattattgccgaaatctagtttcgacagttggcgcgccaggtaggggtagcgtcaagcttttcgccgatcagtgcaa

SEQ ID NO: 35009 - DNA, 357 bp, Oryza sativa
agttacttctattgtatagctaagttacttctacaatttaataaattacttttaaattaataaaatgtttgaatatattcaacatggatcttgttttgtcacatattttatgtagagtataatggtacaaataaatcttgaaaataatatgtgatttaaaagatataagtcattaaaggggttaaaaaagacgtgtaccataggctaaaggcatttatatatgggatgaggtggtctccggttagggctaagcctaagggtgaaaacggagcggattcagacggatagtgatcataccatatcctaaatcatatttttttaagcgaactcggagcgggtgcggtccgtgtggatagt

SEQ ID NO: 35010 - DNA, 795 bp, Oryza sativa
tgaatgggcggccaaaattgcaattagccccttgtcgccctcgggcctaatcgcaattttggccgacggcggcagacagcgcggtcgacccaccgtctgccacgtcagcttgccgcccaccaattgggcggcaggggctatttctgcaatttttttggtcgatagattatttctgtaaatattaaaaaaaaatctaaaaacgaaaaaaattcaacagtagcagagtaattgctaatgggcctttcgtcttagatgggcctccaaatcaatatgactagtccggaacgagtactactgtgattagaaatctcggcccatagaaagcccatatatagccaacagcccagcgtaattaattgacctcggtctccttgctcccctatctttaccctagtcgatctccccgtcgcttcggtctcgactcctcgtctcctcggccgccgccgccgccgccgccgccgagcagaggcgatctccacccgcgagcagcggcgccgtcgccggtgtgctgcttctcccgtcggaccctcgccggtgagcacacgtacgcttatcctctttctcgttcctctctacccacagcttttctcttcgccttaaccctagcttctcttgtagatccggaagcttttcttacttgccctttaacccctaaaccttagtactagtagcaattcgtttccagcaagatttggggattcagctgaaaaccctatgccttacgttagatccgctagctcactcttgtttgctattctgttgtgttacagttcaagatgcctcgctatgatgacc

SEQ ID NO: 35011 - DNA, 860 bp, Oryza sativa
ccccccccccccaacccctcctctgatctgggtgttcgtttgtgctgttggtgatgttctggaatgatgtgtaggtataacgaatggttattggtgttatcgggctaatttcttacaatcagggaaaactagataatttgagcatctttcggtttgtagttgtacacgttgaatccaaagttgtgtggttgtttcgttagttctactgtgatgttaggtggatggatcttgtactgagttattttgtttggtagtgattaggacgagtagggtttactgactggtgccttaatttctttgtggtggattaagtgataatatgagaaattttctgcgcgttactatgctgcaaagctgattattgactgtctgcaaactgagttaagattgcttggagcttttagaatttatttaatagcatgacctttgtaattgtaagttatggatgtatttttttttccaacttgactcgggattcgaacgcctgctaattttgatgtgtttatcaattggcgatgatgttgatggcagggctgatcttttggctccagttaattgcctaatactgtctttatttctgccgtaatgtcacgaggtgtcagtgtgttgcaactagtttcagttcagttgaatttatgttctatttggcttactaggccaggaccctggagttgcccgtcactacttagcagtctatatgattagttgatcttttctgggacgtcattaattttgggctaccaagatgatcagtctattttttatgctcatttggaacctgaagggcttaattagataaaaatgtgttataattatcacagctatattttatttggtattagttgtttcatgcagtttgg

SEQ ID NO: 35012 - DNA, 363 bp, Oryza sativa
tttttggtaattttttatggagtttttttggctacttttgatggagcatagctaaatttctgcctaaacctgtgattgtttaagttagattgttcgaaatttgagcgctcggtacatcaatttaaatgcccttgtttttgtgctgaaaaaagagagtaatattctgtgggtttctccagtattgttgtgaaactgaaccctgaattcgtctatggctttgaaactgaactatgaactcgtactgatgtgatcaatctcaatctcatgtggaagtactaactgaagatttatctttctcatgatttgatctttaggtactcatcatcaattgtgccatccaaattgaagttcaaatttccactg

SEQ ID NO: 35013 - DNA, 436 bp, Oryza sativa
cgttttctcatgggggcggcagtgtcacaccggtgggtgtcaccggatgatgtatatgtggcggcaccactggtgacagaggaagcagaggacctggatgactcagcgaaggcggggtgaacgaaggcgtcttcgttgggtggaaacgtatttatgtaatcatagtgcgtgtgtgtgttcagtgcctgtcatgtgggcctggatgagagggtttaaattatgaggagtcgagttgtaaactgtcgattatctaagaacaaaaacagaggagacaaagtgacaaactatccccaattctctctcgcgttcacaccatccggcggctcgcggcggccgaatcctcgacgccggcgagcggggtgttacatactccctcccactccaacgaccaacatcagcaagcagcagcagctcgatcgatcgaccgccatgagcg

SEQ ID NO: 35014 - DNA, 983 bp, Oryza sativa
gcggcggtggcgctagggcacgggcgaggctgcggggcgcggcgcgaggtaggggatgacgggtgggccccacccgtcagcgagggtggcgggcgggcccgcccgtcagcgacgcgcgcgcgggggaaggccgatgggctgcgggggagaggagagagagggagggagctgggccgagccggcccaagagaggaagggggggaaaaggacttttagggatttttctttttataaaaccactttaactttgtttatttcttcttaattattatttgtgctctgaaaattccactaaaatttatttacgcattttaggcttttaggaaatatacaaaaatcctccaagccttatttgacttttagctttgcacattttaattgttggaggctttcacatggattttacttattctatgcacaatttcgaggatgtattttagagtcgatttgggacgcgacaaaataccagaggaagcatgagatgcaagaagaaaaatattatgaagatgattgcaattttgatcctcattggagttgcgagtttttcaggttctgctagaatgaggggatgagattgccgtcaatagaagattgcccaggatgtggtggctctagaaggagatatgttgggagttcaagtcgatcacatgcaaggagagaggatcggcaagtgcagaaaaagttgcctgttcaccagagattgggtccaactcatcaagattcgtttcaggaggaggatgctgaagatgaagatgaaactaggaaaccccaatggtgtccttctggcattttcactaagaaccagaagagaagaattcaaaggacgaggaacatggagcaaattcaagaggccaaagaagagatcaatcatcggctaaagaggacaaggaatgagtggcgtgttaagagcaaggttgtctcagctgatgaggtcgaagccgacaaggcgagatggttagccaaagggaaggctgttgcttctt

SEQ ID NO: 35015 - DNA, 721 bp, Oryza sativa
ttaaatgaagaaaatcgcaaatattcatttaaagagcatagaaacttcaaatggccataacttgaccatttgaactcggaattggaccgttcaagtctctaatttttccttaagaagtcaagaacccatttttgtgctttgtttctgcttgttatatggagtttattagagtaaaagccttttcttttccgttggtcgtgtagacgctgcagcttcgaaagatccgctcttcgtggaagttgaagccgacgtttgggaaagcgagcaaggcaagtcacatcatctttgaacatattgaatcccagtttgtaaaattatgttgatttaaattattgcattatcgctttatttaaattcccgcgttatcactgttttatctagccatgcctaattacctttgttatgaccttattattattgttattgttagtatttccttgttcaccctagatcaaacaaaaccccaactagtggacactctactcatggtaccactagcatgattttaggtagatgcttcgctgtttaattaggtaacattaggtggttttacaactctagactttgggaatattcatatcacctggacactttggaactattggattatcgtggaattggcttcacacctccccctctattcaaaatccccaaaatggttttaggctgggctcggggtgcatggttttgatagtagcacctcggccatataaggaccggt

SEQ ID NO: 35016 - DNA, 1501 bp, Oryza sativa
gctgcgtaatacagtgcagctttttcggttttctcttctatttattcatctccacacagattttgttacatgtataatagaatcaaatcatgacaatctcggatcaactactgaccgcgccatcccacgatccgagccgagtcattgcagctaaagaaggaagcaaatatgctaaaacagaaaaatgctattctactggctagaattcagactccaacagaactctacatgcaacgaaacaaaagagaatataaatgctcaagattacaatccaacaattcaccccctaatcttgaagcatcagactggaactaatcccagcttgcctctcaactccaaaaatcgaatcttaccaagaggctttgttaaaatatctgcatgttgctcctctaaccttatgtattccacctccacccgtttctgatcaacacaatcccagatgaaataaaactttgtatcaatatgtttactgcgatcatgaagcacaggattcttcaagagacttatagcagacttgttatcaaccttgatcagtgcacaaccaggttcttggccttccaactcacctattggtcgagccagccacactccttgtacagcagcagttgcagcagctatatattcagcctcacacgaagatattgctaccaccttttgtttttgtgactgccaactgatcaaactgtctcccaatttaaatagaactccggttgtactctttctatcatcaatatccccagccatatcactgtcactatagccattcagctgaggaacctgttgttgcttctttctgaattccaccccgagattcagagtacctgccacatacctcaaaactacctgggtggcctgcgcaattgcgcggctagcacccaaacaaaatcatatattttttagtattattctacttaaaatttattaaatagctatctcattgtcttaagactttgaaagaccaaaccttatcatcctcgtgtttctaattatatagtttttaaaagttacaccagtatcatcctcgtgtttctaattatatagtttttaaaagtcacaccagttgctacctcctatgtcatctctttctttatttgcttactcgatctatcactatttctattcattctttctggaacctttaaaatttggattttatagttttagagtttattgtcatatagggtttcgtttttataatttccagatgtcccgtcaaacgttgcgattatactcctctacgacccgtccactgtctcttctctttattgtcattgagatttgtcacgtcccaaaacgaccctaaaatatatcctttaaattatgcctagaataattaaaatccgtgtgaaagcctccaaaaattaaaatgtgcaaagtaaaagtcaaacaaggcttagaggatttttgtatatttcctaaaagcctgaaatgtgtaaataaattttagtggaattttcggagcacaaaaaaataattaagaaataaataaagttaaaaaggt

SEQ ID NO: 35017 - DNA, 882 bp, Oryza sativa
ttatttcatttggctgctaaaagtcaggttcattcgaatatcctgttcaacctcattttctattcgctcagttgtttgtacgtactaactctgaaagaatatgcatggtgggatggtttaggtttgaacacttcctttcattcaggacttcatatatcgatcgcttatattttactaacctatgttgaaatggacatatggtgagtctctccgacgaccaagctgaaaggtcactactcatctactatcttatctcccttaatataagggattttgacattttatttgcactgtttgaccactcatcttattcatttttttttaaatataaaaaaagaaaaattgtgcttaaagtacattggataataagtcacaaataaaataaataataattcaaaatttattgaataagacgaatggtcaaacaacgtaaccaaaatatcaaaatccattatattaggggacagatgaagtattgcctattgactgcaatttcatagttgatcacactggaccttcttgtggttgatatttatggctaggtgtaatagtctagtttagattttattgctggttgtgttatgccactcttaattactgatttgatagctgtgccagtaaaattttataaaattaaaaacatgtcacagccgtcacgttttccatccatctcttttttttccgttttattccttctttctcccatcttcttcctgcaccgacgagcgtcaagtggtggagggactagtgaggaagtgttggttttctccccttttgagtcccctgaatccctcctcgaagatgatgccaatgcactcgtcaaggaagatgacaatcttgcagagttggtagagttacccaaaaccaatccaactttacggc

SEQ ID NO: 35018 - DNA, 1501 bp, Oryza sativa
tttatgttcattgcatagctgataggtaaatctagtgtgtatcggctattgctccaatacatctttatactaagatatcattatagattaaatatattaaacaagtgtcggtctactattaggaagacccaagtagattgagatcaagcttaatatgtttagtcttagcgagatcttaatataaatggcagatttagcatgtcaagtaaataaataaagaacaagataactaaaccaggtaagatcggctgaaactccgatactatctctattagcaatcatgaagcaagctagagattatggttctaaatattacttattagatcaaacttaattgatgtagcattaagcatagagagaaacataagatctagtaaacaagccaatgaaaactttttcgagatggtggatatactatatgatctaaaccaatgatattacctgattctatcggctgatttcgatgatagagacgagccgacaagaccagatagtaaaatcaatctagattatattgcatttatgataactcgacgattcacataaacaagattagagtgtcataaagatgtgagcactaatcccgagaacgcaagccgcaataacaagttttacctctcgccggagatcgaaaacgatgcagcccaactagagaacaagaactcgtcgaaacaatgaaagtagaaaaaggtcgcgatgcgccgaaagtgtattgaactgatgtcacgtcctgataaattcgtcccgaaattaaaaatcattcgctaaaaggaataatagaattaattaaaattcggaaagaaattggcaaacactaaaatacgtacaagaaaaattcaaatgtggcccggagaatttttgttaaattcgccttggtctaaaaggagccctcaaattttacttgaattttcagagcaccggaaataattattaagcaacaaaaacaattaacaaagtttattaaaaataaaaacctaaaaataaccctccttcctcctttgggccaagtctggcccaaagtcctccctctctcccctcggcccgcggccgaagtctccctttcctccctctctttctctccctctccttctctccctcctcttgggcccccttcccctcggcccagctccctcctccctctctctcccgggctgtctctcccccccccccggcctgccggcccaagccgcctccccctcctctcctcctgggccggccgcccggcccaacccgagcggcgccctcccgcccgtgccgcgcacgtgcgcgcgcgtgcgcgccgttgccgcgcgctgaccgcgcgcccgaccgcgtggggcccacgcgtcaggcgcgtcgtctccctcctccagccgcccggccacctctctctctctctcccggaaacctagctcgctccctcctccaaatccgcttgattcaattggccaattccaaaattaattggggggttttaatccccattgaatcgtcttcaattgcccccaaattcccccttgat

SEQ ID NO: 35019 - DNA, 1501 bp, Oryza sativa
acccggagtcgcggcagggcgcgcgggagttccgcacggagatcgagatgctctccggcctgcgccaccgtcacctcgtctccctcatcggctactgcgacgagcaggatgagatgatcctgctctacgagtacatggagcacggctcgctgcggagccgcctgtacggcggcggcgcggcgacggcgacggcgacggcgctcagctgggcgcagcggctggaggcatgcgccggcgcggcgagggggctcctctacctgcacacggccaccgccaagccggtgattcaccgcgacgtcaagtcgtcgaacatcttgctcgacgacggcctcacggcgaaggtcgccgacttcggcctctccaaggccgggccggacatggacgagacgcacgtcagcacggcggtgaaggggagcttcggctacgtggacccggagtacgtgaggacgaggaagctcaccgccaagtccgacgtctactcgttcggcgtcgtgctcctcgaggcgctgtgcgcgcgccccgtcgtcgacccgaggttgcccaagccgatggtgaacctcgtcgagtgggggttgcactggcagcggagggacgagctggagaagatcgtcgaccggcggatcgccgggacggtgaggcccgccgcgctgaggaagtacggcgagacggtggccaggtgcctcgccgaccgcggcgccgaccggccggcgatggaggacgtcgtgtggagcctgcagttcgtggcgcggctgcaggaggtggacggcctcgacgcctccgacgtgagcagcctcaacatggttcatcagctgatgccgccgacgagcttgcacgctcgtcagagaagcgccggcgaaagcgagaccggcaggacggacgccgacgaggacagcagtgtggtagatgatgattacaccgatgcttccatgagaggaatcttctggcaaatggtcaatgtgcgcgggagatgatactgatcagtcatcttcaaacattccagatcatgaattagtcatcttcagactggtcagttcattgttgaacattccaggtcaaaattcacctctccagtatccagtcggaaaaagtgaacaaagacatacttagaatttaaaatatacttaccagtgaaaattttgtactgtccctacaatggagttcaaacatatgcttgaatgaaagacatgcgagtctcataatttatgtttgagcagaaatactacacagttcaaacttttgcctaccttctggaagcaggtactggatggggccggacagcaagactgcaaggcctaattagcatccatacaaaaatattagcaagagcaagcaatagccgatatgttccagaaaccgcggtgggccgcaaattccattttatgcagttcggagtacaaccaacagatggcatggtctatcaacttatgaaaggcgtcaataacaaataggatacagatccactcaaatcccaacaggttcatagatatgactaaaatctcca

SEQ ID NO: 35020 - DNA, 1501 bp, Oryza sativa
agtatatattaaatattatagaaatagtatatgtacttatatattgagctctataatataatatattctagatgatgtgtcacatttgcatgagatttaaaatggtctaagataataattgctagtgaacgatgatgtgacatacttgtatgataagtttagtttttaataattactaatgggtatctcttactcgaaaaaaatactccatccgtttcacaatataagtcattctagcatttcccacattcatactgatgttaatgaatttagatatatatatatatatatatatatatatgtctagattcattagcatcaatatgaatgtgggaaatgttataatgacttacattgtgaaacggaggaagtaattgctaatggatatcaactatatagaaaatataaattactaagaaagaaagcagcttagacttgagaggatttgggccaagctgggctaccatgaaaaatgcctcatttggaaatgttatgttagatacgcgggctaataaatcctttaaattaaagcattttcatacgattttaaaggatttaaatccatagaaatattttctaacttgattgtttggaacataggattagaagttgataaattcctttggattgctttcccttagtccagttccacaacgcatattttcccatcatctctctagaaagctatcaaattcatgtgatattttcctttgagatatctagacacatcacctttttaattcatgtgccttatttcaattatgcgtttttttttattcttgcgttttttaaaaccatgtgtttcaaaaaggagcgctgaagagtgggagtaatctaacccaaatagcctaatgtgaggcttgactagtcttactccaaagttagtgccgggataaatgaatccattgtttgttggggagataacttttccacaacaaacaattccaaatgtttagttccatataggatgcataagtatgaccaggaaatatagataaaaatgttagctgcaattattttgttgttttatagtccacaaaaagttctcgaaagagtaatggctaaataacgagtacaagacaaatctaacgatccactaattgattaatagttgagcaccaatcagtcacatgagtacatgaccttcatcccttttcatgtccattcagatttcagaacagacaacagaaccgcatagctctcccaatccaaacaagaaaaaaatattttattaccagataaaaaaaaagagaaaaggaataaagggaaaaagaaaagaagaagaagaagaagaagagagagagagagcgaaaagtacacgaaatctcttcagttcagaaactttcagtgttggagaacttggaactcccctgaagaagccccggtcgcgggagaggagtccagtcgagactcgagacagcgccgcggcatcccacccccacctacctccgccgccgccgttgttgtggtgattgatcccgccgccgaccgccgccgatgt

SEQ ID NO: 35021 - DNA, 1501 bp, Oryza sativa
ggaaaagttctgaaataaagaaaattgctgtgtatttgaagctattcccaactacctaagagcggaggaccagcaatatttggtttcaagcaaaagatttgactgagtactgacacatcttcacttgctttgactggagtcgttaacctaaattatttgtttgaacaaattacactgacacctcgcgataggaggtaatgcccagttccaataaatagcatttaagaaacttactcataaattggaagaattggttctgaagaaatactgagggcagctttcataagtacaataccatcataataattgtctaatatagaatgcacaggctacatattatgtcacagctcaacctaaaaaaagtattggtcctttcccaacattttacatctcagggcacgccaaagatattcatttacagagtcagtgatcttgcttagatgcagatagaactgcctatcttgcaaaccccatcgtccactccacggctattttatcgtgcttatttctatcagtcaactataaacgtccaatgcttggcacaagaggaagttttcaagttgaaatgaagcaacaattatgtgtatattacaactagcttgaacaggactacatgttaagtaataaaagatagttcagaaacataactatcctgataatatgctgaaacttggaacatacatggatccgggtttgcgatgattgctttagtggcaagtagcacctttgaaatagtaaaagcaggactccagccttcccttaaaatgcccatactcaagttaccagtggagtcaacattgcagtagtaaatccttgtcttgaaagttacctacagtagtgatagaacagttataatcacaggttgaggtcctctaatgctaaaatatcaaataaaattacagcagggggatctcaattgttccatgcttctattatatatactgtattgaaattccaactcccttcaatattgagaagttaatacgttcaactagaagagtaaagtattttaaatattttttttaattattgaaacgtcaaatatgaagccacaattatcagcttacagtgtttttcttattataattgtgctatcaactgtctacaaaacatgagaaaattcacttgctattgccaaattatttggagggttatagtactatcagcatcaatatgtttgccatgttgaaaaaaatcagatagtttgcccccgcgtcgccccccgcgtcgggcgactcgggcggcggaaccctagccgccgccgccgcccttccccaccccttcctctgccttgccgccgcctgagcgagcggccggcaaagccggcggctcgcgaggacggcggcggcggggctcgcggcggccatctcccgagctcctggcgcgggtggacgcaaaggcggtggccgaccggagcggcgccggcgtcaaggctcatggcggcggatccggcatcgccaccaccagatctggcgcgctcgcagctggatccggtcgcgga

SEQ ID NO: 35022 - DNA, 560 bp, Oryza sativa
gtatgcgtggtgatttcggcaccttcgatcgaaggccttcgtaacatgcctccaaccgttattatgcatgatttgcttttcgttaattgagcttatattacactatgtgattccaatggcaagtctactgagtaattaatatagttaagttatttatgacagctatacaatagagttaaaataaagtttagggacaaatgtgatatctaattagtaagagtaagtctttaatataacgatctaaatagtaaatagtaagtactacctttgtttcacgttacaagacattttgagtttgaatacatgcatctatgcatgtgcttcatatataagtcaaaacttatatgaatgtcagtgaatttaaatgatggatagaaaggataaaacatatatattataacgtggaatggatggattgctctttatattacatgtttatgaaattgagtgaatttcttatatataccactgaaatttgatctgatccctttatatgtcacacaaaattgactatgaattattggttacttatctattactattcaggagatcaagagaca

SEQ ID NO: 35023 - DNA, 290 bp, Oryza sativa
ccggtggccagcaggggagaagaacggcggcggtgctcggtgttgaagacgggctgaggtcggggagaccggaggccgccgcctccgccatgctccccctgtgctcccgccgccgccaccctccccttctcccgcgtcgccggctgccggacatcctctccagccatgccccggtgaccgtctccccacccgccggccggctgcccatggaggtgaaaagtgagagagaaagggggaagggagaggaggggaaagagagagagagaggggtgtgacgtggcagcctgaca

SEQ ID NO: 35024 - DNA, 199 bp, Oryza sativa
acagatgtcggcttctacttctattgatgtcagcagctcgttctctctgtcttccccttgtctcttgattgtatgaactccggttgtcaagaccaggctctctgcttttgcttgacgaacgaccgcctaagcggttccaaagagagcgacttctatgcctccttcttgaacgctgctcgtggtcgtcttcatcatcaga

SEQ ID NO: 35025 - DNA, 1199 bp, Oryza sativa
  unsure (1)..(1199): unsure at all n locations
accgacgacgttatcccggacttggccgatcgggagtcccttgacgccctctgaaaaaccccacgtcgctgacgctgccgatgtcgtcgtgccgaagtcgccatcgccatcgcgtcggaatccgccgccgtcgtcgtcgcttgagcagggcggagaggcggcgggatccgcacgaggaggagaggctaccggatccgtccctcccgtcatcgccgccgacggatccgcgcgcatcggtggcggagagacggcgggatctgcgcgggagggggaaaggccgccggatccgcgcgtatggtgggcagcctgcttggagatggcgacggccttatggcgcagaagcccgacgaggttgaggcagagcagcgtggtggaggacgggatgcgctgtggcgtcgcgccgtggttgcggtggtgcagcgtggaggacgggagcacgcggcgtgatacggaggctgcggctgtggcggcggggaggcgaggagcgctgtgcaatctggactgagattagggtttcttatgcgcatacaaaatgggccaccgttggtgtttagtttcttacatgggctttgaccatgttggaatgagtccattaaggtccctcaactatagccacagtttaactagcgtccttataaaatactccctccgttttttaatagatgacgccgttgatttttttttcacatgtttgaccattcgtcttatttaaaaaatttacataattataatttattttgttatgagttattttatcactcatagtactttaagtgtgatttgtaanttatacatttgtataaaatttttgaataagacgaatgatcaaacatgtgagaaaaagtcaacgacgtcatctattaaaaaacggagggagtatatacaatgcaactagtatagcagcaagcgcgctcaacacaaacttttaaaacaaatgttcatactaaagttatctataaattatataggcttgtatatacctcatttgttgttagacttgcccagttttatgaaaatttttgaatccgccactgcttggcattcagtccgagcgtgtaaggaacctcttgtttaagggtggtgacagtgtcatccttaacaaaacgagaggtgtagttattaggattttgctgagttctggtgaagccacgtcacccttttaactccagccgttcgatcagctgctacaaacggttaga

SEQ ID NO: 35026 - DNA, 679 bp, Oryza sativa
tcctttatgaaacacttccaaacctgactaaagtgaaatgcaaaagattttcttgtgcctcgcaaatgttgtagataaacgaataaacaatatgattcattcattgggttacattatttatggttcaacatgtgcagacaattgtcatccttgggttgatcttacaagcaaaacaagttcaccaacaaatatcagaaggcagaccaatttcttgcaaggctccattctaagctaaatctataaaaaaaaacacaaactaggttgtgtttcagatcttgtactgttgcaaagaacctgtgagcgttgaaaaatccttgaactttgaaaattttggcatatttaagcaccatggaaactaggggaatttacatgcatgcttggttcaaatcctgactcatattttgttgtcatcctggacaccagaagcaagtcaatatactctaaaatccaaattcataatgttgggacatttagaagattgaggcgattatagaacggaaaatcgagttaccgttaggatgcaagcgggccgacctgcgagttcacttatagatcaaataaatgataattcataggttttcggtttgtggtccggtttgctacatctagatatgcaagtgggtcgatccataaacccatttacaggtcaaattaataggtaacccgcgagttacataga

SEQ ID NO: 35027 - DNA, 502 bp, Oryza sativa
aataacgcctgaatcatgtgatattttatctgtgctaatattagtgtaactttcttagttaggatttacctctcttacgttgttcctcccatccatatggaagtgttccatccattatctggattacttcacattctgttactctttattttgggcctggttactggcttagaacttctaggtcttttacttgttttaagtagttctatttcgtccatgtttttctaactaatcaaggttgttgatgtgaaatattacttggttactacatatgtgcttctgatagtatttggttcagtggctctctgggtgctgactaattcccccttttacgtcatgtaaaattgatgggttcatttccttgatagtgctgacccagttaccaaccattcattattcctttagttttcttaaagtaaaaggttccaaccttgtctatcatccagaactccagatgatcttttgattgcatatattatgctaatttgatactgtaggacaa

SEQ ID NO: 35028 - DNA, 333 bp, Oryza sativa
tgtgtcttgtgggtacatttgtacacctctgatcagagtaaaactattcgaatagccgtgcccgcggttatgggcagtcaaccagattcaccgtgattagtctcaccctagtgtaatcttttgaatttggattgtttaggtggatggttgggcctgtcgcaacgtggtgtagcgttggacagtggatgattaatactgcttaattattacaactgttttcgcattcaattcctgtttataaatgccagtatttatgcaaatgaacctgcttagctatcccttgtggaatccctgcatcatacccccgttccggtatgacttgctgagtacagt

SEQ ID NO: 35029 - DNA, 731 bp, Oryza sativa
ttcctgcagcccctaaaatttatttacgcattttaggcttttaagaaatatacaaaaatcctccaagccttatttgacttttagctttgcacattttaattgttggaggctttcacatggattttacttattctttgcataatttcgaggatgtattttagagtcgttttgggacgtgacactgtcacttcctgatttttgtttcaggatttataaattatttaataaattattattagaatttatattaaatgttcattaatttacaagtgaagttaaatgtgggaaataaaatttcctaaatataaagcatggatggatttaatttttattaaattctccatggttaattatactctctggaattttctcggatttttcggagctcaattcctaaatgatacaaagaacagttcagtaattatttgatcaataatgatctaattataattgttaagttcttttcttgtttaaaatccttaaattataaattgttgtttaaaaggaattattagaaataattttaaaagcttaaaagataagacctaattttaatttgttaaatctcaatataaaaatgagctagataaaattttattaaatactttgcttgttcctctattttctagaattttctaggaattgtttgagcaagggaagtattttaataaatgaaacatcatttcacgaattattttaattggaaaagtttttaaaatcctcccctaagt

SEQ ID NO: 35030 - DNA, 285 bp, Oryza sativa
ggttaaaattatttctagagctctgaaaattccactaaaaatcatgttaatgaatttcgacctgtagaactcaagaaaaagtcccacatgtcaaatccgattattatttgcattactttcttagggttttctcctgatttgcaccggtattttcttagggtcatttataaattacaattttggcttgggagggaaacttcgtggtgtgacactagtcctcctctttcgtttgccccttttcccgagctctctagtgcgccgtagagtcgccgccgcgtcgcttta

SEQ ID NO: 35031 - DNA, 1501 bp, Oryza sativa
aaagcaaaattttaaaggtcagattttggcgataaatgaagcagcaagacagagagagactagaggattttcacaaatacaaaggatttttatttccaaaatattgctaaggcttgggatctacggctcgtcctagggtcaagggggctctgataccaacttgtcacgaccggaaataacccaacgggcattccttacgtgcgtgcattaatccttgtcccaggaggcaaggtacaccaaaagttgatacaattcagagtttaacaagcggaagcgtaaatagataacttattacatgggcaacgaaggcccagcacacacagagacaaacgagaaacagcggaagactagggcgacgaccacaggcgcttgacggcaggcacgagctagacaccgaagccttcatcctcctggaactcctcttctggggttgggaaaaattgagcaagactgagtacaaccaccgtactcaacaagacacacccacaagtgcagaataaatgcaagggagtacaaaggagttataccataaaggggttagggttgcagtaaacagcatttaaagatatttagttgctcagggctattttgtaaacacgattctagaactaaacaatattatttatcaaggccgtgaacccacacgaacctgccttaacccaaggcctacgatgattcagaccgaactggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaatagattttactctgatcagaggtgtacatctttacccacaagacacatcttcctcacgtgtaaccacgtgccacataccaccacggtatacagacggaagacgtgacatagtttccaacccatcctagccatagacaagagtaccgacccaatcccacctacggccggaacccccgggacaggcaggcaggactgagcccctagcagcaggacaccggccctgtgccatgacatctcgactaccgggccgcagctcgtgtagccttcatttgccctggagaatgtccatcgacccccgacttcatccacctccatccgtgtacttttgtttataactagactgagccacaaactaagccttacccactagacatgtggaagtacggtagtgctttgcaacagaggcccgaacaccggtccttatatggccgaggtgctactatcaaaaccatgcgccccgagcccagcctaaaccatttttggggattttgaatagagggggcggtgtgaatccaattccacaatactccaacaattccacagtgtccaggtgatatgaatattcccaaagtctagagttgtaaaaccgcctaatgttacctaattaaaagcgaagcatctacctataatcatactagtggtaccatgagtagagtgtccactagt

SEQ ID NO: 35032 - DNA, 1501 bp, Oryza sativa
gagtaactgaagaaaaaaaagaaagagataaagagaagtgctagtgggctgctttggtggtttttgggccaagctagctagagtgcagtgtgtgcagaagttgaaatgcgcagtaccacatgtagtgttggactttagtcccacatcgctacttagttgagatggacatgtttataagttggatagcacccaatgacaagtaacacatgtttgaacctttttgcgtgaagtgaggactgaggacgaaagcacagagtgtaggtatggtccaaaagtgagttaggcttaatcattttttggagttaggtttgaatcatttttgggcctgggcaatacataaatatgttaatttagttcatacgttatattatcttgtaggttagttaatgttcaccatttttgtactactttttccttgattcttctaaagataaagaattccatatatataagccatggcaatgacattaaccctcttcttcttaatgataagaatgaactcttgaatccagttgatgcgatgacaacactatttatgatttctatcgtgatcaacaactaatgatgaatagtaacagcttgttcaggatcgattgaactaccactgataagccgttgaaaaataaatgaagcaaccaaaaataatttatgtgtacaacttttatatatgtattgttcgcggcttagaagccaaggttggaaaatagacataactgaaaaaaaaacaaaaaaccaactcaaaattgttctagctaataagccaacaagcagacaatgagatgcacacactgagctacacgcaacattctaaatcatagctggtatgggatgaacacatgtaagtgttttgcacggttgtagatacaaacatatacccacgacaaattgagcattttaggcttgcatttctagccattatagcataaccttatcactttgatcaatgtttatcctattggcagctcataactactagaccatttagtgtgatagctaacctttttgagatgttgatgcactcggcatacatggaacgccatactctagctttctttgtggccgttggattgacctagatatgaacggccgatgtatccctgcgtcccctatattatgagggaagtcaagtccccatcttcgcactgaccaatccccttgttgatttgctccatattgaggttgatttgccttccctaatatcctcccccatcgacaattctggcccttgcttccttccttgggaggtgaattatagtggctacgattgactccttcctcaaccaggagttggtgatggcaaccgacaggatgccggatagtcactttatggcctctagcaatggtggggcctgctaccaaaacactcatggtactccaatcactatgggggtccccaacttaggttgtcttgttgctagcataggcattgctccgtcaagctctcttatgccggagaggggtctggcaaccgctaattacaacttggttgctaactttccag

SEQ ID NO: 35033 - DNA, 337 bp, Oryza sativa
aacctggagaaacaagaatcaggcgtcaatcggcgacacctccgcatctctctgaccctgctccagcagacaaggtttcctccccctgcaaacctttcagccattcaagagatagcagccctgaaaatgggcattgctctgcagttgcttctcctcctctcgaacctctctcacctgacatattgcctgtgtcacaggagcaaggggcgttgctcatgcttaaaaggcacctagatcctatgctgcatgaggctatggtgggaggttcaatttattcccctgacactactctgccacgccctgcttcccctgtttttgttctttcatctgctgcaga

SEQ ID NO: 35034 - DNA, 1501 bp, Oryza sativa
caaccgtcccggaaaccgccataattgccacaaccgtcatagggacccacctgtcagtgaccctgggaagtgtggaggcctgctgggccggcccaggttcgaccgaaccctggtgacgccagctccagttggccttacatgtggacgtccaggattgcttgctgatggtggttgtggggcatttcatacaattcgcatcaattacaaccgtcatacttgcctatttcaggaggagctcattttactttcaacacgcactcaagcaagacttgatctcgatctctctctctaaagtttagtttagtgctctagtgctaagtgtagtagtgttccatctgatgcccaaatgttcccagcaacttttactgtaagggcaagagaaaaagagatgaatcaatgtttccctggggcctccacagataccacaatttaaaacaacatcatccggtgcacaatgtctcttatcaagcatgtcccttgtgtttaatctatcccacaacagatcaagccacatgaaaatcttgatcattttcacacatttggttttccagatccactagaaaggtcttggaacagagattctcatgaaattaggcctatagaacttatgagcgtaaaaggttagggaattccaaaaaaaaaaaaaaaccaagagtcacctctctatgtgctaggtcctaaaccatctaactctgattctagctacaaatattgtatataaacatgtggttcaagtggaaggttgaaacaatcttcaagatgcacattattataaaaacacaccaactcccatctgacagttgtatgatagaaaagacctggaaacttatactttctgatttttcccattccaaagatcatcccagaacaaaacagtagtcctagactagattgtgcattgtgatatggctctgtatatgtcagataggtggaaaattaaatagggaacttttgtcatgtaatatgaatcccaaataagtcttacccagcgcaaatcaacagtagtgtacaatttgtgaagatgttttaggagcagagccacattctgaatgtatagatttataacacctaaacctcttttgtctttcggtctataaactttgtcccaggcatatttttcaatcaaatgggcttgcttgtcattgacttaattttgtagctaagcttgcctcaagtgtgatcaacgttttactaaccatagtacgtacttgtggcaagccatcctatcttattataaaaatctacgcttaaaactaagcattgtgcttaacgctaagtcatttcagcttaacgctaagttgggatgggggcacgcgaccttgcgcggttgcgccccggagcactcctgcagtattagggtttccatgcatttgtacactggaagtgtgcctttatattgcccctccatttctacgtttgctccttcaagagacaggagctatactcgatcgagtagccggtatagctcctagcttgaaatcgactgccatggcgccagagg

SEQ ID NO: 35035 - DNA, 1501 bp, Oryza sativa
ctagacgacctgggttcaaagcctcacccctcctaattatttgatattaggtccttccctaatattctagttatttgggctctttttgcaaggttagcaacttagcatggatgcataccgttaagagccatttgtggtctgggcacccagagattaagtgagtgggtagcaaatcatggaacccaaccatggccagaaatgggccgttagctagttcataccaattcgagtatttgggctcttaaatgggctcgcagtaagcatggattcatcctgaccataagtaatagacaacgtcagtaaaaaaaaaaactattttttattttttaggcaattcattttgattaaaaatttctgaacgtgcaaagtaaaaaaaacaaaatagtttcgagtttttttttgaattaacgtgtgctatatttaatcagagttattttgactccatgcatatacttttagccctctctacacacacacacacacacgcaaaggttacaccatacagcaccaggaacatgtggccgtcctgattttgttctccatttcctctgttatttcattagagaagcgtgtccttaaaactcatgttcatccatggatttttcacaagtcacaacaaacatatgcgctatttcgttggccgagtttggccacgtataacacgtgctgttccatccaggctgaggctggctggggtgatcaagacttgccttgccgtacagtgaagtgtgccattacattggcaattccgatgcggtaccgaaaatttcctattttggcatacaactttttcccaagaacgaagcaattaattaactcctcaagcctaaccacacaattcgacgcgtggaaatgtaaggcttacctatacgtctataagaaagatatacccctaccaacgtatccattttgataattcatactctctccattttataatataaatcgtatgacttttttctaatcaaactatttctttaagtttaatcaagtttataaaagaatatagtgatatttttaacacaaaacaaatatattatcaaaatatattcaatgttagatttgataaaactaatatgatattttagattttgttaaattttctataaacttgaaaaaatataaaacgatttataatatgaaatggagagggtacatatcatgagaactatatggctaaaaaacactaaaagaacaagattctcaaataactcgagattcattttttttcgtagttttgcaaattgcgaggttaaaaattactcagaacaaacccaggttagcgtgcacaaaaatttgtactccgtactaatctgttaatctgttaccactagcaatcgttcccaagctagggtccgggccttgccgactttccggaaacggaaagcgcccagcagataagcgttgccatacacggcgacggggcgcgcgcgcgcacatgctgctttgccccctcgccgagacgagacgtcgcgatccgtcgcagcaagcgagagctaag

SEQ ID NO: 35036 - DNA, 1501 bp, Oryza sativa
taataaagatattcattgaaacattatgtgaattatgttggatgataatttaacatgtttgtatttgaaaagctcttaaattataaaaagaataaagatatagcatgtttgcatgatgtttaatgtgatgattgttagtggatgatgatgtggcatcttgttaattagtggatgatgatgtggtatctttgcatgttaagtttaaggagttagtgggggataactttatagtaagataggaatacagaaatgctctccccttcattaaggccttgtttagttggaaaaaattttgggtttgattgtcacatcggatattcggacacatatttgaagtattaaacgtagtctaataacaaaacaaattacagattccgttaggaaactgcgagacgaatttattaagcctaattaatctattattagcaaatgtttgctgtagcaccacattgtcaaatcatgacgcaattaggcttaaaagattcgtctcacaatttacactcgaactctgtaattaggtttttttccacgtttaatactccatgtatgtgtccaaacattcgatgtgatgggtgaaaagtttttgttttcggaactaaactaggcctaaaaatgcatcctatgaaagaaaaattgcttgaaaatctaaaaaaaaaatatgagctacaccacaaatattataccgccaggcagtagtactccaatgagtatctccacggtatctaggcaggtgagatccatacacacatagtaaccacctaccctcacacggtcatgaccatgtatgttttaatgtcttcccatataatactttcagtgtcggacaatgaacaaagaaaatatttgatgagatagataactcagtagtctgctaatgaagcatatgttgcttatcatgcatactttgttggtgagctgaagatataccacggagttcaacattccatggtttaaataatttatttacctttaaatctatatatgttgtgagggtaattagaaaaagatcataatagttgacttcgtgaatctcaagatacacctaacaatgagaactccaatttatatatgttgtgagggtaattaaaatttattcttttagcgataaacgacttacatgtcactattgatgcgcttgtggtgacttgtgaatatcatgccgatttagttttagagtacttataagatagggtgtgcaagtgtgctcacttatataggcgcatgtgtctgtaccctgtttcaaaaaaaatcacaaccgttgagaagaaaaggtaacaagttcaaaatagaacaaaagaatgtgctttttttaaataaaacaaaatcaccctcacataaatattaatattttttaaggtaataaaatttcatgcaccattaaaattaagaggatgcttgtgataagaggcgaagccaagatttatagataggcggtgtcgagattttcagagactcggtaagacggccaaaactttcgggtttttggattggccatcaaagg

SEQ ID NO: 35037 - DNA, 363 bp, Oryza sativa
atatattaaaatacggagtgagtacttgcttaagaaaatgggatgctgcctaaagctttgagttgtaagattagatttggaaccaaacaaacaacccccaacatccatccggtcgagtcaaattagtggttgcaacaaacataacagcaaaagaacagtgagattcccatgctgcttttcagcatagcaagaacaatccactggagtgactgcacacggctcatctgctaccctgaaatttacacgcagaagaatgaatacccagtagaaacctgaacattttctaataaatataaactgcatttttatgtacagaaaaaaagatgatgtcaacatggttcatactcctatttcacaccaaga

SEQ ID NO: 35038 - DNA, 1501 bp, Oryza sativa
ttgggtggaggaggacatcgccgggttggtgcaagcgactactcctagctagcttagctctcgcttgctgcgacggatcgcgacgtctcgtctcggcgagggggcaaagcagcatgtgcgcgcgcgcgccccgtcgccgtgtatggcaacgcttatctgctgggcgctttccgtttccggaaagtcggcaaggcccggaccctagcttgggaacgattgctagtggtaacagattaacagattagtacggagtacaaatttttgtgcacgctaacctgggtttgttctgagtaatttttaacctcgcaatttgcaaaactacgaaaaaaaatgaatctcgagttatttgagaatcttgttcttttagtgttttttagccatatagttctcatgatatgtaccctctccatttcatattataaatcgttttatattttttcaagtttatagaaaatttaacaaaatctaaaatatcatattagttttatcaaatctaacattgaatatattttgataatatatttgttttgtgttaaaaatatcactatattcttttataaacttgattaaacttaaagaaatagtttgattagaaaaaagtcatacgatttatattataaaatggagagagtatgaattatcaaaatggatacgttggtaggggtatatctttcttatagacgtataggtaagccttacatttccacgcgtcgaattgtgtggttaggcttgaggagttaattaattgcttcgttcttgggaaaaagttgtatgccaaaataggaaattttcggtaccgcatcggaattgccaatgtaatggcacacttcactgtacggcaaggcaagtcttgatcaccccagccagcctcagcctggatggaacagcacgtgttatacgtggccaaactcggccaacgaaatagcgcatatgtttgttgtgacttgtgaaaaatccatggatgaacatgagttttaaggacacgcttctctaatgaaataacagaggaaatggagaacaaaatcaggacggccacatgttcctggtgctgtatggtgtaacctttgcgtgtgtgtgtgtgtgtgtagagagggctaaaagtatatgcatggagtcaaaataactctgattaaatatagcacacgttaattcaaaaaaaaactcgaaactattttgttttttttactttgcacgttcagaaatttttaatcaaaatgaattgcctaaaaaataaaaaatagtttttttttttactgacgttgtctattacttatggtcaggatgaatccatgcttactgcgagcccatttaagagcccaaatactcgaattggtatgaactagctaacggcccatttctggccatggttgggttccatgatttgctacccactcacttaatctctgggtgcccagaccacaaatggctcttaacggtatgcatccatgctaagttgctaaccttgcaaaaagagcccaaataactagaatattagggaagg

SEQ ID NO: 35039 - DNA, 1108 bp, Oryza sativa
tccacgagaccacaacaaaagtaaccaatttgcgcacgatttcatcatggaacacctggtttttttttatagtgctttagagtacctggaggtacgaagatttcatactataaattttagtagtacttattttagtgtaaaattttggtgtaaaaatttggtatctataggttctaataagtatcttaaggtataaaaaaattagtgtaaattttaggtatattaaggtgctttatcaagaactttaaaatttcttagaaaatatggtacaagataccttctcaaggataaattacccgaaaagtataggatttaaatctcaaccgtccattaggcgtcatcgaacggctgacgatgtacctggtgatacggtgatggtgggcagggagctgaggacatgtacaaggacgtcgtcacagaggtagccgatcaggtcgttaccgccgccgccgccgccgtgatcagatggatctcgccggcgatggtttgcctcgtgctcaaccatgatggtttccaactttccatgaaaaaggccatagatacaatctatattctgtatacggtttagattaggtgtacgagaaaacgtgcgtacgtgtttatatatctaagtcagaattcgtttccctcacgaccgaatgcccagatcgccaacgtgaaaaagatctggaccagggctgggctctgcgttcttttttttttttttccttttgccgaagtgtataatttgatggattaatttttcaggtaaatttggtaggggactgcctatacatctgtcgacaaatttttcctcaaaaatttgacagatgtaattatagtacaatcgtagtgtaattacactgtaacttatatgtaattacactgtaacttgcatgtaactatagtgtaacttacgtaagtttcacataattttgaatcattagatctattacaagatttgttttggtgagaaaaaaaacaaatcatagcacacacatatatgaaagaatttgtttctatgacctccattttaccgaaataacatgttacggagagatttttgaaagttacatatacagtgtaattatatgcaagttacagtgtaattacactacgattgtactgt

SEQ ID NO: 35040 - DNA, 1501 bp, Oryza sativa
agtctaattggaatattccttaggttggacacttgctcacatatatacaggatgatagttatgtccacctagtagcattgcttattgctttttatttcagtactgtaacttgcttaaatacttcgttactttaaggccatcaatcttgttagtttgtgttacattgggattagtgcatatgaattagtttattgttatcctattatgggttatggttcataggtgataaacaccactgggaggatagccgggcggtgacggctgctagggatgagagggggacttaggttaggggagactaatcttgattcattgcttaattagaataacgatatagtcccatccttatatagatggagaaacttaacccctaggtaactaacttgatctaatctagatttatctatttcttaatcctatcctatcacccaacctactgctacagtaccgcgggtactgttcactcgccaggggttgggcccatgggcctcgacccctcggcccctacctatgacatatcctcactgttagttagggaagttaaatatatggtttactaggaagcattcccgagtgacaatttatggtttatgtagcactgacatcctccctataaaagggcccatgcaatccattatgaaataagcaatgaatctacaaagtttaattcagtattcctcatagcctctatcatgatggggagaagctcttctggccctcgtagagagcggggtgccctatcccccagtcttccctatcctatgtcaaatccatagcattttgtgtcagaaattcttatgcatgtattttattatctgaaaaacaataatcatgggctagcaaaactttgtgaatgctgaattcttacatgtaaaactgttaatctagttgaactgattgagttctgaaaattgctgtttatctcttaaaaatggggattcagctatatgcttcccgtgatggataagtctttgtggtccttggtcgtggttcttccttttcttttgggtagtttcaccttttcaggacagcatctactcctttagcatattttcagttgctaggacagctgcggttagtaggacaacagcagttagcatctcctttatgcctcctttatgctttattcagtttggatgccctctaggacaacatcccattcaaatttcgaattttagacgaggagggtgcaacaataggcttgcagccagctatggctatatatatgtatccaacctccctcgggtaggtatggctttgagtttgtgaatgaagaaaaccggaaaattgcccccatcctgagtgccatcctcttctcaatgagagtaatcattgaaattctaacatctggtatcagagccacactttcctgtaggctaaacatctcttgttccaccccttcccaagctcggttgagctctcagccagcaggagcagcaccggctactccttcccctttcccttccccctctccacgcagcagccccccggaggcgcgcca

SEQ ID NO: 35041 - DNA, 630 bp, Oryza sativa
gcataggatatattcccttatcccccttataatagttccaaatccccagtttaactgtatgattgttgctgggaactggcgatcctgctgtcactgggaaatgcttttttcttagagacctcccattttagatgttttcaattttttactctatttgctttgtatgtcgaaatctgttgaaattgtaactaaaaacgagaaaataaaatgaaatgtgacaaggactgagcttggtaactgcctcctaccaggccctgtcccaagaaacttgtcctgaaggggccttgctgtcttgaaaacttgttctaggtgaacatcattatatttgttgtaactgttatgtacgtgcaaaactatatatgtattctcttatgtcttttaaggtaaatgaggtgttgtagaaaggtatgaagtattacttcagttttagctgatgatgataaagtgatacttcgcacttagttgttcgctttcacttgaagctttagcttcatgtttgagttgtacaaactagattttgatattgttgagcaatatttttccttgtttgttttgatgtaccagtgttttctttgtttcattttcggacgagtttctaatattttcatgggtaatttattgttttgtagg

SEQ ID NO: 35042 - DNA, 1501 bp, Oryza sativa
gtcagatacctgaatactccaaagtaaacaaaaatccaaagcctttgttgatgtcaaggtcaatttcgtagtttacctttgcaaagagagagaagcaaagaaggggcaatatggtccaagggcagggtcgtaaatacctacgaaaaaggccaacatggcgtctaaataaattgccctccttcccccctctcgaagccttcgaaccacccaaacacccaaaaaaaagaaggcaaaaaaagaaaaaatctcaccacgagcagcacaagaactcctctcctctcttctcttctcccctactccttgattgaaaacccacgcatcctcctccttcccattgcgcattccggctagtcgcctcgccgatccctctcccgcccggcgcggatcgtcgtccccttcgcggaggaggtgccaatccctgttcttgattttttttttaaaaaaaggaaaattgttctttgtactgtgtggagcggattttgggggtaatctggtgctttgtggtgttcgttgttagggaaagtttggttatttttgggtggatttttgtatgtcgtgctaaatgggtttagctttagggggagtttatggatttggtcaatgttttgagacaggagagtccagagttcagagttcagagacgagatgttcttattatgcgttttgttcgttgatttgggaagtttattaggtggattcaacgacaatattcagtagtaacgattatattgggttgaaactggaattgtttgggagttaaaggtttgcgtttgtggagcttgtgaaaaaaataattaattggtcatgagattgaggtcaattcgcctttttacttgtcctggttaatagttaaaaagatggtgttagagtcaaggaaaagtcggttgcctgctaagtgacgcatttgcaccaagatggaagctggaaaggcagcttttacctactttttgagaaaaaaaaaagaggacaatcttgtagtggtttgtgcatcagcaaggtctcaggtagcacgcatgatcttggtttgctctagagaagtaagagtacagaatatttcctttttttttcccactctggcccactggttgtattgccaagtaaatagatgggccaatttggttgtttcctgaaatactaaatttgagatgttcttagatcatcaaatttgcccatgtttacatgataactttttagacagtgatttataatgatggataacttgattggtggtactgtgtaaggctgaattttggattagtagcttcttgtcttttgaacagcatgatcgctttcttgatgcagtagtggttcataaatgtgtagctaagatcgtctatctaaacacaaattaatgcactcaatgtctcaattagtccattgtcttacttacatcctcctctgatggtttcaggtgttaatcattcttggaccaagaagtctgtctctgctttgtcagtaactagcaaccttggtgttctcatggctcattctcatgaaatga

SEQ ID NO: 35043 - DNA, 267 bp, Oryza sativa
  unsure (1)..(267): unsure at all n locations
ttttgtaagacttcccttgtgcctacgttcttgtggggatacactacattctacatttcttttgcattctctggtgggtttattttaactataaacagtgacaattatgaaagtacaactctattgagtatcataaatatatatctagtgctttttggcggtaggtctaatcattctgcagtgaatttttgaaacttcttcaaataagagcttcatgttccccnnnnnnnnnnnnnnnnnnncttnnnnnnnnnnnnnnnnnnnttt

SEQ ID NO: 35044 - DNA, 1501 bp, Oryza sativa
tgatttttggccgcaaacaggacgctactctctcgcttcccgattctgcccctgacttgactggcgtatttacggccctgccacttgtctgtctccacccagtataccttaagacttactccctcgctcaaaaaaaaaataataataatctacaaggggatgtgatctcttttctggacatagggttatccaaaaagtaacctaggttgcttttttatgaagggagtaacaatttgctacacaacactatacaagaatatttggcatggtagcaaaacaaacagcacccatttacttctacactactaggtgaatgtagtttaattggttagattttttttctttggaaccatcctatccagattcaagttgtagacttaaaaatgggtgcttgcatttatgactaattattttctcagtgatagatgatataaccatcgatagcgagacgctcgtacggtgacttcgtcaatctcaaaatataccggatcaatgtttcaattcgaatgtgcttaggcgagtgcagcgcatctgtgtctctaacatgtttcttaaaaaaaagttttggcattattgaactttgctaaattttattgttgctaaaatttgggtgggctaattttggtatgaaagggaacaaactctagtacaactagaaagcaacggccaacggtgcacctgctacacaagttggcagtgtaattttcagcgtgtgcatcacatggtccgtatctttaatactagtcaattcatttttaatgtaaatataagtactatgtatatggactagtagtactttatttaaggtcaaagataccatggaagcaaataaaagacgcatgaaaaattgaaataccaacttatgcaataatatgccaatgcatgttgttctctccctatttatctctcagcgtctctatgtcttagtttaactaattaatgtaaagcatgtgtagtaattatggtgatataccattgtccagatttacttttctagaatgtgtcacatccacctgaaatttcttatattatgggacggaaaaaatattatactactatcttataaaaactatcactttataaaaaattatggcggcatttttctaaaaaaaaatgcgacaaagcaaacttttccatcagaaaataataccatatatgataagttaatccttgttaaactttggtttcaaaacaatttcccacttatttcaccaaaaaatatatttctcattttttttacaaagggacaaatataccattatccacatgctaatttgtggtgtcagatacctgaatactccaaagtaaacaaaaatccaaagcctttgttgatgtcaaggtcaatttcgtagtttacctttgcaaagagagagaagcaaagaaggggcaatatggtccaagggcagggtcgtaaatacctacgaaaaaggccaacatggcgtctaaataaattgccctccttcccccctctcgaagccttcgaaccacccaaacacccaaa

SEQ ID NO: 35045 - DNA, 196 bp, Oryza sativa
ttaggtcaagtcaaccagtcccagccaagtaatcattgaacagtagaccattcggtcaatgaagtcaagcaaacactggagatgtccaaataggatcataggataggagcaatatctcagcctgtaagctgatgttatgctccaaagaccctccctcctctctctctcacagacggaaccaaagaaagaaaccaca

SEQ ID NO: 35046 - DNA, 155 bp, Oryza sativa
acatgatcgcgaatggacatccggatatgctacaagttgggtgtgtgagtcatgctggccacatgagacgcacatataaaccaactctagcacctccattggtgttcgggagataattctacacgttcgctggtccttgaaccagtgtgtagcaa

SEQ ID NO: 35047 - DNA, 383 bp, Oryza sativa
ccttggttcaaaatccaaaatccgtcctagaaatgtcgttagaaagattttccattattgacaatttgacatgtagaccaaaagaccaaagttgcaattcgacttctgttaactgatgagtgaaaactgaaacgagttatgcatgtagagttagttctagatacaaaacactgatgctaaataacaacaattttctcagttaattgtttcaaatgaagccaagattaactaatataaataataacctatgactgtaagccatggcagaggcatatggtattctccagataagttccatataagtctattgcagtaatcctttaatgttccttgtcatatgagacgatgagatgacttctaatgtgctgctcttttctgttttc

SEQ ID NO: 35048 - DNA, 701 bp, Oryza sativa
ttcctgcagccctgaaagagcatataaacttcaaatggccataacttggccatttgaactcggaattggactgttcaagtctctaatttttccttaagaagtcaagaacccattttgtgctttgtttctacttgttatatggagtttattagagtaaaagccttttcttttcggttggtcgtgtagacgctgcagcttcggaagatccgctcttcgtggaagttgaagccggcgtttgggaaagcgagcaaggcaagtcacatcatctttgaacatattgaatcccagtttataaaattatgttgatttaaattattgcattatcgctttatttaaattcccgcgttttcactgttttatttagccatgcctatttacctttgttatgaccttaatattgttattgttattatttccttgttcaccctagattaaacaaaaccccaactagtggacactctactcatggtaccactagtatgattttaggtagatgcttcgcttttaattaggtaacattaggcggttttacaactctagactttgggaatattcatatcacctggacactgtggaatggtttggttattgtggaattggattcacaccgcccccactattcaaaatccccaaaaatggttttaggctgggctcggggtgcatggttttgatagtagcacctcggccatataaggaccggt

SEQ ID NO: 35049 - DNA, 1501 bp, Oryza sativa
tttataaaattatgttgatttaaattattgcattatcgctttatttaaattcccgcgttttcactgttttatttagccatgcctatttacctttgttatgaccttaatattgttattgttattatttccttgttcaccctagattaaacaaaaccccaactagtggacactctactcatggtaccactagtatgattttaggtagatgcttcgcttttaattaggtaacattaggcggttttacaactctagactttgggaatattcatatcacctggacactgtggaatggtttggttattgtggaattggattcacaccgcccccactattcaaaatccccaaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatagaggtggatgaagtcgggagtcaatggacattctccagggcaaatgaaggctacacgagctgcggcccggtagtcgagatgtcatggcacagggccggtgtcctgctgctaggggctcagtcctgcctgcctgtcccgggtgttccggccgtaggtgggattgggtcggtactcttgtctatggctaggatgggttggaaactatgtcacgtctttcgtctgtataccgtggtggtatgtggcacgtggttacacgtgaggaagatgtgtcttgtgggtaaagatgtacacctctgatcagagtaaaatctattcgaatagccgcgccctcggttatgggcaagccgagcaatgtacccaagttagtgttttaattcttaaaaacctgcttaacaactaaaatgtggaatggttggcctgggttggcttgggacgagctgggacccagggtcgggttgccagttcggtctgaatcatcgtaggccttgggttaaggcaggttcgtgtgggttcacggccttgataaataatcttgtatagttctagaatcgtgcttacaaaatagctttgagcaactaaatagctttaaatgctgtttactgcaaccctaaccctttatagtataactcctttgtactcccttgcatttattctgcacttgtgggtgtgtcttgttgagtacggtggttgtactcagtcttgctcaatttttcccaaacccagaagaggagttcctgcaagatgaaggctttggtgtctagctcgtgcctgccgtcaagcgcctgtggtcgtcgccctagtcttccgttgtttctcgtttgtctttgtgtgtgctgggccttcgtcgcccatgtaataaattaactatttacgcttccgcttgttaaactctgaattgtatcaacttttggtgtaccttgcctcctgggacaaggattaatgcacgcacgtaaggaacgcccgttgggttatttccggtcgtgacaga

SEQ ID NO: 35050 - DNA, 1501 bp, Oryza sativa
aggagttccaggaggatgaaggcttcggtgtctagctcgtgcctgccgtcaagcgcctgtggtcgtcgccctagtcttccgctgtttctcgtttgtctctgtgtgtgctgggccttcgttgcccatgtaataagttatctatttacgcttccgcttgttaaactctgaattgtatcaacttttggtgtaccttgcctcctgggacaaggattaatgcacgcacgtaaggaatgcccgttgggttatttccggtcgtgacaagttggtatcagagcccccttgaccctaggacgagccgtagatcccaagccttagcaatattttggaaataaaaatcctttgtatttgtgaaaatcctctagtctctctctgtcttgctgcttcatttatcgccaaaatctgacctttaaaattttgcttttctttttgtttttgtttgtagatggccggcagcgtcagccgtcgtggtttggacatgactggcttcgtcttggagctgcggggcatgtgcgtggtcctggggcatccacatggagtggactaccaggccaggccgcttccggagcaggagggtgacgatgcggagccccacgctgcttgggaggtcactgcagtgatcctcgctggctctcccgagcggacttcgctgacagtcaccgcgggtggggattccttccccgccgcttgccagagcgccgctctcctcgccatcggcactcttcaccagcgctacccggacgagttgcagcactcgccctaccgctaccaccctcgtcgcggaggagcccgcgactacgccaccttccgggatgctagctcggaggatgacgctaccatcgtgcacctggcgcgcatggtggaggcgtacgacgcggctcgtatcgacttccatcagatggtgcgtcgtgggatggtcgagaacaacatgaagatcctggagctgcgtcaggagaacctgcagctcaagaaggacctagatgcggtggaggcgcagctgcatcagctcaagatcgcccagggagagatctgccgccccaagcatcgccgcgtctaccgcagccagaagatcaccgcccgcaagagcacctccaggcccgagcttgttcgtcagtccctggcgtggacttgcttcgtggagacccctcgtgccgagcccgcgcccgtggttccccaggagggggaagcctccggcgttggtagcacggaggatgcgctgttgctcaccttccgtcctggcccgtcacagcagtagacgagcagttagtaggcttgcgcgtgtgttctttctcgtttgtcttcttgttgggttgtgtggggcacggttatgccggtgtgtggtgtaactttgtcggagcctgtctttattttatttgtttaagcaacttgaactttaatgaaccaatttaatagcagtaataaattcaagaattatggtagtcgtgggtggttagctttaattgtcagctctctctgtttgctggttctatgtggggttttcaga

SEQ ID NO: 35051 - DNA, 688 bp, Oryza sativa
cagtttctatacgtatggatactgttgttatactaatgtgagtcaagttgggacgaacttgggctcggaatatggtttcttggttgttgcatgtgcaggtgttgcttaaggccttgggagagtgttgccggtgatagatcgtagtcaacttgggagaagttgatgtccagggatcaagagatcatgcgggatactaaaggctagaggacaatgcacgtggtgatgaagaaatccatatggtatacaagaggaattgtgtacgtatggaaagaggagtcgaatttggaagggagtccgaattcgggaagtttgattgagataaggaaagagataagttgtttacttgcaaaagagggtttcctacgtgggttaggagtcctaagttatgttagattcgtgggctttgcacagcctacctcatgtataaatagagagggagggtgaggcctcccggtatcgattgtagagagactagaattgagagcaagttagggttttgagtttagttcgagattttggtgaggagtgttgttggtgcactttgtaaacactagttgatgcaataaagtcaaaaagtttcaatctacatcttcgagtttgtcatctaccggtgtttctgggtcccgatggtctaaccataggtgtacgcgcagtctgactggtgggatagctgcggtctgaccgcagg

SEQ ID NO: 35052 - DNA, 1437 bp, Oryza sativa
tcctgcagccccggccgattcttggcccaatgtggtgaggcatcggctgttgatgctttgagggtcatattgtttcctttgtctttgtctgggtcgacattcacgtggttttcttcgttgccttataattctgttcatggctgggccaatttggagaaacagtttcatagttacttctacagtgggaaccatgagatgagctttccgatttgacagcagttagacagaggcatgatgaaactatgcaagattacatccagaggttcagagatatgaggaatagatgctatagtttggttttgaccgattcctagttggccgatcttgcattccagggtttgataactccgatcaaggagaagttttcgtctcaagattttgaaagcttgtctcatcttgcacagaaggtagccctacatgagcaaaggtttgcagaggctaagaaaaactttaaaaaggtcaaccatttttatccttatatgtatgaatatgaagaagaatatgactctgaggtagcagcagccgagtgggcgaggagctaaaaggttgtgacatgtcagtgggttaagagtcttggaaaagaggaaaaatatgattttgatatcaccaaggctgacaagatttttgatttgctacttcgggagaaacaaattcaacttcctgctggttatataattccattagctgaggagctaggggagctagggaaaaggaaatattgcaaatggcataattctgggtctcatgctaccaatgattgcaaagttttccggcaacaaatccagttggctattgagggaggaaagattaaattcgatgattcaaagaagccgatgaaggtagatggccatccttttcctgtcaacatgatgcatatgtctgggagagtagtcgatgggggaaaaatcggagttctcagctaaattcagctaggattatcaataaatattaaagaaggcatgataagtagcaggaaaggtattttgagcaagatgatggtggctttgacccacattgggattgtgagatttttaggttttgctggaacgaagggatgagactgccatcgatagaagattgccccaggtgcagtgacaatgcaggggtccaagccgatcttacaatagaggaaatcggctgaatcaaaaaatagtgcctgttcatcagaggttgggtccagtacaccaggatcgttttcaagatgaggatgaagacgggaaatcacatggtgcccttctggtatttttactaagaatcagaagagaagtgtccagaggatgaggaacatggagcgttttcaagaagtgcaacaagaaatcaaccatcggctgaaaaagacaaaacaagaatggcgcattaagagcaaagttatagcaaccgatgaggttgaagccaacaaagcagagtggttgctcaagggcaaagctgttgcatctt

SEQ ID NO: 35053 - DNA, 225 bp, Oryza sativa
caagcagagcaccactaaggagtactactacagatcgatgagaaacagtgatcggtaagctcgacggtttcatttttgggaaaatattgggcacccatcttcgtggtcgaactcatgattttactatctgaagaaaaggtgcttgtacttgagatttgctgcttttgataagtttcacttttttccatttctgatttttttaaatgtggatttatcaccggtaga

SEQ ID NO: 35054 - DNA, 1501 bp, Oryza sativa
gcgcatgaagtggatatgcggttgtggcaatcgaaatggattgtatcgtgcgcgcgttaattaccctcgccgtccgaagcggcgttaccgtatctccaggcgagacaaatctgctcacccagattcgcgcgctgctcaagtggtgtggcagtcttgaatagaccgcccattatggacaaccaaagttatcaataccaatgtgcatggattgagaccgttgggcattttgcccaactacggagaccggtcccacctgtcaccaggctttaggggtggcgtcacacttgaccgcttcccttgggaaaggaaattgctctggcataacgccgggggctactgtcggtgatatgggaccgggagtatcatgaccagaggcttgaggcagacgcaatcgcccacgtggcctggcaccttcggggacgttgggcccgagggtgaggtgtccgccctcctcgtgatttcccctgaggggggggtcgggttgcgcttgctccggccccgagggccggggcacccccgaccccttaaagaagtctgcgccacatatatgggataagtgagcacagctgtgctcacctaacagcatttattgcagtctggtcaagcgtgtcacgctgcgtgcaacgcagtacagcacgctcttttatccggtctgtgaccagtcacagaccggtcagatcaagggttaggtggcgactggcggtctgacgcacgcctcgccccatcccgtcaagacgaaagcctcaaggcaactcgtctcaagccggagctagcgtgttatctcttagagatggcacgttagccctggttagatttataccaggcttcatcctaatcattacaggcaaggtgttacacgaagaagggcaaacatgcacgttgttaaactgacgcgtggtggacaagaatgaccggtctgacactggtcgcatcagcaacgggcagccacgatctcacgttgcgcccgtctccgccgggagtggaggtaggtgtgagctgtcccatcgaagtgtcatttggacgacaaccataccaatctccgcccattaaagagaagaagaacagtccagtttggaaagggaagggtgcatgtggtatccccttgaagtataaaaggaggaccttgcccatagagaaagggttggttgattcttgccagatttagagcctagagcgggggagaagtgggctctcactttgtagctcattcatacacaaatccacaaaaacacaggagtagggtattacgcttggcagcggcccgaacctgtatacatcggccgtgtctcgtgtgtcttgccggcgagcatctttccacatacagagagagcttgagatcgcaccctaagcccccggccgaaccggcaaaggggggcctgcgcggtctcccggtgaggagccacgagctccgtcatctggcgcgccaggtaggggtctcagcgtgtgctttctgagctctcagactcttccgtgtgccccaagtttttcttgttcagcctaa

SEQ ID NO: 35055 - DNA, 1501 bp, Oryza sativa
agcttcaaaacctgaagataaaatcacaaagtttttaagaggagaaaaggagaattgcacatgacaccagttctatcaaactgctgaaggtgcctgcctttagacattgccttcgattctcccatgccgaatttccaggaggtgcagcagcataaagtaatcgaggtagaactgcctggataagagacgggtaaacatctccagctccacctgcaaatttcttacagaatttaaaaaaatagagtgcaagcgaaatagacagaaaaagatcatgaaagctatatgttacctttctggttacgagagtattgagttattgaatccacaagaaagaaaaggtccactctcttatataaattcgactccttctccaagcgttcaacgataatatcaatcgcctaaataagaaaaaaaaatcaggaaaattgatatttggcaattggttgcatagaaaggtatgtaccctctttttattggtaatctaaaagcaccatgcatgtgtctgtagatgagatttcataatctaaaagaacatagaagtggtaaacaaagcaacatctaccagaattatcacaggttatttcgaagtccataagttgctgagatatgttgtcatatcacatcaaaagcatgtagcaactacgtattataagagatggtacacttcaatggtaaataagattgatccttgagaagcaacaataagttccagatgcctgatgatccatcacaaaaaagatggtagttggcacttggcacagagaacatagcactgtaattactaattagcctaggcaaatcaagaatctaacttccccgtccaccaacaaaacaaagaaagcaacaatgtttgctacatctataagcaagtaaatgatgatactacttaagaaagacacagtaaatgcatgataaatgaggatcacgtgccaaatagaaaactaggagtgacatgcatggacgcatggtctaacctctccagcaacgccatgtttggcacactcaattgcaagacgtgttgcacgcgctatattttcttttgttcttgtcagtgtaccaagaaaagatccaaaagcctttcgtgctgcattagcctcatcatgtcctgttaatttgctcaagttcttctgttgctgactatcaaaaggactcctagaatgaatattatcatttgtagatgtggatctgattatccggttcaaaggtgacaattgcttctgtgatccttccttgaaagcaggtgtatcaactacagtttcaggaatatacttggcattcagaaagttatctggaaaagaagttgatcgagagaaccttctagcttgtgcaacagcaataagttctttcataggcattgaatctggagaagtgctcttatcctttaggtttctatggttcagttcttttaatgccaaagctgagaaggtgtgcctgcaatacaacaataagtattgtcatgccttttcagaagaccatcttaaatcaactaatcaagtatcaa

SEQ ID NO: 35056 - DNA, 1489 bp, Oryza sativa
cattggtacatatatttctctccatacacttgggaatgtctcttgggtgatatgtgggcctcactctcatcttggttcatgtagtagggctccttcactttgcaattactttcctgtataattattggtgtaatcagtgtttgactttttgtgagaaaggcaactaaggaagaaggtcaaaacaatgggcttagtggtaaaaataatgcaggtgggggcccagcacacgttgcacgggcacttgcaatgtggggccgggcttgggccggcagttgatgacggcaggtgctcaagtgtatgggctgggactctttcggttggcaattgccaaaatgaaattttcagcatatgcatggacaataacaatccagggcctaccaacttagtagtatataggagtacttactagccatgggatgcaccaaccatcaaccacggtggtatatgaaaaaaagaaagaagaagaaaagaaagaaagaaaggaggaggttgatgaagttggatcatactacgtgcattatattagaaatatgcccttttcgttttttaaagatgacgccgttaactttttgacacacttttgaccattcatcttattaaaaaaaattatgcaaatgtgtaacatattaaatcatgcttaaaatatttttagtgataaaacaactcacaataaaataaattataattatataatttttttaaataaaatgaatggccaaacatgtgttcataagttaagtcttctattaaaaacgaagatagtacgatagtttggaaggtatcgatatactccgtacacccaagattttatttttatttgagagataatctattctatgctcataagtttactcttgctcaacgatttgacaccaaatttatttctttttataatgtctttcaagtctttcaaaaacaatatctaaaatacacttcaaagcgtaccaggattgcaaacaataaaaatatagagcctaccaacacagtattaatagtactagctatgtggtgacatatgacacaactagtagaatatagtatcatcaaccagggtgtagtgtaacggtatctggaaagaaaggggggaaaaaatagaaaaaggttgatggcgttggatcatcatacgtgcactattgcgtgcgtatggttatcaagtcaaaacgttggtttatactcgtgactacgcttttatcctctcggtatctttataaaaattatgtgtatctcgtggcactgatttgggtgtgttcgcaccttctggttgggaactctccctctctggtacgaaaaacgaagcagtcgtgattaattaagtattagctatttttttaaaaaaaaataaatcaatatgatttttttaaaacaacttttgtatagaaaatttttctaaaaaatacaccatttagtagtttgaaaagcgtgcgcgtggataacgagagagaggagttgggaaaactgtgataagaacacagacacgtttggaatgctg

SEQ ID NO: 35057 - DNA, 1501 bp, Oryza sativa
gctatatctttattctttttataatttaagagcttttcaaatacaaacatgttaaattatcatccaacataattcacataatgtttcaatgaatatctttattatgttttatgatatcctatatacttatttagttcatcctcacttagttagtgcttaaatgattaatctatggtccaaattatctttttcctttttttcctctaattaagtcatatcacataaattgtttttagcttttagatgattaatctatggtccaaactatctccctacttttttcttccataaagtcataccacctcactttttacgtttgaatcaccattctacatactatttaaatttaaattatcataaaccacattaatttacttaatctgatgttatatagctatcttacacgttattttttttttgttatcatactaaattcccgcagcaatgcgcggagtttcacctagttgttttaattgaaaggctttaaaaatccatcttcttgctttgagccaaaagtcgtcccatctcccttctcttcccttctcctcgcacgctactgattcacttccttctttttcttactccctctgtgtctcattttaagtacaaccataagttttcgcgctcaactttgatcgtccgtcttatttgaaatttttttataattagtatttttattgttatgagatgataaaacatgtatagtactttacttgtgatttatgtttttaaaatttttttaaaatttttttaaataagacggacgatcaaaattgggcatgaaaaatcatggctatacttaaaatgggaggagggagcattgtgcatgtgtcctattcaacccattgatgcgtcagggcagtgtagctcacccataccctcttattcctgacaagtgggactgtttattttattttattttgttcttgttgcttccctctgttttgcattataattttttttgaacttttaagtcaaactttttaaatttaaaatttatagaaaaatgtagtggtatctatacaataacaaattagtttcacgtactaaagctaacacatgatatattttgacaatatatttgtttgtgttagaaatattactacgttttttaagagagaattgcacattggaccatgtatttttacccatgttatactttggactaaggttacaatacacttttcactttagaccaggtttctttgcaaaatgttttacattgtacctgtcttctcctccagctgccccatctctctcctctctttcttcttcttctttgttgtgacccaaggttacggacaagattgggggatagacgagaaaacaccattttcccgcctatcatgaggaatgagcccgaatacaaaatgtacacacgctttgaccgatgagatttttagtattccaatatgtcctgtctgctacaggctttttatctactttatatagttcatagctgtacatgtgagattacaattgtgcccctcattgggcccat

SEQ ID NO: 35058 - DNA, 271 bp, Oryza sativa
agtatatatgaatatataatcttggttgtctttgaatacacaaagcctagttaattagacacgtggcataaattgattggttatgtatgacaatacgagtccctgaacgactacaaatacctatgcgaaatctccaaaccgcgtcacattccaaccccaaccacgcctcggatcaaaataagaccagaaaaaaaaaaaccctcaaaaatccctgtagaaaaaagagtcgatgactcaaaaagagagtagagaagaagaagccgagagatca

SEQ ID NO: 35059 - DNA, 1501 bp, Oryza sativa
tgtcatatataaacttaagaccgaactaatgcatcttgtttttacctttgacttttcattacttttcaataggacctaaaagggattagggagtcctaattgccctaggctttgtctttaccccttgtatgatgtgaacaccagacataggttcaataggaatgaatagtttgcggatacatatgagataatgttttgcgctatatgtcaaagttagaaggtggtgaacataaaacaaagttaaagtttcactgaataataactagcgacgatgaacataaagaaattattgaagtttaccctcaagaagtagtaatattaatgattgattttgttaattttgctagctagaatatgcatacaacagcagatgttatcatcctttttatttatacgtactgtcatccttttctcctttggtatagattggttttatgaagttgatggaaaattgaccacagatgagtttattattcattcatgaaccgtgaacttctcttaaaaaaagtaaaataaggaagttcaatgcgaataatctatatgggggattaattacttgtcaatgcttttcatgatatttaatgttttcgactgtaagattaacaaattgtgcagagatgtatttttcatgcatgataatttggaagtgcacccacattgttccatgaacttgcattgctagttttatgttaaattctcgttcacaacaaattaactagagacaattaattatcatgatatataggtaatttagcatcaaactgatcatttacaatcagcattactgtttttgaaaacaaaaaaaataaaaaaaaatgctatatcgttacaacggtggtttattttactaacatcatcatgacatcagcatgggatctaggtaccaaatactgttacctatgagtatcatgtatgataccccgatattagatatggttcctatgtttatcatgtctaatgctagtatcatataagtaccaaatttgtgccatgctggcgttatggtgatgccagaaataaagtattccattctggaatggtatagtgtcttctggtaatccttatttagaaaatgtattataaccatttaaatatagtatatgttccccttccatctcaaaatgtaaatgattttgggtagatgtaatctatagtccttaaaatgttagtagttctggtggtgtccattcccacaccatctctactactaccgtgtgagccccacaatctataccattacattatcttttaacgagtcctcccccgtttcaccgttggctctcagtacttggactaaataagtgtttgttaattgatttaataaattagaaactcaatttgttgtccgttacaaagcacaagctcttagctatcctaatattattaatctgaacaaacttatatcacatccatctaaaatctcgtatattatattttgggacgggggagtaagaatgatcgagtgcacgtacattttaggtcgtaaatttactatctttgc

SEQ ID NO: 35060 - DNA, 379 bp, Oryza sativa
catgccggcatgtgaggtgatcgacgtggagttgggatcgccggcgatacgccggcgtgccggcggaggcatcggaggcggtggtggtgaggatcgccgtcgcacaggccggccgccggtgtgtcgggcggggggcgacggcgagcgattgagatttgacagtgaagatgagcaaaatgcctagcagtagatgactgcagtaagtgcagaacggccgttagatcatgaatcaacgtcagataggctcacgagcatcactacccaaaatactctgtgatttcaataccatgattttagtatagttgtattcctcgctaaagaaaatagttttattgctgtggctctaacagtatccctaatcagagcatgtccaacggat

SEQ ID NO: 35061 - DNA, 1501 bp, Oryza sativa
accactgacatcttccgttacttctgatgagcaatttcgtcttcatgttggtcatttcatctccatgccgactgcgtcagctattgccaatagacaattttgactatgacagaaggacaagctatatgctcaggggctcatcaactcaagcgtgaggattatatctccaatttggacttgttccggatacattccacatggattcatagtcatgagtctattttctatgctcaaagactggaccaattattattccccgtaagggctatcaaccgaatacttgcgccagtcgggattcaattattatatttattttggagtatcccataagggataatcattcagatcagaagctattcatatgagctacacttggtctatattacccagaagatttattactcgggagcatgttacatgcgtcatcctttaaagggtgtcgaaggcatattttttggcctaggcctaatatgtctgcaacccatattttcaggtgtggcctgtcacgttcttttagggacttaggcactttttgcttaggccaaagtgcgcgtgatcaagtgcctaataccttaaaatccttttataccgcagttacttaactttttaggagttggtacaatgcatcttaaaaggtgtcaaacagtaaagctttatatagctgtcccgctgacttttttatatataagtcaaggtgctgtttgggtttttaagcaattgattggatacaatatcattgcttttcgccatgtaagtgtgcatttttattgaccaatattatggcttaggctgattatatattgtggtcattttctaggcggttggtaaatcctttatgagtttatttactcggattttacaccacatatgccatatatttccaggtgtggtgaaaccatgtgtcttctagggacttaagcacatctgttaaagcagtgtgcgcatggcgtatgcccaatactttggaaatttctttattcacaatatacaagcttctttatagctatttttctatatcactcatcatattttacaaagcagttggtatatcactcggatcatgttatttggaggattcacaccgcatatgctatatattgatatcaagtcacttggttgattacgattatcaaaaccactcggttggttgaattatttattccttgactatatgcttggtttgttcaattaaccacattgtcgggggctacacctattaggtgcatctagtcggtgcacctgactttattttccagccctccacagtcttcagatttggtaaaagtactcgggagaccatggcaaagatgattgaagtactcggctttggagtaatctggttcgagagaagattatcttttcgactgtgaaggtctcaggggctactgtggagattatgggtaccccatacccacacggcatggttatccgactagttataggggataacttatatatatggaatatgtaacagatcatgacttgggtattacgtttcctt

SEQ ID NO: 35062 - DNA, 215 bp, Oryza sativa
tttcgaaacggagggagtacgtcattaacttgacaatacaaccgaccattcccgatgacacatattgagcaataaaaatgtggaaccaccagctgttacaaagtactccatctagagcattagcatgtagattaatttaatcactaacgagaacgatcaaacaacaatacacatgcgtgcaacaattagaatcacaggctcgcagctactacata

SEQ ID NO: 35063 - DNA, 1501 bp, Oryza sativa
tggctattagattgggtatagataaattgaagctagtagtgggctatactattaaacttgctatgagagagaagaacagcgggctacagatctgtagccagctgcagcgcggactccaatatgtaatgtgtgtatgacatgtgggaccatatattaatagtatagtaagcaattattatatgaattggctattagattgactataaatgaattggagctagtagcgagttatactattagccttgcgctaagctagcttatgtgatgttcaatttttaaccattcaaggttagtgctccctgagtatatcaaacaactgaagctccctgagtgagtgagtatattatgtatcttcactcacgcgctactgcgctagcatgcttgaatatatagatttgtccacatgatagtacgaatgcgccgatcgactatggtttaatcaactggccagttccctttataccaatctagtgatattaattagttaattaatcaacccttcctgcatgcatgcatgattatgcatctggcatataatacactgcgcagcttgccagcatgtttgctgtaaagcgactagcgagcagcagcacacagccacacacacactcgctgatcagccacaatgtgtaaactgacggatcgatcgacatgtgtgtagctagcgagagtacatgcatgattaatcaatgcagcttacccgagcacacatggaccttggcaggggcccacccctcgacagcggtgcgtgcaatatatgcgagctggggagatgggaggtgcccgccccgcaaaaggatcctcgcgttaaaagctaagcatgtgcgaacgcatcgtcttcgccacgatccccctgggagctaggtagggggctcgccagcgtgcagtgctactgtttgtgtgggtagctagctcagctgctacagtatttcatacgtagccgttgactttttatccaaacatttgatcattcaccttatttaaaaaaattatacaattatcatttattttattgtgactcgattcatcattaaatgttctttaagcataatataaatacttttatatttgtacgaaaattttaaataaaacgaatggtcaaacattggttaaaaagtcaacggcgtcatacattaaaatacgaagggagtatttggcatgaacatatcagtgtggaagctcaccgtggtgcgggtcatcgacgtcgtaggttcttttgcagagtaatgtggttcacgtttacatgtgttttgtagatgaattcattatcgaatgggatggatctagcgtggggttagggagacttgatcaagtccccctatctcactgcatcactattgatagagggaagggagaggaggaagacttgatcaagtccccctatctcactgcatcactattgatagaaagagggaagggagaggaggaagagagggggtgcgacgaggaagaaagagatgggttcccctttaatcttattttagatccgtatgcgattata

SEQ ID NO: 35064 - DNA, 1501 bp, Oryza sativa
acagtttacgtgtaaattgagagacaaatcttttaagtttaattgcgccatgattttacaacgtggtgttacaataaacatttactaatgacggattaattatgcttaataaattcgtcaagcagtttacaggcggattatgtaatttgttttgttattatactacgtttaatatttcaaatgtgtgtctgtgtatccgatgggacacgctaaaactttacttccctggatctaaagtctaaacaccccctatgttttggcttagagcagctaaatttggctattttaaccaaaaaaaatccactccaacaacctctctattaggatggctaagctaaatgattagccaaactcatcccctcatggccaaatttggttagcccaacctgccttgccattggtggatcccacgctgaagaggcttttccctcccgcaatagcactacccgcgtcggttgagagcagtgaaggaggaggatgcggcggtggggcagcacgacggcgagcgcacccgcggcctcctgctcgtcggccgccggcgtcaaggaatggagagagaagcgtgtttccgccaccgcctcagttcccggccacatccgtcggcatcttcttccttctcggcaaggagtggatccgctatctccgttgcctcgcgcgaacgaattcgccgtcgccggcttctcccttctcgccgccgccaccgctgttgactcgcacacacgaatcggccgaggcggagacggaggaggacaaggacataggggaggaggggcgaggcgtggaggggaccggggacgggaaaagggggagaaaacgaggaagaagaaaaagttgaggctgacatgcggatcctactgtcatgcactcaggtggtgtttagatccaggacttaactttagtccctgtctttagacactaatttagagtattaaatataaactacttacaaaactaattacataaataaaagctaattcacgagacaaattttttaagcctaattaatctataattagagaatatttactgtagcatcacataggctaatcatggattaattaggctcattagattcgtctcgcaaattagtccaagattatggatgggttttattaatagtctacgtttaatatttataattaattttcaaacatccgatgtgatagggacttaaaagttttagtcccatctaaacagggctcagaatagaaatcagaatagaaaggatgaatggagagactattggagtaaataacaaatttgaattgctaattaaatggagatttggctaaatagacggttggagagtgatttggagaggctgtctggagatgctcttaagctcgaagaggcgctgcccctcgtgcatcgccgacccccgaccataagtatcacgagcaggcggccgccgccgagacatgtgctgctcagtcgctcagagcctcagatcacccacccgcttgctgaagcgctagtactagtgtactaccagtagtagtgt

SEQ ID NO: 35065 - DNA, 349 bp, Oryza sativa
atttcacaaaagtttttgaataagacgaacggtcaaagacatgtgctaaaaagtcaacggtgtcaaacatttcgaaacggagggagtataatagtatttgtagcactgacattacctactgttttcctgttctattgagtggttttagcaacgtttgcagctacaaattcccaataaactgatgttgagtgatctaataacttacgaaggcaaaatgaagtcatataatcgcatcaatttgtaatgttatgggggagttgatttgttttttctttctgtagtgattggtagactgataaacatctacaagatagcatggtcttatcggtaattgttctctctgtgtagg

SEQ ID NO: 35066 - DNA, 1501 bp, Oryza sativa
aaaactaggcaattccccgcgctttgctgccgaaattattgagtaattttaatatatatatatatatacacgttacaatcaagctatgggtaaaaagaaaacaaataaaatatcaggacttatcactatttattatgaaacaaacaaatgaaacccgcgctataatattgaacatattgatatgtttatgttaaatattataaaaatgctagatatgtttgtaaaaatattgtagaaatgatgtgagggtgatgattgaatagattgtagatgatgttacatgcttgcatgaggttgaatatgtaattattgctagtgaataatgatatggcatggttgcatgttacgcttcagagttagtaggttgtaactttatagaaagtatagataccagatatctttaaacccataactattaaaactgatgtaaaatgacccctcattggttttaaaggtggtttttgttgacgtatagtagctcgtcgacctggtccaaccgagtaaatcaacatgtggggctcatatgtcagggactccttccttccccaaatttcctctcggcggtagcgtgtgatagcgtaaagactacaatgaccgctgccatgaggctgaggctgtgtttagttggatccaaagtttggattttggttgaaattaaagatgatgtgactgaaaagttgtgtgtgtatgacaggttgatgtgatggaaaaggactgaagtttggatctaaacacagcctgaagaagacgagcttctctgacctgcccatcgcgccgtcggtctttgcagcagctgcggtgatggtcgtggagctggatgttgggcgtcagcttcaggccaagaatgtgcctatggtctagagcttattgagggcgtgccttacgcaccactgggtacgatgatcactgggagttccgataaaatcttgttttaatctgaaaacataatagtgttgtatgcgcatggtaaacttaatgttttagcagagaaagggaatttgagttcaatacattgttcgatccctttcgctctcattctcaggccttataaagagttcggcctactacacggcccattcaccgcctacgtatcgtggattgggccgtatgcctctcgtgggccgatttggaggaaccggcccactatcctttgaagttgcaaggcggcgtcgcgccttagtgtgacaaaaactgaatgaattaattaacttaaattggttggaaagaggataaaatgaaatagaatgagtgtttgatattaagtgcgtgtagcaagcttggccactaaataaataaataaaccattcgtatgtataatactactagtaaaagaaggaacactaatttttcagggcgaaaaaaaaaaatgagtggtgaatcacgcaatcacttccctgcaatataatgcatggtgctcgccgtcgctgcttgatagcgagtgcttctcgattcgatttgcatgtgtacgcactcagctgtagttctatgttagactgtgata

SEQ ID NO: 35067 - DNA, 1501 bp, Oryza sativa
gcaattagacaacgggacagtgcgtttaggcgtcgactaggcgatagaaatcaaaatttaggcgtgataaaatttagaagcgccacgcgggaccgactcggtatagaaggggatttaggttcccttatttgagagcctggagagagagcgtaatccctgcctaccccttttttcacaccgccacgagcgacggctccgtcgccgcgcccatcgatcttccaccgcttctccacgtccttccctctcctcctctgcttctccacgttcttctccctcctctgcttctcctgctctccatctcatccttcatccttgccgtcaatggaaggtggcaaacacaccgattgaagcagtcaagtacggaaccactcaagcagcttacgccaaccctagatcaggccatcaggggatcaggctcccctccaccacctcacctcctctgttcttccagttctagataaatttttcttcctctctcctagctccagcccctcagatttataaagttatgatttatgaattatgatgtgcatgtacagtggctatactgatgtgttcgctatccctatagatttgtactaaacccaatgcttcgtgtgcagtgttagcgcgttgtatggacttgatgatttctgaatttaactatgatttatgctatttgcctaaatgccaatatttaccgagtaccgaatgtatagaatcagtatttttgtgtgaaagaaatagaaaaaatgtctaattcgcctaatccgtctagtcgccgcctaatcagcctagtcgctagtcaatcggtggccgtccgactagcgtttagcgactaggtgaacactgattaaaatattatataatatgacaatttttttattaatgtttgtaataattaaaattcaattaatcataggctgtgtatatccattatggatataaaggccgaattttagcctattttataaaaaaaactcaattaatatactactgcttttctgcttttcttgtacgtgttgcgtgcatatcttactcaagttcgaacagagccttggataggtagttgatgcctagcgagtttttttcgcggacgcgtaaaaagattacacatcaatatattagatgcctagctagttagcttctcaacttatgctctcatggctcccatgcatcacgcatgctgcccaaaaataacaactgaagaaatgctgtagaaaacgatgggaggaagaaggagaagagagagagagagagagagagagagagagagaaaagcagaagaagaattggccatgcatttgtggacatgtagtggagtggctacacggttggacatgcatgtttgatcgcgagtgtgctgtattgcatggcttgtggtggctacactaccaacatgctcagtgtggagattatgggtaccccatacccacacggcatggttatccgactagttataggggataacttatatatatggaatatgtaacagatcatgacttgggtattacgtttcctt

SEQ ID NO: 35068 - DNA, 861 bp, Oryza sativa
ctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacggccttgataaataatattgtatagtactagattcgtgtttgcaaaatagccctgagcaactaaatatctttaaatgctgtttactgcaaccctaacccctttatagtataactcctttgtactcccttgcatttattctgcacttgtgggtgtgtcttgttgagtacggtggttgtactcagtcttgctcaatttttcccaaacccagaagaggagttcctggaggatgaaggctttggtgtctagctcgtgcctgccgtcaagcgcctgtggtcgtcgccctagtcttccgctatttctcgtttgtctttgtgtgtgctgggccttcgctgcccctgtaataaattatctatttacgcttccgcttgttaaactctgaattgtatcaacttttggtgtaccttgcctcctgggacaagggttaatgcacgcacgcaaggaacgcccgttgggtcagttccggtcgtgacaagttggtatcagagcccccttgaccctaggacgagccttagatcccaagccttagcaatattttcaaaataaaaatcccttcttatttgtgaaaatcctctattctctctctgtcctgctgcttcatttatcgccaaaatctgacctttaaaatgttgcttttctttttgtttttgtttgtaga

SEQ ID NO: 35069 - DNA, 402 bp, Oryza sativa
aatagcaaccacttacatatctgatgagataactaatgagaaagatttggactatcttgccaaatgtaactctccaacacaaggagatgaagagctggatgatgaggaagatgatgaagaagatgaagaagaagctgaacctgaagccatcatttatgatcctgaagatttctgattgtgttttatgtcttgtattttttttccttgcttatgttgtgaacttgtggtcagtgtgttcttatatgttgtggacaagacttgactaagataagctggatgttggtatctttgtgttactgaaatatgctatatctgatgtaatattgtcttaatagcatttagtttatgtatttaattatactagtaagttatttaattagctgtatgtgcatgtgcagatca

SEQ ID NO: 35070 - DNA, 1501 bp, Oryza sativa
cgttgccgccgtcgctccagccgtgcgccgccgccgtctcggtcgtcgccgtcgctcgggaagaccgccgtcgtggtcgccaagtcgtcgccgtcctcgtccgccccttcgccgccgccgaagaccgccagagcttcgtcgccgtcatcaacccgaaggtttccgccgtttcctcctcgtcgccgtcgtcgtccgttgttcttccgccgccgttttggtcaccggtgtgttcgccgcgtcgtcctctacgtgctggtggcctccgtttgcgtcctagtgccgccgttcgccggcgagcgtgcgccgcccgagccgtccgctctgccgagccgccgccgctgtcggtgacgtcattgccgacgtcatcggggtcgtccgccgtgagccggtcgtggaccgttcgatctcagccgtccgttttggattggatcgatctcggccgtccgttcgcgtgaaccgccgcccgtgcgcccggtccaccgaaaccctagcccgctgacgcaataatcttcttttccttttcaaaaataattcattattgcgtcataattcaatttaaaccgatttaagtgttttaatccgatttaatctttaaaaattcataactaattcatcttagctccgatttagttggttcaagtctctaaatttttctaaaattgagatctacacattaaaaatatccacatgtactgttcatgcttgtttatgtgctgttttggtgattttgctcttttctgcttagattccgtcgtttccggagagtccgttttcgccggagaaactatctacctctgtagcaatttattatttgcgaatattaaatagttaattatttgtactctattatcaattttgttattgtgtgcctcggttgattcctggacgagggtttaacacacatgtaagcgtttggaattttggatagaaattccgggcgtgacaagttggtatcagagccaccctgaccttaggataagccaaatggtaaaccttaagtagccttcaaaatattttgacaaaaatagaactgctcttctctattctcttataaattaattaagttggcagcacatgcaaggttatgcacaaaatcaatttaattcattttcttttttttaaaaaaaaaatttgttcttctcaaaatgtttcttattccgccttagtaaacttcattgattagtcggcactgtacatctattatggtatcgatacaatcatggtagcacaagtactactcatctttcttatggtgacactgtaccgtgcttataatagatcataagtattttagttttattttagttatttgtcaaaaaaaaattaaattatttgtctctgtccaaaaagttaaattctaaaaatatatatatataatagcttagtatgtgtcttttcttttaattttcttcctctttggtcaaatcagttaagtctagatggtgcagctaacttaaaaaaaaatatatgcattaattcctctcttctatgtttctttaga

SEQ ID NO: 35071 - DNA, 1501 bp, Oryza sativa
actctcttcaccatcaggacaggtataggttccatagtcttgaccatgaggcttgtgaggatgatactggaaagctgatgaatccaactcttcttcaaagcgttgacgcaactctccaatggccaccaaagctgcttcttgacaagcatggctgtacgatcttcctccagcttcgaacttaatggacggaaggtcttcacgatcactagccaacgtcacacgaacatgacacttctcctcgttggggtcatgggaaatccggcgatactcaggagcaacttcatagcctacctcaaaagccatcaacctcaactccctgacgaatcctaacacctagatcaaatttctcggtgaatggggcggcatctaaagaaacatagaagagaggaattaatgcatatatttttttttaagttagctgcaccatctagacttaactgatttgaccaaagaggaagaaaattaaaagaaaagacacatactaagctattatatatatatatttttagaatttaactttttggacagagacaaataatttaatttttttttgacaaataactaaaataaaactaaaatacttatgatctattataagcacggtacagtgtcaccataagaaagatgagtagtacttgtgctaccatgattgtatcgataccataatagatgtacagtgccgactaatcaatgaagtttactaaggcggaataagaaacattttgagaagaacaaattttttttttaaaaaaaagaaaatgaattaaattgattttgtgcataaccttgcatgtgctgccaacttaattaatttataagagaatagagaagagcagttctatttttgtcaaaatattttgaaggctacttaaggtttaccatttggcttatcctaaggtcagggtggctctgataccaacttgtcacgcccggaatttctatccaaaattccaaacgcttacatgtgtgttaaaccctcgtccaggaatcaaccgaggcacacaataacaaaattgataatagagtacaaataattaactatttaatattcgcaaataataaattgctacagaggtagatagtttctccggcgaaaacggactctccggaaacgacggaatctaagcagaaaagagcaaaatcaccaaaacagcacataaacaagcatgaacagtacatgtggatatttttaatgtgtagatctcaattttagaaaaatttagagacttgaaccaactaaatcggagctaagatgaattagttatgaatttttaaagattaaatcggattaaaacacttaaatcggtttaaattgaattatgacgcaataatgaattatttttgaaaaggaaaagaagattattgcgtcagcgggctagggtttcggtggaccgggcgcacgggcggcggttcacgcgaacggacggccgagatcgatccaatccaaaacggacggctgagatcgaacggtccacgaccggctcacggcggacgaccccga

SEQ ID NO: 35072 - DNA, 1501 bp, Oryza sativa
cataactttgattaattatatacttataattgttttttatatgatctgtgtggctgtgtactatgtttctagtagcatgtgttgcatcatgtagtaaacaacggttggataaaatgatttggaccggggtgatgggttgttctgtgtgaacctagtttggcggtaatgtatctatgtaatcattgacgggcatggtctctatgtgagcctactgttgagatgtgtgctattatagtttagcaagttgacttggtcaattaaggacttcacttcataagccgttgatctaagcctatcgtgcaaccacatgtcctgatgggaaggacttggcctagtaggattccgagtcttggcacccaggtggctagacgataggtgttaaggttagccatgggtactttctcctttatgtgagggaatgtgtttcattgggtaaggcagtgttgcggtggagtttctaaaaagccttgttctagactccttggccgcacacaatctaaagtttgacattgtcgaactggccgtcaaaaagatgatgtatcttgtgggtaagctgtacaacctctgtagagtgttaaactaatctattcgaataaccgcatccgcggtcatggacatgctcggtgatatctcatgagaggtagtttgcgaaaacattgaatgagaatgacttttgtgcaggttaatgaatatagctgtgtggtcttatgtggacaggtcccgtgtgggcagtcgaatggtaacacccattatttataactgcaacagctatgttatgcaaaatagctttagcctttctttgtcagccgtgcatatggatatttccttgtactttgctgagtatttgatgtactcactttacaattgcctcaactccaaaaggaaagtttctgctgttctttgaggaatttgctgctgaagttgaggactaggccgtgtgccccagttgactgcttgtggcatgttgaatggagctttttgtgcatttatgttcttttccgttgtgctatcttattcttgagttgcccttaaggtaaataaatgtaattaagtggggccataaggcttattacaatcattttattaataaatattagctttcctgtgatattatctttgcctatgttgggtgtcatattatctttgtcactgtatgtgctaggtggatcttggattagcacatatacatatgaggtcctattttgggtcctcacaagtgaccaggaacccggactgttttggggcccggacacactcttgccctcgtacatgacgcatgctccacttattggagcatagtgacgtgcaaaatccatatattaaggtgttaaacgtaggggatcctagatggtgtgtccacggtcccctactctgtgtaggctgagcaaatctcccctagcaaagcttacaagaaatacatcctaaaaatgataggaaaatatagatttggggccacttttgtcgacaaatgtatcacccctcttggtttaagaggagtgtc

SEQ ID NO: 35073 - DNA, 1501 bp, Oryza sativa
tgtgggtccctgataatgcaagccatggttaaccttttaagaagtacaaagtattgtctgtcatctgaaagaaatgatttgagctgagaggaaaacctctgtagtatgtctaacctaatttagcttcagtaaagattttcctcaggcaaaaaatttcaaactgcgaacacctcaacaggatatgtattttagaagggtgataattttgttaaggttcacttttgttagacataaagcaatccactatcctctgtgaactaaaaccaaaagggcatagacaacatacccttatttcttttttaattattgtactatttatctcataattattttcagatcaaatactttataataaatttatgctaagcttacccatgcaggttacccattctagcccaagcaaggaaagctggtccaccaaaaaaatcatctaggtctctgtctgtaacattaaaactctgaaatagaactcagtcatcagcaagggattgaacacagcaaaaattgcattatgattccacagtggcatatatggaaaacaaaaacagtggcaatataaatgtcaaactgaagataacttctggatctgtaatgtttaaagatgccagattgatcacaaaacagcaatggtacagattagtatgcagttaatgcaaattttttatcgactatcgtttgggaaaatggtcgataaaattatagaaggcagcacaaaagactggcactcagcaaagataatattccaaatagtgacagacacggagataaattagagtatttgattcgagctttctagaatgtaaagttcccttagataagcgagagagagagagagagaagatcacgcatcctattggactgagccagcccaagtaacctattgggtaaggaaacagacgcagcttctgctaatttatatgcatggcccatcataagcaacatcactggttgctgtatgttaacaatttagactccaaaaagaatttgaaaatgtgcttcagagtttaaattgtgtctgtcatactaccttaaaaaccttttgccagatagcttcctgcccggtaaatgctaaaggcaaattaattccttgaagtgccatccagtcaatttctttctcccatcttttccaatcccaccagacaaatgagtctatagagatgctacatgaactttgtcagagataaacagttggaaaccaagtaaagaagagtaaaagtagccagattgggagatatttcttacaaactaaaaatgtgtggtttgatcttgaaaagaacaaaaggtagatctttgaaacaggtagaatacagaaattaaaaaaaaaacttttggcagaattgcaggactgaaatgcttagaccaaataaaagaacttcaatttgacacgcacagtggcaataatagatttatattgcatcagtacaaacatataatcatgatggcgttttagaaatccaacaagcatttgttttgcaacagacctagatgaccaattccataa

SEQ ID NO: 35074 - DNA, 1501 bp, Oryza sativa
  unsure (1)..(1501): unsure at all n locations
ggtcgtcagctgagctccatcccaaccatcgcatacaaggccccctcagctgttgtgtcttttgtttatgtcgcagctagactgtttcattctaaactggaatgttagaggcttgaacaaccaagctagaaaaggaagtgttaagcttttggtagaacaaatgaatgcaacaatagtctgtcttcaggagacaaagatgaatgaaatcactgatgttgatgttctacacantcttggtaatcgtttcagaaatgattttgcctatctccctgctgatggcactagagggggtattctgcttgcctgcaatggcaattttttcagcctctccaatgttgttcagaagcagtttagcctcacagcaacagtaaccatgaaaaacgataatgctagatggtccttaactgtagtttatgggccacaacaagatgctcagaaaattgaattccttgctgaactccaggaagttgaacagatggtttcccttccttggcttttaattggagatttcaacctaatctacaaaacctcagataagaacaatagtaggctaaacaggggaatgatgcagcgtttcaaaggtactctggacaggttggggataaaagaacttcacctttcagggagaaaattcacttggacacaggagtgtgctaacccaacccaaacaaaaattgatcgtgctttctgttgtcctgattgggatgtcctctttgactctgcgcacatgtctgcactctcttcgtcctgctctaaccatgcccctttattcataactggctgtatggaaagagaacaaaataattccttccgctttgaatcttattggctcaagctcccagatttccggcaagtaactgcagagtcctggaataggccactacagactaccaatcctttcgtgcgactccatttaaaattaaaaaggcttgcaagagatcttagaagatggaaatcaaccagaataggagatataagattgcaattggcaattgcaaatgaagtagtctttcaactggatgttgctcaagaggatagagtattatcggaggaagaacagtgcctccggaaactcttaaaatcaagggtgcttggactggcagctttagagagaatacgactaaggcaaagagccaggatcacttggttaaagcatggagacgttaactctaaattcttccaaatcaaagcaaatggtagaaagagaaaaaatcacatacagatccttcgaactccagatggctttgctgtaactaaagatcaaaagcaggaagaattgaagcgttacttcacacaaaaattaggagcctttgctctcagaaatcagagattaaacttggctgctctcaatctccctacgcttgatctctcagatctcgatgataacttcactgaagaagaactcaaaaatgcaatctctgacttgccttcggaaaaatctcctggaccagatggatttattggagcctttttcaaacaagcatgggacataataaaaaca

SEQ ID NO: 35075 - DNA, 1501 bp, Oryza sativa
tggcaaggcaggttgggctaaccaaatttggccatgaggggatgagtttggctaatcatttagcttagccatcctaatagagaggttgttggagtggattttttttggttaaaatagccaaatttagctgctctaagccaaaacatagggggtgtttagactttagatccagggaagtaaagttttagcgtgtcccatcggatacacagacacacatttgaaatattaaacgtagtataataacaaaacaaattacataatccgcctgtaaactgcttgacgaatttattaagcataattaatccgtcattagtaaatgtttattgtaacaccacgttgtaaaatcatggcgcaattaaacttaaaagatttgtctctcaatttacacgtaaactgtgtaattgatttttttcgtccatatttaatactcgatgtatctatccaaatattcgatgtgataaggtgaaaaatttcaggtgagatttaaacagggccatagtataaagtttcttcgccttctgcgtgcggtagtgggttttgagatgaggtgatgcgagagggcgtcgtacagcgtgcagattacagacgcagatagtacttgtgtcattacagatttattacagtgcgtaggtagcaatgcatacagcagcgttagtgcgtgatgagcgcacgaactgaacgcatgacgatttttattttgctgtcaagcaacctctgagcggaagcaaaagattttttacggctctaaattttttttggaaaattggtcggtaatcagatgcaaccgaggcaaacaccaaactagttaagcgcctggaactgcacacatactagttcgctacaaatacaccttcgagctgaaccatcatccatcaatacagccatacagcatacaggagcatataccgagttaccgaccatgcccgatcgaagttgggtagtagatacgaagtacttgagtagtagtatactgaagtctaaaggtataaaagcaaaataaaagacgatactccttgtagctagggatgcatcatgcatggacacacacgagcaatgcatcacaaaagctcaacttatcctaaacatatcgatctaaaattctaaatagtccaacttaccatcttcatgtcagtcgtcatccgtcaggcgtccatgacctataactactctaaggcagcgttcgttcggaggacattgagggagaaagcacttcgtttttcgcacacacgctttccaaactactaaacggtgcatttttttgtaaaaaatttttatagaaaagttgctttaaaaaatcatattaatctatttttaaaatttaaaataattaatacttaattaatcatgagctaatggctcacctcgttttacgtatcttctcaatctactcaatcccattcttctcaaacacaccctaaagctgtgtttagttcagcgtaaagtttagattttaattaaaattggagatgatgtgactaaaaaattgtgtgtgtataacagg

SEQ ID NO: 35076 - DNA, 1501 bp, Oryza sativa
catcgtcacatatagctttcttccctattggtgcaaaacctccaaaaagaacccagaattcaccagaatctgattctgcttgcaattttccatcatctatcacaaaaattttgtatgaaaatgtgtagatttgtgccagaaagttacatgaattgagatttggttgtcgagcataccaacaatcgcaacatcacacactccattgtggtatgtctcctttaaatgttgaatcgcttccaaagctttcgctctctcttgaatattggagtttgcaccattgaattgatatattttcttttccgtatccaagataaatacatcatcatgattcaatgacgagcgagcaaatggaacctgaatataggacatttagtgtatataacatgaggagataaagtagtctaagaaacagggaggtgaaatagtagtcacctctttaactctgatagctctcttccctttgcaaatatatagccttgtttcaaacttatcctcttcaggtgttttaaacccagaggcgaaacctccctccaagggtataatgcatggtttaaagtacgataggaacttatcagattcatagccttgaagttctctgtgctgcactgcacgacctccgagcatggtgtcaagttcaactgtcttaattgctgcagtcccagcttcatcctgaatgagaacacatcaaatcaagaagtgggctggaaatgccatttatcagtacatgaaacttgagatgttagagaaaatgtacttgactagaatctttcccaatccaaaagtggatgtcaaaaagataggcgccaccacctttgctgcaagtcgtctacaaaacaaaatgaacagatcattgaaactttccatagtggagataacagaaagattcttctaaaatgtaaatataaaaaaaatcacctggagaactatatatgaatctccattgtaaaatttaccgtaatctgcttttggcaaaggaactggcttaaaatcttgaatcctccatatttctgtgccactatattttaattaaggggctaacagcataaaaggatagaaactcttgtacgtagatttctaaaagaagacaactaaaacaaaccataaaggcatttaaagaaggatacggtttttggccaactccttgaaatgcaggatcaagcactggttttgcacttgacattgagcagcaactttacaaaggtttaattgaaaacagggtagtggaagatggctccaccacagaataataggaacttgcacactgaaaaggggaagaaaaaattatatgtcaacaagattagaaagaaaaaatagccaagctaatttggacttctatacatggatcgaaagaccagatgttaaaagagcaatgatattcaaacaaacaatcaactcgaatcaagacaacaaatagagtagttagctgttgggaaatatgaatgaatggaacacacaagtgaatgatcaaaacgaacatatcctgaatgaaaccatcgtaaaa

SEQ ID NO: 35077 - DNA, 252 bp, Oryza sativa
gtaagacctttttttgtaagacttcccttgtgcctacgttcttgtgggatacactacattctacatttcttttgcattctccggtgggtttattttaactataaacagtgacaattatgaaagtacaactctattgagtatcataaatatatatctagtgctttttggcggtaggtctaatcattctgcagtgaatttttgaaacttcttcaaataagagcttcatgttccccttatgccctccaatatggt

SEQ ID NO: 35078 - DNA, 1501 bp, Oryza sativa
tcctctctgaccacgcagtgtcgaaacaagatttcggcaatactaaaagggggtggctatcaagctgaaaaagtagatgggttcagagacaaggaattttatataggttcaggccttcttattcaagaagtaataccctactcctgtccggggattgatccgccgagtatattattgattgtatgatctgggagaaaaaatcgtgcccctagaggcacccggacccctccttatataggggaggagtccgtattacaaagtacagaccatatccctaacggaataggtagttacagataaaatacaatcgtaaccgactagaaccttggatatttccttgacatacaagtttaatatttaacccgagtccctttaaagatattctatctatacatggcaccccatacccagtcggttatacatgccgtgtaggtatggggtatccataatctccacagtagcccctgagacctttacagtcgacgaaatagtcttctctcataatccaaaaagacaatccgagtgctttaacttcctctgttttggtctcccgagtaataaaatcaaagactgtgaagggctgaagaatagaaaaaatcaggtgcatcgactagatgcacctaattaggtgtagcccccgactatgtggttagttaaataaaactaaacatatagtcagagtgcatcaagacatccatccgagtggttttaaaccaaacggtctaaggctaagcatgtgcagcatctgataaaacctcctgccgactgcttttaatgcgccaaagaaacataaagaaaaacccgagcgagaagcactctaaaggtttataaatcaacatagatgataaaaggccgagtaaaaactctcaaaagacctatcaaacgtggcataaaatttgataaaagatgagtttaaatagcctaggctatgactcatgccataatcaaaataagcatataacatgccgaatggatgactgcattaaaaccaatcatctcaagaaaacccgaacagcatttgtagcctaaaaggcctacaaaattagtataacacttttctgttgggcacctttttatttgcatcgtagtaattccaaagaattatctaactgcatcaaaaaggattttagcagcatcgagtcacatcattatgagcacaaattgccaaagcaaaaagcgcctaagtccctagggatcacaacgggccacgctgataataatattgggctgaagtactgtacaggcccaggcccattagtactcccgataccctaacaaaacaccgaagtccaagcgacgcttcgtcttccccgccgagactctcgccatttccccactccttgctacagttaaaaaccgcaccgacgaagctagggttcatcaatccgccccaatccattctcaaaaatcccacgaaacttctccgcgcgtcctccgctccgattcctcattcccctccagctatatcttggaccaaatcaaaccattccacacgcatcca

SEQ ID NO: 35079 - DNA, 604 bp, Oryza sativa
attttggaaatggcagataagactccaagtttgtctggtaaaaatacattcaaattcttttaggtaatagtgatgaataatgtaattgaacagtctgtccaattactttgttacagtttcatggcgggggtgttccaatattattgtcgatgcgatagacacgaacaccacaacacggggccggctaaggccttgtttagttggggaaaaaatttaggttagttgtcacatcggatatacggacacacatttgaagtattaaacataatctgataacaaaacaaattacagattccgccagaaaaccgcgagattaatttattaagcatgattaacctgtcattagcaaatatttactgtagcaccacattgtcaaatcatggcgtaattaggcttaaaagattcatctcgcaatttcccggcaactgcgtaattggttttttatctatatttaatacttcatatatgtgtttaaatattcgatgtgacaatatgaaaaaatttgtttgggaactaaataggccctaagccaaattggccagatgtgatcgatcgttcaaatgggcaattatgtttgctaggcaaaccatgtggccggaggcca

SEQ ID NO: 35080 - DNA, 531 bp, Oryza sativa
tgaatcatcgtaggctttgggttaaggcaggttcgtgtgggttcacggctttgataaataatattgtatagtactagaatcgtgtttgcaaaatagccctgagcaactaatgtctttaaatgctgtttactgcaaccctaaccctctatagtataactcctttgtactcccttgcatttattctgcacttgtgggtgtgtcttgttgagtacggtggttgtactcagtcttgctcaatttttcccaaacccagaagaggagttcctggaggatgaaggctttggtgtctagctcgtgcctgccgtcaagtgcctgtggtcgtcgccctagtcttccgctgtttgtcgtttgtctttgtgtgtgctgggctttcgctgcccatgtaataaattaactatttacgcttccgcttgttaaactttgaattgtatcaacttttggtgtaccttgcctcctgggacaaggattaatgcacgcacgtaaggaacgcccgttgggttatttccggtcgtgacatttgggcataacaga

SEQ ID NO: 35081 - DNA, 217 bp, Oryza sativa
catgctatatttacaaatctgtgatggaatagaaaaagctaaaagaaaaagtgagatcaaggggaagggaaaaaaattttggggttttttttaaaaagggaaaattagatctctctccccttgagccgttggctcaagggggccttgaccgcgccctgatcgggggcgcccagcccaatggctggtgggcgcccgtcacactgcgccatataaaaga

SEQ ID NO: 35082 - DNA, 1501 bp, Oryza sativa
agtgcctatatatatgacagaatgacacatcaaccgattgagacttcttctctcttataattgaaatgaaattaggagaaaaaaattaagtttgattgtgacaactgacaaatccactaattaatttgaatctttaatttcatctatatgcatgtatccctcacgaaaaagaaaccatccaacatatatcatcatcctccagagcacattggttttatgaggaaagagaaaaacacatccaaagttaatctcttatgtttccccttaaagatataatgaaagtacaacttcttgtctctgcattaacgagagaatgcacacaatcattacgctgccatgatctaataaagatgccaattgccaaaataaattagatcacatctaaagtttctctagttagcaaagtgttttttttccctggattgattattatttttgttcttccatgtatatatatatctcacttgtgtaggagagacatatattatatgccctaagattatatcctgagtacataatcacaaatgcttgctttgtccagaatatttgttggattgatgccctagaattgataggttttggcctatgttctatctaattaatttatgccacttttctcaccctaaaaaaatgttctaattaatttgatttgatatacaggatcgaagctaggtgatcttagctagtctatatagaaaacgcaaagttacacatttagaatctcatttatttaaagagtagtgttcctatatcatggtatatgtcattgtagcttggtagctaaattaattgcaatggtgtcatgaacttgacacaacataatccataattcaaggatgcatgcatgcctctaccatgcatgcatctagctaaaagctaacatggatcactaactagttgtaaacttgtaattaattaggccccattaatctccatctaggttaacacatttgctaggagagatgcaagctaatgataggacatggatgactgcagagagatgtgagagatagcattagctaggtcctacattattagataagcacaaagatatatattttatgccagggctagctttgcatgccatcatacacaagcgcacacacacacacttgttaatcctcctaatgatcaaatcaagctctcacacaagctattatacaaaaggccaccattgtttccttctgatgcttactttgcatatcacccattaaccaattacttaattacttaattgtttctcctcccatggcccccacatgtaatacacacaacctgccactctcatccctaacctgccaacctatgtgtataaattcccagctccttccctcccatctgagaagaaagcagcagcagcagagaattcatcacccagcaagatcagtcaggatcagctagctaataagctagctacaagcttgattagtcacaaaaccacaagacaattagctagaagtatatactgagatgggtgaggaggagaagatcatggcagctg

SEQ ID NO: 35083 - DNA, 232 bp, Oryza sativa
agcatacaaacagacagtgagctaaattaaatagcactcctggaggcaataaaattcagaatgcattgtacacaggctaactaattttgtatatagacttcactcaatgtgaacacaactatttttgacctcctctaatgtatagattataaagttttttttcctcgaggggagattgtatatatgttaatggtactacacttgtagacatgtcacactaattaattggaaa

SEQ ID NO: 35084 - DNA, 1501 bp, Oryza sativa
tgacatcaaaccaaatggacccattactactttgccattaccaatttttcctttttgttgttaaggttgagaatggatgcaatccacaagcccccctaatcccaggtccccgcaagtgcacctttgatttggcggagaatgatttggttggttggagtgctgtctcagactcaaattctcagtgcttggcgctgacagtgaaggaaacatcatccagatgtttgttggttggcttttttggtttactatatatactttggtcactttggtgagtactagtggcaaagaccagaaaagtgcctcatttttttctttcccgaatttattttaccttttaaatattaaaaataaacatatcaaattttatttttaaaaatatgaacattttgccacactatcctgacgtggcaaaataacacgtgtcagttttatgctgactacttcagtgtgaaaaaaaaagtcagatttaaaaataagtattttgggggaatttgttttttaaactagttgaaaccccgcgcgttgctgcggggataataataagtaaaaataatgtgtcaaatagctaaacaacataagattatgtaagttaacatggtttatgataatttaagtttaaataatatatagaatgataattcaaatgtaaaagtaagatgctatgattttatgaaagtagaaaaatgttgagatagtttggacagtatattaatcatctaaaggctaaaattaattaaggtgatatggattaatgagagaagaaaatgagagataagttggaccatagattaatcttttaagcactaaaaataattgatatgatatatgacttaatcagagaaaaaagaaataacattaactaagagaggatgaactatataggtacatagcatattataaaaataatgaagatatatattgaaatataatatgaattatgtgggatgatgatttaacacgcttgcattttgaaagctctaaaaatttaataaattataaaattatagataatatagcatgtttgcatgatgtttaaatttaatgattgttagtggatagtgatatgacatctttgcatattaatatttagtagttagtgggttacaactttataataagagatgataaataattattagaaagtttgaacaaataaataaaaaaatcgctgccatgtgaacaacacactagggctcccatcggatgacctattcagccaaagaaaaagcaaaaatttaaatttttaaacttaattttgacattgattttgagatatttttaacgtaatttctttttcagcattgacttttaagtcaccaagaacacatatataaaagttttacctataaatttatttttattctttaataagtcgttttggcttaatacgaaaaaagccaaagaggcccctaggagagtggcaccactggcaaagcagagtggagctgtggaggatcagcagcagcagctttcccttagctcgcgagctcatcagtcatca

SEQ ID NO: 35085 - DNA, 382 bp, Oryza sativa
ttcctgcacccatcactgtgggtttcttttgtttgttgtgtttatatttaactgccactaagattaggcttacgtgccctattaccacagctacaaaatctagcaggcggtggaaaagaatgtggttaattaaattttgggaaagtagatttgattaaaaggtttgtgtgagctttcagtggaagtgtggttaatttcacccttttgagatctgataaaaaggtgagtgatacatcttcttttcttttcttctaattttttgcttaccgttggactatatgtgtagagtgtagactcgaactagaaggttccatcttccatggaagttcatgaaagagcgagcctagtactttaggctgtgttcgccatttattgttctagg

SEQ ID NO: 35086 - DNA, 166 bp, Oryza sativa
acctgcaattttttatatacacttgttatatcattcattactgttttgtactgttttgcacgcagctgaagtgcattattcgtattctctagccacagttaaaagtacttttcttctgacttacctagtgttcctgacataaataacaagattgtatgatgaacag

SEQ ID NO: 35087 - DNA, 1501 bp, Oryza sativa
tggcccttcctttagcccatcaagctcatacaggacaccgtccacaggaacatagctaatgaaatggtagacatcatcatccttgacagatgatttctgctcctcggggacttccggccttgcaaatgaattactggccaaacggatgctctcagaattgactatagccaatcctttgagatctggtggcaagtcctttgcaaactcctttagctttttgagctcctcactaagggtgatacccggagagtttaatagaacagaaacgatagcttgggtggcacatgcattgttaattatctgtaagtgaagcattgagttgatcataaaaggatgcagaggagtgaaggctacacaaaaataaacatataaacagctctgacctgcttagcaaagaaaaggtttgggattgggtccttgataggacgctcatctttttctggaggttgccatttgtacagcacaatgagcccataaactggcctggaaagcaccaagttaagttggtttagaaaagaatgaaatttatgatactgctagcaggtattaggattacatactgaagatcattgagggcatccagatcgagtgaatagagttcatcaacctgttaaggaggaataacatagaatgtcatatattaccattcaaggtcataaaaaaaattctagtgtcacagatataagcaaaagtagaacaagatctccaaaaacatatgccagtacattgcatgcatgttttgccatatgttttaccaacaaaatttggcaacaaggttgtatttgaaaagcatagtttttattattcgtgagctaagctaaaaatagagtttcaagaaacaacatcacacacaaagtgttcaatacctgaaggcaaaaacatatattttcagcaaactttagagcataacaaagaatggacttaagtaaatgggttacatgattacttacttgaagacccttcagttgcatctgttgcaacagttcagtaaaaatgcctacagaagatatacaaaagaagggttattgcctacttcattggggaaaaaaaaagccaagtggccaacatttacaggggaagcaaggaatttaacactgaataagaaggtgtaacatggcagatagacctagccttttccaattccaatgaaatttgagttatcttccataacagctaattgactgcgcctcctgttcaatgtgtcccttaggactactggactagaaattaccagagaaaagctgtgaaacaggcgtatctgcccacatctcaatccgctattaccatcgaacactaaacagttaaaccggcagctcagaacaccaaggtccaacagcaagcttggtaatctcatatgctacttaaaccatagatgatgtttctttagggtagtcagaaaaatggcccataacttcaggaggagttctctccaatcttgtgatgagtaaagtggtactacttactactggtagtagttgtttattaaaacacaaaacaaatt

SEQ ID NO: 35088 - DNA, 1501 bp, Oryza sativa
atcgtacgaggaagggactatcttccgaaggttgaagacgacaatgggttgtgcgagttggacctacaactccacgtttgggctggcccgaagagtgaaaggccgagcgtagtgaggtagcgaaccgggatcgggctggaaaggaatgaatgaatgagctttcggtccaaaaccaaacgagtataatgtatagctatcaaaaacgtttttacccgttgcaacgcacggacattttcctagtctgtactattataaaaattgaagatgtttccgcggtccatcatccgtgtttgagtcggttataaaaattaaagatatttctgcggttcgtcatctatgtttgagttggttttaattttatgttttggttttaatctatatctcttttctatctctatctcaactattataaaaattgaagatgtttttgtcggtattttgtacgtcatccgtgtatgagtcggtttttaagtttatttgcttttgaaaatacatatccgtatttgagtcggtttttaagatcgctcacttttggtaatacagaaggaatcatataagaaatctgtttaaaaaaactcacatgctaacttgagacgatctgactcttaactgcagctcatgattttctatatatatatccaagcgaactcccacagtgaatttcatcttaactaaaccatataacaataataagattaaaatagacttcacctgttgcaacgcacgggcattttttctagtaagaataaaatataaaaattgaagatatttttgccggtactttggtacgtcatccgtgcatgagttggttttcaagtttgttctttttggaaatacagttccgtatttaagtcggtttttaagttcgttcgcttttggaaatataaaaagaatcgtataacaaacctcttttaaaaaaactcgcatgctaacttgaaatgaccggactcctaattgcagatcatgattttctgagaaaaatatagagtcggtttttaagttcgtttagtttttaaaatatagaaggaatcgcataagaaatctctttaaaaaaaacttgcatgctaccttgaaacgatcagagtcctaattgcagcgcatgattttcttaaaaaaatatatatccaaacgagttcttacaatagatttcaccttaactaaaatgtataacaataataagattaaaataactttcatctgttgcaacgcacggacttttttttttttggttagaataaaatgtatgggtcagccgggccgtgtctcgtgcttgggtcgtgtcgtgccggcccatgggttgtggtagccgtgccggccagcccagtcctagagtacggccgtgccccggccgggtcttggtccggcccatttgacagctatactctaaccctaagtaggtcgccttggaggcgctccccctgcagggccttctcccacgcggccgcgccatcacgtccgccgctccctgtcttccgtcccctccaacacaccatggcgccgc

SEQ ID NO: 35089 - DNA, 1501 bp, Oryza sativa
atgatctaaatgaataaatctggatcaactgctgattaggaaattaaatacgaatacgcattgacaagaaaacgtaacatggtgcgcttggtttaacaacaagaaatttgtttccccaagtttccttctcctttcagcctgacaagaaatagataattgtaggaggcaagaccaacacctatataagggccaaggccggttcgattaataccaatccccaatcccaacaatctctataatcgaatcgttcttttacctttattttttagtcatgttttctactttatcctagtttagtctatctttgtcggtttgcgccataaaccgtccgccgtcgctgagagtgtaatacccctttgtaggtttgtcccgtaaatcttccgtttgcccacgagacgggtggttatcctttgttgcacctagatcggcttcgctagccggtctagtttgcaaaatccatcttgatttggtcgttggctagatcggggtggttggcgactccatatcaccgcaaggcgtttaggtgtcctgatcgtgattgtcttcttgccaaaaaaaaagagttgccaacaccatgcacattaaaaagcacatacaggtgctccacaaacagcaagcaataagcttcaccacaaaatgactatggcaagagttgctgttgaatacataaaccagggcagcatcggaagcccttttgcagccaggctgcactaaattttattgacaaaatttgctacagaaaatccagattttgtggcctttcatgtaggatacttagaaaacttgtggttgttgggcacccgaaaaactgataattaattatgggataccgtgaccattgttttattattttctctccaaacgaagatggaaatgggcagatgtttgtaggcaccgtggacgtcggcaccgctacgcaaattctattgttttggagaagtgatcagggggatggagagcggcttgggtatggttcaaacaagacccaattagggtacaagcacccccctcccccgcggggtcggggggattgccttttccacatggtttttaccttcattaggatcaaaaataattaaacaatgatcgcgatgtccggtagctaattactatttttttggaatgtccaatagcgttatcacgtttctaaggtgtcatatgataaagaccacaaactttttgtgttatagcagattttgctaattttgttcccttggaaacggccgaacagttttgaacgtctgtttggatgtggtccttcagttatttggtatttgaacagttgaggtactaaaatgcaaacatgcccgaagtttgaattagacagccgttggagcccttcgacccctccttgtctgggcgctcggccccacgcggtctcccccatttcaaaatagcggatcgcgattcgcgaacacgaagacgacgcaaaagcttaaaaaagcatcctcccaccgcgcgctgctgccttttaaaagagcagctctttccccacttggag

SEQ ID NO: 35090 - DNA, 241 bp, Oryza sativa
tcctgcagcccttttccggaggttgctttaatcttttctctcattatagggatttgtaaattggttaattaatttggaattatcttttctttaattaggttaaatgggaattaaatcttgtaaaattggtaattaattcatatgaaatcggaatgaggtcgttcaagtctctaaattcatctaaatcatgatctacatgtttgtttactttatatgtactgtttatttggagtttcttagt

SEQ ID NO: 35091 - DNA, 1501 bp, Oryza sativa
caacaagcatttctggcgccgttgccggggaacggttgctgatcattttcgaacccagttcatcctttatcctttttcattttttattctaccttcacccctgctatcctagagaagtattcctgtcaaactcttctcgaccttggagcaacctctttttgagctatctgctcctcggggcgaattctacgagccacctccttcatcggagcccatttatacaactggctatgaaattcgtcccgaactaattagtatggttagggaaaatcctttttctggctttgatctagaaaatccctaccatcatctgcgagactttgaacaagtctgctcgtgccttaagattcgtggcatgagacaagaaactgtgcggtggaaattgttctcgttctctcttcaagagagagcaaagcaatggtatacctctaccgttggatgtgtaaacggtagctaggaaaagctgcaagacagattctgtcttgccttcttcccagttacttgtatcactgcccttcgagtagaaattctcagttttaagcaaatcgaaaatgaatcaatcggtgcagcttggtccagattcactaatttagtgcagtccggaccaaccctgtccttacccgagtatgtgcttctccaacatttccatacgggtttggataaggagtctgcattctatctggacataactgctggaggatcattcatgcacaaaacgccgtcagaaggaaaaacgattttggatcgcattctagaaaatacttccttcatgatgcagtccaatgaaccccagctggaggcatccgtgtccaagatagaggaacttctaacaatcgagccacttgctgaaccatccacttctgctagctcgattgatgagaaggttcctgtgtagccgtccgtcgggaatgaagaaattcagactccggattgtaccgtaattatgttcagggacagttttgacgaagactacggcaataccctgaactattttagcaagaggaaaccacccgttcctttgtcacctcccgatcctatggaactcgggttcctgtgagaaactgtccgagttgacatccataatgagcaatgaatggctaagggaggtagagctttcatccgaagtaattcagataaatacggctccccgaatcattccatgccatctagaagggaacgatgtcggtattctctacagtccatctgtcggggccaacctcgtctctgagtcttttgcactcgcttatttaagcgataaggcagtgtccccgacaaacaaattcttcaagcatccgaacggaaatatcatcgaagggtttgggattgtgcaagatgtgcctgtctgctttgaagacatggaggcgatcttggatttccacgtctttgaaattcaagatttcgacattctaatcgggcttcccattgagcaacttcttattaacacaccccgattaggtagcctcaaaataacactgggagagaatgaattttcaattccatt

SEQ ID NO: 35092 - DNA, 1501 bp, Oryza sativa
acgcgttctagttggccactgcattgacatgctttcgaggcgcgggaccgtcgtggtgctgcacttccgacctatgggaacgtggcggttccgctcacccgtgctgcaagaatgatccggctggtggcgtacccacatcctcgttgcaggacgaatatatgtgtgctaatccttcccctacatatatataaacgtaaattattaaaacaaatgtatattcacaaactttttcggttgccattatcgtcacctagcaatacgttctagggaaaaccttgtttgccagtactatgcttttttcttatttatcactcaactatggctataactttcttttcttgtttctatttttttaatgtgtgcttttgttatttatatcttcatgttataagatatgattttatataggtactccctccgtctcagaatatagaaaactaagatcggatgtgacgtatcctaggactacgaatctggacataccccctgtctagattcgtagtactatggtacatcacatctggtcttaggttgctatattctgcgacggagggagtaggtagctacgaaaatatttgtttttatttaagcttggcgattattttgttcaaccgtgaataatttgatttttttatgaacgtggggaactttggattaaactagctcttggtgtgaacggtaataagactatattggttgttttttctttctttttttatgtaacattctgccccaggaacggtgggcttaatggagaattttctgctatttgattgacatgtggccccaaccattgactgctccgttagtttagttagaattaccgagttcctatcccacatagcactgtagcccaccgtgatttccgttcccgttcgcgccacgttgctgctaacgaaataccgttcgcgccaacgaaaagttctgggaagattggtgcgggccccacattgcctagtttaacctcaaaacacaccgtactctttacgataatgctattcgtcggtcgaccgacgggggagaaaaaaaaatcgggtgctccccccgtggccccgttcccgcgcacagtgatattgttggccccaccataatatctgtccctacctgcaacaaatcaactatatattttgaaaaccctatattaaaagaatttggtttatttttttgttccacaaaaaatattgcatatagtatactcacaatgtttcattatgtataaatctaatgttgcagtgagctaaaatattccattgcaaacaaaaaaaacccacatattttagaaacccctattaagggaaatcgttttattttttgttccaccgaaaaatgtttcacctagaatttgttccagagtagattttcgtgatgtgatttctaactatagaaagaacttatatacaatatacaaaaaaatttcctaatcccttttttcttccttgaatcttttagttttagtcagttcatgaaaaaatttatactattaatttcttcttatccataa

SEQ ID NO: 35093 - DNA, 577 bp, Oryza sativa
tcggggactcatatggtactttggttagaaatataattcaagattttcttaaatactgttgcatatcatacatttcaggaagttctacctctttattctcagccttctgcaagtaaatctagctctacacagatattacctctcatgcattcattggtgaataatataatagcttgctgagtacgttgtactcacccttgcttcaacccctctttttcagagtttaattggagtttttgccgaagctgggagttcaatcacataagttagttccctttaaacctagtcttcaagtctagtagtatagttagatggtttaattctatagtaaaacgacagagttgagtcatcatatagcttctgctgtaatagttagccacaaacttgtaaatgtcctattattttatataaagatatctcctttggagtctttaccaaatgtatgcgatgaagatctagattgttgaacctgtatcaatctactgatccagggcttgaaacagttaaacatgtcggtttccgaatcattagttttgggagccgacaattatcacccgggaaaggctaatgttgtagc

SEQ ID NO: 35094 - DNA, 1501 bp, Oryza sativa
tgccccaggaacggtgggcttaatggagaattttctgctatttgattgacatgtggccccaaccattgactgctccgttagtttagttagaattaccgagttcctatcccacatagcactgtagcccaccgtgatttccgttcccgttcgcgccacgttgctgctaacgaaataccgttcgcgccaacgaaaagttctgggaagattggtgcgggccccacattgcctagtttaacctcaaaacacaccgtactctttacgataatgctattcgtcggtcgaccgacgggggagaaaaaaaaatcgggtgctccccccgtggccccgttcccgcgcacagtgatattgttggccccaccataatatctgtccctacctgcaacaaatcaactatatattttgaaaaccctatattaaaagaatttggtttatttttttgttccacaaaaaatattgcatatagtatactcacaatgtttcattatgtataaatctaatgttgcagtgagctaaaatattccattgcaaacaaaaaaaacccacatattttagaaacccctattaagggaaatcgttttattttttgttccaccgaaaaatgtttcacctagaatttgttccagagtagattttcgtgatgtgatttctaactatagaaagaacttatatacaatatacaaaaaaatttcctaatcccttttttcttccttgaatcttttagttttagtcagttcatgaaaaaatttatactattaatttcttcttatccataatggatttacctgggccaatacatgaaattcttgtgctatttgggggatttgttcttctactagggggtctaggggtggtattacttaccaacccaactttttctgctttttcgctaggattagttcttgtttgtatatccttattcaattcctactttgtagctgtggcacaacttcttatttatgtgggagctataaatgtcttgatcatatttgccgtaatgttcgtaaatggctcagaatggtctaaagataagaatttttggactattggagatgggttcacttcactcgtttgtataactattcctttttcactaatgactactatcccagatacgtcatggtatggaattctttggactacaagatcaaaccaaatagtagaacagggtctcataaataacgttcaacaaattgggattcatttagcaaccgatttttatcttccatttgaactcatttccataattcttctagtttctttaataggtgcaattactatggctcggcaataagaaatacttagaatgagtcaaaattataagaatttcaaatctaaaataaatcactaaagaaccacaattttgatttagtaaaacccatctactgccaacaaataccttcttttctcttttgttgtgtaattgttctattctaattaattcaatcggttcaattcttgtccccatattgaaatgaatcgagattgataaggagttagttaa

SEQ ID NO: 35095 - DNA, 733 bp, Oryza sativa
tggcttgtggtaagtacgataagttcttccagggcatcccatgaaccggtccttaattgccatgggtgcgactagcaaaaccatgcacccacagcccaccatgtgattcattttaattaatcaacaccaaagcggtggtactaattcaacattaccattagaacctacagtctaaacagtaataggatctccctcattgtgtgctagttgaactaaacatggctaagcaattcctagtccaaagtctattcatgttataacccaagctaacaaggagcatggtaccaaaatagcatggttgtaacaataggtgaacatcccatagtaacattataaaacaatgcagtatttgaagaaaaacaatagagcatttgcaatataggatcaacatgttcaagtgacaaacatgacttgccttgctctgctggtggaggaaccttggcgactatctggaatacaccggagcgtagaagaaccggaattaacgacatacaaggcaaacaatgcaaacaggctataagactactgaaacagagaacaaaaccatttttaatggattctacacatttttcttgatttactgagacttgaatgggcttaaacggagcacggatgaattagttatgatttttagaagattcactgtgtttattactataaaaaaagtccttaaatcatttattgcgcaataagtcccagggctgacgtcatcaaggggggcgcggcgccgaca

SEQ ID NO: 35096 - DNA, 1501 bp, Oryza sativa
ttaatttcttcttatccataatggatttacctgggccaatacatgaaattcttgtgctatttgggggatttgttcttctactagggggtctaggggtggtattacttaccaacccaactttttctgctttttcgctaggattagttcttgtttgtatatccttattcaattcctactttgtagctgtggcacaacttcttatttatgtgggagctataaatgtcttgatcatatttgccgtaatgttcgtaaatggctcagaatggtctaaagataagaatttttggactattggagatgggttcacttcactcgtttgtataactattcctttttcactaatgactactatcccagatacgtcatggtatggaattctttggactacaagatcaaaccaaatagtagaacagggtctcataaataacgttcaacaaattgggattcatttagcaaccgatttttatcttccatttgaactcatttccataattcttctagtttctttaataggtgcaattactatggctcggcaataagaaatacttagaatgagtcaaaattataagaatttcaaatctaaaataaatcactaaagaaccacaattttgatttagtaaaacccatctactgccaacaaataccttcttttctcttttgttgtgtaattgttctattctaattaattcaatcggttcaattcttgtccccatattgaaatgaatcgagattgataaggagttagttaatgatgtttgagcatgtactttttttgagtgtctatttattttcgattggtatctatggattgatcacaagccgaaacatggttagagctctaatatgccttgaacttatactgaattcaattaatctaaatctcgtaacattttctgatctatttgatagccgccaattaaaaggagacattttcgcaatttttgttatagcccttgcggctgctgaagcagctattggattatccattctttcttccatccatcgtaataggaaatcaactcgtatcaatcaatctaattttttgaataattagacatagaatcttctaaacaaagggacacatataataataatatgaaatattaacatgaatactatttattatttgagaatatctattttttgagtaggttattccatagtattcttttttacttagttgaatttttgcaattcattgatattgcaatttgaatattgcaataatttatattgaaaagacgatagccaatttattggctaattcgaattcgtatatacaattcgtataattatgattgttgaagcccaaaattaaagtctcttggctcttttcatgctttctcacaaacggattaagaaatatattgcattatttgttgaagtttggataaaccattgcttcgtctggtgtctacaatacatttgattgatatagtactaatttcattttgaccagatcgaaaatttttatgttgaaaaggaaaatttatagatccaa

SEQ ID NO: 35097 - DNA, 1501 bp, Oryza sativa
ttcagtctgaatcggctgaagatgatcggatcaaggacagccgatacagccgatggggttgatacagccgattccagtggcgatggctttggggctgtttctagaatctatcaacatgcttcacaaggattgccacgatggagataaagctctcggaaaggcaattgtatctattaattaggatatttttataatttccttagagatatgtttgggcaaaagtctgccgcaaagagttatggtatcttagaatttgttagatataagagtcgtgtccggcaaggacatattttgtaatctcgggtataaataggacccgaacccatgtaatcaattaacacacgttcaataacaatttcggcgcatcgccaccctgtttactttcgttctatttcgacgagttcttactttcggattgagctgcatcgattcgatcttcaactagatgtaaacttatcatggcggcttgcgttctcaggattagtgcttccatctttatgacactctaatcatgtttatgtaattcgtcgagttatcatatacacgttacagtctttgttagttgcgttatataacttgttatcgggtagttcttattgtcaggaagtgaccgatagtgttatgtttggttattaagttagattatatcgtgtatccaccatcacttagaggttttcatcatcttgtttagatcccacgattatctttatgcttaatgctgcatcagttgagttcaatctgttgagttttacttataattgtgatatctggcttgttttatgattatcgagagagatagtatcggggtttcaaccgatcttacttgatttagctactttatatctcatatgcttaattaatatgctagatatgccctttatattaagatcttattgcattaagttatattaggcttcttgtttcaatattctgtttgtcttgatattttaatatagagtggtatcggagtattagccgatacatgctagatctatttgatcagctatgctataaacatctatataatcagtactttactttatatttcgacttaagtgatttatactatctcggcatggcgaccaatttatcccaatcatttagtttaaatatgtattgaagtaaggattatatgttgtcaatatctatagccgatcgagtagatttagtcttatcttatttactcatgactaccgatcgattcaaatatgacatcggcttgaagataaatgatatgtcatcggcgactagtcgatcggttatcgtttatggatttaaccgttgtttttcttgtctttctttcttgctgattgtaggatcaaatcaattggcacgttcacgaacctaaaggcaagattttggacctgcactgaagttaagtagatcttccaggccagtgtgtgtttttcacatcaacacgcttttggcacgcccagtgggaccgagttgcgacaactttttctcatggcagaaaaacaatcaccggcatcgacaggcaagg

SEQ ID NO: 35098 - DNA, 1501 bp, Oryza sativa
gtggccgattgacaaccatcctggtgtgcaaatttagccagatccgcagtaaccaccatggaccccctgtaccgaataattctccagaggctatcttgttaattgcggtattgagagtctgatatagatagcctagcaagtattttccaagggggaagtgcttcttttctaccaagttctcggctacacgctgccagtttgcggtaggaccacagcttggaccgcagaacaagaatttttcgagccacatcataaggaaagctgcatgttcccttggagagactggcccagttcccatgttcttcgcaacataacttgtccaaccgcctatgcttctagtcttgaactcgtgggtgagttgggtatccaaactagacaagttagccgatgaagtgacatctagcccggtgatcatgatggaatctaacagggttggggtcatcggcccttgggagaaaaggaaggtattcatggctctggaccagaagtaagaagtggctgccatcataggctcatctcttgccatatccgctgcagttaaggccaaggcttgggatatgccgatttcttcccagtgggttgatttggtagccgatatcctcttataccaagcaggccaagcttttttcggccaacggccaggatttgaaggtgttcttccagcagctcagatctaggttagcaaatctaaagggaatttggttggtttctccattgataaattctgtggggtctagattgccgattaggccaaggaaaaactggaattcatcagttatacaaggaaacgcaacttggtgggtgagatgctacagaagaagagaaatcgaggattgagcggaagaagaaccaatcttgtgcagtaaagaaagggatttagccaatggtacttgtcacgcccgaaatttctatccaaaattccaaacgcttacatgtgtgttaaatcctcgtccaggaatcagccgaggcacacaataacaaattgataatagagtattattaaacagctaattaatactcgcaaaataataagttattacaaaggtggatagttcctctcaaaagaataaaattctacgcagcggaacaataaacaaaagactaaatagctatggcggctccactccacaagcaacttgacccgaacaaagcctaatcctcctgatcatcaccttcagtgaagtactcctcctctgatgaatgaatattgcaagaatgagcatatgacatactcaacaagccacacagcaaatatggaagtgcacaggataacaaaggatgacatagtatagcttatttgcataaacaacatttaatgaacatttgagagaatagtaaaacagttgagtaattaagcaatattaaataaacaccatacaacacacccgtgttgcataggcccaacctcatctgaacaaccaaccccggttgtacaaatcaaacctccatactaggaatataccattccaaaccaggagtcaatttaaatatcacaggttat

SEQ ID NO: 35099 - DNA, 1501 bp, Oryza sativa
gaatatattgttgcatttgcacccacctgaataaaaaccttcctgactttaagtcctcgcccgaaatcttttgtgatgtttgtgagtaaaaacttgacattaagtcatcgcccaagacattatggcaaaacttttttttttcctgaagtttgttttctttgaggtagtagcaaaactttctaaatttgatgtattatgtttgttttattatcttttagatcttcaatgtattattcttctaatacatattgtgaattttcgccatggcaatatggcataacaaaaattttcttatccacttacactcagcctgcgttcagtgcgtgctgaagcagaatatcaaaccacctcgtttgaacttttaactgaattttcttatccgcattggaactggatttcaatccacctcgtctttttcccccaacctagcgagcccacgagcagagcagagcaaagcagaggcagatgcatgtgtgcttccatcgacgtcaccagggacttcaccaagatcttgattgctcgtgaaggtgggaaccacgcgctggcgcgtcgcggcggcgccggcgcagctgcaggccgagtgggtggctgggatgctgctcacgctggcgccgtcgccacccggcagacggaacaaccaaccggctccggaggatacggttcagggacagggaggaggtgttcgacgcgtgggcggcgcaggcagtgctggttggcggactagcacgaccgcctgagagagcgtttttgtctagagtttttacttattcgattcaaaatgtacattgaaatttgatactagttatgctttccatttggagaacagagtggagttttcgagtacaaaacgtacaatactcggaatgtttgcggtggtcccacctgcaggtcaaaaggggttgacaccgtcggaatgttggttgggctgacccctaccacttccccatcacttgggcacaccgagccaatggtagctgctagctgggcaccctgggacgacagcattgacacgccttctcctctccctcatcaaattttagattttgctaggaaggtgtccgtgcgttacgtacaacggcattagattagattacaaactgaagatctcgaagcttctacctccagttgaacgagatttgagacatgtttagattccaactttttttccttcaaacttccaacttttccgtcacatcgaactttcctacacacaaactttcaacttttccgtcacatcgttctaattttttcaaactttcaatttttgcatggaactaaggttgtgtttagttccacactaaaattagaagtttgaagaaatgaaaacgatatgatggaaaagttggaaatttgtgtttgtagaaaagttcaatgtgatcgaaaagttgaaagtttgaagaaaaaaattggaatctaaacagggcctaaacacagccttggttttgttaagtttgaaacgtgggataaaaccattggtgggctcaaattcgaaagagctgat

SEQ ID NO: 35100 - DNA, 331 bp, Oryza sativa
ttaatggacctcatgtgctgcattttttttcgcgaacgcgtaaaaggattgcacatcaatatattagaagaaaaagagtttagttacacgatgcaatcagccagaccggcttatgccaggggaagggagaaaaagcaaatgaaaaaaatctgaagcttagagaaactacggcggcttaaaacatactccacgcaacagaagggaccaagccatgctacactcccaacaaatccccaaaagcggcgacgccagctaaagaccacagatggccctccgaatggatggactccagaaccactgagaccgaagagagagcggagtcgaaaaccct

SEQ ID NO: 35101 - DNA, 1501 bp, Oryza sativa
atgaacatcttcaatttaatctaaaacataagaatgatcttcattgagaaaaaatatattgcaaaatgctagaaaaaattgttaacaatattccaagaaacaagtcatatttgtgttgagatattttttctacataaacatggccagttgtaatcctttaccattaatattctatgaaacaacaaatgaatacattattttcctcactccactgcatgttgaaaaatattttatttatgatgaagaagtatttgcatttgcatttgtatttgtatttatgtattgttagtgtatccagtcgagaaaacatgtcttatattatatttgtatccagtcttatattgttattgtctaatattgtttccagtcatctgggaagtatttaaatttttttatttacaacttttgtagtcttagaattgcaattgccagtgaaaatattcaatttagtatactacatgaaatgaacatattagctatacttgtgaactagttttatgacatttataactggttactaaacaagacgtgtcacttatcgctacttatgtttcaaagaaagtaacaaagttatctagaagatttgccacataagaagagaagctaacaaaatatagctataattatgatcaggcccaatgctcagctaagttgaaccatttttttatattcgttttcaagatctagcctatgtaccaagtttgagtgggtcgataggtgggagaaaatcaactacatggtgcaattctcactaacagctatacttttttagttgtccctctaacctatcgacatattatactactctcaagaccaaagttaagaaacacaaaaaaatctattagagagtataactttctttaataggatgtagactacatcagtagcgacctaaatatcctttgatcttgtaaccgctcgatgtaactgggggctaagcccctatcctgctcggtataaaattgactggccctcagtcccacttggtgtaaaattgttgtttagttactcacaataatggtatttaaattgcttagtctgaaattatacattgtataacaaacattaagtctattcagaattactgttgaggtggatcttgttacatatataaaatgttgcaattgatccgtaaacagtcagttcaacatgcatgtcattcacgccctcaggtttccctttttatgcctgatccaagttccttccgagttgcatagggatactttgatagccggccaatatttgatgctaaataatggggctttccaagaacactttatgagacctgatatccccttcaatcgggaaggttggataatgattttagggattccttcggattacagaaatgagactcacatttatagggttgcaaacacttttgggaagttaatacgttggcatcacagagaaagtgttcttggcagagttctgacaaaatatctttatacagaccctagtgaagtggctcaaagaattgttatggtaaatcctgctaata

SEQ ID NO: 35102 - DNA, 284 bp, Oryza sativa
tcccgccaccgccgtcacgcccgccgcctctctctccctctcctgccaccgccggccacctctctccccctctgtcgctacgcctgctcgagagaacccggagagaagagaagagaaaagaaaaaaaaattgaaatgttggacccacaccattttctcacttatatgtgggcccaacatattaattttaattatttttgctgactaggcctctatactgccttgggacattttatgcacggttttacatagttcaggtacatatttctggttttgtggttgagg

SEQ ID NO: 35103 - DNA, 1501 bp, Oryza sativa
cgcgctgcgctcctaatagtagtaatattaggaacgcgctgcgctcctaatattaggaacgcgctgcgcttcagttattcctctgatcttgtatctactgacaccggcaagatgtgtaacaggaacaatctgaaggacaccctgctctctgtctacgggaacaatctgaaagacgccgtggacgacgaactagtcgaggtaatcaaaccaacgaccccaaatgaaatgtaattattgatggttctaatctctggcatcaaatttgtaaacactgaactatccccaaaactaatccatgaaactcttcctcgagacaagtctctccagttcttcactgctgccttttgtcgtcggaattttttctgttcgagctttgcacggccgcgtcctgtcgtcgttgtgttgatctgctgccaggcctagcgcctttcccctcgtagctcgatgcccacagacgcacgaacacatgtcccgatcaccacatctctcactgaatccacactcgcagatcgtcctatgctctctctctctctctctctctctctctctctctctctctgcaatcgaccaatcgtggactggctgattcggttggactgcaatcccgctgttccctccgagctgattttattgtaattattgcgtccgatttagagtctgttaggaaccacaacctctaatctcaattccactcaaatatgcaagcatccagtacaatagcaaccagtaaatagaggtagaagtgaggatgaactaagcgaatacaagtggtggaagatgccagaaacttctagaaggtagaggaagaaggaaggtaggtagggaggaaggaaatcgacaaggtgccaactggccaccaggtcgccgccgcggttcgccgttcgccaattgatctgttcgatgcctcgagcagggctgctgctgccttttgtatcctttcttcagcctccatgggctgggcttgtagtatggctaacatagcccatgtacagcccaattgagttcctaacagagtcaaaaaaatatagaatcccctccttgacttgccgagttctccgaagttcggcgagcctattttgtgcctctctgaaacccgtccgtcgtcggagctgttttccccaatccaggcaccgcccgcttcaccattgttgcgccctggcttctcatcgctcatcgccattgggggtaatggctttctttttccctccctctcttcctttcaccctgtcgcgttcgaaccagcactccatcccaaagccaaatcttctccccttcgctgggaatttggtcgctgctagcgaatcgatgtagcttggcaacggacctactctgccactcaccgccggtcatctccagtgatccagtgcctaactgatccgtctatcctcgtcgtccttctccactcgttccaatcctatgctccacctccactttaccctctcgtgcctccgttcgctggagcactgccggtcatcgatcccgcctgggttatagatggcca

SEQ ID NO: 35104 - DNA, 1024 bp, Oryza sativa
ttgctgaaaaggggttcgatgtttgaaaaatctgtagctgatgggatcagctaggcccgggtggccgtttgaaaagttgttggcccgggtggccgttgaaaagctgttggccgggtgccaaccttgtttcaattctaaagactgatgcattgcacatactccgaccggacgagatgcactgtctcatccgtgtcgtttgagaagcactcacttagtcgtttttagaaaagagttcaaataaaatcaattgcaaaaacaacagcctttccttgaagcctgcattaaacacttatttcccatggcttgctgagtactcccgtactcacccttgctctatataaataatccccccccccccagttgctgaagaagatgaagcggatcctgctgatgaggagttcttcgaggagcaagccggctacgatgagttttagggtttcggcctagttcccaagtcgcgcctgtgttgtttggtccatgtcttggcttccgcttcccttttgtaatgcagttgtgagctcgggatctgtccacagcccaacatgactgtacctctactctataataaagagacctctgttgctgtgataatccgtcttcctgtgataccagcaccgtttcctgggactggtatcgattaacaggttaatttagagcgtcacgggctagttccggtcggtactagttcggggcgtgacaagagatggtataagagcacaggcttggccctagggcgaaacccgacatttaggacgaccctaaggatactaagttcaaaactacttgcgaaaagctaaggcttcttttggtttccttattttcaatagtttgtttctaaaatggttactgatcttttctccctctttcaaaattgtagatggctccctctttcaatagtttgcttcagttcccacggttttggtgagggtcaccacgtcgctcagcttcgtgacctcgcccgcttccttggcttctcgtgccccgagtacacggggtactccgtggaccgtgttccccctcactg

SEQ ID NO: 35105 - DNA, 223 bp, Oryza sativa
ttgctgaaaaggggttcgatgtttgaaaaatctgtagctgatgggatcagctaggcccgggtggccgtttgaaaagttgttggcccgggtggccgttgaaaagctgttggccgggtgccaaccttgtttcaattctaaagactgatgcattgcacatactccgaccggacgagatgcactgtctcatccgtgtcgtttgagaagcactcacttagtcgttttt

SEQ ID NO: 35106 - DNA, 1501 bp, Oryza sativa
ggcaataatgacagaggaaagtgttagatggagaatcaactggctgacgttggatatacagctctctcacctacagatccggttggccggcagcggaggcgacgagtccttcagagaaagagaaggagagagctcgagcacaccggatcgagaagaagggcgagtgaccagcagctgagctagcatttgtttatgtgtgtgttgatgtgatggaaaaattgaaagtttgaaaaaaaaatttgaaactaaactcggcctatataaaattttggcccagctcgctcgaaccccgcttgcttgaagactctgtggtagacgtgaaacgcgaatgccatagacaaaagtcccatcaaagattctcatgcaggaccctgacacgcgcgaaaggcggacaacggatagaccggcggaattgaggttgctaccgcgatcgatcgcttgttgggatcgttgttgtgcgggtacctgactctgactcccaatgatggacgagcgcacgctagtgcgcagcatgggaggatgccacgatgatgcaagcaacgatggacaaacgaaagttctgctggaaccagatttcgtttttaaagtagaccggaaaaaaaatacatgtgcgttgctacgagaaaaattaaatttatgatgaacatcataagattaaagttttattttatatgcattgggcaatcttaggtgtagtcatgcaaatcataattttatcgtaaaaataatgccataattttatcgtaaaaataatgcaatcagaatgtttctcataccaccgaagaacatctatcctgaaatcggaaaagcataaaaataaattgaaataataagaacataatgttaagtgcaagttagactatggcagcttgctagggtgggagggagagagaaagtgagaggaaacacattcaccactcccggtccctggcggtgattgtggtttggtgaagacgatggaggagtgtagtgatggatcagataattggttgaaatgatcaatattgacggaaactggagaggagcgagctaaatggctttattctgatgcgattttggttagatctcgtcggatgccgtgatttctgctacaaactgatctaggggtgtgctctaggggtgtgtttagttcacaccaaaatttaaagtttggttgaaattagaacgatgtgacggaaaagttgaaagtttatccgtgtagaaaagttttgatgtgatgaaaaagttgaaagtttgaagagaaagtttggaactaaactcggcctagattggaatcgcaaagggtgaccttgtgtaacatatgttttctttccatgaagaagcactgtacatatgttttttgttttttccacatatgattttgtaaccgcatatagagaaatatttattcgcatttgtggattattagaaatgaacgtattaactaaaggaaaaatatatgccgttgattatagtggatcttaaaaaaaagttttggtccacctctggacataatgatgta

SEQ ID NO: 35107 - DNA, 1501 bp, Oryza sativa
gttaccagtgttatccatctgtcacaaggtagaggttgagagggggagcatataaggaaagaatagaccagaactaggggcaagaccttaaaggaactaactctttttgttgatgtgttgtttgttttgcttattctgcaagttgattaagcaaacaacctagcgcggttacatcacaacccactgatgcaaaccacgcgctacacacacaagcaaggaaacacacaactaacgattctaccctagagggtggcttaggttctgcgacgggttctccaagatcttcactgcttcctccacttcgctagcagatcctgcagtcttccggagcttcggcaaacaattggcgacatcttcttcttcgcaaaactaaccatctagtactagttgaaatttgaagaaggaaggagtaaatattttgcaaatagcacaggggaaaggaggaaaaaggggctttcgcaaatagtttcatttataaaatatgtccttaggttttatccacttggcttatcctacagtcgagatggctctgataccagcttgtcgcgaccgagaaaaatacattttcccgaacgctagtgtattaatccccgtcccaggaaaagccggggtacaccacacaaatatggtacaaaaggcacatctttattatatcgataatatttacattattacaaaggcacttaaggcctgacaataaaaaataaacagcagcggactaacgggcctacggctctatcttcacaggcgctcaactggggtataagccaggactccacctaagacttcttctccaaagcttctcttactgaagggggggaaagattgagcaagaatgagtacaaccacagtactcagcaagccacaccggcagatgcatgattaatgcaagggggtacaaggggtaataatataggggttaagttttgcagaaaacagcatttaaaagtcacttagttgcccaaagctattttgtaaagacgatcctagagctatacaatattattaatcaaggccgtgaaccctcacgaacctgccttaacccaaggcctacgatgattcagaccgaactggcaacccgaccctgggtcccagctcgtcccaagccaacccaggccaaccattccacattttagttgttgagcaaattttaagaattaaaacactaacttgggtacattgctcggcttgcccataaccgagggcgcggctattcgaataggttttactctgatcagaggtgtacatctttacccacaagacacattttcctcacgtgtaaccacgtgccacataccaccacggtatacggacggaagacgtgacatagttcccaacccatcctagccataaacaagagtaccgacccaaccccacctacgaccggaacccccgggacaggcaggcaggattgagccccctagcagcaggacaccagccctgtgccatgacatctcgactaccgggccgcagctcgtgtagccttcatttgccctggaga

SEQ ID NO: 35108 - DNA, 687 bp, Oryza sativa
tctcgcggtttccaagcgagttatgaaattagttttttcattcgtgtccgaaaaccctttccgacatccagtcaaacgtccgatgtgacacccaaaaattttcatttcaccaactaaacagttcctaagatgaagcctgcagtctcctggttggatacttgaatcttgtgtgctcttacttatcaatcctcgtgttgcaatgttgcatgcactggattgggcagaaaccaatctgtacatgtgcattcgcatgtgactatgtatgcatagtctgattagtgttagctgatcgtctgcttggaatcctatctatgggtgtgttagttcacgtcaaaactaaaagtttgattgaaattggaacgatgtgacggaaaaattggaagtttatgtgtgtagaaaagttttgatgtaatagaaaagttgaaagtttgaagaaaaaatttagaactaaactcggcctatataaaattttggcccagctcgctcgaaccccacttgcttaatgactctgtggtagacgcgaaacgcgaatgccgtagacaaaagtcccatcaaagattctcatgcaggaccctgacacgcgcgaaaggcggacaacggatagaccggcggaattgaggttgctaccgcgatcgatcgcttgttgggatcgttgttgtgcgggtacctgactccgactcccaatga

SEQ ID NO: 35109 - DNA, 1501 bp, Oryza sativa
aaagtcttacattgtgaaatggaggaagtagtaaggctctcctattatttttgctccttttatcgttagattggcttatggcttcttccttgcttgttaattttccataacctcaagtagactgggttatttatttatatctaccactaagaggaggaggcagggcgaggagaaagatgtgttggccgtaaggaagagggagtaaaaggtgaagtagtctatcgtccttggaggcagtgccgtggacagcgtgatgacgataagatgaggcggtttgcagcttttttgttttcacaacaggggcgtgggagagtaggagcccaggcctatttgtgaaagaaggtttgcaacatctccataaaaatggaatggctcatgcatatttgtttcatgacgtgacacgataattttgcaagaaactttagtgattcagtgttctagataagatagctaaaactaagccaactattgttttatagcgtccgtgtaaaacaatcttctcacctctaaaatcagatatccaacacccctaagctattcaaactattcaatttaccccatgtttaaagtagctgtgtttgcctatatatcattgacgtggtgaaaaagtctaccacatcggctaacatcaatgtttggcgatgccacaaacaaagttatgagatagtaagaagtaaagaatgtcatatttgaaaacaaaaatgaaagaatatgctatatggaccgcaccataaaaacacagttctgagtttgtactcttcatatatcttttactaaaggacacaagctgacttttataacagaatttttactaggatgaatgagccaaagtggacacaagatcttgcctgccatccacatgaaaaacaaaactattcctcttcttcttcttggattaaaagatgatggatgggcccaggaaagaaacctggcctagaaagggccggccgggaccggagcatccgatctcctgtcaaaaccgacgcccatcatgatccatgaacaatgctaccctaatcaatcaacatgcatatgcaagcatggctaatggtcccacggagagatcgatcaccaacccgaccggctgaccccacatccatgcatgcaatgatgcaaatcagcatatacatgaatacatccgtccatgcggttgagctaacaaaatgatgaaacgagatgatcgccagattaatccattgtttacatgcagccaaagtacaatgacagttgacaaccttcaatctgcaggcaataatttacacttttcttttaaataaaccttttttttcctcttagaaattaaaccgaagctgtgagcaagagcacatcatggtcagttcttggaagtcttttgtttgacacacacttgaattgctcccattttttcccaaccaatttgccacctaccatgcctatctgcacgcacccgtcgcgcggtttattagcctcttttctcctgcgaatcacggcgagctgatcagcgattaggcgaagcaaacgt

SEQ ID NO: 35110 - DNA, 167 bp, Oryza sativa
cacatgttaatacatcttcacaaatatttttaattttttcataactatttaagtgacatgcaaacaacgagggacatcccctcgagggattaaaatccactcccttgttgtggttgtgaaagtactaccacccgtttttaatagaggatgacattgactttttgaca

SEQ ID NO: 35111 - DNA, 346 bp, Oryza sativa
tcccgcttagattaatccaggtttcatcgcacccattcaaggaagtcattgtatgaaaaaggcaaaacgtgcggcatgataaactgacgcgtggtgaacaagaatgcccggtttgtgactggtctcacgccggtcacgtcatcggcaggcacccgtgctcccacgttgcatctgcttccggcggagtgaaggtaggtatgacccatcccatcggagggtcattcggacagtggccattgcaaatctctgcccattaatgaaggaatgacagggtgatcccctgtgtcgggcgagtgacggcgctgggcctcactcaaggacaagctatcatttagcttccaggcga

SEQ ID NO: 35112 - DNA, 1501 bp, Oryza sativa
aggggttaatcgttcaaagttagtcgttctcaggtgatcaatggcgcggcggtcttcctgtcctcttgctcaactgaggcccagtcggagccggccgcggcggagcaagcggagaggaggcagccagtgcgctggacagaggagtggctgtagtagagctcgagcagggaggaggtgaagaaatggagaggtgcaagtgaggccgcgttttggcgatggtttatatatgttgccggctgctggtgcatgggaagctgttggaacacagggggcaaggtaagtttgttggctgctctgtgaactcggtgtgtttgatcggtgtgaactcttcccactatgctgcacgtgtttggggagtattttgtggatggttttgtggattgggtgtatggtgtatggattgttgtttgggaagggcccctggtattgaatggccgcataatttggtgcaaaagactgttgtggttcggcaaaagtgggtgtaaaaccctgttgtggcttgtaggcaattcgtcgaacaggttctgtgcatgcatatgatcggctggggagggagagcagactttggctgagaaggttgcttggtaggctgcaattctgagattagggagaaaaaacagacttgttgtgagatgagttgggctgacagtgggcttgggctaaaaggcggtccactgtaataggaacttttgtattattctgagatttgtagtttaggaatttgcaaggggatttgggtggggggaaacaacatgtacatttggacttgtaaattggcagtgtatttgtaaccggactgaataatgtgctgtgcatttggactgtagaatatggatattgattttggctctgtgtttggactagaaatatacttggactgtaaatatatttcgagcatgcaccgggacagaataaagggattgcaatatgagatttgatttgtttggatggatgcaccgtggtgccaaataggagtttaggcttaacgcctgataagcgaactcgtcgatcgtcgtaggattattttaagggcgtccgcacgaacgaacgacggaaacgaagaagtgaatttagggatgacgcgtggcatactaatccactcgtcatgataggaatagaatcggatatgtttgaatggatgtatgataagtaaatgcgccgatcgattgtagacataggatttattgagttgaattaacataacggctttaaataaccggagggcaagaattgagaaagatatgtcgcattgcgacataagaaaagatttttgggttatatattaaggtctgtgatttatttagtaccgaagcacttaataaatcagaccgtaaagataaggaaaggagaagacattggactgagggcgtccctttaggagataagatttaatcgagatctttagcacacaacctaaatacacacaattgcataataaatcctagcatgcaaaaaggtttaaaaagatttttgattattccgaatttttaactccgtattt

SEQ ID NO: 35113 - DNA, 322 bp, Oryza sativa
ctacgggtaccgccacaaggacccgctctccgacgaggtgcggccgctgccgttagactacccagccgcccggtgacgcggcggcggcggcgccgccgccgccggccttggcctggacgcgcgcctagctctttcgttctctctcgttcgttacagtaaaaaagaaaagaaaatgaaattatcagtgctggtaatagcagggacagataaattcggcccaaatttgcatcttttcaagtcaaatctaccctgcttttgatcttgcttttgtacctttgtttacttctttttgtgaagtatatatgatcatcaaaactatagt

SEQ ID NO: 35114 - DNA, 1501 bp, Oryza sativa
ccgctcgtttggattcttaatgtttattatagtagccactattaaagaaaactattttattgagtctgctcttttgttttattggttctattattattattattttaagaaagaggtgagggggtcaatgctaggtcccatggtactgagaagttgggccttagcaccaacgttggcgtagtttttgttaaggctcatttgtataataaagtttgtaaaagggttaaagtgtcaaaattttcatgtgcatggtaacaacgcaagcttctaaaatgcaatacacatactatactagactagataaagtactagatgacatcaaatgattatatttccaaaaacactcagatgattcaagtatgcaaactacaaaaattagcaaacagtgaaacctcaaatcgtggcttcaacagttcgatataacattataacctcatcacatgtatgaaagacatttgcaacattgctaaatgaaaaacaaattagccatatcatgtacagcatagacggtttgaagcatcagagttgttattattggtcgtgaagattatacatatggattaaaagaaaaataatgaaagaacaatatacagttctactaacctgtaattctgatacatacaacaaatgcatccagattgcctcttgttctgtttatcttaatttagaccccccacccccaccctatgcgaggggtgtaatcagtttaatttatttttctttttatacactcgaattaaagagcaaaactttatcctatcttcctttctcttgtatgtgcacttataacttggtaataagcatgctttggatggggtcctgctgtgatgtaaaaattcagttctcgctgtattcaaatattgcaccagtatgattgaaaccacatgacacatggacggcccttgcattcttgccgaattccaccatcataggttcaaagtaatcaacatcgtttccgtgtccctgaaaagcagtcgatggttagcacaatcagctgaaatagcaatttcagcataaatgaaagggaaaaggtccatataccacctaaactttggatgaagtaaagcagggatggacatatttaaattttcaaatgaaggtagaccaatcatttttactgtactaatcgattggacgaaaaatgtgaaatcaagtaagtgcacaggattaacatgacaaacaatcttgtagttgcagacttgcagtggtagcaagtaacttactaactgtccaccagaagaatggccctcttcgaaaaaagtaccgttagcacctccccagccccacgtgtaaatatctccacctgagtgtttccagatgcttcaaatatcagtaacacgtagcaactaaataaaatatgagaaactagactattatctaatatacaataatacaaacagggcagtggcaaaagtgttaaatattaagtcatgatgatggaaacttgttatcaatatataactatttgcttcaaacaacgctgtgctactaagttatactc

SEQ ID NO: 35115 - DNA, 235 bp, Oryza sativa
aaaaaactgaaaaaaatggcttaattggatctatgccactgcaaatataccaattcgaaaaaataccattactattcacgacatcggctacatgtcactagaatttgggaaaattggaatcatgccactcccgtccaattttctatcaacctctgtcatctctctccctcttcctttcttcgcttctccgccatggacgccggtgagccctacacctcggactcgttggtccttg

SEQ ID NO: 35116 - DNA, 1501 bp, Oryza sativa
ttagcaggttgagtctaagttctattttaatcttcttggtttgagaagtccttttgcaaggcatgtaatcttgtattatgttggttgtgtatctagtttggatgtagagaccagatttagatccattttctaaaaatttaacaatatatcacaagacaacagccattagctccttgtaagacacatctcctgagccatcaattagcagatataaaacatcattctcaacttcctcgagaatagaaggaagtctcctaatataacaacttgggaaatgagcatcctaatataataacttggtaattgggtgcaatttagtgtaggaaatttataagtgagcatatgagtgtaacaacttgcaagatgggtgcaaatttgttacaataggttaagaagtgatatggcaacttaattgtttcgagaatattttcttatacatattatttttaattttgacaatatactagcatggatttgtataagcatatttaaattttcattctaaaatctgaaatttaattaaactttactttgcagaaaatattatatttcagttgagattgagaaggtgtagaaaaaaatccatacctgtggcaaattggatgcgcaataatgtaattcttaaagattaaatttaatattataaagtaatatttgtaggattgctatgtgatgacacatattgacatcgtgaaaaaaacttacctagtactcgttaaccaaaacaacacatgcttagccaagttgctactctaaaatactaaattatcaaattcttatactagaatgcaccttgttatattcgggcattcaattgtcaatttcttatactgatgtatttgtagaaaatttggaatctgatgttaaaaaaaaagatgttctcgtaaaagttgaagaacaaattaggtggcaatgtcattccgtaacttatcaaacaatcaacttcaactccagtttctgtttggagaactacctagcaaaccataaggttaaaaaggggaagggccaaaacgtttactgttcacatacaacttaaaaggttgttatgccaaatccacactgttccatctcctcgatctgcaagaagtgttgttcccctaatttcatcataggttaattggatccatgctactacaaatataccaaatttaaaaaataccactactatttacgatatcgactgggtgccacttaaattttataaaattagaaccgtgcaactctgtcacattttccatccacttttctgccgccccctttaattttatcggttgtgttctagtcgtcgttgtcttcgtcctcctcagcctaggggctagcagaagccaaccaatggctgcagctacagcagcagaaggcaagaatgacagcggcggaggtgagcatcacgtgtgccgatcgatctgcagaaccaaggagagctcggtggcgagcagggggagaggccgccggcgccggaacgtcggcggcgatggtggcggaggcagcacgcacgtcgagc

SEQ ID NO: 35117 - DNA, 870 bp, Oryza sativa
cgttccaggcttcatcgcaaccatagcaaggaagtcattgtatgaagaaaggcagacgtgcggcatgctaaactgacgcgcggtggacaagagtgaccggtctgtgactggtctgacgccggtcacgtcataggcagacaaccgtgctcccacgttgcatctgcttccggcggagtggaggtaggtatgacccatcccatcggagggtcattcggacagcggccattgcaaatctccacccattaatgaaggaatgacagggttatcccctgtgtcaggcgagtgacggcactgggcctcactcaaggacaagctgtgatttagcttccaggcgaaggtgcgagccaagtttgggtcaagatagggtgagtccccacccaaaagaagagtaggtagaagtggtgcatgtggtatccccttgagatataaaaggaggaccttgcccaccgaagtaaaggacggagagaaaaaaaagagaaaggggggacgactcggagaatacctgagctcatagaggagagaaagaggaagaggggttctagagcctgaactctcttgctctccggctctctgtaactccttcacacacagatccaccagaacacaggagtagggtattacgcttctcagcggcccgaacctgtctacatcgcccgtgtcttgtgcatttgctctctcgcgaacattccacagatcgagggtgaagaacctcacttagcgcccccggccgaaccggcaaagggggacctgcgcggtctcccggtgaggagccccacgctccgtcatctggcgcgccaggtagggggcgcgtgtgtctttctaagccctcgtcctctttcgtgtgcgccaagcttctcccgctcagcccaa

SEQ ID NO: 35118 - DNA, 1501 bp, Oryza sativa
tgtaccgggtgtacagtttcccgctcttgcacttaaggaccgtttccttggaatttgatccaaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggaccaaacctgttgttggtctgggacccctctcgtcggcatatggtaaacctgtgtcggctttcgaaatgccttgtcatgaaagcttggaggtctcccgacgtggctgatccccacgggctggtgatccgggttagtaatgtcgtgagggtaaagtgtaccccctctgcagaggttaacaaactgttcgaacagtcgtgcccacggtcatgggcggatgtgaggtgatttctaccgtagttttgtttgactactgcttgtgaaattgctgttgtgaaaaggggttcgatgtttgaaaaatctgtagctgatgggatcagctaggcccgggtggccgtttgaaaagttgttggcccgggtggccgttgaaaagttgttggccgggtgccaaccttgtttcaattctaaagactgatgcattgcacatactccgaccggacgagatgcactgtctcatccgtgtcgtttgagaagcactcacttagtcgtttttagaaaagagttcaaataaaatcaattgcaaaaacaacagcctttccttgaagcctgcattaaacacttatttcccatggcttgctgagtactcccgtactcacccttgctctatataaataatcccccccagttgctgaagaagataaagcggatcctgctgatgaggagttcttccaggagcaagccggctacgatgagttttagggtttcggcctagttcccaagtcgcgcctgtgttgtttggtccatgtcttggcttccgcttcccttttgtaatgcagttgtgagctcgggatctgtccacagcccaacatgactgtacctctactctataataaagagacctctgttgctgtgataatccgtcttcctgtgataccagcaccgtttcctgggactggtatcgattaacaggttaatttagagcgtcacgggctagttccggtcggtactagttcggggcgtgacaagagatggtataagagcacaggcttggccctagggcgaaacccgacatttaggacgaccctaaggatactaagttcaaaactacttgcgaaaagctaaggcttcttttggtttccttattttcaatagtttgtttctaaaatggttactgatcttttctccctctttcaaaattgtagatggctccctctttcaatagtttgcttcagttcccacggttttggtgagggtcaccacgtcgctcagcttcgtgacctcgcccgcttccttggcttctcgtgccccgagtacacggggtactccgtggaccgtgttccccctcactg

SEQ ID NO: 35119 - DNA, 215 bp, Oryza sativa
ggcaaaggaaggcggccggacttggcgcgtccgttcccggcgattgggggcgccattcaagggggaattaagggggaaagagagaggagggaaaggggtttaattccccctaatcaatttgggaatcccatgcttgaatcgcgcggatttgagggaggaatggcgctagggttcacgggagagggagagaggacagccgggcgggaggaggacga

SEQ ID NO: 35120 - DNA, 1501 bp, Oryza sativa
ccctccgaactatcgcggttgaccgaattactcccctgaactacaaagccagacattactcaccctggactttcaataccggatgaattatccccttgacctaattcagagcggttttgtcctacgtggcgtacgcgtggcaatccagtcagcattttctttttaaaaaatagtgggacccacatgtcatacctacccttcccctcttcccctctctctctctcttcactcactctctctcacggagtcacggggcagcgtagggggcaggcgcgagaagcggctgggtggcgagcggcggcgcgaggcgaggcggctgcgcaaaacgaggaggcagtggcgctaggtggcgattcgttccccctccaccgtgcccacgaacccattccattccattctccatcccccacccatgtcacttccgcgctcctcggctttcatctctcttacttcccggtctccctctcctcggtcgctctctctctctctcccatgcatgtgctcgggcaggcggatgcggacgggcggtgggcagcggcgcgggggacgcgcggtgggcagagtcgcagggggacgggcggggagatgggcgcccgccggtacccgggcatcctccacgccacccgctgctgactgggggttccaccgtcgtcggcgcccacactggagctcctccccgccgctcgtgccctccagggactcctccatggatgccatccagtcgcgcccgctgctgtcgctcgccacccagtcgttgcttgcgctgccgcccacctcccgcccctgtaacaccccgtgagacacataagagagaatagagagagaggaagagggaataggaggtatggcaggtgggtcccacaattttttaaataagaaaatgctgactggtttgccacgcgtacactacgtaggataaacccgctctagattgagtccagggaggtaatttgtccggtattgaaagtttagggtgagcaatgtctggttttcgggttcagggggtaattcggtcgatcgtgattgttcatggggtattttgtacttatagtactattacccgagtcttacacgacacccataagtatcagagtctagtacctagctatcatgttgatgttaggcatataattaaacaattccattccaagtatatatatgttaactgtaatatttctgtatacttatgactacacaccataccatctgtacatatgcctgagtactacaaaacttctgcacatgacacgcgcacggtgatacactatcagtacggatacataagagtagacactaactgaaatacttagcatggcatttgtctattctttctaagtcacaactcaaatgttactacacgtagtacgctagcacgtctacagggtgcaagcaatcaccttatatactgctgcctgcgtcctcatcaaagctcgccattatcagctagcttagctcaaacacttgtagcttaactaaccatcaagaatccaagctcgatcaa

SEQ ID NO: 35121 - DNA, 1362 bp, Oryza sativa
tctggtttgggtttcttttgccactccctacccaatgctcccatgcataccccagctttcctaaccaaacgtggaaattttcggtctcgattttttttttgcccacccatacccagcactcacacgcgtccaccaactcttctacacaaatgtggtaaattcttgtaaactaaatcaatccgctcatttgtgttatctaccaacgtaaccaaccatctccattcatccacatcatccagtcatgtttattcaaatctatagatcgaataggtgaagcagcgctggctataggatatgttctccgaagcacatcatgagacaagccatgccgccggccaggccttcagtcaccaccactagacacctacattgtgccattcctccttaccacccctttggagcggatatgtacaggccgtgtcgctagctggtccatctgttaccacccctagggcccacctcgttcacgataacactatgtgtctttggccaactggatctagcgatgtgaatagggagggcattggttctgatgcaccaacatagctctgagctctccatgtgtcactgccagagaatctccttgtgggatcttttcaatcttacttggtggccacttgatccaaccgcctcgtcgggcatgtcaacacccacaagactcggctctggacactcctccatatagttgttggcttcatcgctcctattttttcatggtcatcaccacccccagatttgggttgccgatgctagccatggcctgtctccaacaatgatgcgtccttacctcctccacttttgtcgacttccctagccaggaacctatgtcaactccagctcgctacctctttgcttgaaacccataattcaccaagtcaccaatgccctagagaccaaacttgatcatgccaagccaggtactaccatatctagccacatgaccctggaaggcatcgaatctagcctctttggcaactctgtaccaatgatatggatgctagaataccccttctccatcgcacactcgctagtaaccactactacagaaaacatcgttagtgttggttgggaaaccgccataggtgccagattttccaactagaaccaagaaggcggcactgatgaccctagtcaaaattaccgattccagaaccagcacctttgaggcgcacatgatcccaaaatgatgcctcaaatccatgaacacataactataatcaataatcccaagaaaaacaacacatctagatcaaatccgagacaatcaaacatcaataaacatcaacaatcaagaaaaacagtcgacgccgtcgcacctccagccggcgaccccacctccaccctagcgatccttgctgtgcc

SEQ ID NO: 35122 - DNA, 297 bp, Oryza sativa
aaccgggactaaaggtcatcaggacggttagtctcagttgattccatgtcaggccgtgtcagggccctaggatctttagtcccggttagtaacaccaaccgggactaaaaacctaaatttagtcctggttgatgttactaaccgggaataaaaatcaaaactcactatataatccatagtacttatcctcttttcctatccacacaacaaactcctccctctatctctttttttctctctaactccttacctctttccttcctctaagccttctctttcctttttttccttcacagt

SEQ ID NO: 35123 - DNA, 753 bp, Oryza sativa
tgaggcgcaatgatttgccaaggaagccatgacatctgggaggccaccagcagagaggaggaggggacggcaccaccatgtcaaagaagcgacagagaaggagatggtcattgccgttgactccaacgacaaggaaggtatggtcatccaaggtatggagcaccgggtctccacatcatagctgacatgttcatcaatagaagctctgatcaggcgaccaaggagagatctacattggtacattttgtgatttttcgatgtttcagctcacatgttttatatgtttctttgtgattgatcggaatgttttagtagagattcttatggtctttcattttttttactccgatacttgtgcatctgttgatgtttcaacagttgaatcctgatgtttctagtgcatgagtgaaatgtttaatctttatgcaactatgtttcaccattttaatcatttgcaacatttttttatctagaagtgcacattttcatataagccgtgaaacagcgccgtacacccgatttgtgctccctctcaaatatcgttatcactgtcaaatatttacagcccgaaaaagttgacctcttaatacttgtgaatgtaatacaatgccagttaaaattgataaaaattaaaaaacaacgggtgtacgtagtattttaagtatatactcattatacttttatttgcatttaatttggatatgatatcaaatctttgcacttaataacttccttctttgtgtcacccagata

SEQ ID NO: 35124 - DNA, 1501 bp, Oryza sativa; identical to SEQ ID NO: 35109

SEQ ID NO: 35125 - DNA, 1501 bp, Oryza sativa
tttccagtcaagttccgtggatacttgccaactcatgtgtgggaagtgctagcagaggtgagcttcttttatcgcaaactttgcgcaaaacagtttgatcctatagagatggcaaacatgcagtctcaagtaattgttttggtttgcaaattagaaaagatctttccacctggattttttaatccaatgcaacacttaatgattcacttaccatatgaagctagcatgggtggacctgtgcaatttagatggaattaccccgttgaaagaggccaaaagtatcttaagagcaaggttagaaaccgagcacgtgttgaagcttccatagcagaggcttacatactagatgaaatctcaaacttcacatccatatactttgctgatcaagtgcagacaattcacaatcctgttcctcgatacaatgttgctactcagtctactgattgttccctaagtctattctctattaggggggattctactagccgtggagtccctcgacacctaactcgtgaagagtggaatgctgccatattgtatgtgcttacaaaccttactgaagtggatgactacattgggtattaactatgaaattgatatgagttacttctagttcatagctgcatataattttactttaaatcattgtgtgcatttttatcttgcaggaaattcatagatgaggaatggactagatgaggtgtcccaacaaggcaacaacaagagaatatcttacggaatggtgatgggagagatcgtcctaatttcgtatcttggttctatcaacaagtaatttctttagcccagactttacttatattatacgcgtagcaatgcatatcctttcagatcagattaggaaatctagctagcttacttcgatgtaatatcttgcatgtgtatacatactttcctaactgttgaacattaagttctttcatgaatgttcctgcaactaacctaggtaatccccatcaaaccaataaagtattactgctaaaactctaaatttggtgacttcttatatcaatgctataaatttggtcctacaatagtaaagcacatttggattagtgcaagttcctagtatgcatatggctttttcatagtacaatctgagttaattttttttcatgcattatgaaaatagtattgaacatgtatgtacatgtcattaatatggagacacttctcaattgatcatctgttaggtcggaaatctggaaagaataaaatccttgccaatttctaataacaaaaagaacctagccaattaataacttgataacttcagttttgcaattcaagacctcaataattaatagtgccttcttccattttctttctgttttcattagtttgcagtttaacgcctcttaattgcatttgtgtcaataacctaataatacttatgtttttctataacataaccttcaatattgccataatagaacattatgccacaatttattgacacattatttcctttcatttcactgct

SEQ ID NO: 35126 - DNA, 1501 bp, Oryza sativa
gtttaatgcaggcttcaaggaaaggctgttgtttttgcaattgattttatttgaactcttttctaaaaacgactaagtgagtgcttctcaaacgacacggatgagacagtgcatctcgtccggtcggagtatgtgcaatgcatcagtctttagaattgaaacaaggttggcacccggccaacaacttttcaacggccacccgggccaacaacttttcaaacggccacccgggcctagctgatcccatcagctacagatttttcaaacatcgaaccccttttcacaacagcaatttcacaagcagtagtcaaacaaaactacgctagaaatcacctcacatccgcccatgaccgtgggcacgactgttcgaacagtttgttaacctctgcagagggggtacactttaccctcacgacattactaacccggatcaccagcccgtggggatcagccacgtcgggagacctccaagctttcatgacaaggcatttcgaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaattccaaggaaacggtccttaagtgcaagagcgggaaactgtacacccggtacgttccccggtccgcggttttggaaattcatttagttcgcaagcaccgacccaggtgtcgggttttccaagtcttttgtaaaacccaagttttacccaagatgtttatcatattttaagtttgaaggcgaccatcgatactcgcacagagtgcacgaataccaaggcgcaactgggtggttacaagggaacatggtgtaacgattaacaaaggaaggatcaaatgcaacaagttaggtatgcccactaatctgcctcgcagacggggcaaacatattacgtgcaatcctatcaatgcatgatattttgcaagcaatataattaagttcaaatataggctcaagatgttcaaaggtggcttgccttgctcgagatctggagcttgatcctcgaaatcctcgcactgtgggtcttcgggctccgaaactacacgcgaaacgggacaactcaacaaacggcgaataataaagccctattaatgacctctaagcgtgccattagatagatctcgagattcgaggaattttggaagttgaacggagtcaaacggatttacggttgggaagatattgaatttctaagattattggatttttggtctaaaggaaaaaggatttaattaaatcctttttggaaaagaaaagaaaagaaaagaaaagagggagggaatatagacttttcctcgggcggctagggcgcggcccgagagaaacggagcggtccggccgagctaaa

SEQ ID NO: 35127 - DNA, 407 bp, Oryza sativa
cggtaaaaatatatttgatttttataatagtagagatagagatatctcactaaatttaaattgaaaataagtacgtttaatattagttggcaacttggcatcaaaatacgaagtaaacttaccttggtaaagataaagaaagaaaaaatcttagccgttattcctttcgcgaggcggcaacagggagcacgcactctaccgtcgatcttgactggtcagcggaagcgaaccgacctatccaacggtcggtgggagatgtagccgccagtttgaccggtcgctgaccccggccaaactcacacgcaaccttcgcgccaaattttcttgccctccaagaacttttcgcgccataataagtacctcctcaagctgcttccatccattaacctccgtacaagtaatggcaa

SEQ ID NO: 35128 - DNA, 1501 bp, Oryza sativa
tgaggacaaacctgtgatgactccaaaaggagataggtaaataggctaattttggtatgtttcattagttgaaatatgaaggcttgatctgtttgttcattgatttgcacaggcaatggcaggctaatgattttgggggcaacattagggtccccactggcatcctgactgtgcttattaagcattttttccctggcattgtcaattttaaaggaagagatgagccagcatggagttggaaacattacaggattgcaccggatgatccagaaagcgctatactgaatcgcttgccaagccgtctccatcgtgttgaggaagatttctggatttgttttagagcattaccttctccaatatgaagtacactatgcattttattgtgtcttcagttttcatagtttatggccaatttgtactgtacaatagtaaagtatcttagtaccacacttttcaatgtcaagcaggctaactttctgtagttgcagctttacttcaggtgggcagagcgaacggaacaagctgctagaaaggttgtccgcaattgaatcaagcgccttttttcggacctgatttatgaaactcgtatcctggccgtgctcaattaccaaaggaagattttaaaggtagaaacttctcgggatattgcttgcaggacatacctaacagaggaagagtacctacaggtgctatggttgttcattgataatttgttgtgatctactgatcagattagtaattaataaatctgtgcttctcctataggtagaaccatggtggttcctaaaggcaaaaaatgcgtggcgggagttgatacgattgaagtggtgtaatcctgaatggcaggctagctcacatgctcataggatacggagggagaaaatgacatggccatctcaccgccaaggcagtgctaacttgagtcgtttccaaaaaaatttggtatgtgcatctatgttgaaacatgtagcagatcatggtataatatatatggtacccatgttctgttttgggagaagaagaaaaagcgggtagtgtcggtcgagtaccccatccaaacccacgacgtcgccccgcgcccatccatctagtgtcggtcgagtacgagaccccagcccgcacgtgcaccgccgtgctgacaccagtcgccacgcacggaagaggattggctgctcgtccagcaaccctccctaggactgattcgtctcaggtgttgttgtcttgctcctggaatcctcattcggccttcatgtttcatcatctttttgattagtgaccagttctagaatttactagtcaggttgcggttgtactaagggattgcagaactaggttgttatgccatgtgaaagtttgtgtgattgatgatctgaactaatgtttgatattttatttctcagtcatacaaactaaactaggcctttcttattcttgaacctttcatgaatagaaggacatttcctaacataattttattctatcactttgtcataactaggta

SEQ ID NO: 35129 - DNA, 1501 bp, Oryza sativa
acaaaggtagttaccatgttgttactcatagcaacaagaaattgggactagcaagttcacctcacattgacgaaaatcaaaccaatgcaaccaacgaatcatatactaaacataaacctcaaaataggcacaacacgtactgatgattcacggctcgcggttcggacctgcgcaacacccgtgttaggaactcaaatgggcctcataatgggccagttctcacgcaagcattggcccaagccaacctaattggagaggcaacaaaagcagcaacaacgttgcagggaattgaagcgggctgaagctctctgtggggatgcggcagcctaggaggcaagtggggcacccttgtcgatttctcttccctatctctcctcctacctccagcattctctcttagttttagaagctcccggaatactctattcaatagttttgttttctctttttttttccccaaacacttgctgcttgtgtagtatattcttgctattaaatcaaaagaagtgggtttggaacggggaacacgagtggatagccacacagggaatagttggttgacctacccaaggtagaatgatatcttattttctttaactcattagttttgggctcatataacatatgtccaaactaggagtaaattaaaacccttccaaaaaaaagggtaaaatcataattacattataaagcagatatgtggatgtttttattttacgaatttccattgttgatgtgctagaacacatatcaattttcccattgcaacgcacagacacctaagggtgtgtacaattgaggccactggtaccagtagtctcaacatgctaaataggataagaccacataaaattcacacaatctacaacggagatcaccgttgagtatattttccgtttatctacaaacgaagaccaccgttgagtatagtttttgtttcagcccttggttatttatgtgtcaataccaagttattgaatcaattagaaattttatattttggaccttataataacaaaaagaaatagatagataccactaaacttcacatggatccactgtcagcctctccaccttttctttttttctcacctaccccactctctctcttctctcgattccccactggccaccaaaactaatccacgacatctcgccgttgccgcctcctctttcgccaccaaatcgctgcctcttcttctgacgctcacagtgctgactctcccccctcctccccatccaccactgcgccattattctccccatttctccccctccccattctcctcctcccattccactgccatgtcgcactttcccaccaccattctcctcctccccattcaccacatcaaacttcgagggtggctctccccctctcctcttctccctgtccaccgccacgctgctctccccctctccttctctttgggcgacggcggcagatctggccgcgtctgtcgacttctcccctcccatccccttctcgtggcggtcgagg

SEQ ID NO: 35130 - DNA, 1501 bp, Oryza sativa
acggtgggggaaaccaccatcgcgatctgtcctccccgggcaatgcacggcgggtggtcggtctggtcgatggtgagggcaacctacgaccaccgcgcccgccgcgtcgcctcatgggtaggggccgcggccagaagctctcgcttcatggccttgaggctccggcgagaagtgtgagcgcacgctcccccatcgacggtggcgatggtggcctcaggctcctggaaccccaggtcatcgtcgccatcatcgatgtcatcggcgggggccttctgcttggcctcacttcgccggttgccggcgggagccgccggggccttgccctcacggcgctcctgcctcctctcctcctcccacttcctcgtccgctcagccaaacttttgactgcgcggcagtccgcgaggtcgtggagggaggtgttgtgcacggaacaccacttgccggtcgggcgctccctgctgggagcgccggcctccttctttttgtcgctcgcaggcctcccctttcgggtggcccgcgaaccgccctcgacggcgaggacgtgaccctcgtcgtcagaatgggccgacctcttcttcctcctcctgtcccaccgccctgaccgagcggcagacccgggggcggccaaagctgccacaccggaaccggaggagttccaggtccaggcctcctccttgcgaaccacacggtccgcgagctgaaaaagctccgcggtggtctggggctccttggaggcgatcttctcgagcatgcggttgtgccgcacgcccccccctgaacgcgtagatcaccgcgtgtgcggggatgcatggtatggtgttgcggacttgacagaaccgctgaatgtacgagcgaagagactcatcgtcccttcgctgtaccgcatgcaagtccgcttcttcacctgggcgcggatatgtgccctggaagttcatggtgaactgctggcacaaatcctcccaagagtggaccgacgcgggtggcaagttcattagccaaccccgcgcctgacctctcagggccatggggaagaaattcgccatgaccctgtcgtcacccccggcggcctcgatcccggtcgtgtagatctggagaaactcggcggggttgacgcttccgtcgtatttttcggtgatggtgggccggaaccttgggggccaacggacgttccgaaggctcgccacaaaggctcgacagccggcaccgccaaccggggacacggggggctggcccccgtgcccggaccgaagtggcgctccggacgaggaagcgtcctccgttgcgtgggcagcacgacgaccattgcgccggcgctcgatattgaggcgggcatccggccccccacgcacatcttcttgggtcggaggcgttgacgagggaatggcggacgaacggcgggtaacggccgccgctcgccgcgccctccgcctcgacgacacggagccggcggtagcagcgctagaggccttggtggcggaggaccgcccgccggcacctagg

SEQ ID NO: 35131 - DNA, 232 bp, Oryza sativa
ttgatatattatgcaacaagcctacaatcattcatatgttcatatgagggcaatcagttgttagggtcgggcatgagatctccagattgatgaccctttaggctcacagaagtcatgccagttgccaaggtggcaagagtaacattgttgtcccaaataatttttttttgtggggacccaaagaacaaattagctagtttatgtctatttgtttgaatcaaagaactcaaat

SEQ ID NO: 35132 - DNA, 883 bp, Oryza sativa
tcatgacatattgacactttatgatggccaaaaggaagggaacgaaaggtcctttgcaaacaaaatttgaatgtgtgagatggtagatttgttgtagaaacatattatttcaggcactgttaagtgttaaccttgttgaattgtagcttggtctgaaaaataaaattatgaatatgttaactagtagttaggttattttttctggctgttggatgtgctcgaaacctttagctgtttatcttgctcttagccagcaaactgcctacaccctgatgtagacatgccaaaattcttacatcattgattggcctgctcgtactttatggaattcaactcttgtgtatagatataaattagcctgttagaaacattggccacgaatagcttccgtactccttccgtatcaaaataaaacaatttctggaatttgaaatttattccaaaataaacaccttctatcttcttaactatcgtcaatccgcaaagcaagaagttttattacctcaatacccccgacctaccagtaaatcaatacaactttcacattaattgagggcattgtggtttctgtttctctccttaaaattttctttggatgttagggtttaagttagggagaaagggggtagatgtacttcattcagcttaaagcagtaactgcatagcccttaattttcaactatgcctaagtttatttccaaactttttttttaaactttcaacttttccatcacatcaaaactttcctacacacacaaactttcaacttttccgtcacatcgttccaatttcaatcaaacttttaattttggcgtgaactaaacataccctatatcgggaagtcgctggtttgcttacttttttaatttaatgttactatagg

SEQ ID NO: 35133 - DNA, 1501 bp, Oryza sativa
ttgtatcgtagaggtttactgtgataacataaaaaaagtcttaataccttcatcacaccaacgaggtatcacaataaattgatgtatcaccgatacttcatggttttattgtagaagataccataaaagtatcattataccttcatggaatcaattaagtattatgatacctctatggtgccgaggaggtatcaacataaaacgataaatttaccatgataatttcatggcatcaagtaagtatcatgatactccattaggggtgggcaatcagtcagaccaatcagttcgggctcggggactttagagaaacttcggtcgtctaaaattcaagaccaaattgcattgcctaaagggtgaagatagatcatggtcgagaaataaagttgtggcagtagcaggaaagaagaaagtgctgctgctcggtatgttccgataggccaactgccttgacgtgctgctaatgggggtcaacacttaatcaacattcatcatagttggcgtgttgggcaacattgttggtgtggaggagctaaggaggcaggatgcgcgtcggtacggagtagggcgcagcggttgggtgcgtgcatgaggaggaggaatgagtgaatgactggggatgggggtgttaagagatgacgtggctagagttttccagtgattctgggcttaatgggcctaatgggctacttttggtttattcggttaacggtgtcacgccctgaactagccccgagcggaactagcccgtgacgctccaaattaacctgttaatcgataccagtcccaggaaacagtgctggtatcacaggaagacagaatatcacagcagcagaggtctctttattacagagtaggagtacagtcatgttgggttgcggacagatcccgagctcacaactgcattacaaaagggaaaacggaagccaagacttggactattcatcacaggcgcaacttgggaactaggccgaaaccctaaaactcatcgtagccgacttgctcctggaagaactcctcatcagcagtatccacatcatcttctttagcaactggggggattatttatatagagcaagggtgagtacaggagtactcagcaagccatgggaattaagtgtttaatgcaggcttcaaaggaagggctgttgtttttgcaattgtttttatttaaactcctttttgaaacaactaagtgagtgcttctcaaacgacacggatgagacagtgtgtctcgttcggtcggagtttgtgcaatgtatcagtctttgaattgattcaaggttggcacccggccaacagcttttaaacggccacccgggcctggctgatcccatcagccgcagatttttcaaacatcgaacccattccacaacagtaatttcacaagcagtagtcaaacaaaactacgctaggaatcacctcacatccacccatgatcgtgggcacggctgttcgaacagtttgttaacctctgcagagagggtacactttacccaca

SEQ ID NO: 35134 - DNA, 892 bp, Oryza sativa
ctccgcggctatcctcctcttgttctcctcgcgtcgttcgcatcagccactaacttcacctacatcgggccggccacgtgccaatccgccatcctctgcacacccccccccccgccgccaccgcctacatcgagcccctcaccagcttcgagaacaccaccctccacgacctcttcggatggggctcctctaactttaagttagaggagcctcatccgaagaggtcgtggagggtggtgttctcgaagctggtgaggggctcgatgtaggcggtggcggcgggggggggggtgtgcagaggatggcggattggcacgtggccggcccgatgtaggtgaagttagtggctgatgcgaacgacgcgaggaagaacaagaggaggatagccgcggaggagaatgatggcaccatgataacaatagctataggctatagatagccacgttgtgtttgagaggtgaggttgggaactcacctcacgcgcacgtaaaacgaagtatttacttatgattaattaagtatttacttttataaaaatgattaatatgattttttaaagtaactttcgtatattttttttcaaaaacatatcatttagaagtttgaaaagtgtgtatatgaaaaaggaaaactcacctccgtgcacgtaaaacggagtgacgtattttcttatgattaattaagtttttttaaaaaaatagattaatatgattttttaaagtaacttttatatttttgcaaaaaaaaaggtatcgtttatcagtttaaaagcgtgcacgtgaaaaacgagaggtgtttcgagaacacgctgaaaaaagaacacagcagaagtgtttgagatggccggagctagcgtacgtacgaacgtgtgcagaggtgagctagcacttca

SEQ ID NO: 35135 - DNA, 184 bp, Oryza sativa
ttttagatcactgaaaacacgtatataaaagttttattaacaaataatttattgtttgcaaatataccgtttggcttatttggagccgaaagctgagaaaaaaaaaatagtgaattccaaaagcggttcctcaattgtagacgtcagagggaggcgcgtgtcactgacgcgtgggccccacagc

SEQ ID NO: 35136 - DNA, 1501 bp, Oryza sativa; identical to SEQ ID NO: 35109

SEQ ID NO: 35137 - DNA, 1501 bp, Oryza sativa
aatctgcatgtaacgcaactcaatcattctcgttgacacaacaaaactaaacacaagcaaatgaatctggcatccgatcaaaacaaagaaaaacctcggttttgtctactacagatttttaaaaatctgaataaaaaaaaagacaaactacgttattatctcgataaagtgaattaacagtaataactcagagaactttgataacattggtaacatgagtaacagctcaaaaactttatgcctataaaaccaacgatttaagggtgccagttggtaaatccacgatacaataatgcaaaaatacacaaaaattcacaatcttccgatcctgacaaagttgctcagtttaacagtaacatctctctttcccatcatcatatatatcaaaccagcaaaagaactcaagtgtcagcatcacatgctcagccttataactgatgatgataccacttcactcctgcagccaagttatttagcatgcttcaagctgtggtagcttcaaagtaaccttctgaacaagtaatgcgtaggacatcgaaggcctgggcaaattatgggcgggaagctccacaagaagattctgcacagcaaggcaaaagaaaaacgaaattacttaataagtgaaaataagaattaaaaaatgatatgaaactactccagcataaatgagagctgtaggaacctgtacgccttcaaattagtcatcaaggtagtagtaggatcctgcagacttttgttccctgtcttttgtggagtccagtttgtttattcttggcctatagttggttgggtctcttctaaaagtaatgtcaagatgctatcatgcacaaaaggaaaaacaatagaaagcattagcatgtgaaaacataaatgaaatactctgaaaaataaacagaagtgggacatctttcgacaactaaaaacagatatagaatgtcaaactctactgaaaaattaatcttttgaggaagttgcctacaactgaaccaaagacaaggatgcgagatggtattacaacaaacttgtggatctcttctcaatatttaatattcagaacttaccgataagaacttattcatcccagataccaaagactgtggtgcattggcagtacagtcgatagaaggccgcccctcataaacaatgaccttgtcagctaagtaggtagccatgatgaaatcatgctccacaataaatgcagttttctttgcatgaaggatgaatcttttgataaccttcgaagcaacaatgcgctgctccgaatcaagataggcacttggttcatcaatcagatagatatctgcaggctgaacatataccacattgcaagtatcaataagctgacaatcaagtcaatatttatataggcaatacagcatttaggtgcttagccctgatgaatcccctaatgattttggtaaaaatcattaagttaaggtggatacacatcttgtcatatgatcaaatggtttcgcgaaaaatcaataatcagacaacaaga

SEQ ID NO: 35138 - DNA, 519 bp, Oryza sativa
cccgacagctgtcgtcgcctagggttgtccccatcaccaaggttggggagggaagggtcaccatcaccgcagcaccaccctcgccaccgcctcgtcttggctgccgctccctcctttggacccatactttctactgctactagcctaccaccactggtactaccccatatctaatgatcgagcaggaggattgcttgctagaccatcaacccaaaggaggaatagggtgaggcgaagaagaagggggaaggaggatactagcgtcagcgtcggctctgacgccaccgtgatgcgagggctgaggagggcgggacggaggcggtgaccttgcggccgaggggggaggccaggaagggggatctgatggttcggttagataataatgctttgcaaaagcacccttgtactcattatgtttatagcgcaaaccctaaaaacaaatttttgtcttcttcacattgtattttatagaacaacaaggactgttttgaataaattacaacaagatgccaggtagcg

SEQ ID NO: 35139 - DNA, 825 bp, Oryza sativa
aaaaccttgacttcaattctgttatgcgttgcaagtgaagttgtcttcctcttttgcttttaattggcaaaacagcatgcttactgaagagttctatggcctatgggcgcatttttctaaaaaaatcatatctgatttctgaacttatctgaagcattgtctctttttgtctcttcaggctcaagcgtagacgcctcacgttttctaattaaaacgagtactactaaagataagcctacatcatcagtggctttcagatgacttcaggtgagtgcagctgccactagtcctcctcctgtaacctgttagccataatgccattagcattggaccaaattgctgagcccaaaacagaaaggttaattactgctcagaaattaaaccgattaaagtggatgatgcactcacagccacaatgattgtgcttatttttatgcagtgatttggaggcctcttttggttgtctgtacgtgaagctcacttcagagtgagacaactggaaactatgtgttcccctcgcgagccctacaacgaagtcgaccgcatcagagagggggaaaaataatggaaattctgatgctgattgtgccttagtggattggtgactcgtatactctggcagcctgatccggaaatggagccacagcattgaagcgacaacccgtcaacttttttcgtttcatcgactctgaatttcttaaacgtccgttcgtctaaaagtctctaaccccaggtaggcaaggcaggtgatcacggctatcaaatcggcgttgttatacgtagctttcgtccctgttcgctcgttttttttgcctctactgcagt

SEQ ID NO: 35140 - DNA, 444 bp, Oryza sativa
ttgagagggagcaaattgtactataggagtatagcaccgattgggtctctgtgcgtgcgatgttcgtaccgtcgatgctgactcgttgtctcgttctgctcgtcgtgaacgaagggggttggcggcgcgcaggaatttcagtacggggtctcggcacattcggtgaacggcgcaggccgcgcgtgtggaggatgacggagaggcggcccatgtgacgctcgagaggggcggtggcggagaagcccacctgccacagtggttggatggagttcgtaacgaggcccaacctccgaagacctgcagcccaggttgaccccaatgatggagaaacgggccagggttgagcgagccgccaatattttttttttcgattttgctaaacatcacgcgacagatttttttctggaaatcactcgaattttagttatacacgcaacgtataga

SEQ ID NO: 35141 - DNA, 1501 bp, Oryza sativa
gcacttttgaagcctctgaataatggctatgaacaatccaattgatgatccacctaacatatccgtagtactttcatgtggctaagcactgagagatcccctcataatttccccaaagcgtaaccatgtgtgaataaattttgagctagtagggttgcagccacgagtaagtcttcccttgttattgtgtagccagaatgccgcaaaacttccatgcctaagcgaactgttgagagtacgtttcgatttctgactgtgttagcctggaagtgcttgtcccaaccttgtttctgagcatgaacgcccgcaagccaacatgttagttgaagcatcagggcgattagcagcatgatatcaaaacgctctgagctgctcgttcggctatggcgtaggcctagtccgtaggcaggacttttcaagtctcggaaggtttcttcaatctgcattcgcttcgaatagatattaacaagttgtttgggtgttcgaatttcaacaggtaagttagttgctagaacccatggctcctttgccgacgctgagtagattttaggtgacgggtggtgacaatgagtccgtgtcgagcgctgattttttcggcctttagagcgagatttatacaatagaatttggcatgagattggattgcttttagtcagcctcttatagcctaaagtctttgagtgactagatgacatatcatgtaagttgctgataggtttccagttttccgctcctaggtctgcatattgtacttttcctcttactcgacttaaccagtaccaacccagcttctcaacggatttataccatggcactttaaagccagcatcactgacaatgagcggtgtggtgttactcggtagaatgctcgcaaggtcggctagaaattggtcatgagctttctttgaacattgctctgaaagcgggaacgctttctcataaagagtaacagaacgaccgtgtagtgcgactgaagctcgcaataccataagtcgtttttgctcacgaatatcagaccagtcaacaagtacaatgggcatcgtattgcccgaacagataaagctagcatgccaacggtatacagcgagtcgctctttgtggaggtgacgattacctaacaatcggtcgattcgtttgatgttatgttttgttctcgctttggttggcaggttacggccaagttcggtaagagtgagagttttacagtcaagtaatgcgtggcaagccaacgttaagctgttgagtcgttttaagtgtaattcggggcagaattggtaaagagagtcgtgtaaaatatcgagttcgcacatcttgttgtctgattattgatttttcgcgaaaccatttgatcatatgacaagatgtgtatccaccttaacttaatgatttttaccaaaatcattaggggattcatcagggctaagcacctaaatgctgtattgcctatataaatattgacttgattgtcagcttattgatacttgcaatgtggtatatgttc

SEQ ID NO: 35142 - DNA, 1501 bp, Oryza sativa
ataccctgcaggttgtggaggtgctctttgcgtaccatacactttatccacatcgtatagctggaacttccgaacctatccaaatggaaacgtgtattttccaagactttgaattttggaacaataaatgtctatgcacacacccaagcccgacaaaaatgtatcatttgcactggagtcaattgtccaacctgaatggtcaagcgacagtttgacatatgggaatccaatatccatacacgcgaccatcaccaatcctaattaaaccgatcgtcacacacaattcaaacaggtaagcagagaatttgacgaatccaggccgacctggtggttgccgcactgctcgcaggtggcgcagggaacgtaggtgacggtgctcccggagtccacgatcagcgcgaactcctgcgaaggcgtcccgatgtacagcctcgtcgtgtaatacctaaaccagcacgaacaacacgcggcgacatccagcctcagatccaaccacgcaacccccccaagaaaaaaaaatttgggggaaattatcgagagagagagagcggagggcaaaaaacgaactgtaccgacccgttggtgaggagatcatcgtggaggcgcatgcgggcgttggggttgtgtccatcgccgaggccgcgcctggccgaggaggcggggaggcgggtggcgttggggtaggcgagcgtgagcgggagcaccagcggcggccgcgcggggccggcccgatcgggggatcccgcggcggcggcggcggcggaagcgatgaggaggaggaggaccaccgcggcggcgaagggcacgagcgagccgagccgacgcgaccggcgactcgccatggcgaggactcgtcgcgccgagccgaggaggaggaaggaaggggaagagagctgagcgagcccgagagggcgacgacttgttggaggagaaggcgaggggtaatccggtaattctcgcgtcgccggccggttcacgcaggtccgggattagtatattttttgtcactgtgtgggagatgcctcgggggcgtggcaccggctgacaggtgggggcggcctcgcgtgggtcccacctgtcggtggctcagatcatcccgatgcgtatagctgtattcctttttgcgcaagtggcggttttttgttttcctagtgagattggagtggaagaggagagtggcgttgacgagacgagcggggtgcgtgtgggccccacatggaggccaccagacatgcgatttgtgaaagagttcgtctcatcatcctaaaaaacgtgcttctgctcatgcgttccatgcttatctagctcatatctttgcatccttaaatcgtgcaagattgtaggctctgcaaagtaatcagaaaggcttgcatcttaagctgtacaaggaaattgcagtttgcaaagcaagagattagttcagaaaggtaaggggaaaaaaatattctactactcaaaagcgccagagcccagagggcgaattaaaatggagccaatctta

SEQ ID NO: 35143 - DNA, 1501 bp, Oryza sativa
taaaaaccaaaaaacacagtagtactaatagtagtataacagtagtactagtagtattattatagcagtagtagtagtactgtagtactactagtactagggggcaccgcgcgggggcagcggcacgcggtcagtcgcgcattagcgctccccgccctatgatgttgcttcctgtgctggcccatgctgcatagcatttttaggctttacttgggccgaaacaaatcacagtccatattaagatggaaaaggcccagtttcactcccctcaactataggtcaaatattgttcagattcctcaatgataaaaccgtgtataacgtgtccttcaactattaaaatccgtgaaaaatgactccctccgttgtattaatatggttttcgatgacgtgatatctacatggtgcattgacctagttttcattttacatgactcttgtatcttgtatggataatggtcaaagttgatgaagacatcatgctcgccccaacgcgaccccatcgagtttgagctccatgaaaagagaggcagcggaggtggcgatcgatgagccatatcgagatcaaactcacctacccatccacatggaggcaacgccctgggtcgttgccaccatccatctttgtctttacctattggaccactagaacatgtcgtccttcaggccaactttgtcttcctttgtttcgactggtccagtttcgtcctctctctaaatcgacaaggagatgaagagcagaagaggcattctgtcggtcgttgctcctctaccatggatggaaagggagtaaggaggaggaagaaatggatgataacaatgcttgccaacagggaattggagtccaccttaacatccgatttgtgtgtgcccgccactgccctgctgcctcacctcaacctctcattgccgttctgccgtcaagaaaataagggatagcggaaggggtagggaaggaaggagagaggaggacatgtgggctccactccatttcttaatttatgtgatgattgacatttcatgtggatgctatgtctgcgagaaacaccatcaatattaccgaccaagtcgttcttcactgatattaatagtttgagaagtgttatatcggttccagggatacaatcagattcaacgttgaggcaggcgcattaaaccttttcccattaagatggcgctgcctacgcagctgggcttctgcgtggtgtaaggcgtgtaggccttgattgggccgaagcaaatctcaccgtaacatgttagccacagaatgcatccccatcccaagcctctcagggcgcaggctccggcgaacccaaccctagtccggtagcccccgacgccgccccaccgcgccgacgccgcgcatcctccccgcggccctcggaggcatctcctcgcccgtcgtccctcggcgcctcgccatcgccggcggtctgcctccgctgctcggcggctcgcccgacgcacccacgagtatcttccccttccctggcgtaaaaga

SEQ ID NO: 35144 - DNA, 1501 bp, Oryza sativa
ggagcgtcacgggctagttccgctcggggctagttcagggcgtgacaccgttaaccgaataaaccaaaagtagcccattaggcccattaagcccagaatcactggaaaactctagccacgtcatctcttaacacccccatccccagtcattcactcattcctcctcctcatgcacgcacccaaccgctgcgccctactccgtaccgacgcgcatcctgcctccttagctcctccacaccaacaatgttgcccaacacgccaactatgatgaatgttgattaagtgttgacccccattagcagcacgtcaaggcagttggcctatcggaacataccgagcagcagcactttcttctttcctgctactgccacaactttatttctcgaccatgatctatcttcaccctttaggcaatgcaatttggtcttgaattttagacgaccgaagtttctctaaagtccccgagcccgaactgattggtctgactgattgcccacccctaatggagtatcatgatacttacttgatgccatgaaattatcatggtaaatttatcgttttatgttgatacctcctcggcaccatagaggtatcataatacttaattgattccatgaaggtataatgatacttttatggtatcttctacaataaaaccatgaagtatcggtgatacatcaatttattgtgatacctcgttggtgtgatgaaggtattaagactttttttatgttatcacagtaaacctctacgatacaaccaacaacatttacgatattttcatgatatctccaaatatttcgtgaaatctttgtaaatataaccatgatgacattttcagatatgatggaaatcatgtggtaccatctacataaataaaacatggagatacatgtgagatatgatagaaatcgtaattacctctatgatattatggagatacatgaggcacaaagtgtaagggtcgatctgatataacataattaagttcacttctaacaagccttatcctaccatgcatatgacccaatagtggtgtatgctcatgtattatccaacacagaggaggtgcttgcccggtgtgtagaggcttggaaggatgtgcttgagggaattgtaaggaggacttgctcgcaagcgtgggtgcacactgcacacgtggaaactgcacatagaagaatcgcgggattgtgatttctataccatccctgaatggtacgacgctctataggaatgtttgtattaggcagaaccattttttaagatatagtctatatagcagaacgcccaaaatagtatgccattatgtggttccttcacagtatgaatacgttcttctcctatgatatctatagaagagaataaaaatgcatttaattttcaccaatcacattaatatgataattcattcacctacctcgagctatatatggattgcaccggccaatgcaccactagactatatattggggaaaagaacctcatccctcttcagccaaca

SEQ ID NO: 35145 - DNA, 1501 bp, Oryza sativa
  unsure (1)..(1501): unsure at all n locations
ctaaaaacttgtaataaattgacaaatcattgacatctgtggagtgtatgccacggccgttgtcggatttaacatttggaaagttattgtctatgcaaatacagagcngaccgtgacgaaccaatcaatgatcattgtcacgttgaggtcaacagttaaaaaaaaaaagattccgtggatcaattggtgatcctttttataaatttgttggctgatgtctactattggaggcctgatagatacatcaaacctctacctcctgtatttctcagaacagataagaaaaacaaagagaaaaggggtcgctcctttttggcttggaatgatgacgtccaattctttgtttttttgtcatggagatgtagttaaccagaagcatggtttttgattacttgtgatagccgaaacttattaatggaaagcagttacaatttgtactgctctataagagctattctactctaaaatcttaaggacacaaaattaagtaagcaacagtcattagcaatttaggttctggataagtgaccatccaacagaacaaggggagcatacggccaaattctttgctatactatacatcatcatcaaacgttatttcgaataaaaatatgtctaagtatcaaggcagcattttgtgtctttctttcccttttttcatttaaaaatagagctcgcatattcttaggtcaacaccgaaaactaatcaccatgttgactttgaattatttaaatcaatgtaactcaaaagttaataaacgtgaatgtgcaagcatacaaaacaaactattttgtattttagttgcacgatcatgttcacttacaaactcttttcctcattatttggaaaactgacccactatattttgctcctccttttagttgtaaacatccttctggaaatacatatgtgcacaagcacagtgctcacataattcatgagttggacaccagatgaaaaaaaaccccaagaaaataataagtggagtaaacttccatccaacttaagttaccacggtccacggttaattcctattgactacgaacaaattgttttactatgttaaccatgtttttttagacaatagtgtcaaattatcatattacgtatgaatttatgattacacctcttctttctccctgaaaatactgcagcatcctctcgatttgagatgattacttcagtttcttgccacaccagaggtaatccattcccttgatttttgttaaaagataaagataatatagacgctatctttttaaacggccaatatcattattaatcaaataactgaaaaaaaaatgtctctgaatgatacttgcccctacttcgctatccacagttgcgatttgcgacttgcaagcacaccgtagctaacttctctccttctgggtataaatatccctctcctctccctgtttctcctcatccctgcttcctcttctacacctcattttccgcttgcatcttgctcattcagatctcttctgctttgagcaa

SEQ ID NO: 35146 - DNA, 502 bp, Oryza sativa
ctccaataatattacatgctaagactaaaatagtcatctatgctaagtgtttcgtgcgtatatgctaagtctaattaagactacaatagtcaattgctacttgtcgccccaattccgtagtcaataattatacatactaataagtctaattacaaataaagtaatcttatattaaaactcaaataatattagaacactacacaatcttatatgataagtccaattacaggtctaataatcttaattaattgcattacaaatataacaatcatttatattattacgtcacttgcctgctccaattccttctagggctagctcttccactcaggcttgacggacgactccgacaacacgtcttttctgcaagatacaaaaagatgtattaggataaatgcgaagtaacatatatatatatatatatatatatatatatatatatatatattgcatttcacgttaacgttcgtcctcgttcgttcgctcgttcatgttccctagc

SEQ ID NO: 35147 - DNA, 1501 bp, Oryza sativa
ttgccatcacctggttgtgattatcctggttatgttaggaacagtctatggtttcttttctttaaaaggaaatggaaacgggttacatatttagcctctgccatattaggcagtttatggtttctgtcaagcaagagttaagagcatcacctgtgcagctgctcaatgaagtcagcacaagttgtatcaccatatagacaaaaatgacggccaacacccaagcattcctgggttttagcacggcccggctggtcccagctgcataggcccccacaaggccaagcagatccagcaccatggccacccgcagtggaagcatggggatccaaaagtttttcttctcttgtgcgattgcaaggctcaagatgaggatgatgactataatggacaaaacgaacgcagccgcattgcagtagaagaaaacaaggtaccgggggtagtaggtatcccggataatggagtcaccggcgaggtgcccggcctcggtatcctgccagacacccccgggtggattgaaacctgtggcatatgtcactgtggctgccataatagccagcagtaagaggtacttccgcaagagtaactccagtggtttttcttccactttctcttgatcctctgtagagtgtccattcgccatttgctagctggggagcagtgatagaaaggaggtgcctcaaggtgtcaatgactcaatgccaagaaggtgcttcaacatgcatacattatatagagttgtgttgtaccagcttcatggagactggccttgggcagacgtcctcgtcgttttaaagtttagttgattcattgacgttgatttgatctcaccttgtttcctctttgtttgagcttcccataaatctgtctatgagcggcttgaattgtttatatggccaagtgatctggacatctatgtaattattgacccaaaagacgagtgtttgttttcttctgaaagactgactttatggagttcatatatatcccaatcccatgtcaagatttgattaaactgtttccacgtttctcttgcttagtctaattttgctgattgaaacttttttttgagggactttcaggttgaaacttgacagtctctttggctagcaacagctactggatgttctttttaattgcgaggcaagccacaattctcattaacagaggccataattgtgaactatcttgtcttcattccagtgctctatttcagcatatatgctaatgtgtaagatatgcaggagacgaattgaagtgtttcttaatttgaacttctaaaatgccagcaaaactcttgtttggtgaaatgcccatagtcttaaattcagctttccaactaatggtgaacgtgagatatacatgtatgtaaagtttggtatacactccagggtgtgtctagctgctttctgtagctgtcctttcttttcagatgggatgcgtttacttatacattttgactgcccaaacttacagattgtaactgtcgaggttccaacactgt

SEQ ID NO: 35148 - DNA, 1501 bp, Oryza sativa
cttgcgttcttctttactccattgcttggcctagcgattcattagcatgcaaatttaagatggaaatacagatattaataatatttggaagcagaaacatgttcatgcatccataccttccatttgaatctgatgctgacccttgtgggtgaggggatataatcaccttgagaaaaagaatgcatgcaagaacagcgaaaaccagacagccaacatagatggtagtgtcactattcctgctgctgccggtggcgtaggcccccacaagaccgacaagagcaataatgatgtacgctttgagaaagcgggtccttactcgggaggtcatgctttgatcctggtcctggagtagtgggatgactagttgcttgtctaggagcagcataatgatgagcagggacatgacaaatgcagcagcattaaagacaaagaatgccttcaggcggatagcatggtgctctcgcatgaccaggtcgcctgcattgtgtccctccttgctgctgtcccagtagccaccaggtgcactcaacccagccaggtaagtgacgctcatcacaaatgtagcgagaagtagtaggagcttgcggcgccgctctttttcctcctctttcttatgacctgattgggagagcttattgattttctcctctttgccatcagctgtttgcagttgctccttggcttcctcctttttgccatcacctggttgtgattatcctggttatgttaggaacagtctatggtttcttttctttaaaaggaaatggaaacgggttacatatttagcctctgccatattaggcagtttatggtttctgtcaagcaagagttaagagcatcacctgtgcagctgctcaatgaagtcagcacaagttgtatcaccatatagacaaaaatgacggccaacacccaagcattcctgggttttagcacggcccggctggtcccagctgcataggcccccacaaggccaagcagatccagcaccatggccacccgcagtggaagcatggggatccaaaagtttttcttctcttgtgcgattgcaaggctcaagatgaggatgatgactataatggacaaaacgaacgcagccgcattgcagtagaagaaaacaaggtaccgggggtagtaggtatcccggataatggagtcaccggcgaggtgcccggcctcggtatcctgccagacacccccgggtggattgaaacctgtggcatatgtcactgtggctgccataatagccagcagtaagaggtacttccgcaagagtaactccagtggtttttcttccactttctcttgatcctctgtagagtgtccattcgccatttgctagctggggagcagtgatagaaaggaggtgcctcaaggtgtcaatgactcaatgccaagaaggtgcttcaacatgcatacattatatagagttgtgttgtaccagcttcatggagactggccttgggcagacgtcctcgtcgttttaaagtttagttgattcatt

SEQ ID NO: 35149 - DNA, 953 bp, Oryza sativa
ctatgcttgcatgcatattttgtttaagaataatctatctccactagtacttgaaattttatttgtttgaagagaaaattacgtaattggaggagaatcgatggaaatcaaccgaacaatcaattgaactccattgagaggtagacttataggttgatgggcttataaatccagtgaaataacaccaaatgggcacaaccaccacaccacaggaccgaggaatctacaggaggcacaccttccaaattgtggtccatttaggccaggctagggttcttcgcatggaaagcggtagaggctgatccgtagctttggtcgtcgcactctaatccgctttagaagaagcagccaagttgtttcttctcccatgctggtcctatttttaactatacattggttacgcaccaaggttatactaaaaagtcgagctcacgggagttggttactgttgcgtgtctacacttgcaggagatggcgaatgagagtcttacctaggtaaattggtggcgatttactcttggtactgatggtccttaatgcttcttggacctcccttcttttaaattggttcgcatgtgttttggctaagcgcatccttgttatagagacgtcgagagtgttcttagcgtagttgtatgactttgatgtaatagaacaagtttaatagaaccttccattatctaaaaggggataacctgttaccatggccatccaccaaacacctagctgctcgctaacgacatgttattgggagaaatgcgcggtgacccatagacatggcacatatgcattcaaccaaccaatttatgaccacaaagcttctacgccttacagactatttaaagaaatcacgtcccactttcataatagcaagcaactcatcgatctagggtagctagttcttgttgcattgaatcatccctcatcaaattattaggatatatacttcatga

SEQ ID NO: 35150 - DNA, 1501 bp, Oryza sativa
aataaaatgcattgaagagtataagcttcagaaggactatcctcttggacctctccagaagcgtgttgctgagctaaaatctaagggtgagaaaaggccattggaagctgggcgccataatgcaaagaagcctcgcactttcggcaattcagctgctcgcaggccaccaaatcctgttggttcagctggtcgcagaccttcaggcccggctggtacttggcagcggccccctccaccaatgccttcctatcctgatcgatatggacatgcagatcggtaccattacactgcaccctctgcaacatatgatcctcctgcttatgcttcttacagcgaaccatacagtgcctcaaagccataccagtacacaccaggctcagtagctcctgcatcatacaactcgaatcagttcaaagtagcttatggtggacctggtgccccgccaacagcaggcggctacggaagctacaacgatgcagcagggcagtctacttcgagtagctattcgggttattctggttaccacccttcactaccaaggttataacttgcatttgctatgctacgctggttatgataaagcacaatctggctatcaatctcgttcagagttcagaccccagatgtaacctttagatatactctagtggattttgtagctgtaactggtgtagatcttgatcttccaaggctggtcgtgtgagaagccggtcgattttagagactttttttttgtcctgctacatgtatccagttgaatactgttgcgtgtacctaacctgttttgaatattctccatgttcagtcttctgtgactaactactaagattggctccattttaattcgccctctgggctctggcgcttttgagtagtagaatatttttttccccttacctttctgaactaatctcttgctttgcaaactgcaatttccttgtacagcttaagatgcaagcctttctgattactttgcagagcctacaatcttgcacgatttaaggatgcaaagatatgagctagataagcatggaacgcatgagcagaagcacgttttttaggatgatgagacgaactctttcacaaatcgcatgtctggtggcctccatgtggggcccacacgcaccccgctcgtctcgtcaacgccactctcctcttccactccaatctcactaggaaaacaaaaaaccgccacttgcgcaaaaaggaatacagctatacgcatcgggatgatctgagccaccgacaggtgggacccacgcgaggccgcccccacctgtcagccggtgccacgcccccgaggcatctcccacacagtgacaaaaaatatactaatcccggacctgcgtgaaccggccggcgacgcgagaattaccggattacccctcgccttctcctccaacaagtcgtcgccctctcgggctcgctcagctctcttccccttccttcctcctcctcggctcggcgcgacgagtcctcgccatggcgagtcgccggtcgc

SEQ ID NO: 35151 - DNA, 1501 bp, Oryza sativa
atggcatagtagggttcatttgcaaaagcagcatttagcaaacatttgagaatttgataaaacagttaagtaattaaacaatattaatccaacgctatacaacataccctgttgcataggcccaaccattctgaacaaccatcccggctgcacagttctatctccaaaccaggaatataccattccaaaccaggagctaatcaaattattaccaattgaagcatcatttactatggtgagaagggtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtacctcggaaaggagttgtgacaataccccttgcataacacaatccactacggcgcacctttcctggatcataatcacccccttataaacaaggtatggactccccagcgacccccgtgggcttatctccgccacttctcagtctggtgccccgcaatgaaccatgctacacaaaagataaagccgttgcccatgctggcttgtggttggcacggttaatgtttcacaaccgaaactcgtgaaccggtccttaattgtcatgagcacgaccatcaaaaccatgtgctcacaacccaccattaccaggttttagttggcacattaattaattaactaatcacgattgaccatcgtgaactatcattcagccatcattaaataacagtgagtcataagttaacccaatagtgagctaatgtttctaagcagggctaagcaattatatctaatatctagttgaaccaatatataaagctcaactagtcaagttataataacccaaggtatcaaggaataaagtaatcaagaacaaaagggttgtaacaaacaataggttatttccacccaatgacattcgaaaataaatgcaatagttgaataaaaacagtagctttaaataggatcaacatgctcaaagggttgtttgggatctgtgtgacttgccttgctggccttggaactcttcaaattcttctccggcgaaaacggactctccggaaacgacggaatctaagcaaaaagaagcaaaaacaccaaaacagcacataaacaagcatgaacagtatatgtggatatttttaacatgtatatctcaattttagaaaaatttagagacttgaaccaactaaatcggagctaagatgaattagttatgaatttttgaagatttaatcggattaaaacacttaaattgattttaattgaattatgacgcaataatgaattatttttgaaaaggaaaaggaggattattgcgtcagcgggctagggtttcggtggaccgggcgcacggcggcggttcacgcgaacggacggccgagatcgacttgatccaaaacgtacggccgagatcgatcggtccacgaccggctcacgacggacggggacga

SEQ ID NO: 35152 - DNA, 387 bp, Oryza sativa
attggactttggttaccctgaactaatccatttgtcctaaaataagttcattaccaatacaaaccaaaacaaaaattagaatactcctactttatcaaatattatgggattatttttcaattttatttatttccaatgcaattattcctaattgcataaactttggtgtaataattactcaaaatgcacctattttggaacaaatgggagggaaatatgaactaattgtggaataaagggagtatataaaattaataaaaaaagatttgggattgtcataggaaacttaacagggttagttttctaacagtgaaagtacatgtaccaacctcttcataaaaaaaagacagccatttcttttccatgacatgagagtatagatggcca

SEQ ID NO: 35153 - DNA, 203 bp, Oryza sativa
cggtcgaaagaatagggatgtaaaatagacttattttacctatatatatgtcagcccaaagaggagggacggaaaatagacttattttcactatatatatgtcacagcccaaagtggagggacggaaaatagacttattttcgatatattatgtcacagcccaaagaggagggacgaaaaatagacttatttaaaaaaaggca

SEQ ID NO: 35154 - DNA, 1501 bp, Oryza sativa
tgcaattttaaacaaatattaaatttgttagcttgacctttagaattataataaatcagtacctattcaggatattctactgattgtagtgaggtacacaaaagaatgccaaattactgcaaataaaaggagcatccacattggtctcgacaattctaagtcattgcttacatggtcatgaaagggcagtcacattctaattctgaaacaagaaagcaatacctacataagggtgttacaggccacataagggttataggcctcccaactgcatttgcatgaatctggaataaaacaaatagtggcaatccattttcagttaaatggaacacacggagttgagaaatcaatataaaatcaaatgcagatgttataagtcataaccaattgattttttttaattgtaaaagcaatcaaacaagaaatagagggcaaagttcatcgatcatcaactaataataccttaagtagtcctgcattcttgaagcagtcaaaaattttggttaacaatgaacatgttatctgatcatttcagatgagcgggatgcctaacctgaaatctgccttggtttgtccctacggcaagatgagtgccacgctgcgcccaaccgatagaaattaacattatagagacctgtcaaccacagcgtctcatccaaccataaccaagtccaatatagttaaagcaattggtttcttaggactgaaaactttatcgaatttcagtctctcaggaatttttcagacaaaaattttgagaaaattctttcaggttataaatcctgaacttctatgctgcatgttggactgacgtacattactttttttcttcttgatctaaaagtgaacttaagcaattctaatcccagagatggccctaattaaaatctgcctgtccaacggtgcctgtttttatacatacatgcatgcaacaaaaaaaaattaaaaccgtttattaatctattatcattgatgaataattataattagagcatttgccttattacaagattagaggagcataataggtaaatgtagatcaaccaactccctttttcatggctaacatttgatagaaaatcctccataaaaatccatcaaatgtaatatttataatgcaattacaatgtaagtataattagggttaaataagtcacattaaactacacaaaacaattgctaggtaccaaacaatctgtcaaactcatgatctctgtcatgcaacagaacaatggagctataaaaagattgaaagaactggataataatttggaaagcctgaaaacaggaactacgtgcaatttgggccagcagttcacaaagcaaatgtacaacaatgcttgtttgttcaatcgaaattaaagaagtgaacttctacagtgtatgtatgtatgatgagaaaaatgtggacgactgcgtagcatttcaatctcatacctgctgtgtgggttcctgctgctatggaggctcctgctgatgttgctcgtaattgccataacca

SEQ ID NO: 35155 - DNA, 1501 bp, Oryza sativa
ccactctcaggcatactaccagtatgcggaccaaaaccaaataagtaagatcatatagaccttgaaatggggaaacaaaaatattatatatactttggatttatttatgtggttatacgtcaataatatgtcctaacaaattcagatttgaattaagagcacagtcgtggcttcttgttgtgcatagtagaattcgtggcttcttgttgtgcatagtagaatttaatgggcaaatgtgtaatcagattttagatggataggtagtgagctgtccttgtgagactgagcaacaaaattatcccttgtatatgagccacaactatagaaacttcgaaaagataaattactgagtgctaagaagcctgcacaaacaattaattatgcacaaacaagaaggaattatccatgttttatttggcattgcatgtctgcaccagcataaaactatcactgatccttttcacttgttagtcatgatccagcattccagctgctaaggacttacaattagctgataagagaacgtaacaaagccatactattggatcacacgttcaacacataacccgtgttaaccaaacaaatcaagattggctcacttctatgaaaacattatattaacgtaaattatttcaaccaaaaagaaggaatagaaacaaccagtaatctctttaatgcatagtagacaacatcagatgccatggtgtcctcctgatggatttgcttcgacagcctacacgtttttcatgcattttttgtaacctgaaaagaaaagttagataagtttgctagatatgaaaaagtgatataaattgtgatagttaatctacatgttgactaagtttgctaaacatttcagaatctagaacacaccatgtatatttaaggtaacatagttgattaactatagaacatctacaaatagtgcaattcatgcaatagtgttctatgtaaaaatatatggaacatgatcctgacctcagattgtaagtccagaacctctatgctcttactcattgcaagtgcaagcagctaaccaacatattgccgttttttgctttgagtatcttgtaatgaacgtgtgatacaatgcaattaactgctgcaagttggaagtcatgatccaattttaaagaactgcaattgattgataaaatatgtgacaaacggaatacagaacaaatattgaggtgtaaaaaccaatttgagaagtagaccattagcaatatatggatttgagatctatcagacaaatatgaatgtggtacatgttcttattcagtttattacgactttgcaaatgaagggaaatatggtgtgtattacctgtctttgcatacgattatgatgtagagcatcctccgttgtctattgaagtaggccgaggcaagcagatgattgactcgaatacttctagccacacaagtcaaatagctcccacctgacaatatcggtggattatttggagcaacaaataacatcagttctaaaacctgaaacc

SEQ ID NO: 35156 - DNA, 1501 bp, Oryza sativa
aagatgaaattccgcatagcaatttacgggaaagcaaaatcatgttacatattgatttgtgcatcatggagtcatttgaagtagccagtagccaagtattagttttttcagattatttaccggattagtgaaacgaattatttgctccacactttataaaatagattttattttttaaaatatatctactatatttcttaaacaatttattttaagttatttcgtaagtttatttattaaattatttaatttgtttctataatttattaaataattcacagcaacaacccgctcaattatctgtctcaaactgaccgctcagatcaaaaatagggagaaagtgagtgctaattttggctattgcatggtgcctttctttgccacattttgcagggtacattggagattaagtagttgcattgacttgcacactttatgaagatttgtatcttagtacactttgcagattgcatgtgtcttccttgctatcatagtttgagtatttcttcatatggttgagcattgatagtgatagagttataactcatgaaactgaatttggagctattattatgtacagtagcctttctttatttggtttggtggcttattgcaatttatcgtttcctcacttttgtacgcaagcaccacattatatcgctacatacaaactatacatcaccttatgatgaggacactaaagtaaggatacttaatacaaaatgttttgtagtctattcaaaccaatgctattattgcacatttattttccaactggcctctatgtttttttttttatgtcgaagatttaactcctacgaaataagtgcaacactttcatatacaattatatatatattttttaaaaaatacaatggtatgactctcaacatacggttaaaaaaaagtggcttatgccatattgagatagtcgaccacatgtataaagtgttagaaactaactccatgaattttttttccctcatgtagtagggcttaggactgaatttacatgtacttggactaaatttgaactgtttgtcaaaatttgttaaattttcaccagtaatcagccgtatccaaacggtttacgtaaaaacttgaacgacctgtttggttggaaggagttggtgatggggaatgggagtttacgatacttgggagtttaagtctgtagtttggttggaagacttggaattcgaggggtttgggatagggaatttaggggtttaattcccaccaagacatgttaattcgtgagactggaagaggtttttccgaccggctgttgggttatgtttaaagctgtaaactctcttgtgtatagagaggagtccatggatgacaaagaggttaaaaccgggtcgcgccaccacatgagcccccaccgtgacaggctgcaggtccagcagcaacactgcacagtcacagtcactgtcctctcctccactccactcctcttctctcctcgcagcctcgcagtgtggaggaggagtagagc

SEQ ID NO: 35157 - DNA, 1501 bp, Oryza sativa
gatatcttttcaatcttaaaagttaacatattttctggaagggtttttctccgtaacatttctttagaaaagtttgtcagtaccaaaataaaagtgattttaatggctaggatcttatagaggagtgaacatatgtcacttgcttataaagtatgaaaaactacgaacaattgttgtttatttatctctctaataaaatttctgtcttcctgggcccaaacctagctcagcccagtcttctgctcgtcccctcagcccagtgcggtctccacttcagtccaagcatggaatcagcaatgaagaccaaagatatgtgattagggatgagcaagggtcaggcgacccattttagttcatctttatgaacataactaagtgtatatatacaaaattgaacaccacatggaccagatgtgaagtgggggccatagccaggctcaaccctacacctcaaaacatatttctgtatagtgcaaaatttcctgcatccaggactcagctatcatgattcatgatcttgcatacatctagacaggccatagatcagtcctaaagttgtgattgtatacaatataatgggtacaaaaagagctgccaaatataattcttgctgattttgcaaagaaatgaagaggagagaagtgcatctcattatatcctaaagagtaaaaactatcaacttctgctggtcatttaaaaataatccacttctgctggcattcactatcaatgtactttgaacatcgatccagaagcaattgaatagtctgaatgagggaacaacctacaactacatgatatattatagtgtaaattcacaaatggccagggcctagtggaaatcatgaagaactttggcccggcatccatgtggttgaacctcatgaagattttgctatttcatttgcaaatagtcggatgtatgtatcagttaagacgggacgaaacaaataactggtactggaatgcaatgcacatggatcagaaataaagaacacaaaggtcatgtacaagaaacagataagtggaggctaaacagttgttttttaactgatttataagaaacatgtgcgactatgtcccaagataatccataagaaacattgttctcttacaggctactgaaaattagtcagggttgcaagcaacagataagaaactgtaacagtagtagtaagtttgtgacattcgttgggctatttcggcacaatctatcgaatcgactatataatttgcctcctctgtgaggaaaatgcagggggttagtgcatacgaatgtgtgaagcggtacaccactgatgaacaatgcaattacaaacagccgaggacagagcaggaggaaggagatgaaaaggaggagcgattaattagggcgagtagctcacctgtgacgactctcgcgtagccagcagaacgtgtacggtggcggctgccccttcccccatcggtgcgcgaggcgaggggatgaatcgaagaggccaagggaggagtttaaccatca

SEQ ID NO: 35158 - DNA, 1501 bp, Oryza sativa
atgccaggcgaggggagcgagcatgttccccctcttttctccacctcatatgtctcaagtggctaggagagcatactcccttataaggagatctctctctcctaaaataggtaagatgaacagggccggccctgactttttggtggctcagtgtggaaaaaaaaatgaaggctcccattcaccataaaaatacaagataatatttaaaaactcattgtcattaacgaatttcacactaacaagtttaaaataccaaaaagaaatatctctagatcatttaaaacaatttcttctaacagttcagatgcaaaatcagtgatgatagtgtcaataacaatctcatctaacagcatcttctcaatgcacaaagtagtctatcaggcttggtactatagtatacatattttggaggcccctaatttttggaggcccagtgcggtcgcactgcccgcactgccccagggccggccctggatgaactaaactccctatgcatgctatccccatgaggtgggcttttgtgattttctaaagaattaatctttgaataagctaagaccatctattaattccgactagagttcacccataatcggaaagctgaagttaagacacggggattttaccaacatgagttttgctgtcattctcgaaggtcaaattaagaatttccttttaaaaaatttcaaattaagaaacattaaacaaaaaaataaatgggtaaagcttttatatatgcattcctaacgatttaaaaaccaatgctagaaaataaataatagtggaaaaatctcaaactcagttccaaatttaagtttcaaaattcaaattgtgggcgtgactgctaagccaagaagcaaacggtgaaatatgctaaatgaagacaagataattcacagttaaatggtttgtgttaataagaactgtcaattgtatgacttgcaaaactagaatatccattagccgttcctcgccatagaagctttcgacctgcaaaactagagtaagcaagagagaaacgtgctaacagtttaaagaaaatcttcacttgggagatggatatctaatagactgcagaaagtcagtcttagcagaagaatacaaaaaactcccatgtctttctggtcaaagaaagtatagccatgtccagatcatttccttcaaaaaaaatcaactacacatttaaaaatgacgtacgaggattggaagaaagtctgcgcatggtcagtctccgttaagctgataccccacaactctacataatgcatgttatggtgaaggacctgattggcattgcgttgttgacgccttgaggcacctcctttcagtcactgctcctcagctagcaaacaaatggtaaaacagtcgttagagtaatccaaagatgaagacaaaccagtgtagtattgcttgtggaagtacttctacctcttgctgatggccattatggtggccatggcgacatatgccgcagggtttaacctgcatgagatatgatgac

SEQ ID NO: 35159 - DNA, 1501 bp, Oryza sativa
cccctttgcagtatcatggtgatacttcggggcatggcgacatgtgtggaatcgtgtcttgtgggtacagttgtacacctctggccagagtaaaactattcgaatagccgtgcccgcggttatgggcgatcaaccagattcaccgtgattagtctcatccctagtttagcttaatgaactggtgtagttcaggtggttggctgggcctgttgcaacgtggtgtagcgttggacagtgtttggttaatattgattaattactacaactgtcttactgctttcaactactgcttttaaatgctagctttatgcaaaagaacctctagcttcctttggttatatcctgcatcatacctcctcttccggtatgacttgctgagtacagtgggtagtactcagtcttgctctcttttcccccacaccagagctgaagatcttcctagttggagctgttttgtcaaagttggtttcgtcgctgccgtcaaggattgcctgtggagtggagtcgcccgctgctgaagtcaagcttcccggtttagctcgcttttatttcttttccgctgcatttgtaatcttttctatttttgtaagacgtggatctgtatgtcaacaattgtcgtttgtgtaccctggctggtcctggacagggatttaatgcacattcagcttagaaattctggtttgagaatttctgggcgtgacaagttggtatcagagccaggtttgaccgtaggacaagccaactggaaacctaagagccctctgaacccctttttcatctgcatatgcctttttgcacttggattttgttttggaaaaatttggagttttgcctctttggtttgcgggaaaaatcttggtcgttctttcggatcagatttttttttaaaaaaaaaattagctcagtctagggctttagaaaaattttagttggagtttattcgacagtcagtcgggaatttattgggggttatgcattaggtcgtgtctatattcgatgggggcaatgttatgcgcatcattttccatgcaactagtctatgcattaatttattgtttagttgcattagtgtctttatttgagttcatgaaaaatgttctatgcataaaaatcatcctgctcggttatttatttgagtcttcttttgctttgtttaatttggatttgagcatgagttggttcctatcccttgtctactttagatgtcagtcctatccctcgtttgcaagcgccgcctcgagcttcagagtcgccgcccttagctttatcgccttcttagtctgtttgcttgctagttttcgtgtttaggtttgttgcttgtgggttagtcggcggtcgatatcatgtgtcagtggtatgactgcctcaattaggagttgcgtgcctctttttcagtgttttaatcaagattaagataattgcacttaaattcataagcaagattagtttctgagcccctgtttttcttccttttctcatatttctacctatccccttcaga

SEQ ID NO: 35160 - DNA, 1501 bp, Oryza sativa
aaatttttcgctcttcaatcttcacctagttccacaggttggatgtatttccatgaaacataccatgtcaatcaagtttcgtggtaaaagcttcaagagatgatgggattgtgaaggtcatttcaagaatgtatagtatattatactctctctgttctaaaatataacaacattataatacaaatttaaataaattaaaaccatatatatatcttgagtctgtcaagattaagattcagagtactaatcagtgatataaatctagattattatattttaaaacagatagattgttttttatcacgtgctatataagtattattattattattattatatattttttatacacagatgacgcacacgcacaccaccaccatgcatgcattcacatgtgctattattattattattattattattattattattattattattattattattattattattattattattattattattatcatcatcgcacacatcaccacacaggcacgccacgctcacacacctaagtgtgtcccttaacccactttcaaatagagtgaaaccagtagcgtatatctgatcccactaattattttgttgaagtccactaaatctacattcaataatatcaagatttaaatcctaagagcagttacaataggatggatgactcggcaggctccaaaatatgccacgtcatttaattcctaggtggaagagagagaaataagagaaataaggaaagagaataaagcacagtttttcacgcgcgagcaacacaggtatcaataaaataatgttttacgtggggggccaaaatccaatatcgtgactgaacagggaaacagtgattaaaaaaactagaggataccccgtgcgttgctgcaggacttggttaacatcaatttgttagataggaagtacaatcttaagaagaaacagaagaaacaaatagatttcttggagaaattctttttagcagccctatctaaaatttgtagataatttaggtagcacatgtcaactgaaggagcgttcagccgtaaagctcttttatacggattgacgggttggatacatgtaaatgtgtatagagaggggccaatgtgttcatatgtgctacatttgatactgaggaggcgaagagactcacctggtgactaatgggttgggttctatgttgcatttcatccaacgtctgagaagcaatctaatgcattcattcaacggttcataatttgatgatgacgtggaagcacgaggtttgagcttttggccttaactgtatagaaagaagggataggaaaactatcattcactacaccagattctcatatctctgacgggatacctgtgacggataaacgaaatggtcactgatgaccgtcacaggtgactagttacctgtgacgggtcgcagctggacggcccgtcagaggtgaggtttactcacctcaaacggcttgaagtcctagcctgtttgagatgacttctgccacta

SEQ ID NO: 35161 - DNA, 1501 bp, Oryza sativa
tcccggttggtattaccaaccggaagtaaatatcttttcccgctatttcgaaattctttttaaacccggttagggttaagaaccgggactaaagattatagcactgcatatgattttcgcttacgtatgtgtttataaaatagaagttaatgcattaacattatttaaagtacaaagattaatgacaattacttcgaaaaattatttttgtctgtaataaattaagtggataaatcgtaataagcaaatatatgacttataattaataaaaattccaatatatatatatacttagcatatatatgaatgatattattatattggtaaaaactctaattaagatatgtatgtacatactgcatgatttaaaattaataaaaattgtaatcatcatatatacttagtgtaggaattatattaaattaaatgctaaaaactctaattaacatatgtaaatgccacatgcatgatttaaaccttttaaaaattcgaatagtcatatataagtagcatatgaaatatagtaaattaaattgtgaaaaactctaatatatgaatgatagttttaaaaatatattaaatttaatacttttaaaaattctccagtcaattataattagcatatgaatgatagtaaattaaatgttaaaaactctaattaacatatgaaattgccacttgcgtgatttaaaacttttaaaaatcctctagtcaattataattagcatatgaatgctagtaaattaaatgttaaaaactctaattaacatacatatgaaattgccacctgtgtgatttaaaacttttaaaaattataagtatcacatataactagcatatacatgcatgatttaaacttgttgaaacctctaataatcgtgcgtaattaacatatgccatacatcaattgatttatatggataatcaatacatccaaaatagtttacatcgtgtacacaataattacggcattacatcggcggtgacggttgaccgcacgtactttctcctcactattgttccctccttgtgatcgctgcgtgagtaaggggtgtcttccgacatgtggcatacgggggtactcagtttcaggttacgaacactacgaaatttttcgctcttcaatcttcacctagttccacaggttggatgtatttccatgaaacataccatgtcaatcaagtttcgtggtaaaagcttcaagagatgatgggattgtgaaggtcatttcaagaatgtatagtatattatactctctctgttctaaaatataacaacattataatacaaatttaaataaattaaaaccatatatatatcttgagtctgtcaagattaagattcagagtactaatcagtgatataaatctagattattatattttaaaacagatagattgttttttatcacgtgctatataagtattattattattattattatatattttttatacacagatgacgcacacgcacaccaccaccatgcatgcattcacat

SEQ ID NO: 35162 - DNA, 953 bp, Oryza sativa
agatatttactcccggttgttgagaacaaccgggactaaagatgatctttagtcccggttggtattaccaaccggaagtaaatatcttttcccgctatttcgaaattctttttaaacccggttagggttaagaaccgggactaaagattatagcactgcatatgattttcgcttacgtatgtgtttataaaatagaagttaatgcattaacattatttaaagtacaaagattaatgacaattacttcgaaaaattatttttgtctgtaataaattaagtggataaatcgtaataagcaaatatatgacttataattaataaaaattccaatatatatatatacttagcatatatatgaatgatattattatattggtaaaaactctaattaagatatgtatgtacatactgcatgatttaaaattaataaaaattgtaatcatcatatatacttagtgtaggaattatattaaattaaatgctaaaaactctaattaacatatgtaaatgccacatgcatgatttaaaccttttaaaaattcgaatagtcatatataagtagcatatgaaatatagtaaattaaattgtgaaaaactctaatatatgaatgatagttttaaaaatatattaaatttaatacttttaaaaattctccagtcaattataattagcatatgaatgatagtaaattaaatgttaaaaactctaattaacatatgaaattgccacttgcgtgatttaaaacttttaaaaatcctctagtcaattataattagcatatgaatgctagtaaattaaatgttaaaaactctaattaacatacatatgaaattgccacctgtgtgatttaaaacttttaaaaattataagtatcacatataactagcatatacatgcatgatttaaacttgttgaaacctctaataatcgtgcgtaattaacatatgccata

SEQ ID NO: 35163 - DNA, 1501 bp, Oryza sativa
taaaaaaaaaacgaaagagaaagaaaagaaaatgaaaacccggacacgcacgtaccgacacagccgccgaggtccagccttcctctaccctcgcaacgaacccacccctaccccacgtgactgacgctgggccccactttaagtggccccgcatggcagtggcacaagagtatccgtcgtcgcggcggcttcaccgctgtcactgttatccgggggaaaaaacattcaccgcggcagcgaaaaaaaattgagaagcagattagaaaaagaaaaaaaaagcagtaaaaacttggggggagctgaaagaaaggggaaaaaaagattttactaaagtggagttcaaacgaagcgagcaggaggaggaggaggcagtagagaggaaacgaagtcccaatcccacggtgccctctctctccacgcccaccaccaccaccaccgcgccctcgctcgctgctgctgctgccgccggggagcgcgcgcccccgacgcggggggaaccctaggcggcgggagggcgtcgatcccgagatccccgggtggggaggtgggtgcgggccctcctccgctgagctcgccggcgggcggcgggcgggtggggccccccatgcctttggcgccccgatcggagccgatcggtggccgcgtgaggcgtcagagcagctcgcccggcgaggggggcgcaggagaggcggaggcggcggcggcggcggaggagaagggggaggaggaggaggggaaggatggcgctcttccgcaaattcttcctgaagaagacgccggatcggctgctcgagatctccgagcgcgtctatggtataatgccctcgcctctgggtggaattgggaccgtgggggtgtgagatttgcgggggagccttttgttccgagggggatttgtggctttggagtgcttggggggctcgaattttgggaaggttttgcttactggggtgttgatttaagcgggaatttagggcatgcgcagggcgtaagcgctatatttagtaatttctgagttagattttgggtcatgcatttggtctgatactgggtttgcatgtgtttaataagccttagatttagctgcattttggcttaattttttctttatttgtttccttctatgaatcttgtgtgattgtggagttttgctctgcgggaagctttgggctcagctgcatttggcttaaatcggccgtagacccaccatatcctgcttgcatgttcatatggttaatttctgcttgctgcgaatctaatgtttggttataatggtgtacttttatattgaaaccacttggatcaaatacttgaattcaactggaaatatgaattttagcacacttgcagtgtgaaaaatcagatgctggtagccttttagtgctagatgtgctttccttttctttaattctagtcgaaagatgaaaagttgcttataccagttctggctaatttctattaacacatgtttcagtgttcgactgctgcttttcaactgatt

SEQ ID NO: 35164 - DNA, 994 bp, Oryza sativa
aggaggtggtggagggggtggaggaggagggacaaaagttcgtgtttgtgctccaaaagacataagtggaggtggagggggaggaggaggaatgcttgacaagcctgatgaagctggaggaggtggcggtggcggcagtggtggtggtggtggcggcggcggtggctgctgctttgtagctgatcccatgtgcattgataaggaacttgaagaagcatagggtggaggtggtggaggtggaggtggaggtgcagcttgaatttttggcacagcttgtgcacctgatgatacaagaggtgcatctttgccaacattgaatttgttatttgtatgcatggaatggatagctagtgcagctggagaactatcatatctagatggaggatgagatggcctatgcacagaggtagtttcagattctttattgggtgaaatccatctgcgtactgtcttaggtttgactgcctttggttgttcttgcgattggtcactattgcctagcttttcttccaataaaactgcctcaggtgcatggtctactggcatcttctttgagggcacaactttatcaggtatttgccttctgtcactgcttatccgtgggctcttagccctagcttctattttactttgaggaagagatatgccaacatcccgtctgccaccagactcttctctcttggttttgatttttgttgctatttcagtggctgtaggacaacaatgctaccctgcacagtggttttctttagagatatggcatcttcaagcccagatttcaatttagtttgctccattttgctatcagttgtatcagcagctttagcgacctccatcttgtatttttgttatcttgtgagtccacactctcgataacagatctatctaatttaggtgtagtgctctcttcattgacaacatttttcacttcctgcggtaggttcgcattatcaactatagttttctcttcatagatcaccagctcattgtccac

SEQ ID NO: 35165 - DNA, 1501 bp, Oryza sativa
caaacaacttgagaagtgtcgaaaatggcgacaaattaaggttcattccaatgaaacaactagctacactttttttaaaaagaaaaaggaagataattacatccctagccattataagcatgtacttgagtataaggatatacagtgcgtctaagctttatagtaggcacaactctacattcaaacgaaatacttgcatagttacatatgaaattcggttagtttatataaattggaacatcatctcgcctcaaagacccattttagttggcgcctttacatatgttttctcaatttcctcttgctatgttactcgaatgcgtctctaagaaacggatgtgaaccaaacgcagtcatcaggattaatttcaagacttgtcctccttaattatctcctccctaagcttgatgattttgctgccgataggagtttaaatcttgatacatacatatcacttgttggtttgattggagtaccgtgtaatgactctatccagtaggatcaaattacttgatttgattatgtgacgtgttatttagagcgataggccaattcaaccacttgatatgtgtcgaaaacggtatcaaactaaggttcattcaaacgagacaacaagctagtaccccctccatcttaaaatacaagaacctaggatctgataggattatatataaacatgtattccatccattaaaaaaaaacaacctaggtgatgatttgataccacataagacaatgaatctaggccctatttagttctcaaattttttttttctaaaaacatcacatcaaatctttggatacatatatggagcattaaatatagataaaaagaaaaactaattgcacaatttgcatgtaaatcgcgagacgaatcttttgagcctaattaggacatgattagtcataagtgctacagtaacccacatgtgctaatgatggattaattaggctcaaaagattcgtctcgcggtttccaggcaagttatgaaattagtttttttttcatttgtgtctaaaaaccccttccaacatttggtcggacgtctgatgcgacacccaaaaatttttatttaactaactaaacaggcccctagacttgctctagatgatgtgaaatcctcaccaagattacttttgtttggagggagggagtactagagtgtgtctagtaggcacaaccgcacaactctacattaaaatgaaatacaaatatgcattagcatatatttccacaattacataggaaattcggctaattacatataaaattggagcatcatcccaattcaaaatccaataagacacatctaattggcgcgaatcttcccaacgtacgcctgcaggttcttctccgacgagccgccgtcggccaccgccgcccgcgccttctctctccacgccgccgcgctggcgcgcaccgcctccgacgtggcggcgtcgatgcaccgcctcagctcgccggcctccagcacgccgtcgacctcgctcacggcggcc

SEQ ID NO: 35166 - DNA, 1501 bp, Oryza sativa
tgagtaaacctcacctctgacgggccgtccagctgcgacccgtcacaggtaactagtcacctgtgacggtcatcagtgaccatttcgtttatccgtcacaggtatcccgtcagagatatgagaatctggtgtagtgaatgatagttttcctatcccttctttctatacagttaaggccaaaagctcaaacctcgtgcttccacgtcatcatcaaattatgaaccgttgaatgaatgcattagattgcttctcagacgttggatgaaatgcaacatagaacccaacccattagtcaccaggtgagtctcttcgcctcctcagtatcaaatgtagcacatatgaacacattggcccctctctatacacatttacatgtatccaacccgtcaatccgtataaaagagctttacggctgaacgctccttcagttgacatgtgctacctaaattatctacaaattttagatagggctgctaaaaagaatttctccaagaaatctatttgtttcttctgtttcttcttaagattgtacttcctatctaacaaattgatgttaaccaagtcctgcagcaacgcacggggtatcctctagtttttttaatcactgtttccctgttcagtcacgatattggattttggccccccacgtaaaacattattttattgatacctgtgttgctcgcgcgtgaaaaactgtgctttattctctttccttatttctcttatttctctctcttccacctaggaattaaatgacgtggcatattttggagcctgccgagtcatccatcctattgtaactgctcttaggatttaaatcttgatattattgaatgtagatttagtggacttcaacaaaataattagtgggatcagatatacgctactggtttcactctatttgaaagtgggttaagggacacacttaggtgtgtgagcgtggcgtgcctgtgtggtgatgtgtgcgatgatgataataataataataataataataataataataataataataataataataataataataataataataataataataatagcacatgtgaatgcatgcatggtggtggtgtgcgtgtgcgtcatctgtgtataaaaaatatataataataataataataatacttatatagcacgtgataaaaaacaatctatctgttttaaaatataataatctagatttatatcactgattagtactctgaatcttaatcttgacagactcaagatatatatatggttttaatttatttaaatttgtattataatgttgttatattttagaacagagagagtataatatactatacattcttgaaatgaccttcacaatcccatcatctcttgaagcttttaccacgaaacttgattgacatggtatgtttcatggaaatacatccaacctgtggaactaggtgaagattgaagagcgaaaaatttcgtagtgttcgtaacctgaaactgagtacccccgtatgccacatgtcgg

SEQ ID NO: 35167 - DNA, 729 bp, Oryza sativa
gaacggctaaatggtgcattgcatggtgcatgttattcaaatactttctatatataagtttcttttaaaaaaatttcatttttttaatatttaatactcaattaatcttgtggtaataatctatatcatttcgtgtgcatggataagctcacttaatgagctagatcgaacgaagcctaagtaggacattaaaaacatggacatgatatcaaaataatatagttgacctttaatttctaataatatataaataaataaaacttatactatatgaaaatacgttcatgataaattttgtaatattattttgatgtaacattattttttttatagtagggagtgagtaattttaggaattaatgttactcacaactggagtttttttttttgaaaatacaaatctaattcaacaaaacatgttattaagtgatatacaattatataactatataatgtatattattcatttatttagattatggatatttcgatgacatgagtatagtacaatacaactgaaaaaaacttatatttgtacaactataagctggaactattaattggtttttatctcatgtgagtgaaaaaaggaaaaaagaggatggacgtggggcactttgtgagaagtacatactcctatgcactcctaagaactatatgggctggaaattatgtattttgttttttatgttaattagtgagaaagaaaaaaaaagaaaatgaggggca

SEQ ID NO: 35168 - DNA, 328 bp, Oryza sativa
tcaattagaaaataatgctttagtacaagatttattttttgagaaggaaattaaagatacgatttttcaaatggaacataataaagctctgagtccggatgaattcctagctgagttttatcaggttttttggaattttattaagtccgatttggttgatttatttaatgattttcatagtggtagtttacctctttagtctcttaactttggttactgcccaagtgcaaagaggccttgaaaattcaaacatataggcctatttgtttacttaatgtcttaatgttagtttgaaaatttttactacagttgctacaaatagaatttc

SEQ ID NO: 35169 - DNA, 242 bp, Oryza sativa
aatcatctcactacacccgttacggatgacttgttatacatgacggagcatggttgtgacccatcaaatgttatccgagacgtgttagactaggatccaacaaagttgacattctatcagtgatgggtcatctgctgtagtcattaatccgacatggatagttcatcaggaataatgtgtagatctgtactagggaggtaagttgttggccctgtttattccatcacgtgttgtgtgacagt

SEQ ID NO: 35170 - DNA, 1501 bp, Oryza sativa
attatgtgagcaaacagatcatattcacatttgaatcttggtgatagtcataatgtgtattagtgtatgcatatgtgggtatgcttctgacataaagttcttttagacgaatgtttatatataattcttaaaagttacaattatagatactgtgttgttttgatcttaataacacagcttgaaacattcatacccaggcacgcaacttagtgcgtgattcttgctagttacttgtaaagtaccagcgaacagctccacgccgcgacgactacacaggatgtccagggatggacatggacgcaaggtggagcacgacagcaatcaacggaattttatcggtggaatcagacacttcaggcagtggttgaaaccgttcaatggctgcaatcaatagggagaagaccagatgtggtgccggggttgatggtggtagaagcgattggtgatccaatcggtaggttggacacttcgggcgggtagcctagattttccattgagctactctcacccagggagacgtgcggccgcacgcttggggttgattgaagctggaggcaatcggcattcttggtcggtggaatcgaacactccggatggggtggtccggacttttcgatgagctgcgttcgacaggtagatggttagacgtagcgcttgggtcgttcggcggctgggaagacggcatggtgatttgttggctgactcgcgaccatctaattccactacccgcataaaaattcactagtttatttttcatatgatatagtacaaaatttgaaagaaaaaataaactagaagtaagataagtgggtaaaagaatcccatttggcagccataggtctggccttagatggaagaacctgacaatggtgttttgcttccttgttgagggtaacgatggtgcgtaaaaacgtcgttgcctttctagaggcgttgttttaggagagcctcttccacagtttaagtattgctttgatggagtttgagattgaggatcactcgtggttgtggtttgggtttgcggcgatttgatatttgttgtcatgttgtattttttcttttgtctttttaatcatcattagagttattatatcatcttggtgtaattttctaaaatcaataaagtttccttttatcttacaataaacttcagaatctccggcccaacagggtctatgcttataactcagggagccatccaactgacagcaccacctttgatttccttgctaagataatccaaaattccaaatagtaatagaatataaatatacatactctccagggtctaagtgcaatgttctccatacttacaacagtgcaagattttgaatcccctgaacgcgagcggcaacaaccaaaattcaagtgaatggatcaacccatgtatacatgggtaccagtggtgtaccagacttaaccatgaaaccaatcagatcaatcagtgtagcataaaaaaagaatggcttggtccattggttaaacagtggctcagtttttc

SEQ ID NO: 35171 - DNA, 521 bp, Oryza sativa
tcttcgtccgctggttagcttattagtcgcaactaaaatttaatttttaaaacataacttttagttgattttaggggtttatttttattgtggtctatttttcagtattggttggatgacatataaattatttttattactctgttcaattttatagcacttattagccgttgcttaacccattagagccgaacacaactcttttgcttgcccggcactaaaaaattgtatttctaatttctacggtgcaaaatttgacgaggtcctatttatatgatgctctgggagatgaatagttatagtctgtgagattttttcatactgagtgaggagggcatggcattatcacaaagtagctcaatattcgtgtttggaacacccgagaaaattttgaatgctctctgttttcgtgtgaaatttctcaggcagggatcaattcaagtgtggttcaccttgtgctgcaaaagagagccacacaagaaaggctcccaaagattttgtaatttgtatgcatgcgtaca

SEQ ID NO: 35172 - DNA, 1501 bp, Oryza sativa
gtaaaaatctaaaactaagagtattgttgatctgtatcacaaaataatcgtataaatgaaaaaaattactggctcaatcacacacaagcgataaaattactcacaaaattactcacagctgaatcaaactagaaaaaaaaatgattcagccaaaaatccatctggtggctttgctggatcttgctataaggatgaagagcacggtctatgtcttgtgactggtagtggagagggcaaccgggtggcgagcagtagtcgacgatggaatcatggaaggatgtagcggtgtggtatagagatgagctcgacgttgcgcagtagcagccattcatcatctagcaagcacgaaaaaatgcaaaaacattctcgttcatgtcaatacagatgacgagcaaaagaaaaatagcaaacaacttccatcaccggcggactccaccctatcctctgcagccagccacatggagcacgatgtgcaaatgtaggacctgtgcagcccatcaattgagatcaggtaatattgaagattgcacgttaatttgatttgcaaaaaaaattagggcttcatgcgtgaagttgaaggagagtatgcatatgcaaatcagagtgtcatttccttgcttgttctatcaatgtcgccgatgtggagcagccgctggttgttgctattggcccaggtgaacacctctttgctggttaaggtgatacctagcgtccggcagcgaggcccgaagcgtgccttcgcctcaaccgtcgccggccactgccatcaaccaccacggtgtcatcctcctcctccatggtgtgtcgccgatctgtggggtgggatggtggatcgatccagatcccaaaaaaaaggaaaaaaatgaagtaggggcgagagtggttggttgggtacgggaaaaatataatatataccggaagcagagaaattgtttttatcgcagttaatcatttactccgataatggtgggagcacgatgcgggacgtggggtgggatcggaagcagtggagttgtttttattatcgaagtaaatcgtttactcgaataaagttgggtggttggggcgcgcgataggagtaaatcgtttactccgacaacggtaggagtgaaatgacggaacgtggggtggggtgggcctgggctgatgcatgtttggcgcttagaattctatcaaattaatctatgtttcaagtttgtaataattaaaacttaattaattatacgttaatattacctcgttttgcattaaaacacttaatttttatctctaagagaaaaaaacaccacctaaattaaattttttaagcatggagaaagtacatattttttgtttttacacagctggtagatgtgtagcaaatccaaaataaaatccacgaggcaaacgcgtccgtggagcagtcgagccgaagcaaacgccgcccgcttccgagttccgagtcggcgcggcggacggtatatttatcatcatcctgcccccctgcaaaatccttcctact

SEQ ID NO: 35173 - DNA, 1501 bp, Oryza sativa
gcgccgccgcgaagacggagcagcgcacgaggaagagcccctcccgccatagcggcgcgagggaggcgacgagggcctggtacggcggcggcggctgctgctgctgccgccgcgtcgggagcagcggctggtgctgcgagtgcgggtggtgcggcgcggggcagtcgctggagtcggagaccttgaggcggagcagcggcggcgggtcgaagcgggcgcgcgcgacgaggggcctcgtccccggggaggtgtggatgcagcctccctggcggtggcggcggcggcgggacgggtggaggaggggaggcggcggggagaggaagggcgacgcccggaggcagtgggacattgcggccggcggcgagcggcggcggcggcggcggcggcggcgagcctaggtgaccatttgattttggcgttgcgtgcggcgaggggagagatgcttggcttggctttcgccggggggatcgttttgcgtattctcctcgaggtttttttctctttttcttctatctttgtctttactttgctttattttgtctctttgaggatggcttttcagtcttgatttttaagtggaaatctgaataaatgtttataagtacttgttgttgaattatgatattcatcttctgtacattttgatcacttcttttatgaatgttttatatacttatctaaagattatcaaagtacttcctccgtttcacaatgtatgtcattgtagcatttctcatattcatattgatgctaatgaatctagacatatagcattaatatgaatgtggaaaatgctagaatgatttacattgtgaaacggagagagtatgtaaaagtaaagtaaaagtctattgcattcatgctgcttgcacatacgacttcaccatcacatttgcttgcacctaggacttcttcaccatcacaacactgatgcttctcagttccaaaatattttttcaaacttccaacttttccatcacatcaaaactttcctacacacataaaccttcaacttttccatcatattgtttcaatttcaaccaaacttcacacttccaattttgacgtgaactaaacacagcctgtatgaacttgcaagaacatgcagctttgtccattgtggctagactgtttctatcacaaccagggcagcttccattcatcagaatagccaaacaaatcaccagacgccagccacaagaacgccagacactcagtaaaaaatgtccacaggttacattaacacactgagctagcaccacaagcagctagatgatcagctattctactccagaaacacgaacaccgccataaagaacactggagaaatttaaattcgacaccaacaagatccttgctacttctggctcacaacgccaattccagcaacatccccattaaacagcttctaaagtaaggaacaaaagatatgacaacgtaagaacaataactgtcgaccaatttcgacacagcaagccacagcacaaaagagaacgagagt

SEQ ID NO: 35174 - DNA, 1501 bp, Oryza sativa
ttcttctcaatagctgcggcacaacctgggtgtggagacagtttgcatgggttcgtgcacagatttacgttcaataatccctggggctttcacttcgacacgtcttcgttcgtgatcgcttagagccccttttccatcaataggtactcccaaggcgtcgaccacacggcctaacatggcctttcccgcaggaacatccacaatagatccagtgcgcttgacaagatctccttctttaatagcggtatcactaccaaagacaacaatacctacattctcattctcaagattcaaggctattcctttcacaccgctggcaaattccaccatgggtctattctgagaagcagctggttggtagcctgtttttgagaatctaggaagggttgggtttctagtttctaacttctaatttattttctggattatacaactacaacttatcagaatctgaatctaaaactggagaagctcccccaaacaggccgcccatgcatgtaagctgatgtaacgaaaatgtatatcatctcttgctattctcatttggttattcttctttagttccatctgaaggaaaacaataggaaaaagacagtacatcttcattcattcagacatacgacaacatgatatgtgttccatcccatttgattctacattgttatatttttgaacaaatggaatatttttttctttttctcggtgattgaaatttggctcgaaatttctgaaatttaggaaatcccgggggacacagaacgatttcgtatggaaatttcttttttttttaaaaaatattcaatctaaatttgttcaaatttaataaaaatcccattcgaaattcctgagatgcccccgggcataaatacgcaaaacgaaattgcaaatgtatgcacccatagttgccagttggcatagaacccggatgttttcatcggggatatatatgatacagctactctcttcagtcttcaggtttttgtcatctgatctctctgcaccaagatgtgtactacacttcttgctgatcttagatttgccttagaagatcaacaagaaggtgagagggacatgatggagtggttgccaatcgtcattagctgtactaccactgcctgcctgccctgcaaagtctctctccatcagagcaaacaagagaggaccaataattggagatctctctctctggaggatgaacagacaaacaaccatgcattaatccatagttgctttaataattcagtcaatgaataaagttttctcccagctaccccagatacaagttgttggatctgcatgcaagcatgctactaaaaacataaacgtgggagtttactcttctgttcttccattctcatccaatgattatgtgggctcaaatgattatgtcatggtaatatcatctataagtgttgcattacagtagaataaactcaactgctaatctgtacttgctcaagcacttgatgagtgctgggagatctctgcctactaactgaat

SEQ ID NO: 35175 - DNA, 1501 bp, Oryza sativa
ggcagtcccaacccataacactagacatggtttccataaactccacatcatcaagaaactagtacaagacactactcttccaatgtaaacaccactattccatactttaatttaatgctacttatctcacatgatgtcttggatgttgtgtagaaaccatgtctcatgcaagacatggtttccttttctttcctcatttattcacttgtcacattattttttttcataggtggcaacttatttaatgttatggacaccattctagtcattgggttgggaatgtccttatattatggaatagagggagtactatttgttcgtgaggggtctacttatatcatgtaatagagggagtactatttgttcgtgaggggtctacttatatcatgtaatagagggagtactatttgttcgtgaggggtctatatctaattgcaaacaatataaggactttttcaaaacatttacacctcgcgtactacaaacagtgttctgacgtgccacgcgcgagcgctcggcctttctgcgcgcctaggcttaaaaaaaattgtcacgtgaattagctcttatttgtataattactcaaatatccgatgtgatatgtgctaaagtttagtctccggatctaatcaccaccttaatattctccaatactacagaagaaaattggcaatttttgctacagcctacacaacgtcgtgactttgtaattttagctataggataccacgcgaagccactttggggaagacactctcagaaattgaatatttgccacgggacatcgcacccattaaaatgatattttcgattgaagaggagagagaaaccacgtgtgtttggagagaaaattaatttttcgtctctctgcccagggaaataaaataaaataaaatgtgcgggcgtgccagtgtactaagtacaaaaaataaaatagacgatggaaagtgcactttattataattcttaagaattacaaaaatacaaaatacttgaacaaatacgcaccacagcccatcgacatggtggatctaacttggcgattgtgctctcctggttcccggggtctcggaagacacccggttaaatactcttgcgagttaaactcacgagacacctccgattaaggtacgatggtcgtcatcgttggtcttcgctttatgttctccaatgtatgatgtagatgtgatgatgttgatgtaaagatagcaatcttaaaggccacatcggtggaggtaaagattgtgattgtagtggagacaaacatgccattggcgacggtagccaccaaaacacgtcggcgggtgtatggatgaagcttgttgcggtggcaccaaacttgagatcatcattggcagatgcacgacgacgtcatttacaaatactcatcagaagtctggggacaccggcagtggtatgtgtgtatgaatgctgtcagtgaggtgacgagcttgaagaagacgacgccgatgatagtgatgagctttaggtcgtcaccggt

SEQ ID NO: 35176 - DNA, 1501 bp, Oryza sativa
atattcgcagctcccatgttcaagaagcaaaagatggaagttcttaattagtgtttctggtctttgtgtttatgaaacaaacaaaactatgactgaaaatggtaatcagtatacattctcaaatgcagcagttcatttgtaatccatttgtttggaaattcatgttgtatttagttttgtctggggcttattggagttaactttcagcatttatattcattattatcttttcagcagcccaagctgatgcagccagtgaccagcaatgcagtatctgctgattcagggatgtcgatcccaggagccaaaggtgattccagtctttgtatacctgtgaggcaagctaggtccagtatctctctttcattttctggtttgactggtgagagcagtgctggagattaccaagattgtggggtatcaccagtgctccttatgggtgagcctccttggcatcctcctggccctgaggggtcatttgctggagctaccagagacgatgctatcacacgatacaaggagaagaagaagagaagaaagtaagtgcatttcttactaatttcgctactcatttgcttaaacatttatgctgtataaccacgtaagaattctataataaatttgtggctgcaaaagaactcaaagagaaattgtagcttgtaaacttttcggcacaacctctactttacacatttggtaaagagtgcttgtatcgttgagtttcatgaaagaagacacatggaagtagttttcatggaagttaaattttgagtttttggaaacatcagtttttgttaccctagttttacagtaggtagaagtaaaattaccttaactctgtatctttttacttacaccaaaaatgtttttggtaggtaactgcatcacataaaaacatgctgaagattttctgcttgaagataacttattgctaccttttcattcagagagctaataacttcttgtttcttgccttctcttctaatatgtcagtccactgatgctaacatgctatatttctagcataccaattgcctcctttttgacagctagctgattatcttttctcatggcttctcttgacagatttgacaagaaaatcaggtatgcatctcgcaaggctagggcagatgtgagaaaaagagtcaagggccggtttgttaaggctggtgaagcatacgactacgatccactctgtgaaacgaggagctactgaacacaataaaacattatccaagtgttaggttagcaagcatcaaccaatgcttgttgtggctggcaggaaggcactcatactacaaacaatgtggcaggcctgcctctaaaaacaacaaaaaaaacagagcaatcaaggggacaaaaaggacaaaaagatttgaatttgggaaatttttcagatgctaccccctcctttttcttctgtacagtggagggaatttgcatctttctgttgctttcgggaggagcgatttgagtcgctgcccaccttttgtgaattaat

SEQ ID NO: 35177 - DNA, 1501 bp, Oryza sativa
aacacacgtggtttctctctcctcttcaatcgaaaatatcattttaatgggtgcgatgtcccgtggcaaatattcaatttctgagagtgtcttccccaaagtggcttcgcgtggtatcctatagctaaaattacaaagtcacgacgttgtgtaggctgtagcaaaaattgccaattttcttctgtagtattggagaatattaaggtggtgattagatccggagactaaactttagcacatatcacatcggatatttgagtaattatacaaataagagctaattcacgtgacaattttttttaagcctaggcgcgcagaaaggccgagcgctcgcgcgtggcacgtcagaacactgtttgtagtacgcgaggtgtaaatgttttgaaaaagtccttatattgtttgcaattagatatagacccctcacgaacaaatagtactccctctattacatgatataagtagacccctcacgaacaaatagtactccctctattacatgatataagtagacccctcacgaacaaatagtactccctctattccataatataaggacattcccaacccaatgactagaatggtgtccataacattaaataagttgccacctatgaaaaaaaataatgtgacaagtgaataaatgaggaaagaaaaggaaaccatgtcttgcatgagacatggtttctacacaacatccaagacatcatgtgagataagtagcattaaattaaagtatggaatagtggtgtttacattggaagagtagtgtcttgtactagtttcttgatgatgtggagtttatggaaaccatgtctagtgttatgggttgggactgccttaaggcacaactactatttttagatgttccataatataaagcatacatgcatgcatacaattaattaggacatattctccattaaattattactttttaaaatcctccacccttaagatctctaattctattggatgcatgcattatatttattagggtgatccaaactagaagatgataataattgtttcttggtctttgggttaagggtagttgtgacttagggtgtgtttggatgggaggatttgggtggataggagatggcggcccatttttgtggctgtttggttgatgggcggaagtgggatacgacggccccaagaggaatattcctgttagatgctggatggggggggggtccggacgatttgcccggatgcagccgcccgggcgcccgggcgagcagggcgacgggtcgcttcaccccctcaccgagcgttagcagcggccacgcgagtgaatcgacggttgacgcaaaggagaggtcggcgaggtccgcggcggcggcgtgaaatgcgaacgccgcggggtgggaagggaggtcggcggcggcgtgaggtgaacgcggcactggcggcgggaggcgaggtcggcggcggcgcgagatgtgaacgcggcggcggcgcaagatgcgagagccgcggcgccgggaggcgacgg

SEQ ID NO: 35178 - DNA, 1501 bp, Oryza sativa
gtaactgctccgcacgacaagtgctttaacgactaaaaatctaagggatccaatttagaacaaggagttttagaggaattttatagggttcaaatagaaaaaggatacatgtaaaaaacgtgtttgcaaacatcatattaaattgatatgtcaaatgtggttgaaacttcatttttataacaacccactaaatccaatggttgagattttgttagtaagagtttagtaaagatttcttagtacatacgtaagtattactcgttaaaatactacaattttttttcataaatgtccatttggtgtaaaggaatagccattccaaaatcttataaaattccaatttcttcaaaatttcttgggacggtctcaaatcatagtgatttttgagaattaatttataattagtatgggatccaaacctctcggaaaaaattctttctatatgtttcttttgatgcctgtatttttcttcggcgtgcctgtattttttctttcctttattggaagaggtcatttctgtaccttccgtgtaattttctatgcatgagaaaaatcttacgtttttcttatccatgtgtatcttttatcctaaatatatgttccaaagtgaaaaattaaccaaaacaaaggaaaaggatggcaccttaggagatatgttttcagtctcatctaccaccatagtatcatcatcaagtgccctgacctgttgatccactcgtactggacggacagggcatgcacatgctgtcttggtggtgggccggcggcaaacggattttgtccggagtgtaatctccgcggctgttttcgatcagttagcctgtttactaccttttcctacgtttcgtacacctacaaaaagagaaacatagttaagcaaacgctaatcaggggcggaagctccacttctatattaagtatgttattagtgtacaactggttaattactgagctcacaccgctcaagtggcatacatccatcattactcggagaaacggcgctctatcgggtcatcgggtaaaaaaccacttgttgttttggacaagattctatatatcatattggtaatgacttcttagatatttaatttgaaaacttaaatatgtgcaaacttatctttaaaaaactacttcatagtactgcaaacttattagagtataaatataattaagggaactgctagatttcaagcgcctaaaattttgtacattcttaagccctaaattgcagagttatgcaatatgtaatatatgttacttcttttaaactggaattttggcgctacatggttgagtttgaatattttttacctgtactggaattgtaagttctatcatgtagttcagcattttttcaatttttccaggttagaatagtttgttgcttaacttttttatcttggaaagagggagtactgatgaaaaacaactactatgttgttattcaaggaaataaaaaaagtgacataaattttcaaaaaaaatagtcaaatcgccctca

SEQ ID NO: 35179 - DNA, 1501 bp, Oryza sativa
tcctgcttggtatgtgacagttgctacaagagtggaaagcagtacaacaagagattgagccttctccagaatatccgcattgcttgtatttgtgtctgctccaccattgctcgtgtccgtctgcactccaacatttcttgtggtcggtggtacaccattgcttgtgggcaacttggctccaccatggcttgtgcctgtttgttctcttctactgcttgggtttgcctgtgcttcaccatttcttcttctcgtcccattacttgacctagtcattcatgagcatgtgtatttaagatggaattgcatatgtcaataatatttggaagcagaaaaatatacatgcattccatacctgtcacttgaatctgactgatggaatataattgtcttgaggacaataatgcatgcaagaacggcaaaaactagactgcccacatagatggtagtgtcactttctcggctgcttccggtggcataggcccccgcaagaccgacaagagcaatagagatgtatgctttgagcactatagtccgcactggtctagttgtgcttggaaccttgtcatggagtaatgggatgatgagccgcttgtctagaagcagcataatggtgagcagggacatgacaaatgcagtagcatttaagagaaagaatgccttcagacggatagaatggtgttcccgcatgactgggtcgcttgcctcatggccttcctttcctttccagctgagatgttgcattttgactgcacaagttacagattgcaagttgcaactgtcactggttcgaacattgtaaagaatctgatggatctagtcatatctgatgcatatgccagtacattgccttgagtccttaacactggggagagtagactttttttagattacaccacaataaaagtgcaagttggatcttagatgtaatcttagcacgtacctttattcagcatctgctatttaattaagctccatagatatggtgaagaatcagctggaacaagtactagggctacttaacaaaaggtagcaattgtgtgagtgaccataaaatagttctggagagagattaataaagagactcactaagaaacgtatttttggggtagatgttaatagtagaactcgtgcaatttgagatgcggtctgactgacaagaaaagagatcgtttgtgaagtcgtcgttttcatgctgagtactttgaaataactgtgatccctaacagtaacagcgtgtagatcacagtgacacagaaacctaattgctcttaaagctagataacagcatagtaaaatattattccttatcgtgcgagcctgccatgtgcactggattcacacctgcctgagttctcgtccatcctcagatgaaacctgaatttactgaattcatacacaacagtagtcgttcttaatctatctattatgtagtactaaatgaactcgaactttgatccactacaagcaagcaaaaaaaaggagttgggagtgggggtgggac

SEQ ID NO: 35180 - DNA, 595 bp, Oryza sativa
ctcattgacggaacagagggtacacctcatggcgctagaaccagcgagggacccctgactagcggcactagggttgctcctaatgtggatacactactacagaatcgattttccggatgagaccgcctccaaactgcaggcgggacatatataactaatcccgcatgcaaattcgctccctcagaagcggttcaagggccggatgtgaaaatctattatcgcaagtggtctcttaagaggaccgcatgcgaaagtatatttttgcatgcagacaacgtggagagcaagaggcccccatacgtcagtgtactattttttcccacaccctattttctcctcctctccacctcatcactcattttcttctcttgtcctccaaaacagcatctcttccccttccacttccactcttctccatcactcctttctcactccatcacctcatctcttccccttcccgccatccctctcttatcttctcaacctccagcagctgagacgatggcctcgcgggcgggtggctgacgcggaggcggaggcaactgaggcgaagacagtgacctcgcaggcaggacacaccggcgctctgagatga

SEQ ID NO: 35181 - DNA, 220 bp, Oryza sativa
actattctaattacaaataactagcatacagatatcacataacaaacaattcaccaacatggccaccatatgttggtctctgcttccagattagcaaacaaagcaatgcactaccatattttttctctacagcacagtagctcaacagatcaaacagaacacaagatatatgataactaccatagtttggtaagtctctaccacaaaggggaacagataa

SEQ ID NO: 35182 - DNA, 478 bp, Oryza sativa
agctcggtacccgccatgaggacaaaggctgcctctatgcatggtgatcctcttcttctgtcatgctcttctaatctttcagagaagctgttgatgctattttatgttgcttattaatttggatgtcatctaaactaggttatattctctagattaggatgtgatctaaggtatttttcaaagtagaaattaggacatgtttgttcatcttggatgcactgttcaacatttctcaaatcatcagatagttcatctagtttcttcagacaagctgatttctgcatcatgtgagcattgaacacactcctaaagtcctactagattcagagatggatgagctgaagtagttagtggtcattttcatgtccaagaaaaccaaagatcatgtgagattttgccctgatcaagagggcttcttcaccatttgacaccttttttcctctgtttacctgtgatctctttccctttttgttgcagc

SEQ ID NO: 35183 - DNA, 200 bp, Oryza sativa
atgatggttgccgaattcagagaagacgctggcgatcacgcgaaacaagaaaggggaacgaacagaacaaatcagagaccatgaaatcgtcgaagaacatgagcaagcagcaaacaagctagcggagttcttctagcgtgcacgcgacacggagcgggtgtccgccatgcgcagctgctggcaatgccaccgtcgtcccc

SEQ ID NO: 35184 - DNA, 203 bp, Oryza sativa
tcctgcagcccgatcagtggagattcaatattactttaattactcaattgttttactgttttgctcaataaaatgttttacaactgcctttatgcaaatagccacaaacccctccttgtatccccttgcacgtctgcatcgttggtgtggcttgctcagtacggtggttgtactcagtcttgctattattcccccttttcaga

SEQ ID NO: 35185 - DNA, 344 bp, Oryza sativa
accgatgtatatagcgtgcaaacccctcccaactccgaagtccacagccagatcaacacgaatcctctcattcccaagtcaactctgccggatcaatacgaatcctcgcggctcgcgcgctccggttgttaagcagtacgtgttgagtgctaccagaaaagcacatagccattaacatgcatatatacgattcgtaatttgatatgactaattaactacacctcttcttccactataagtactcaagatgccaagctagaagatgtagaagcgagccgaaatagcctcgaaaggaacagaggtgcgttatatagatcgggctgtcaaaagcatacaaacacaca

SEQ ID NO: 35186 - DNA, 1501 bp, Oryza sativa
tttatattcgatacgatttgtatttatttctatatccgagctattcatatttgttttctattaaaaaaacaaaaaagaatatgttacgagtataatccgtcctccattccgtattcattcctaggacctttgactaccgaaagtatgtagccgttgtgcattcgagttcaatgtttgcaatataacattcgttaggttcgccaggtttagatcgccaggtttagatgagtaagagcatctccaataggctatctaaattaggttctccaaacactcatatatccaactcttcatctgatttatcaaattaaactcgttgcttactctgacaacatctctatctaccctctctattctaagtctatgatagtgcgattcatatgtcagtctctccaccatcctcacaaccacacatccttcaatccttcatgcatcctgagttagcaaccatgctgggaagaggggagaaggcagcagcggtggcaagtggcgagaggaatggatagccaccgtcgttggtggcagatggcgagagcagaagaagacgacaatgcagcggcggcagcaccagctgcgatggtggtgagctcgcgctgtgggaaaggtggagctatgacagcctgtgatctcggccggcagcgaaaggagcagttacctcggctggcgacgctgtgacgactcaactgtggtgccacatcgtcatctcgctccgagccatccagccgaccaccgtcgtgtcattgtctcgcactcactactcccttgccaccgagccgccatcgcgccctcgctcttccctttccaacatcgtgttgtctcgccgtcgagctaccctatcgccctcgctgtggagctgcgtcgatcttgcgccctcgctcctcccttgtcgtcattgccttaaacgaagaagacccctgggccaccttgcgaaatgccgtgtcctcctaccgtctctcctccctcgccgagccaccctcgccccatctcctctggccgcgggtaaaggctggcttgatggagcactgccggatggctgcctggcaaggagagagagctagagagggggatagagtcatggggcccacggttggcgagtgatattgggtggccaaattatgtcagggattggagagatttggccagcgggttggagaggctgttggagcactttttttttatggagttgccaagttttagcttggaggtgcacttagagtctgttggagatgctctaagttgctacttgctagctgctggttacagcgacttcgtccaaactaactaaatttatgtggcatgtaaaagagctataaaaacgttatggttaattaatattaattattatgaccttaaaataaaaatttatttaatttttaaaagaattttaaattttcttttaacaaaacaagttgtttagaacaatagctcagccaagaagttgtttagaacgcagccacttggatcgtatgatggcgtgagcattattatcggctagtctatg

SEQ ID NO: 35187 - DNA, 1501 bp, Oryza sativa
atcaacctaattttgattttctagcacaattcaggtatattgagcagcagtttttctaatttcggcaaatgatggaggggataaatttcgcccctttttttattttaggtcccacccccactcccaactccttttttttgcttgcttgtagtggatcaaagttcgagttcatttagtactacataatagatagattaagaacgactactgttgtgtatgaattcagtaaattcaggtttcatctgaggatggacgagaactcaggcaggtgtgaatccagtgcacatggcaggctcgcacgataaggaataatattttactatgctgttatctagctttaagagcaattaggtttctgtgtcactgtgatctacacgctgttactgttagggatcacagttatttcaaagtactcagcatgaaaacgacgacttcacaaacgatctcttttcttgtcagtcagaccgcatctcaaattgcacgagttctactattaacatctaccccaaaaatacgtttcttagtgagtctctttattaatctctctccagaactattttatggtcactcacacaattgctaccttttgttaagtagccctagtacttgttccagctgattcttcaccatatctatggagcttaattaaatagcagatgctgaataaaggtacgtgctaagattacatctaagatccaacttgcacttttattgtggtgtaatctaaaaaaagtctactctccccagtgttaaggactcaaggcaatgtactggcatatgcatcagatatgactagatccatcagattctttacaatgttcgaaccagtgacagttgcaacttgcaatctgtaacttgtgcagtcaaaatgcaacatctcagctggaaaggaaaggaaggccatgaggcaagcgacccagtcatgcgggaacaccattctatccgtctgaaggcattctttctcttaaatgctactgcatttgtcatgtccctgctcaccattatgctgcttctagacaagcggctcatcatcccattactccatgacaaggttccaagcacaactagaccagtgcggactatagtgctcaaagcatacatctctattgctcttgtcggtcttgcgggggcctatgccaccggaagcagccgagaaagtgacactaccatctatgtgggcagtctagtttttgccgttcttgcatgcattattgtcctcaagacaattatattccatcagtcagattcaagtgacaggtatggaatgcatgtatatttttctgcttccaaatattattgacatatgcaattccatcttaaatacacatgctcatgaatgactaggtcaagtaatgggacgagaagaagaaatggtgaagcacaggcaaacccaagcagtagaagagaacaaacaggcacaagccatggtggagccaagttgcccacaagcaatggtgtaccaccgaccacaagaaatgttggagtgcagacggacacgagc

SEQ ID NO: 35188 - DNA, 1103 bp, Oryza sativa
ttcctgcagcccgtaccagggccggcgctggctcgccgtctccgccgccccatcagagcaccggcgccgccgtaaggagagagagagaaatgtggatagggttgggggtggatggatagggtttcctaagggtattgtgggtattatgaataatagttgcattttttttttattttaaatcaaaacttaacggactagtggaaacagggtcagacgggagcttcatttttgaaaaggagggtcaaataagcaaactctaaaaagtagggtcaaattggtagttagggttcaaaacggggtcaaataagcaatagcccctaataattatggaagataggtgaaagaatctatgttcagtcgaggagccaatatgatcgtagctatgtaaagagataggagcgaaattaggtggtctataatctggggaaacaactggtcagccagaattaatataggatcactggagacaagtaaattctcagaaggcgaggtgaaccaacctctgtatccaatggcatccaaaatcaatctacatctgtggctcgacacagcagtagtatgagatgaaagcaaatactaactgttactaaaatgcaatgcgcatctggtttgctgcctgtgcatactcactttggaaaataagaaaccgcagatttttcgacaagcaacaagccagactttcagacacaatccagcaaattatcgactgtcttgaactttggaaactccgggccaacgcagccattaaagagaaattttcattctggtgtgactcaatcacacagagctaatgtaaatacaaacttgaatgttttttgtttctaaatttcttgtatattctactttctactcctacttctcatgtttccccactcagtaactctattcttctccattttatcaatgaaatggctataaggtagaaccagctctaccttcttacgtcaaaaaaatgcaatgcacatagatcagaaatgaagaacgcaaaggtcatgaacttgaacaggttcacaggtaggttagttggaggtgggtaatagcagtgagaatacgtaccttggaaagttgtcgtgattttttatcccaaactgatgatgtgacca

SEQ ID NO: 35189 - DNA, 512 bp, Oryza sativa
cttttgtttatgactagactgagccacaaactaagccttacccactagacatgtggaagtacggtagtgttttgcaacagaggcccgagcttaatccttatagtacccgaggtacgactaacaaaacccaaccacgcacctcgagcccagcctaaaaccattttgggggttttgaatagagggggaggtgtgtgtccaattccaacataaaccaacaattccatagtgtccaaaagatatgagaattcccaaagtctaaagttataaaaaccacctaatgttgtcctattaaacagcgaagcatctacctaaattcatactagtggaaccatgaatataatgtccactagttagggttttgtttattctagggtgaacaaggtaataataacaatagcaataataataaggtcataacaaaggtaaataggcatggctaaataaaacagtgataacgcgggaatttaaataaagcgataatgcaataatttaaatcaaaatacttttataga

SEQ ID NO: 35190 - DNA, 683 bp, Oryza sativa
acttcaaatggccataacttggccatttgaactcggaattggaccgttcaagtctctaatttttccttaagaagtcaagaacccatttttgtgctttgtttctgctgttatgtggagtttattagagtaaaagccttttcttttccgttggtcgtgtagacgctgcagcttcggaagatccgctcttcgtggaagttgaagccggcgtttgggaaagcaagcaaggcaagtcacatcatccttgaacatattgaatcccagtctataaaagtattttgatttaaattattgcattatcgctttatttaaattcccgcgttatcactgttttatttagccatgcctatttacctttgttatgaccttattattattgctattgttattattaccttgttcaccctagaataaacaaaaccctaactagtggacattatattcatggttccactagtatgaatttaggtagatgcttcgctgtttaataggacaacattaggtggtttttataactttagactttgggaattctcatatcttttggacactatggaattgttggtttatgttggaattggacacacacctccccctctattcaaaacccccaaaatggttttaggctgggctcgaggtgcgtggttgggttttgttagtcgtacctcgggtactataaggattaa

SEQ ID NO: 35191 - DNA, 656 bp, Oryza sativa
gggactaaagatcgtaactttagtcccggttggtaataccaaccgggactaaagatcccggtgatctttagccccggttggtgctaccaaccgggactaaagtcccacccctatatatatgtcttcttcctcctccagctgcccgagcaagcttcaaaatttcttcaaaaaagaggggaggtcatgccaaaatttctattgaatttattttggtgattacatacaaatcggaggtgcctaaaaggtttgcaacttcatcctccaatgtttttttttgtcatactacatttgcacctatgttttgcacactttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttgtgtacggtttttttgactcatgtaga

SEQ ID NO: 35192 - DNA, 810 bp, Oryza sativa
ttgactatgaaagttgataatgcaatctttaggtaataaaataagatgtgaggagctacattgctagaccctgcaaatggaattgacgcattcatgcatcatggcagatattaaatcctgtttgttatgtaatgttacaatatatagaatcctgcaactgttcatgttagagaaatggaaacggaatgtcttagttgcgcaaactgcaagtactataatgttgcattattagtgagccaggtcagcacagttgagttcatgatgggacatgtctttatttttggtttataattacaaatgactctttttggtctttgacaatgccggaatccgcttaccatatattcactagatgtggttggtaaaactgtcgtgtggatagctccttttccccttgataatagaggcatatctctgtacacttttccttggaaaataaaagtgtccttttcttattcggcaatatttgcaaaatcaaataggataccatgaggggggggggggggggtatagtactaaaaagcttggtgttcatatggagtacaatgaaatagtattactcgtctatatcagctatcagcatgcatatcccacggtagctgcctagctggcatggaaaaggcaataaattagccctttctaagtattactcctacatagtaaggtgtagaagagagagtgaagaaagagttgtttctttgcagagaaattactcggacacgttgctccaagcaatatgagttagcttatcttttgtttcactaaataacagttctggataagtagttgttacctagcttctcgttaagt

SEQ ID NO: 35193 - DNA, 925 bp, Oryza sativa
gtggcgaagctatattatgtggggagggggggggggggagtgcacatagactctcaaagaatttgttttgagaattaatattatttttatggaaaatcgcaaaagtagtggctaaccggggaaaatcgcgaaagtaggtccctgtcgaacgggtgcaattcgatagggcacctatcgaacgacgggcagtcgacaaagccctgtcgaacggctggcgttcgacacgctcacctgtcgaacggagggagttcgacagggcccacaacccggcgccgcgaggcctgtcgaaccgggggcgttcgacaggtccctccaccgaccctgtcgaacaatgggcgttcgacaggccggtttaaagccccgtccacccaggccgcgagttccatttgtttgaggaccacatcgccagccaccgccgagagtcgccacatcgtcgccgtgagcccccgagggagccaggggaggggatagcaggcccgagaggaggcccaaaagcgccggccgggaggaaagggttggcgacgccctccagcagtgaagttaaggtatacattagtaatccctaagtacaatgcatatgaaagtttaataaaaaattggtttaagagttgttaattgtttcgcattgttcgatgttagtatgtatgattagcacatatttgttattgctaaatgttggtagaggtatttaagtaattgtacggttaaattagttcttagttagtacatattattgatatgttgtgtgttaaaataggtacaaaggtgttatattttatttggattattaaactagttgtttgttactaatagttgtaaattagtacacggcaatgtagtataagttgtaataggttaattatcgaatgattaaatgattaaacgtgagactatttgtcatgttttatcaggatgtcaggtgata

SEQ ID NO: 35194 - DNA, 1501 bp, Oryza sativa
catttgcggcaaggagaagtccatagcaagaacagcacatgccacattggactagaaacctaccttttctagccatcgaaatcaccttttctgctatagtgctattgccgattggagttgttttcgatataaagctccacagatacatagcttcacagccatcgaagatagttcgtacttagaatctacactctttcattgtacattttaacctcgaccatcgttaacttcatatttgtttgtatcattgcaacgtatgctccgtcgatctgcatcagattctctactttctttgaccaacatcacattttcgtttcaccaacaaaataatcaattcagtagagcttaacaacctacatgatgagataatgcagtttattttacgtccctcgattttacccagagtctgacttttgaacttgaaccgaaatgccacattcaagtccatctctttaaactggtgcaacccggattgatttagatgttgctaacaacacgtctaaggctgtgtttagatccaaaatttggatccaaacttcagtccttttccatcacatcaacttgtcatacacacataacttttcagtcacattatctttaatttcaaccaaaatccaaactttgcactaaactaaacacagcctaagtgttttgtttgactgagtttttataccacatggcgttaatgtagcacttgaaaaaaatgtatctgtgggaaccatgtgttaataagtactatctccatcctagccgtggttacacgtgtcgtccgtcttatttaaaaatttatatataaaaaaattaatcatataaaatactaatcatgttttattatctaataataataataataaataaaatactaattataaaaaaaattaaattagacaaacggtgtaaaattgtactaattttgaaacggaggagtatcatttttcctcggcgcagcgttcccttgccgaaccagcacattatcctcttctttatttcaagtttgaggcagtcttccgactgtcttcttcttccttccacgaaacaagtaacaacatctccggtgtgatctgatctgttcatttgatttgatcgtatacacgcacttgcatatcgcgtctccttgtgtgggggcgagtggcttaggaaggacgctgtccggcttgacacgtcggcgattttcctagctggctgaaggaggtaaaggtaaaagcacctttgagagaatgttcctcgttcgtgtcaaacagtcaggtacgcccctcaccacatgcacgaaagttgttaacaccacaactagcaagagcgacagatgcaaccaaaatatatgggggtgtgcctgattttgtgtttaggcggtgttcttccctcaccttttccaactatctctatcgtttttcacacacatatttaccaaactactgagggccgctttgaatcgcagaaatggaaaaacgcaggaatagaaaaaatacaggattctgataggaatgcagatgtaaaatagagg

SEQ ID NO: 35195 - DNA, 712 bp, Oryza sativa
  unsure (1)..(712): unsure at all n locations
ttcctgcagcccaaacttcaatttaactttgcctcaactcaagtgcaattgcagtatgtcatgcaaacatcaccaaagattgccatgcaaatatcaccgaaaactgatctaataccaacatctgttgagctttaatttgatttaggtcatattaaataaatttgaggtgaagtaatgaatatcattggcagaaaaaaaaacaatctaaagaccatcaacaattatactatgatccctacattacatatcccacgaacatttgtctgatttttttgtgtgcagggactgaatgagcatctgtgtgacatttttttaaggagaatcacacattggcagaatgtaattagagaaatcttataaagtaacgaactaaccagcaggctagggctgcaaacaccacgacggggtgggttggtgtggggaagggggagcctgaatcttccactgttacagagttgcaggcattttagcaagcatacagatggctaacatcacggctgaaccataccacaaataggggaggaaaatcagtgtaggaacactgtgcaaatcaatttacaagcattgaatggtgcctgcgtttgcagtgcaaattagattcggagaaatacttgctcccacgctgtggacgggaggtcgaggggaacttgggcgccgatggagttgttagctagccaacagcagcgccccccccccccannnnnnnnacagc

SEQ ID NO: 35196 - DNA, 1501 bp, Oryza sativa
ttgatacaacatatgaaagatatcacatcctgggtatgcaagaaagacaatcagaatatgaagcaggcaagatgtcatttctgcaacataaattttctaccctgaaacaaacgtatggatgaacaaataattaactattctgtaactcacacagaatttaattctttccactgcagaggaattgcaataaggatgaaactgctgccagaacttcttaaccgcgttgcttctaaatattccctgcattaataaggacaggttgaatagagaaagagtaagaataaaaagctttgcatagcattccataaatacgagcaagggtatagaattttaaacagccagcagacttgcaacagataatatggcatcttttagactaggatcctcttatatgtttgcataagagctaattcaactaaaatgtaaggagtgaaaaaagttaagtgcaaatcctaagccattacaatttcaaaccaacctgaaaacctgaggcattctgtcaattttcaatgctcaaataaaactaaaacaagtattgtagacactctagcacatagatactctcccctaaattgcagggggctctgcctgtctgacaaacaggaaacagccaccctgtgcattgtggccatctcttccctcctttttaactacgtcacagataaataaaagggttcaccacaaacctgaagggatgaaagaagtgatgtcctgacaattgtttcagcgaaagcaaactagtcctactacccgtctaccccatgtttccatagtgtggcctagttcaaccttgactgtctatggccaagcacacacgaaagggtctttgagcccaagtccataccccctctgctactgctacaccgtctcaaattcggggcaggcattctcacaaacactcagcgcgcagcgcgatccgagtccccaaaaccgtgcaatgcagaaagccccccaatactccgcgcggcgggagcaacacgcagcaggtgagtgtgggtagagaagcgtgggggttgcgtcacctctagggagcggatgaattggtcccgaagcagctcggcgaggccgcgggcgcagaggtccgcgacgacgggggccaggcgcgggcccgccgagaggtcgccggcgccgccgaagagctcgtcggagaggtcgcagaagcgggcccacgagtcgagggccccgtcggcgtcgtccaccagctgcatcgccctagccgccgcgtccccgcgggcgcgcgagcgagaaggcgcgggcgcgggagggaagacgaacaccaaaaactcgtcaggaaggaagggaaacgcctgaaagttgtttgttttttttttcttttggaaaaagtatgaattactggttgaactatcgcagtgaaccgaattacccctttaacttgaaaagcagatatcgctcaccctaaactttcaatacaggaaaaaacaccccctaactcaacatcggagtggttttggccctacgtggcaatccagttagtattttt

SEQ ID NO: 35197 - DNA, 1005 bp, Oryza sativa
gcccccccccccctccctcgaatttttttttgttttatttgtttgatatttttttcacgcttagggacacacaagaaccaaccatagaaaaattgaactcaaatgaacgtaatatgtgacctatagaatttttcctctcctctcctctctctccgaactagtgcaaaggggagatgtacaacttttttatttttattttatttttttgatattttttcacacttaggaactcacaggaaccaaccatgtaaaaaataaactcaaacggacgaaatatgtggcatgtgaaattttccaaagctctaccgaaaaacttctctcctcgaaaacacaatcttgcaagcggaatttggaggttttaatatcgccgaacccggcaaagctagggagaattggatgtaactttttctgtagatgtccgtgcatatattatttgcctgattccgagtccgtatgagaaagttacgcctattttaatagatgacatattttgtccgtttcggtagagttttggaaaattctacaagtcacatattttgtccgtttgagtttattttttatacggttggttcctatgttctcctaagtgtgaaaaaaatatcaaaaaaataaaataaaaataaaaaaattgcatctctatgtactgtttaacttatatatgtcatttcatgtggttatattttgaattagattaagtaatttcatatagtggtagagtgcattatgtttaacatgctgatcaaagggttttactaaagaaattatggtctaattttagtgaaggtgcaaagtagactaagtggtatgctagctattttcagacttagctaagtggtagttcgagtttaaattttttttgtggttggttgtatcgtgatcctgagtgtgaaaaaaatccgaaaaaataaaataaaaatgacaccgttgcaactccatacagaaaaacagaaatggaggcggcagcgcagccatgctggcgccctcctcccttgggcggcgccagca

SEQ ID NO: 35198 - DNA, 1501 bp, Oryza sativa
gccaccgccgccgccggtgagccgtcttccccccctcacctcgcgcccaccgccgtcgccgcccggggaagcaaagagccgagagagagagagatatagaaagaagccgggagggagcagagaaaaagaaaagagaggaaaggaggaaggagccgggaggagagaaagaaaagaaaagagaaaagagagaaaaagaaagagaggagagaaaaagagggaaaatagaaaagaagaaaaggagaaaatagaagggaaatttggggagaaattaggaggatttaggaaataaaaatggtcggggttaatcgtagattatttttggaaattcctcgagcgtaatagtatttcggtcgaaattccgagttaattataaaaatatgtttcttgatcagattagattaaaattagtagtaatttagatataattaataactaaacaattagatgaattcttatagattattatagattatttttggtaatctctaaaagtcatcggttcacggtagaaattcggatttaattactagggattttagccgtgtattatatttaatcatttagtcatagactaaattaaatcatataatatttctaggatttcgtccgatatttagctcgcgatagaaatctctaacctattatatggatataatgctcgggtagattaaattaaaaacttatgacaacaaaatatttatacccgcaaaatagtttaagtcgaaattgggtttgccgtagttcgcagatagtaaagtttataaaaaggaatcgactttcacattcgactttcatttggatttatttggatttttatttgaattctaaccgaattcaaatcaatttttgcacgtaactatagagcccgagggagttgcggatccaagcgaaggcaagacccgcaagactctgagcaaggcaagtcatcactattccttgaacatgttgatcccaattgcgaaattgttttgtttacaaataaaattgcatgcaatgatgaacatcctacttgtgattatgccatgccttgattattgtttacccttaaatctttgtaaccatgtttacgtatgagtccctagtcaactatgacaattgcttagaaatgctattctagaatcatgcatactcatatttatcaaatgctatatgcttgggcaattacctttgggaaggtaattgagatgcggcatgtggagacatgagcgccacattgccatgatgttgatgacatgatttgtgaaaggagaaataaaattaaataactgttttcgactggggcggacggaggatttgggtggtatctggaaaaggctagtaccgtccccggtcaattaaggaccgagccatgaagttaagcatgaaacaacccccgtacaaccgcacttctcgtatgggtatagacctagcggattagatagccgagcggaggcagtatccctgcatagatggttcacccctgagtgaggcaggtgcgctacgatgggacagccgttgaggt

SEQ ID NO: 35199 - DNA, 1501 bp, Oryza sativa
gggatcacaatggatggtggacagaaccgtcattgtttaatatgaacactggtattaaaacttgatcagtctatgctaggtcttaggcttgtgaaaagaattacaaaacttgctttgcgcaaaagaaccatagccatcctttgaattcctctgtcatgtgcatcattgctgtggtggcttgctgagtacggttggtactcacccttgcaaatataaaattaatcagaagcgggagatgaagcctcggaggatccctatgcctactaccaggagggagatgaagacgatggcgctcagtaggtcttagtacggtcgttgcctgtggcaatggcatgccgctgcctgaattccgctgccttatctatttctgcttttggatgtattccggaccgctcggtccgatgatttaagactacgcctgcggggttatgatgtaataattcgtattagacactcgtgtatgtgcacttggtatttcagctatgaattcgtgtgtaccagactacttgatctagggaaattgtactgtttacacaattgattcctgttataaaaacgggggtccacaggggacgacggggatgggcgacaaacttgttaccgtagcctgccgcctccaatgtcctcggtgccgcccgtctcaccctcttcaccgcgcgcgcctcgccttccccgtggaggactcgtcgaccaccgcctgcctgagctgagaagagatagagagagagggggggggggaagagggaggcctcactgccgtctccagggaagggagcatcagcggcgccgactagtgacgtcgacaatgaaccactcgtctcctcttgtgcttgttgctccgagtcctcgtctttgcatggatacaggaaagaggagtcgggagagagagagaaagagggaggcgacgcgtgccgacggcgctcacccgtgaccccgagatacctcagcctttccgctaaccacgccgccctcacctccgtggtcactggcctctacagccaccccgccgcatcacccctctcccccacccccgccatggctaccttctcgtgtaagtctggcgtcatccgccgctcccccgaccacaggaggacaaggcatatggtgagctcgacatgccagccatagcccgcgcgcgtgccgctcgttcttagcggcgagcgagcaacgggcgagagagatagaggtgagaggggatagagaggagagcgactatgacaggtaggcccaacattttttaaaataaaaaaatactaactggattgccacgtagggccaaaaccactccgatgttgagttagggggtgttttttcctgtattgaaagtttagggtgagcgatatctgcttttcaagttaaaggggtaattcggttcactgcgatagttcaaccagtaattcatactttttccaaaagaaaaaaaaaacaaacaactttcaggcgtttcccttccttcctgacgagtttttggtgttcgtcttccctcccgcgcccgcgcctt

SEQ ID NO: 35200 - DNA, 1501 bp, Oryza sativa
ttttatgaaagaaccttatgaaaggtgaaacctaaactgaaacataaatgagccacatcatccaataaatattagccattggattcatgaaaaacaaaagagggtgaatgaatcaagaccgttggattagatggatgataaaaaaaatattcaaataggttttcggaagctactagaagaggaaaaaaaggaaaaatgaaagagagccaggaaataagtaaaggaagataaaagattacatatatatttttacgatctgcacctatagcaaattattttttcaaatgagcccttcatcttttaggtaagattaattggtagggattgaaggtagggattgaactattaagagcatattcaaaatgtatactcgtatgataaatttagtttctataagttaattgttaatatgtttgataagaaaaatgctactgggacatacatattccttccaatgagaggtcattatctcccaaatatagatttaatgattttcacactgatttaaaacaaaacaaaattattccttataaacagacaaaatatatgtacgtaggctacataaagggtgaacaccaaagtcgaataaggggatgatagagggggtcatgtaacgatgaaaacaactataggatgagatgtaaagtttacaataaataggaagtcatttattatatcagcataatatcactcatcccacccatattcttttacgagcaacgagaagcccaagagagatggcttgccactctaatgtaccatgttacaggattttagagtccggcgaacgcgcgacatgatgtgctagttttttatgaaaaacggaacatttttccatcttttcctatattgtcatttttctagatttctttggagatcaattcaattctcatttgaattatacccaccacatagtatttctcatatgtttgagaattggctggtgggagttaataaaaaaattaagaaacttattcttgtatgggctttcaccgtatgttagactatttggcttagtaaaaatgatacagtttatgataaaacaccaacaaaatattatttgcaagtacttttcaaggcaacggggatgggctcaactacaaaggtatgataatgatatcaagctaataaatgatgcatgtcgtaaacccgagtcgataattatgcacctttttaccaactttggatggagattctcgaatagaattcataaattcagggttcttttatcttgtgtggttgggcccaactacaaaggcatgatgatgatatcaagctaataaatgatgaatgtcgtaaatttgagtcgacgattatgcaaatcgggattctcgaatagaattcagcaatttagggtctttttatcttgcgtttgtgttttctttacagtgtgtgctaagtttgtttatgtgtggactttataataattggttgtagctcgttagcaaaggtcgaaatgttactccattatcttcttataaaaggaaaaaaatacgaatta

SEQ ID NO: 35201 - DNA, 1501 bp, Oryza sativa
acgataatcatgcaagctggatctgtcatgtaaatttaattaagctcgatagatatgtgaagaattagctggaacaagtaccttaacaaaaggtagcaagaatagaaaatagaaaaattgtccggagaatatttgtgtaactataaaatagttctggatagaaattaataaagagactcactaagaaattattttttggatatatattactccttccgttcctaaatatttgacaccgttgacttttttaaacatgtttgaccatttgtcttattcaaaaaataattattaattattttcctatcatttggttcattgttaaatatacttttatgtatacacatagttttacatatttcacaaaagtttttgaataagacgaacggtcaaacatattgaaaaagtcaacgacgtcaaacatttagggatggagggagtataatattagaactcgtgattacctgaactaccttttcaactgtctgactgataagaaaggagttgtttgtgaagttgtcgttttcatacggagtattctgaaatatgtgtgatccctaacagtaacaacgtgttattactagatcacagtgacatagaaatctaattgctcttaaacgaggtaacagcatagtactagctagtaaaattttattccttgtcgtgcgagcctgccagtaggtgtaaatttttattgcttgttgtattactgcacacaggattcacacccgcctgagttctcccccaggccccatccatcctcagatgatacctgaactaattaaattttatacataagcagtagtcgttcttaatctatcttatgtagtatgaaaacctgaactttggtccaatgcccactcaaacaaacaaacgaaaaaaaaagctctataaaatcgaacatgggtcaaatttatccaaataaacaaaaaagaagctctataaaatcgacaatgagtcaaatttatcgtgtctatcatttgtaggaaaaagtacactttgactccctcaactatgacccgagtaaaaccaggtatttcaaaagtggtgaaacccgtgtaaaacgactacttgagtagtatagtaggtggtttcatctgatgtggccatttaaccctagtcaacatactgaatcagcagacgatttttgaccgcacgtgctaaggtggtgtttggatccagggactatgtcacatcagatgtttgaaaatagattacttacaaaactaattgcataaataagagctaattcgcgggacatttttttaagcctaattaatcaataattagcacatgtttactatagcatcacataggctaatcatggattaattaggctcaatagattcgtctcgcaaattagtccagggttatggaataggttttatcattagcctatgtttaatacttctaattagtgtcccaaacatccgatatgatagggaccaaaaataagtccctggatccaaataggggtggtctaagtaagctgcgatttcgatta

SEQ ID NO: 35202 - DNA, 626 bp, Oryza sativa
ttcatacctagaattttcttagcagcaccaagatccttcatatcgaactcactacttaactgtttcttcaatatagtgatttgttccttgctcttagcagcaatcaacatatcatcaacatataacagcaagtatataggtgatccattaacaaatttaatatacacacagctatcaaattcagacctcttaaagccatgtgacaacataaatgaatcaaaccttttataccattgacgaggagactgtttcagtttgtcaccatccggcgatgggcctccgctccactacggcagaagctggcctttattaagtgcaaatgaatttggatcacaactcaacaagtgtgagactgagagagggccagggaggcaagcatccttaatcgaaatcgcagcttacttagaccacccctatttggatccagggacttatttttggtccctatcatatcggatgtttgggacactaattagaagtattaaacataggctaatgataaaacctattccataaccctggactaatttgcgagacgaatctattgagcctaattaatccatgattagcctatgtgatgctatagtaaacatgtgctaattattgattaattaggcttaaaaaaa

SEQ ID NO: 35203 - DNA, 711 bp, Oryza sativa
cgagggtaagggagaataggagagaaggcgttagcgttagatagctcgccgatcagccaagctgtaacaaacccaaattgtgaaaacaaaaaccttagaaagtcaatataatgagatttttcatttatatttattgtggtgaaaatttattttggttgttttttttggattttctacgcatcattgcatttttgcatatttaaattaaaattgagaaaaacaaaacatgtgtatatgtgtttgtgtgtgtatatatatatatatatatactagcaaaggtgcccgtgcgttgcaacgggaagtgtacagaacaaaaaaattgagaaaaagttaaaaaaaatttacattatgtaattcattaaaatatttggtatttttaagtaggtaggtgtataattaaatcaatttacaagtaaagcaagtgtgaaaaataaaatgacatggttaaatttaatttgattaaattctcatgattagttatgctctttggaatttattggaattatcagagcttaattgctaatttttaataatacaaaaatcatttaacaaattatttaattggaaaaaaaaatcaaaatcctcctttctatgtttgggccgaatatagaaaagtttatattccctcccttttgtctattctatgtgtctggcctgttttctttctccattgaagtctattttgcgtcctccattcggtggcccaatagg

SEQ ID NO: 35204 - DNA, 284 bp, Oryza sativa
tcacaattttagaggaaaaaccagtacataagttagccatttttattttacaacattgtagatcacgtttttattaatccatagaaatttggttcagctcaaacggagttcagatgaattttctacacatttttgaagttagtacaatttcagcacatgttgaaaacagttttccattaagagtcctcgaacttcctgaatattacagagtggtcaaggctacagtgttatgtgtcttggtctgttttttgggaaaaaaccctcaagtttatctaattcaccga

SEQ ID NO: 35205 - DNA, 307 bp, Oryza sativa
aaggaggtctatatagcatgatataatttatttagttattgctttttttcgtcatctctttttgtgaccagtgaataatttgttgctcttgaaccaaacatctgcatttcttttcatgtgccacaccatgtcttttccatgttaaggtctaaccaaatatgttcacacttcacacggccatctcaaacagaagagtttgcttatgatatttcttttatgttgcattaatttagttttattctttatgatgtatgtgttcttaactggagcacagtttttaatctggaaatttttgggtattgatgaa

SEQ ID NO: 35206 - DNA, 1501 bp, Oryza sativa
tcaatatgaattcgacctgcataatgtattcaaattattttaaacttatgatagcattaatcaaatgtaactagaaagtgaatcgaattactcaaaccaagacacaacactctcaagggtaagggcaaaccttgtctacactatggcctagccttttgagctgatctatcctgcttctggcctgcacatatggattgtacctacaagtagacagatcagaaagttctgaaacccaaagggatgaagcagtcaaaataatggcgacaacttcatggctatatcgcccaacacaatctgttgctatagaactgccagaccaaaagatcactagtgggcattggtgtactttcttgtttcattagctagtgaactttgatcacagtaattaatgagttgtgcatcatttgtactcctctaatgcaagtcttcaatttcgacaaaataactaccccgtggcttgctgacaatcgactaattttcaataaataacagaactctgccttcacttgcagttcagcatacttcaaaacaacactagagaaagcatcgccgtgcagctcatctcacaggtggtatagtatttccaagtgacatcagtagccagtgaggtaaatcaccttgctcgaatggcgcgcatgctggtgggctcgtagccggtgtaggactgggtgctgtactcgaagtcggagtcggggcctccggggcagtacacgcagatgttccccgtggtggcgatgtgggggcaccggtgcggcttcgacatcacggcgaccacggcaatgcccgacgccgtgcgcacgggcttggcgcgcagccttgggagcagcgcggcgcggtcggcctccggcaccgccgcgatcatctccaccagcttcggcgcccgcgccagcccgtacctccggcacgcggccgacttgagcgcgttcaggtccacgtcctcccctcgccgcgagagctcccccatcgccgacacgatctccgcgatggcccgcacccgcgcctcctcctccgacagccccgcggggagcaccactccccctctccccggcgccggcttcctcctgcgcggctgctcgccgccgccgccaccgccggcggcggctacggcggtggccatcggtggaaagggttttgggtctctcggtgagagctcgggatgtagcgtggcgtggcggcgcgggtcggaactcggaaacggaatggggtttggagtttggactcgggtcggtgttgcgctttgcccttgtacacgtgccgtactagatctcggccccccgcacagccgtcggatcgtggtacggacgtctcagataagaccacgtcgctctgcaacgtcgtagtagcctggaaatactctcccgaattaaaaactttggaggacgaaactagccttctctccttctctctcgtgttctctcccaatctcttcttgcggcggaagcaaagcgagaagcgaggcgactcttctccggcggcggcggcggcggaagcggcggcgaga

SEQ ID NO: 35207 - DNA, 1501 bp, Oryza sativa
ttggatcgagctggtaggaataacaagctgtagtaggaaaaaaaaattgtgacaaacttttggattggataagccagcatggtgaagtggctaggagatgtggtgtcagtggtacttgatgctgatttaaaaggtgtccccagtagtgtcttgatgtactagtagtactactctccttgcttgtaccgggggggtgtttagtaggagagaggggtgggacttatgcttctatgagagggactaaagtttagtccctagtttccaaacacctctgaatcatccaaatgtacaccatacgttgctgaatactcaaatcattatttgtaatttctctacaactaattagtacatatttgtcattataaaatatcctgaacttatgtaagctacggtgctatgttacccaaaaggacatggtcaatcagtactagcaatactgacagtagtattatctttggatagtataatctaggtagcgaagggcacctaaatgacactgttagtgactactaatcaagtcctatattgcattactaatactataatcgtgtggatcatgccaggctaattagtggagtagtagcatgcacgccaataaatgcactgacctaagctgtctaccaaatcgttcagtcgactggcctgacacattccgtcggcgccaacgactcgtttagcagccatcaaagcgcaaaattatgggaaaattaggcgataattatagtattcgagaacgggaccgtccacagtctatcatgccagaaatacacacagtgccccataatttcagcaaattaattagtagttggtcaagttgtacttatcgtcttgctgttcgttgtagcgtaagagcatgtacaatagcaaggctataaaccagctataaacatattttaaagagataaaagaagagagagaagagcagcgggctacagatctattgtcagctgcaacacagactccaatacatattgtgtgtatgacatgtgcgattagatattaatagtatagtaagtaattattgtatgaattgattattatacggcttatagatgaattggagctagtagtgggctatactattaaacttgctctaagcatacagtttgaaaaagagtaaagtccatcaccggtccctaaacttgtaccgttgtgtcatcccggtccctaaactcgcaaattgaccgttcaggtccttaaacttgttcgactgtgttatcccggtcctaaacttgcagatcactcgtttagatcctccaacttgttcagttgtgtcaccccggtatttaaacttggatttaaatatcatctgggtcaaataggacggtttaaagacttcatatttaaaaataatttataactttttcatgtgaattctaacgaagacaaactttatatcaaacttgtagccctcgacgcgatctacaactttgtagttgaatttatttttattttaagtcattttttgtcccaaaatgtaactttaaaattaaaatttcaa

SEQ ID NO: 35208 - DNA, 994 bp, Oryza sativa
tgatattgtctctaagttgctttctcgcgtcaatttccccagcgactagtttgttgcagagcgtgcaagcgttttttagcagcggcctctagtggccgtgggccagcaaagatattgtgcgatgattacgacgaggggtcgtgtgtaattatgttcacttcaccgcttcaattatagtatcgcctttgcgaggggtcgtgtgtaattatgttcacttcatcgcttcaattatactatcacctttgcgttgtgcttagctgtgagtggatggatgcttttgacaagaacgtttctgtctggcgtcacgaaataatgcattaatcctgggattggaattcgacgtctaatcgctgaccctggataggtacaatagagataatgtgagtggtctcacgtttgctaattaggcctcgtttggaatgtgtggggtacaaattcatacagaaatcgagatgcttattctgaatttcctgtgttgtaatagtagtagtcttaatccaccttggagttacagcggtgaacggtggaaaaaacggatgaaatttaccaacaaaattcaaaatattcttttgaccttgatagggttaatggatcatcaaattgtgatgtgatgtggccatgtgggagttgaacatccaactaccaacaggcccagcaaactgcacgagctgtgtgtactaaatttccttggccaagtttcccctatttccgcttatttttattcatttttcatgttggagatcaagttatctcagacgtgacaacacttattttattcaatatgtcttcttgtgctgacatctcagagatcatcgcatcgagaccaagaaaaggaggtttgcaaagcaagtctgaagtctctgatctctgaagaccgtttagactgcaaaatgtgcgctgatttcgccgtgataatttcagaggttagttggtaggatagcagccggttagatacactgactcctccccgttttccaagtcgtagtctgacgca

SEQ ID NO: 35209 - DNA, 1501 bp, Oryza sativa
gtggatgcggatgcggattttatcatgtaaatgtggtatcaacgatatccgacggatacggattatccgatattttgatcggattatccgatgcactatttggcggataatccgcaactttcagtctttcaacccatatattgtaacccatttagcccatctattgtgacctaatccactcctcccgaaatctctctctctctctgccgaatgccgtgcgccatctatctctctctcgagtcgcctcttcgcctcttttcccacacgcgccaccgcaacgccactgcaggctggtggcaccgccgccgatcctccattcctcctagcgcgccggccgctcctcctcagctccagccggcgccgccgctggtcgtcgtcggctcctcggcgtcgccgccagtgccagtacagtcgcccgcgccatccgcgccatcccaattgtcggcccgtcggcccgtcgccggcgccaggccgccagcgcccaggcggcaccgtcgcctgcgcaatccccatcgccagctgttgttcccctgttccagtccgacgaggtgatggccaacgacgaggctgtgtgcctgtgtgcacacgtgcagtcctcactgctgtctgtcgtatgctgtatgcctgttgtgtgctgtactactactgcagtactgctgtatgctgcgtgctctactgctctatgtgctctatgttgtatgcctgtatgccttgcctcacgctgatgagtgatgacttttatttttccattttaagcaactcagtgacaagtgagctattgaactgaacacttatattattttttttatggatcatggatgtaccttgaattatattgagaccgggctaattgtattgctgcccccttgttgtatggattgaatacaaacttgacatccgacaattttttgtccgttaccgaaccgactccgcaccgaatccgacgtccgaaataatccgctccgcattcgcatccgcacgtcatccgcacccgctccgcatccgcttaaaaaaaatggtttaggatagatatggtatagctattatccgtttgaatccgctccgttttcacccctagtcaccacaggtacctcgcctaccgggccggcaaatactggagagattgacgaagtcaccacaggcacctcgcctaccactgaaagcacagcgccgttaaattctgaaaaattcgctcccatggcctaccactgaaagcacagcgccgttaaatcctgaaaaatttgctcccccatggagagtcgaacccaggacctcaggtgctactgaggctcttaaattactaggctacaggccctttcgcaactctatgcataccttaaaccacccgagaactttgtaaggctagtaatacatcagttctaacgcaacgactgtgttctgtaatgcaaatcacaacatatattttttttataaaagagcaaataaggtaaacacgatactcaggcaagaaaataaactttgaaaaaaaatactacctcca

SEQ ID NO: 35210 - DNA, 1501 bp, Oryza sativa
gatgatcaatccaaatcagcacaccaattaggttttattttgttgttgttctaacaaagaaacaaacaaactataggacatcttttttttttagagcgggtaaagtatgaaggacttttgactgggatcctgtggtaaagcaataggtaaagtatgaaggacttttgactgggatcctgtggtaaagcaatagttgtgctttactgtcacgccacgcctgtataacgtttacatatcatcgtgacatttttttcgattaacatatactcctatcaccgtgccgtgtttatgtaaaatggtggtgccataatccccttgctcgtgcctaacaacttggggaaagggactcttgacttctagttttagttttcttattaattccgaattttagttagttctaaattgtatatttgtatggactctagtatctttttcctgtattccctacttttaattctgattttttgttatttctaaattttatttctaaatggactctactttttatttttatccgattaatgtgagaatttatgagccgtgagagcgaacatggagactccttttctattaatttaataagttaatagattcatattggtcatccaaactataaaggacaaatttcaatttttattatgttgagtggggaaaattctcttgcacctcgctaacatgctttgcgaagacatgaaagttggtttagatagggttcttgttacttatgatcagacgagttttttttttttaaaaatgatcagacgagttagacaatgacttgtgagaccttggaagatcaactttgtataattgtaggtttccatccaggtcgaatttgtctcccataattaatatacagtttaataaaaaatgcttctgcttgtaaagttcggtttgtattagttcaaggcaaatatgtttggtttgtaggttacaatttttattattctcgtgactatcttattagcaacaatacaatagtccctccgttttttaatagatgacgccgttgactttttctcacatgtttaaccattcgtcttattcaaaacatttacgtaattataatttattttgttatgagttgttttatcactcatagtattttaagtgtgatttatatcttatacatttgcataaattttttgaataagatgaatggtcaaacatgtaagaaaaaaatcaacagcgttatctattaaaaaatggaggtagtattttttttcaaagtttattttcttgcctgagtatcgtgtttaccttatttgctcttttataaaaaaaatatatgttgtgatttgcattacagaacacagtcgttgcgttagaactgatgtattactagccttacaaagttctcgggtggtttaaggtatgcatagagttgcgaaagggcctgtagcctagtaatttaagagcctcagtagcacctgaggtcctgggttcgactctccatgggggagcaaatttttcaggatttaacggcgctgtgctttcagtg

SEQ ID NO: 35211 - DNA, 569 bp, Oryza sativa
tgccagttgagtttccctccaatggtaccaatatcgaagccatgcgtttgaaaaatattgtttgcaggctctgaacttggtacggttgatgattatttttatttgtacaaatattcctcactagcagtgataagttgggttaggtttttccttttaaggtgcttatatttcatccaaaattttaacatttgcaattgcttaaatttccgcagtaacgctggggtccctgagccaaaaggacgcggttgcaaaattctcctcggaaaccgcatctcaccgtccgatctagcacgaacggctaggatgctctgccgggtcagcccaagggtttctgtgcttaaccacgcctccgaaaagaaaaccgaaaaatccgcacctaaacctcacgacttcacgagcagcagcgagaggaggagggagcaatcaatccatcggcggcaatggagaacggcggcggcgacgtcccggagaacgccaacgaccgtaggggcaaaccacttgcttcctcagggtttctcgtgttcgaggatttttgcgggttttttgatcgtttttttaattgttttttt

SEQ ID NO: 35212 - DNA, 708 bp, Oryza sativa
tctatcttcatgatactctaatcttgtaatagccctagctcataaccaggtatttagaagtgcatttgttgtcttttagattgcatatttactatattgcaatttgatcatatgcgataacaaaattaactctaatcggtaaaattgaaaccacttctatttgaacaataacttgaacagaagtgtacatgtttaataatttattcaaatactagtttatttatcaccaacaaatataaattttgtggaatttttcctctctttttagacctcctaaaaattcaaactaactttcagattaactgaattcactttttcactagaattatttaactcaacattttttagtgaaaccaattggattagaaagcatgttccaagacccatctctggaccagaggccaaaatttgaatcccctcctaagcaattcgaattagcaggtcatgagtgagaagagggaataaatcttagttttgtcttttcttcttgtctcttcctctccaacccctctctctttgacatgtggatcccaccagcagtccctggcccacatggcagtggcccaaccctctcatactcaggggacaagcagaagaatagccatgccacgttttggccatgcaagggagagagacaagtgtgacacctctctctttactctcccttctcctctaagcttctggccactttctccactcctcccactc

SEQ ID NO: 35213 - DNA, 186 bp, Oryza sativa
  unsure (1)..(186): unsure at all n locations
tcacttatatattaggtcattttgctcttcacaaccaatgtgagactattcaacatttgtttcccgaatntttatcattgtagttaggactgagaatcatcaggaaatgagccctcccagagatataccagttgcagttgggttgccgcctatatcctggagatgctataccatgtcatccgttta

SEQ ID NO: 35214 - DNA, 258 bp, Oryza sativa
tttgtttcaaaaattggttgaggggaaatatttcccatatcctcctccttccattccccaagatttggagtccaattttgcatggattaatcaaatcaaatcggattcgaatttctctttcctaatcaaacgctaatccttccatgtcgccgccggcttgccatagccctccccggtgcctcttgacccatataaaaggaccccctgggactcctctacccctcatcacctccaccttcgcccgccgccccctctagc

SEQ ID NO: 35215 - DNA, 154 bp, Oryza sativa
ctcatgtcagtaaactctaaactttcggtcgtattcaggccatctttttctccaattctggttgatggagattctacaaaagctggttgcagtaatgctatgacaacatcaaaccctgtcagctacaaactaagctcagggtgtctttttcaga

SEQ ID NO: 35216 - DNA, 156 bp, Oryza sativa
attactatgtctgagaagaaccacaatttcagcagtttactttagttcattcaattaggtgaaaatccattccaccataagctactttccataaaaatgaaaaagggacagactttaaagtttctcgtatgagacaataatttgacatactttgtg

SEQ ID NO: 35217 - DNA, 1501 bp, Oryza sativa
agggtttattccttgcttgattttaggaagcaggcttgcttggggcaagtaaaagtctgggctaagagatcccggattctcaagcaatggagtatatactacaatgaagcaaactccaggaagatgaaaaacgacaacttgcaaatagctctaacctcttatgccggacaacaaagattccatttacagttcgatcaagggatatttgtctcctgcctcttttatctatgtgttatcaaattatataggcagagcatacttcagtcagtatttaacatgaatccaagcctcacgtataattgtatactactgaaacaatctattcaagtgcagtcctgatgatgaggtgaagctaaatttaagtcacacccctgataaagctgaagaattgataagtacagctatacacattatatgaattagcaggatacttttgaacaattttctgaaggcaagtaagaatttcagaaacgaaattacaactcattgagagcattgaaatcttataagccttcacatttccccttaggccttatcccttcatataccttctttttctcccaaaatccctttggcatttggcaccaatactcaattaacttgtatgcgctccaaaatcaacgctaggagtgtccttgtccccaattgcaagattcagttaaccaaaatgtactatgtatcctaatggtcaatggagcaatcgtttggtttcattccgtactttgttttgtagttgcaagctcccccaagactttcatgccattattaagcgttcacttccccacctagtgaccaccaaaagactttgtcctaaaccacaatctcccgatactcaagccccatctaaccacgcagcgcccacccaggcacagatatccagacaaaaggccgcaaatgttcaccccagagccatcgaggacgacgtgtcttgtggctatgagggaacaaccaagaaaaaaggctccatcccttctagtacctgaagcggccggacaggcggcggcggcggcggcgcgcccggccacgcgcagcggtggtgtcctccgggaggacgcggccgcggccgccggcggggcacggaggccagcggcccggggcggctcgcgcctctgcggcatatggtcgagcacatggcgcgcgtccagtagagtggcgccgcggcgggagtagcagctgtggggagggggtgcgcttaccgccgctctcattctgtcccccctttttctacgttacggctttagcgcggcgctttgtttggggatgaataggaagtgtaggactatacgagatgggattgcttgctttttttccagtctagtccaccatctcctcattatttcacttctacaaaacaaaagcttttaaatctaacgctacacgtttttctttttgtcaaatgtaataaagctccgttcttattaggttgtggtatttttcagactgctaaacaatattttatatatatatatatatatatatatatatatatatatatatatat

SEQ ID NO: 35218 - DNA, 1501 bp, Oryza sativa
taatgaggagatggtggactagactggaaaaaaagcaagcaatcccatctcgtatagtcctacacttcctattcatccccaaacaaagcgccgcgctaaagccgtaacgtagaaaaaggggggacagaatgagagcggcggtaagcgcaccccctccccacagctgctactcccgccgcggcgccactctactggacgcgcgccatgtgctcgaccatatgccgcagaggcgcgagccgccccgggccgctggcctccgtgccccgccggcggccgcggccgcgtcctcccggaggacaccaccgctgcgcgtggccgggcgcgccgccgccgccgccgcctgtccggccgcttcaggtactagaagggatggagccttttttcttggttgttccctcatagccacaagacacgtcgtcctcgatggctctggggtgaacatttgcggccttttgtctggatatctgtgcctgggtgggcgctgcgtggttagatggggcttgagtatcgggagattgtggtttaggacaaagtcttttggtggtcactaggtggggaagtgaacgcttaataatggcatgaaagtcttgggggagcttgcaactacaaaacaaagtacggaatgaaaccaaacgattgctccattgaccattaggatacatagtacattttggttaactgaatcttgcaattggggacaaggacactcctagcgttgattttggagcgcatacaagttaattgagtattggtgccaaatgccaaagggattttgggagaaaaagaaggtatatgaagggataaggcctaaggggaaatgtgaaggcttataagatttcaatgctctcaatgagttgtaatttcgtttctgaaattcttacttgccttcagaaaattgttcaaaagtatcctgctaattcatataatgtgtatagctgtacttatcaattcttcagctttatcaggggtgtgacttaaatttagcttcacctcatcatcaggactgcacttgaatagattgtttcagtagtatacaattatacgtgaggcttggattcatgttaaatactgactgaagtatgctctgcctatataatttgataacacatagataaaagaggcaggagacaaatatcccttgatcgaactgtaaatggaatctttgttgtccggcataagaggttagagctatttgcaagttgtcgtttttcatcttcctggagtttgcttcattgtagtatatactccattgcttgagaatccgggatctcttagcccagacttttacttgccccaagcaagcctgcttcctaaaatcaagcaaggaataaacccttgctagttgcttgcattattcttgcaaaaagccaagcatgttcatcatataaaaataagtatagcttttcatgtatgccacattcagaggttaaccattcttgttgagcacttcctgcatgctttctcagctatgctatatttatccagactgcaccgtcattta

SEQ ID NO: 35219 - DNA, 1501 bp, Oryza sativa
tggcaatgaatcaagcagacttgcagattagccaaacaggcacaaatgtaatttgcctttttttccctatgtgccatagcctaactcaacatgacgatctcaaactgaactttggtttttctttccttttcatttgccaaatgtaattgttgagttggccttctctttttctttccattgtacgccaagcagcagcaattcaatccgacaggtgttgcttgcttccaggatattcctatcctatcccgggagacaaaaaaaaaacgggttgcaactcgacatgccggttgcttctcagctctcacgacccctttgttcttaccttgcatgtgggacaagcaagcaagcctgaccatgatagatacacaactcaaggagcaggcaacaaggcaaaggtctggggctaacctggtcaagaccatttggtatctgacctattcatatcaggggcctaattgaccggtaacccgcgttctcagcactgctaattgcagccagttttctgattgtagtgctgtgaggtaacggccgatctgatgatgggtggtgtgaccgggcaaaccattgtggtgtcatgcaatggttttccgagttcttgtaacccaaaaaaagaaaaaaaaaaaaagagaagagacttggatgatttagcacaagtgtagggtccctatatttagagtactggacaacgagactccttttttctccatgcttgacagagtacaaaagatatgttcccattgccatggcggtctccatgaccaaatttcgtggcactcagcccacatgtcgaaacaaataccttcaagatataagaaaaaaaaggagcacgcacagcaaatcgcagagaaaaagaaggaaaacccaacgaggggaacaaacgttacataagtacataaccttttgcataccatcctgaccaagcgatcatgttaccacttaccaacgaggacggccattcaccatagtttgacaaaaagaaatgatgggataacaaaccaagccatagtaacttaacgtcctaacaagcgatcatgttaccaccgaggacggctattcaccatacttggcaaattgacatgatagcaagcgcaagtttggttagaagtcatttatttctctgcaagtagttgtaaattacatggtagtgtgacaaatgttctcagaactacaacaacattgtggcacgcatgtacaaggtaaattacagcagtcctctctttatttgctctggtgagaccgtgaaaggagtagagcagttcatcttcgatcttaacattccaagaacagcagcagctgctgcaatactgacgtaaagttcacgctgtacttccgctcttgaaccgcaatccctggaagcaaccccaaaccaaagataggaaatgagctctcacataagacttaattcaatgggatgtataacatcaaagcaatcaggaaaaactcacctctgaaatgtcaccagtcagacaatagtagcgaaacaatcttttttttccttttt

SEQ ID NO: 35220 - DNA, 1501 bp, Oryza sativa
tccgcggaaatctcgaagcctcctttgcttccccttggcttccgcgccgcgcgaggggaggagaggtgaagaagaggagaggaggaggaggagagagagtgcgtgtgcgtggcctgcctgctcgttgcgctgggtgggggcggctgggctggcttggctaaggtaaaggcgagatcgctcgcctcgcgtcgcctctccttttcgcttgcgttttcgttggggggtttggtttttttttctcttctccgagcgagagtacaggggctttccggcaaatacacgcctacctgcctaccggactgcctcgcctccctccatgcaaaacctcctttgaacggccgtgcggaattggcggccccttggaacggttggggcacaaagaattagttttaccgcttgacttggtaaacatatatcggatttgacatatgcttcgtgaataattgcatataatatgaaactagtggaggatagtaaccatgtacgatgggaaagtttataactgacgaaaaaaatatagtagtattcatgaggaatgataatatgttgtgatgttttagatttgtgatagtttatgacggttacataagttaagataagaatacgacttataactattacgtaagtgaagagaactagcgagataaaacttatgtttaggctattacttatgtagttttaaggtgattgaaagtatgaaaacaactcctgaaaattaaagaaaaaagaaatatactccctcccctccggttctagtttaattgatgttttagacagtattgcaaataccaatgagtaattaattaggatctacattttcaattatacccatattaaatacattcgaggatgaaaatgaagcagcagatgcatgcatctttactcctggagtaccagctgttggtcacagatggaaaccaagcaacaaatgtttgcctcgggagtgtattgtgtttgcatgcatgcaaggatagtgctgggaaactgagccttgagctaaaacgtcgatttttcccatacaaaagctattaagctataatgtcagttaaaaaagaactggagggtgtactattcttatctccacataatatgttatctatagacttaattacatttccatataggccaaaatttggcgtggctataacacctaagttaacgggaagaaagaaaatctaaataaagggggttatattccagacctataattggcgacggctccaaaatagttgggcccaacaaaaccgcacgcactaagatatgaggcttgtttggctacaaggtatggtgttgccttgcagctcgcctgacgtctacggcagcttcatttgctgcatggtgtaacagtcgactggctgcatggcagcgctacaccaggcagccgaccgagacaatgtaagtagttttattttggcgcgactattggcctaaaaacaaatatgggtatctattatatttctctatgtatataaaattcaacttttacaaactactctatgcg

SEQ ID NO: 35221 - DNA, 1501 bp, Oryza sativa
ggggtagtttttagtatagaatcacatagttcacaaatatattaaaaactatatttagattattgagtatattattatcgccattatataaccgattatagtggttaatttaatattttaagataaaatatgtctaaaatgagtggtctaagtaatactccctacatgccaaaatgggtgttaggctaaatcacttctaacgcaaaagaccgagaaataatttgattatcgcatcggttagatcacatccgtacaggcaagcagtgtgattgggggcttgatggtagatggtttaaaacaaaccaaatttaaaggactaagaggtgatagttaatgtgcatgcatgcacacacaccttatattacaagacatggaaaaaagttgttgtgccgtgatggaaggactacagtataagtttttgtattttcaaaacataattttccaaaccgtgaatcaaatgatatgctctgataatataatgaataagcgtatttttttagtctggtgaagaataaacttttcgatttacaattcggccgaataagcccagaaaaacagtaagaaacagatgtctcgtttggtaagacgctcattttgcgagaacactctaaccagctttactctattttttttggtgaaaccaaaattgtttggtaagttataactgtgctaaacggacgaatatgagggcaaataggggttgttggcggcaaagggcaaataccttccctccgtttctaagggtattcccaacccaatgtctaggatgatgtccataacattatataagttgccacctaggataaaaaatgatgtggcaagtaaataaatgaggaaagagaaggaaaccatgtcttgcatgagatatggtttctacacaaaatatcatgtaagataaattgcattaaattgaagtatggaatagtggtgtttatattgaaagagtagtgtctagtactaatttcttgatgatgtagagtttatgaaaactatgtctagtgttatgggttgggactgccctaaaggccaaccgtccgaacaagttcaaaaacccagccacccaggagcattttctccaagaaaatggtgtttctacggttctactagtagtctactggtaccagtacaattcatcatcaacaagaggtaaaggactcgaagagagcgcgcggcttgggcgaatcgcgccaaccgaagcccactggcccaccgcccacacgaccgttgggagcgcaggtccggcccacctttaaaaactcccgaaacccacccgcacgccgacaccttctctcccccgcacctgacccaacacgacccatcgacaaacaacgctcccaagttcccaagcgccgcagcccgcagccgatccgctccacactagccgttgcctttgcccggcttttccccccctttcctctttcctctccccccatccgccgccgccgccgccgccgcacgggaggcaagaggaggagttaagaaggtgaggcggatcaggaga

SEQ ID NO: 35222 - DNA, 1501 bp, Oryza sativa
aatgcgtgatactctcttcaccgatcgcatcccatggcaagatatacctgatgcacacagacagatcatgtggcgagaagatgcaccagattctccggattgatcacccacctgcagcagcgcaggatgggtcgggctcgggcgcaggtcgtgctctacaagagccaaagctggttgccacaatccctgcacgcaagctcgaccattttcaaggtctggtagaatgtggttcagagatcctggtgcttggttacaagaactggtctacgtcgcggatttcagttttcaaacttgcggaccttgtgctgcaaaggtttatgccaataaaaagcatcgggggccataccctgttcattggagaaaggaacataagtgtctcttctaagatactgcctacagtcaagggtgacaatcttgtctaccttaattcaggacttgtgaaataccacctcagtagtggcagcttgtcactggcaattgataattgcagcctgtatggccgtgcaccgggacctagtagcctcgtccactatatctacagctgctgcattcgtaatcggtggtattgactttattttcttactgctttatttctccctactgtcgattgtttttgtcctgggctagctattaatatttgcattatgtacttgtaggagcagaggactaatatgcagaaaggatgcaccagagtggttagtgcaagattgaagactagttcaataatgaggctagtccttcctcccttgttttctgtaccaatacgtgatgcaccggtcttgagctagaattttgctgataatcttttttggatcttgcggttatagatactttacatgccagatcttctgctactcacaagctatgttttgtatactgatgagtaagctgattgcgataatgattgacaagatgaatcagcacgctgttggaaaagggaacactaaaatatttagtagtgccaaaacaacaaaacatgtctggattttggcactacggatgttttggtatggcactgaaccaaacaaacccgaagagttaaactggaaccattctcttcttcttttttccattgatgaagtgtacctccaaatatccgacacgcaaacccccatcgtttggcttatcggaggaacaagcgaaacgacatgtttgcaaacgaaaaataatttatgagtaaaatttttatatacgtgttcttagcaatctaaaagcaaaggctgaaaaataaactttaattaagaaactctaaaattaactccaaatttaaagttaaaagttcaaattttaactgataaatataagtataagcgaaaagatgaggctggcagtcattcgcagcttcaaaagactaggaatcccctcatgcctatgggccattagtgaagttaaagcttgtacattttgatgggcctgacccactagtccatgcaggccatggccgggaactcgggccgggccgggccgaacgtccaccgcatcttccccgagtccccccggt

SEQ ID NO: 35223 - DNA, 1501 bp, Oryza sativa
ctttaaatttggtttgttttaaaccatctaccatcaagcccccaatcacactgcttgcctgtacggatgtgatctaaccgatgcgataatcaaattatttctcggtcttttgcgttagaagtgatttagcctaacacccattttggcatgtagggagtattacttagaccactcattttagacatattttatcttaaaatattaaattaaccactataatcggttatataatggcgataataatatactcaataatctaaatatagtttttaatatatttgtgaactatgtgattctatactaaaaactacccctatgccttaaaagccactgactagcactgacattctgtttgccttttgtttgaaagttaatttggatgtatttaaaattcaagtaggattatattgtttcggtagagattatttttcaagagaaagtttcctttgattttttttggtgcaaccttttttctttacaaagggaacttttctaatgtttgttagaagttttggtatatagctaacttttttatttctcttgtagatttttttcctatgaaaaacctttatagttcttttggtgaaagttctatcaggccctgccatttttactggcacagcttaagaaatggagcactatgtttgattcattggccaatgtatgcacggtaaattgttaatgcatcgtatagcaaccaatatatacaactaccagttgtagaggagatatctcgtttcagtaaccgccattttttcaccaaccaagtcacgttttaataacattctaatcgaacattttcaatttataactaaaactaaaccagaggaaatgactgtattctaggacaaaatatacacggatcaaatcacgtcttattaagaaggaatatttctcagtatcggttcccttgctctaaatgatactgtatcaactattcataacaccgtttatatgtttcttgatcagcaggacgatagatcttcaacggctgattatcatcgatcttcttggggaggaagcctacctttgccattatcttttcgtgggcccaaatccagcagcggtccaacgtttctctccacccacaggaaccttctggaaacccacgccctctctatcccctctcccaatccagcgacgtggccgcatctcccaccgtccacttcccccctcccgattcaaaccaacggccccgatcccatccttgagccgcgggcacagagccctggatcccccggcggagccagttctatataaaggcgaggccgccccagctggcaccacccattcctcgcgtcgcatcgcacttgtagctctcgacccccgcatctcatccctcctctcgcttagttcagatcgaaatcgcaaatgggtaactccgccatctgatcccgcttcctccgatctcgatctggtctccccgttcccgttctgttctagtggagtgatttttttgcatttttttctgactttttgctggttggttttttggcttctg

SEQ ID NO: 35224 - DNA, 270 bp, Oryza sativa
cggcggatgcactctccggcgcattgcatcgatgataacggcagtccaagctgggcgggacctcgcatcatgcatctcgctgtttcattctcctatgttccctttatcgctctgctactccattgaggtgtaggtcaattttccccaattttttttatgtgcaaattcaaattttgtttgaaatttcgtatgaaatttccggaaaaaaaatccaaaattttagaaatttcgtaatttcgctgacccttaaaatttcctctttccgataga

SEQ ID NO: 35225 - DNA, 174 bp, Oryza sativa
ttcctccctctccgcatttctctccccaaaataccccccccccgccttaaaccctccgccgccgccgccgcggggcccggcttgtcgccgccatgcgccgcttcgtcggggccctccgcccgctccgcaccctaaccctcagccccatcccgacggcgctccgcgtcctctcca

SEQ ID NO: 35226 - DNA, 588 bp, Oryza sativa
agtctgtttgcaatgtttgccttgtatgtcgctagattccggttcccccgacgcttcggtgtacttcgaaatagtcgccgaggttcctccagcagcagagcaaggcaagtcatgcttgtcacttgaacatgttgatcctatattgcaaatgctctattgtttctttcaaatattgcattgttttataatgttactatgggatgtttacctattgtcatagccatgctattgttgtaccatgtccctttgtcagcttggggttataacatgactagagatggactagggattgcttagccatgcttagttcaactagttcacaaatggggaagatcctattaatgtttagactgtcggttctaatggtattgttggattagtgccaccgctttggtgttggttaattaaaataaatcacatggtgggctgtgggtgcatggttttgctggtcgcacccatggcagctaaggaccggttcgcgggatgccctggaagaacttatcgtacttactacaagccagcgtgggcaacggtgggcttgtagcgtagctttcctctagccgacgcatcaggcaagggtgggcgtga

SEQ ID NO: 35227 - DNA, 289 bp, Oryza sativa
tgagtttgataagtttatgaaggatccatgttaagattgcaagagctgtgagttgtgtacattttgttgttgattagggggacctagggtctcatttccgtaagctcataatctattatgaatcaaataacctagcgattgatggcgaagaaaatcaagtgatcaaccaaagagacatttgtttggactaagagtttcagatatgtcttcttcggatcaaaggcatgcacccgttgtggagaaattggacacgttgctagcatgtgtctcacactctgcactcactagg

SEQ ID NO: 35228 - DNA, 796 bp, Oryza sativa
actcgaagtaccaggagggcatcagaaagggggtaatagctagttaatcatatatttaggatgtatgtacactatgtatactagaagtataggaatagattcttttctatattctttccacttagcttagagatttaatataggaatgagtagcttgagcttgtgtgtcattctaccctggaattatctttaccccttcttaggcacgactagtacaagtaacatataaatattagtttagttctctctattataatcttcccacgggataacaaatacgatacccttggaaaactctcaggtgaaatgctacaatggtatatccgtgcgcttgcggataatctctgtaaccataatataccttgactatttctggcgccactgctgggaattatatttctagtaatgtcgttaggaaataccaacaagcatttctggcgccgttgctggggaagatttataagaagagattcctaaaactaatatcttatatttacctctgtatagtcaatatcctttgcaggttaaccttgttgttttcaccctttgttgtgaaaatagggtagtgtataattgtttttgacctgccggaaaacttccaggaaaatccataagtcttcttctgaagcataaaactgcgggttgttcccccgcagaagactcttccgacaaagaagccaaacgtactagcgccaccaactttcaagaccatggctgacaagactcttcgcgagttcgctgctccctcctctaagaatgtggccactgggccgcagctcaatttgggagacatgga

SEQ ID NO: 35229 - DNA, 792 bp, Oryza sativa
tcaacaggagatcgagccaagcagtccagagtggagaagttttgctaggcaagttcgttatagaagacgcgacggaagaagtcagacaagaagagaagaccgcccaacctatcttcatgctagcctcctcgaatctcggggacgagattcttgtaaggggggtggatttgtcacgtcctgataaattcatcccgaaataaaaatcattttctaaaaggaataatagaattaattaaaattcgaaaagaaattggcaaacactaaaatacgtataagaaaaattcaaatgtggcccggagattttttgttaaattctccttggtctaaaaggagccctcaaattttagtggaattctcagagcacaaataataattattaagaaataaacaaagttaaaatgattttataaaaagaaaaatcctaaaaagtcttctttttccccccttcccctcttgggccggctcggcccatgtccctccccctccctctcctctccccgcggcccactcggcctctccccgcgcgcgcgccgctgacgggcgggcccgcccgccaccctcgctgacaggtggggcccgcctgtcatccctatcctcgcgccgctcccgccgcccgcccgtgccctagcgccgccgccgccgccgcggattccgccgcatcccgccgtccccgcgcgcaataaagtggggggaatcattccccgtgattccctctcccttttcccccacttttccctctctctctccctcggattcgctcggaatctttcccctaaacctcgtcggcatcaa

SEQ ID NO: 35230 - DNA, 1365 bp, Oryza sativa
taaaaataaaatatgagtaatattaatctagtgtaatttccgtataaatttgattccacaattcttaattttgcatatatgcattttactcaatatttgtgttatcttaactaatgaattcaccctagattaatattactcatattttatttttatgtaatttatttgagttttaattagggttaattcttattccatcgtatttaaatttaattgatccaaatatggtcgcgataatattttatttatttctatcccacctaatctttattttgtatttattttaccaatttgtttttaaggtttattcctaattaactattctttactcacgattaataatcttcgatatcaaattcagataaaatacactaataagatcggcatcatgtaattagtttaaaaagtttttgaaaatccgtatttttatagtcttgattctgtcggtcaaattttcacggtgttacactttgtttcctacaggtgatctttgacccattcaaggagatgaattgattatcatgtttgccatggttagaaaaattaaaatcgctcctgttaaatgtatgataaggcaatggttagtgtcgcgaccgagaaaattgcattttcccgaacgctagtgtattaatccccgtcccagcaaaagccggggtacaccatacaaacatgatataaaagacacatctgtattatatcgataatatttacattattacaaaggcacttaagcctgacaatcaaaaataaacagcagcggactatcgggcctactgctccatcttcacaggcgctcaactggggtataagccaggactcacacctaagacttcttctccaaagcttctcttactgaagaggggaaagattgagcaagaatgagtacaaccacagtactcagcaagtcacaccggcagatgcatgattaatgcaagggggtacaaggggataataataggggttaagttttgcagtaaacagcatttaaaagtcacttagttgcccaaagccattttataaagacgatcctagagttacacagtgttattaatcaaggccgtgaacccacacgaacctgccttaacccaaggcctacgatgattcagaccgaactagcaacccgaccctgggtcccagctcgtcccaagccaacccaggccaaccattccatattttagttgttaagcaaattttaggaattaaaacgctaacttgggtacattgctcggcttgcccataaccgagggcgcggctattcgaatagattatactctgatcagaggtgtacaactttacccacaagacacatcttcctcacgtgcaaccacgtgccacataccaccacggtatacaggcggaagacgt

SEQ ID NO: 35231 - DNA, 503 bp, Oryza sativa
cgtctgcaatctaaaattagtcagtgtgctctgcatttcaccggggcaaatatcctttgctccgctcaacgctggcgacctcaaaccgctgcccctccacgtgtctatagaggtctttttttttatagaggatgtctttagaggtcttaaacaaatgtctttttatttttgtctgaaaggaattaaaatgttcgtttacgctttcagccgttatataggaagccgtcgtttagcttattttaagcataagcgaaacagcatattttaaaaaaaataatttatgaataaaatttttatatatgtgttcttagcgatctaaaagcaaaggctgaaaaataaactttgatgaaaaaacctcaaaatcaacttcaaatttaaggttgaaaatttaaattttggctgataagcataagcataaacgaaaagacgagactgatagggttaacctccaaatgcattaataggttccgctttcacttgggaggacacgtaaatcatctagt

SEQ ID NO: 35232 - DNA, 306 bp, Oryza sativa
tgttcacttgttcagtgaagaatcaaataatccccagcgttgtctcctttttctctagtctttcagaaatgcaaaactgtagcttcttattcctgatgaaatctgcaatttgtttcagaaatatataccgcttgtgtggctcacctgaaacctgaattttattccagaaacctctgaaacctgacactgatagtttaaactgttgccactgaatgtatggtttgatttgattctctgttttaaacagaacaatgctgaagtaacagaaacattcttttgatttgccgcgttgttcttccctgcaga

SEQ ID NO: 35233 - DNA, 356 bp, Oryza sativa
tgctgaaacgtagagacttgctcccttctttccaaaataaatgaactcctaaaatttaactttgtcacaaatctaatcaatttatacttttttacctatattctaatccatagttcaattgataagttttatccctacagtactcttcacttatcaatatatctattctattatatactaaaagtccattaaatttcctacaaacgtttttaagccaccaagtgacgctcctaaaaacactcctagattgccacgtggcagtttataatctcaccatcaattttcatttaaattagtgggcccattattttaggccattagattagatctattgcttactcttaatattctgtaga

SEQ ID NO: 35234 - DNA, 508 bp, Oryza sativa
atgctgattccctgtactggaatctgatagtagaaattttttaagaaatttttttatgctgattccctgtactgtaatctgatagtagaaattttagcactgagccactgactggcgttttaataatcgcagagctcacactgaagtctgccctcatgctctggtcttaatttgtcatattactgatgaaagtcttaggaaatggtatgagcaacaaatgaaccacatagttcttttctattgttgtatggcttgataggtataagtaaagtacctttgttgttgcttgattccttgcaatacatcaactgtaaactatgtgttgaaccaaagttgcaaagttttgctgctattcttgctacttaatcttcgtttctgtgtctgttcagaaggaagcccatgacttgaactgaaaaggtaacgttacaaaagaattagtacaaggccgaaagcaacaggaagggtctccaactgaagagaatagaaaaaaaaaatccagaggagacca

SEQ ID NO: 35235 - DNA, 278 bp, Oryza sativa
catacattgattcacacatcacattcttttaactgtcaaaggcaatttttccttctgcctttgtaaaatggtgtaaactggattcttgtccctcaagctttaaaagtttttctttgctaataaaccataatgcttgtagtaatagaagagctttggtttctttgctggctgcaatctgtggggttcttgggccccaaagaaacaatataatatccagatctcaattggtgtatccccccataatgcttccttttgtattgcttctaatttgctgcagt

SEQ ID NO: 35236 - DNA, 236 bp, Oryza sativa
cagtcaaaagcatagttttaaatttgaagtacctttgcaatgaaaatgggcaatggttaccaagtaggttaacacataagtacttatgttatcattttatagtgttttttgacttgattgtcgttttatagttgagatatggtagtctgacacatgccaattatgcttcagtttccaatttatgaggatactcacttatttccagcacattaatctgacatgtctttttctccagg

SEQ ID NO: 35237 - DNA, 174 bp, Oryza sativa
accatatctcaatcgggcgaaacttcggcccaattaagattacttccttgtgacggcccgcaaattccagtcttgttatgggccgtcacagatggaaggatctgtactagtgtatatgtccgtcctcctccattatggtttttgccttttctcctacactgcttcttctccaga

SEQ ID NO: 35238 - DNA, 244 bp, Oryza sativa
aaaattatttgtaagatagaaatatgttttcgcatttctactgtacacttggacattagcaaaacaaatttgcaagttacaatgcaataggcaaaacaggtattcacaacaataggatctagcaaagaaaacatggcattgcacttcaactcatacagaagcatggaagtattaaaggataaatgaggattgaactatcaagaagatgtgttcccccaactgcattgctactccatacaaatca

SEQ ID NO: 35239 - DNA, 245 bp, Oryza sativa
cctgttgcaacgtggtatagcattggacagtggatgattaatattgattaattattacaacggttttactactttcaactactatttataaatgctcgctttatgcaaaggaaccattatagctatcccttgataattccctgcatcatacccctattccggtatgacttgctgagtacagtgggtagtactcagtcttgctatattttccccaaaccccagagtttgagtatgcgtcagatggt

SEQ ID NO: 35240 - DNA, 353 bp, Oryza sativa
  unsure (1)..(353): unsure at all n locations
ccctcagcccgcatacgtttctaatgtactacctntatttaagatcgatatacgcatgtacaatcttattactcttcctttcccccccccccccctgcaattagtagcactcttatcnaccacagccgaanncgagctcggcacccganccacaagaggacacngncacaaanctccaaaaggaccgccaaggaanggnctatttcttctacgacaccttgcggtcctgccgagacaaggagtacattatgtgcgcctataatcaatagtaagtgtgctaactaaatatacacagcaaaatgacacacattccttgagtacttaattaactttcactatattaatgccgcagt

SEQ ID NO: 35241 - DNA, 719 bp, Oryza sativa
tctagatatccatttcacctataacttttcaacatgccaatgcacgagaagcactcttaccaagaatatcactatcaacacaactatacaggtactagctagctagatccaataaacacgcttgttttagtagtgcgtctgcaagcaattaagctaggaatcaatcagataacataaacaaggaccggatctatagtcgatactactagatctggtaaatgcatgcgttcattgactaaatctacacagccttcactaggtgatatcgcttacgtagttgggaaaaaaaaactatagttgttttggaattgttactgacatttagtatagtcactgcttgcataggactagtaaatgcatccatagcgtatagttcatatgcgatactagagaggtgggacacacatcaatcataacaattaggaaaatttgttacagggtataaaacacctatagaaataatcataggactcacccatattaaaatagaggaaataatagagaggtgtagcttgcaacctgtaagcacgatttatctgacatgagggtccaaagacactctcgtaccattgaaaccaaggacgagtactagtacttggtctcaggctgaggcctgctaaaaatataaccataatgtatagggctagcatcatgcccttatctctcgagaaagctagttgacgatcagtcgcgtgcccccctccccgcgtgactggaca

SEQ ID NO: 35242 - DNA, 453 bp, Oryza sativa
caggtttataataaaggtggtgggcacccctccatttttatccggtcatctatccaaaaattaaacctacttatacactatttccaatacacttgccaccaatcagcccctctcattttcttttgttcttgaagttgtgtggagggttccccttatacgagggggggctgcttctctctttcttgtcttctctcctccacaacatcatttaagcatagacactttggagtttgtgcttagaaccttagatccttagtgcaaggctaataatataaccagctgtttactatatagatcttgacagtctacctcttagctaactggttagctcttaactattaatatatggtcaatatgtctctctcacatatttttttggtcttgtgcctaagccggctgtaatcgtgccatccgcttcttctctcactcctctcctctcttatccacctcagt

SEQ ID NO: 35243 - DNA, 265 bp, Oryza sativa
tgaaaaccaccatcttacagcattctacttgcaagctacttgcacatatactaattaggtgagattgagaagataagtatatctcagctttgctgccaataaatatcgtcggctgcatgccccattacactggacaccactccggctagtcaattaaccatcctgcagctgcaggcacaccaaacacacgcatgcacaataatccacacaagatggccaccggcgtagcctcgatctcctacggctgccgtcgccgtcgccgcca

SEQ ID NO: 35244 - DNA, 679 bp, Oryza sativa
tgtcacaccttaaaatccccaatatatagaattggtgtgttaaatggaaatatttagatttaatttaaaaacctaggagagaaggttccctaataatttattaaatccaatataaaatggggccagataaaattttattaaaactttgcttgattctatagttcctagagttttctgggatttatttgagccaaggaagtatttttaataaatagaattgcatttcatgaataatttaaattgaaaaaggttttttaaaagtctctttggctttgggccgaaagtcggcccaaaaccctctctctctctcctcctcggcccaagtcggcccaagtcaagccgagccacgcgtgcgctcgctgcggttgacaggtggggcccacctgtcaggcctgtcgtctacctccggccggccgccgcccgaaccctagcgccgtgccgccgtcgtctccttccaaatccagccgcccctttccgtttccggtgaaattaatagaggggaaatgatccccgggatcccttctatcttttctcttatggaatcgtcggctaattttgtttggaaatccgtggattcgagttcgattcggatcgatctctctcctccgaaccctagactttccttcgcgtcaccggtcgccgtgagccttcgccgccgccttccaacccctatataagg

SEQ ID NO: 35245 - DNA, 519 bp, Oryza sativa
ttaaattaaacaatttcttcgaatgatttattttatgaatttagagtaagggaggggtacttcagggcgtgacacttgctggccttggaactcttcaaattcttctcctgcgaaaacggactctccggaaacgtcggaatctaaacagaaaggagcaaaacaccaaaacagcacattaacaagcatgaacagtacatgtagatatttttaacatgtagatctcaattttagaaaaatttagagacttgaaccaactaaatccgagctaagatgaattagttatgaattttcaaagattaaatcggtttaaaacacttatatagattttaattgaattatgacgcaataatgaattatttttgaaaaggaaaagggaattattgcgtcattggctagggttcgcggtgaaccgggtgcacggcggcggttcacaagattgggcggccgagatcgatcctaactacaacggacggccaagatcgatcggatccaccgcggctcacggatggacgacgacga

SEQ ID NO: 35246 - DNA, 1501 bp, Oryza sativa
  unsure (1)..(1501): unsure at all n locations
caaacatatgagattacttacccggtttctaagggcggaacaggaaagtaccaaggtgcactaggtgagaagaacttttttcgcttttttatcggaatttgactcattttagtatagaaaaacaccattctatctgacctagtaggaaaagttactattttgcattccttagggaaagtggcattttcaagggtcatttttgaaaagcatttgtcccaaccatgtgcaaaagtaaagaaaattgcttctccctcgtaaatggctccaaaatctactccatttttgaaaacttgatagccagcatggggcaatttggtagttttttcattttgcttgtaaatcggctctttttggcatcccagttctgaactttttcatctcgcctagtggaacttgagactttttccagtatctttatccagcagcaggactttcactactttcccaagtaaagctagtgttaagagactggattgtagaagtgttgactgacttgactggaaatataatatggaaagactgatggactgactaaagtggctattgacttaagtggctatttcctgattccgatatggcgtcctgaatccaatattgcttgattgtctgttgatgcccagccgaagaagtgacttgcttaacgtagcaatttctgttttcttgtgctctccacctccgcttgacactatcgtagtagatcataagagaagtattctttcaagaaattcgtatagaaagatggactagctcgagaacaagcaacggattgagcgcactagcgcaaaagcgttagcacgcgcatccgttttcttgctccttggcttcaaacaatcgattgaatctggattcctttgcttatccttcctggctatagtctctcttgtgccttcggcagttcagttaaagatttctgtatcaacagtttgtttccccatttgctcaaagaacgcataaaacctgttccctcatcgtatcaaaagatcaagcggaagagtcctcttcttcaagaagagtttttcatttcactcttccgcagcaatgcccgggcaagaaaacaatatgagcaaatccgcaaaacaatatcatagcaaacggtatgtgctggttggatagagcaatcagtagttgacgttcgaaccaatcttctctctagtagactttagattcagtcgtccgtttgttttgttttgaattgacatagagaaattttcccactacgtaattaaggaataggtggcgaaggcccttggcggactatatataaaggaaaggggttatttttcctttacggcaataagagctgattcccttgcttgtagtttttgatcgatggagtgtatttaacatatttaagagtggttaggagagagaatcaatgtttagtagtaggcccggttcaccaggttctaccactgttcggcccaatcatagtcaaaatctnnnnnnnnnnnnnnnnnnnnnnnnnnnnnnnnnnnnnnnnnnnnnnnnnnnnnnnnnnnnt

SEQ ID NO: 35247 - DNA, 1501 bp, Oryza sativa
cagcaactaaactataactaaaatgtggtctaaacctgtcggcttcatgctccaggccctgcatgtcagtgaaacactccttgtcgcctctatgttctgctcccctaatctcacccaactagcaaggctagattaaaggaagagttaatgacagatcataaacacatactttctacttgcttttagatagtttaattacgtagggctgcataatctgcatttctttttttttatagatatgcatttgtgtaatgtcccttgtgtgcacgcaacagtgaagtccagtctcacttgcttatgttgcatgataatgacaccaacagtagtggcattgttcacctctctgaaacttctcgcattgatgcatttcagtgaacttgtcttctctctagtgatgtcttcagatcaggcagttgtctatgccgctttgcatcattgtcagataagggcttgtccgtatctccgtatgttgtcattcagagatctctcttatttatgtttgattggatatggggcacccgacaccagatacattgatatatacaacattcgtttcatactataagccgttttgactttttttttaagtcaaccttatttagctttggccaaattttataaaaaaaatataataatttttcaacataaaacaaagaagctattaaaatatatttaatggtagatttaataaaactaatttaatgttataaatgttactgtatttttctataaacctagtaaaacttcttaacttagttaatttttttaaaaaaatcaaaacgacttataatattaaacagagggagtagacgagtagtgtatattgataagtgatgagtccagcctacctgaataattcttttgagttaatatggaatgaattatgtaggaggtatccatttggacaccacttcagagttcaagttgatgtcaagtgctccattaagcacactgatgtagtcccttttctgtagtaagaaaaaggcaataagctagataaccttccattgcaattgtaatgctactcatagctaatgctgtagggacactttgatggtccaccaaatcagaaatattacaatgacaaactttgtctggtcaataacgccctggttcttaaatggcaggccatccgtttgttttgcagtagctattcgtcatgttggctacaaaaagcaggaaagcaaaggttggcaatggttgttcttcccatccgtttcgagctgcaatagaaattgaaacgtccagagtgagtaatgctattctgtctatgagaaattccaatgatctgtggctgaagctgaaaacatgccctgttgttgttagtaactgacaggccgttctgcgacttgatgatagccttcaatttcagtttaccagcataaaccacgcattgaattcgttccaacaaaattttcatgcgttgagaacttgagataacagctcaagatgaggtcactagttcgtttgtcaattctcctcgaaattgtcgatcatcttt

SEQ ID NO: 35248 - DNA, 1223 bp, Oryza sativa
  unsure (1)..(1223): unsure at all n locations
ttttgaagcagggcgagactactttagctaggagcctcttttccttctgcccagctccccgaaaacaannnnnnnnnnnnnnnnnnnnnnnnnnnnnnnnnnnnnnnnnnnnnnnnnnnnnnnnnnnnagattttgactatgattgggccgaacagtggtagaacctggtgaaccgggcctactactaaacattgattctctctcctaaccactcttaaatatgttaaatacactccatcgatcaaaaactacaagcaagggaatcagctcttattgccgtaaaggaaaaataacccctttcctttatatatagtccgccaagggccttcgccacctattccttaattacgtagtgggaaaatttctctatgtcaattcaaaacaaaacaaacggacgactgaatctaaagtctactagagagaagattggttcgaacgtcaactactgattgctctatccaaccagcacataccgtttgctatgatattgttttgcggatttgctcatattgttttcttgcccgggcattgctgcggaagagtgaaatgaaaaactcttcttgaagaagaggactcttccgcttgatcttttgatacgatgagggaacaggttttatgcgttctttgagcaaatggggaaacaaactgttgatacagaaatctttaactgaactgccgaaggcacaagagagactatagccaggaaggataagcaaaggaatccagattcaatcgattgtttgaagccaaggagcaagaaaacggatgcgcgtgctaacgcttttgcgctagtgcgctcaatccgttgcttgttctcgagctagtccatctttctatacgaatttcttgaaagaatacttctcttatgatctactacgatagtgtcaagcggaggtggagagcacaagaaaacagaaattgctacgttaagcaagtcacttcttcggctgggcatcaacagacaatcaagcaatattggattcaggacgccatatcggaatcaggaaatagccacttaagtcaatagccactttagtcagtccatcagtctttccatattatatttccagtcaagtcagtcaacacttctacaatccagtctcttaacactagctttacttgggaaagtagtgaaagtcctgctgctggataaagatactggaaaaagtctcaagttccactaggcgagatgaaaaagttcagaactgggatgccaaaaaga

SEQ ID NO: 35249 - DNA, 580 bp, Oryza sativa
ttcttccgtttgattcagtatttgttactcccttgttccatgttacaagtcgttttgatttttttaaaaaaactttgttaagtttgataaatgtatagaaaattttagcaacatttataataccaaattagtttcattaaatttagtattgaatatattctgataatatgtttgttttgtgttgaaaatactcctatgttattctgaaaacaagtttgactagaaaaaaaaaatcaaaactacttatagtatgagacggatggagtatgtgtaaattgtgatccatatatttgtgtggtaaatattggatatgacaaactttttcatagcccttaccattactaagtttggttccaacttttttttccctggccagatattaggtgcactcaggatgaatcaatgtgctattgttgaattattgcaatctttgatgaaaagttgctcattatgctttattatttttatgccggatattcaactatataatattccctctgtataattggccttttcacatcttaggagttcgatagtaaatgtttagtattgctgatcagtttaaccatgaaagatacct

SEQ ID NO: 35250 - DNA, 184 bp, Oryza sativa
agtggcatatgtaaggtaaaaaagactctgcatcagcatttggccatttgctttgacgagttaccgtagctgggctctttgggggaaaggtaaatcacgcaaaacattttagcactatgccacgctagccgtatgaatgaatcgattttcacatcaaattcaggtcactctgaatctgcaagca

SEQ ID NO: 35251 - DNA, 470 bp, Oryza sativa
aatttgagcgcttatgtagctaataactctgccacctgaatacttgattcattaaggtcgtcacccaatacccggaagtctctatcgttttctttgtctgttaagcttcacagggttgggactccctaaatcaaactgcaatcgctgtttatcaaccactcacgacgacaccgagatcttcgacttagctcccacaggtctcggggcggaagataacgaaagggagacaaagtcctaactaaatcaacacacaataacctcaaccttctaccatccatcatatcagtcgagtcgaggagattcgttcttatctatagataaggcaagagagaacttatgacctcgcggatggagagggattcgaacccccggtattcctatcaatacttcggttttcaagaccgactctttcaaccgctcagacatccatccctgcgctcgcccgccctatctatctgcgcgctggcagg

SEQ ID NO: 35252 - DNA, 1501 bp, Oryza sativa
gcataatagggttgcatttgcaaaagcagcatttagcaaacttttgagaatttgataaaacagttaagtaattaaacaatattaatccaacgctatacaacataccctgttgtataggcccaaccattctgaacaaccaccccggctgcacagttctatctccaaaccaggaatataccattccaaaccaggagctaatcaaattattaccagtttaagcatcttttacaatgatgagaggtgtgagactaatcacgaaagacattgttagacccgcccataacagcgggcacggctattcgaatagttttactctgatcagaggtgtaccactgtacccacaagacacaaccccacatcatgtcaccatgtgcctcaataccaccacggtacctcggaaaggagttgtgacaatacccctcgcataacacaatccactgcagcgcaccttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacggttaatgtttcacaaccgaaactcgtgaaccggtccttaattgtcatgagcacgaccaacaaaaccatgtgctcacaacccaccattaccaggttttagttggcacattaattaattaactaatcacgattgaccatcgtgaactatcatgaaaccatcattaaataataatgagtcattagttatcccgaatgtgtactaatgtttctaagcagggctaagcaattatatctaatatctagttgaaacaatataaataaagctcaactagtcaaattgtaataacccaaggtatcaaggaataaggtaatcaagtacgaaagggccataacaaagaataggtcaattccacccaatgacattcgaaaatagatgcaatagttgaatagaaacaatagctttaaataggatcaacatgctcaaagggttgtttgggatctgtgtgacttgccttgctggccttggaactcttcaaactcttcttctgcgaaaacggactctccggaaacgacggaatctaagcagaaaagagcaaaatcactaaaacagcacataaacaagcatgaacagtacatgtggatatttttaatgtgtagatctcaattttagaaaaatttagagacttgaaccaactaaatcggagctaagatgaattagttatgaatttttaaagattaaatcggattaaaacacttatatcggtttaaattgaattatgacgcaataatgaattatttttgaaaaggaaaagaaggtttattgcgtcagcgggctagggttttggtggaccgggcgcacgggcggcggttcacgcgaacggacggccgagatcgaaccaatccaaaacggacggccgagatcgatcgggtccacggcggctcacggcggacaaccccga

SEQ ID NO: 35253 - DNA, 485 bp, Oryza sativa
ttctattctaagacggctaaatcgagggcagacacaacaggtcccgaagaggttcgaaaaggcgtacatgagtttctcctacataaggggctcattggttgtcaaccaagtgagaggggtctaataaagctgaaggatgagtatagataccttcagccgagatcgcttgggaggcatagccgcctctaccaggagattctctcttatttcttaagaaagtatgaattgccatagaattcttcgaggcctgattcaagatctgaagtatgtattgaacattggttttttcctgtcaataatatccgttaaaaagaagagagagagagagagagagactgccatcgccatctctctctctgtcatgtcaaatcgagattgtgtgggtgttcggtatcacaatccctgtattctaggttctggctggttagagcagaggactcgaaatcctctttagctttgcgcgttggactctaaatcctaacaga

SEQ ID NO: 35254 - DNA, 648 bp, Oryza sativa
tctgacttctaaggtagacaagggataggaatcaatgcatgctcaaatccaaatttaaaccaagcaacaaatgggccaaaccactagccaagcatgatgatttgtatgcatagaacatttttcatgaacccggataaagacactaatgcgactgactaaactatagcttaatgcataaactagatgcatgaaaaatgatgcgcgtaacattgccccatcgaacatagacacgacctaatgcatatcacccgataaattcccaactgactgtcaaataaactccaaataaacttttaccaaaccctagactgtccctagtcgagaaatccaattaaataagcgaccaagatttttcccacaaactcaaaagaacaaaaccccaaaatttttcccgaaacaaatccaagtgcaaaaagcatatgcagatgaaaaggtttcagagggctcttagggtttccatttggcttgtcctacggtcaaggtcggctctgataccaacttgtcacgcccagaaattcacgaaccagaatttctaagctgattgtgcattaaacccctgtccaggaccagccagggtacacaaacgacaattgttgacatacagatccacgtcttacaaaaatataaaagattacaaatgcagcggaa

SEQ ID NO: 35255 - DNA, 1501 bp, Oryza sativa
tgtttatttttgtttgtcaggccgaagtgcctttgtaataatgtaaatattatcgatataataaagatgtgccttttgtatcatgtttgtttggtgtaccccggcttttcctgggacggggattaatacactagcgttcgggaaaatgtatttttctcggtcgcgacaagctggtatcagagccatctcgactgtaggataagccaagtggataaaacctaaggacatattttataaataaaactatttgcgaaagttccttctttctccttcccctaatgctatttgcaaaaggtttactcccttcttccttcttcggatttcaactagtactagatggtcaggtcagtgaagaagaagacatcgtcagttgtttgccgaagctccggaagactgcaggatccgttagcgaagtggaggaagcagtgaagccaactgtgaagcaggagtgaagatcttgggaacccgtcgcagaacctaagccaccctctagtgtttcgtttgtcgtgtgtttccttgcttgtgtgtgtagcgcgtggtttgcatcagtgggttgtgatgtaaccatgctaggttgtttgcttaatcaacttgcagaataagcctaacatacatcataacagcaaaagacttagatctgttaaggtcctatccttagtttctaatctgtctctcccctttgttttccctctctccctctccaaacctttgcaacagatggctgacaatgagaaaggcaataaggtcagaagtcaggacattggtacctcaagctcccgagtgaatgaagcaccagacaccagttgtgtgacactggtccaacacctgattaaccagaaccgattgcttatagagatactacagcagcatcagacgccaattctgaacctgagtcaaatacaacctcaagtgcagttggaggcagtccaagcactcacaccacaagtcagcatgccgccagcatcccgaaggacccatggtgacgtgccacatgttgactcaaaagaagcaagtatcatttgttttatgtgtgatgagcaagggcactatgcaagggagtgtcctcagcagaaaagaaaaacaccaatgcgaaccgaagatgaagtccgtaagatgatcattaccagcatagaatggcctccaccaggaatgacaaaacgtcagagaagaaataccttccgaggtgcaccacagttgacagagcatcttttagctaatggaggtagggtgtctgatagtgaagattcagatcaagtctcctcagatgatgaagatgagaagtctccccaaggtttcaaccagaataaaatggaacgaaaggcatgctctcgttgtggagaaatcggtcatgttgccagctcgtgtgccactacatgcgttcattgtgaggaagaccatccacccgacaggtgcccaacgagcaggatcacttgtttcttttgtgaaggaactgatcatgtaccaaaagattgtcaattcagttttctgctgacgaagaaga

SEQ ID NO: 35256 - DNA, 1501 bp, Oryza sativa
tcacggcctctttccggtatgtcgtggtggcatgtcggcgcacgggaacgtgtcgtggggctgtgtcttgtgggtacagttgtacacctctgatcagagtaaaactattcgaatagccgtgcccgcggttatgggcggtcgaccagattcaccgtgattagtttcaccctagttagcttttggaactgattagtttaggtggtggtttgggcctgttgcaacgtggtgtaacgttggacagtgattggttaatatggattaattactacaactgttttactgctttcaactactgttttgaaatgccggctttatgcaaaagaacctttagcctcccttggatatatcttgcatcatacctcctcttccggtatgacttgctgagtacagtgggtagtactcagtcttgctctcttttcccccacaccagagttgaagtccttcccagttgaagatgtctcgaagaggttggtttcgtcgctgccgtcaaggattgcctgtggaatggagtcgcccgctgcaggagtcaagtcttcaggcttagctcgcttttatctttttccgctgcatttgtaatcttttatatttttgtaagacgtggatctgtatgtcaacaattgtcgtttgtgtaccctggctggtcctggacaggggtttaatgcacaatcagcttagaaattctggttcgtgaatttctgggcgtgacaagttggtatcagagccgaccttgaccgtaggacaagccaaatggaaaccctaagagccctctgaaaccttttcatctgcatatgctttttgcacttggatttgtttcgggaaaaattttggggttttgttcttttgagtttgtgggaaaaatcttggtcgcttatttaattggatttctcgactagggacagtctagggtttggtaaaagtttatttggagtttatttgacagtcagttgggaatttatcgggtgatatgcattaggtcgtgtctatgttcgatggggcaatgttacgcgcatcatttttcatgcatctagtttatgcattaagctatagtttagtcagtcgcattagtgtctttatccgggttcatgaaaaatgttctatgcatacaaatcatcatgcttggctagtggtttgggccatttgttgcttggtttaaatttggatttgagcatgcattgattcctatcccttgtctaccttagaagtcagacatgttcttcgatcgcaagcgccgctccgagcttcagagtcgccgcccttagctttatcgtcttcttagtctgtttgcgtgctagtttttgtgtttaggtttgttgcttgtgggttaatcggcggtcgatatcatgtgtgagtggtatgacagccttaattaggaattgcgtgcctctttttcagtgttttaatcaagattaagataattgcacttaattttataagaaagattagtttccgagccatctgttttcttcctttctcttatttctacctatcctcctccagatgg

SEQ ID NO: 35257 - DNA, 1306 bp, Oryza sativa
cttgctgagtacagtgggtagtactcagtcttgctctcttttcccccacaccagagttgaagtccttcccagttgaagatgtctcgaagaggttggtttcgtcgctgccgtcaaggattgcctgtggaatggagtcgcccgctgcaggagtcaagtcttcaggcttagctcgcttttatctttttccgctgcatttgtaatcttttatatttttgtaagacgtggatctgtatgtcaacaattgtcgtttgtgtaccctggctggtcctggacaggggtttaatgcacaatcagcttagaaattctggttcgtgaatttctgggcgtgacacgccgcctcccgccggccgcgctggcttggccgccctcgggcgcgtcgagtggctgccgtgtggggcccggccgtaagccgcccgcgccctcgggtgcggctgacgcgtgggacccacggcgccggccggtgtgagccgggtgcacccggtccaccgtggaccgtgaggctgccgcgtgggccccactcccgtggacccggtccgcgcgccctctcccctcggctgacgcaataattccgattttaaattaaaatttaaatgaagaaattcgcaaatattcaattaaagagcatataaacttcaaatggccataacttggccatttgaactcggaattggaccgttcaagtctctaatttttccttaagaagtcaagaacccatttttgtgctttgtttctgcttgttatatggagtttattagagtaaaagccttttcttttctgttggtcgtgtagacgctgcagcttcggaagatccgctcttcgtggaagttgaagccggcgtttgggaaagcgagcaaggcaagtcacatcatccttgaacatattaaatcccagtttataaaattattttgatttaaattattgcattgtcgctttatttaaattcccgcgttatcactgttttatttagccatgcctatttacctttgttatgaccttattattattgttattgttattattaccttgttcaccctagattaaacaaaaccccaactagtggatactctacttacggtaccactagtatgattttaggtagatgcttcgctgtttaattaggtaacattaggtggttttacaactctagactttgggatattctcatcacctggacactttggaattgttggattattgtggaattggattcacaccgccccctctattcaaaacccccaaaatggttttaggctgggctcagggtgcatggtttggatagtagcacctcggccatataaggaccggt

SEQ ID NO: 35258 - DNA, 1129 bp, Oryza sativa
  unsure (1)..(1129): unsure at all n locations
ttatannnnnnnnnnnnnnnnnnnnnnnnnnnnnnnnnnnnnnnnnnnnnnnnnaatatgcaagtgcacaggataacaaaggatggcatagtagggtttcatttgcataaacagcatttaataaacatttcagaatttaataaaacagttaagtaataattaaacaatattaactgtcgcgaccgagaaaaatacattttcccgaacgctagtgtattaatccccgtcccaggaaaagccggggtacaccaaacaaacatgatacaaaaggcacatctttaatatatcgataatatttacattattacaaaggcacttcggcctgacaaacaaaaataaacaacagcggactagcgggcctacggctccatcttcacaggcgctcaactggggtataagccaggactccacctaagacatcttctccgaagcttctcttactgaaggggggaaagattgaacaagaatgagtacaaccacaatactcagcaagccacaccggcagatgcatgattaatgcaagggggtacaaggggtaataataaaggggttaagttttgcagtaaatagcatttaaaagtcacttagttgcccaaagccattttaaaaagacgatcctaaagctacacagtattattaatcaaggccgtgaaccctcacgaacctgccttaacccaaggcctacgatgattcagaccgaactggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaataggttatactctgatcagaggtgtacatctttacccacaagacacatcttcctcacgcgtaaccacgtgccacataccaccacggcatatggacggaagacatgacatagtttccaacccatcctagccatagacaagagtaccgacccaaccccacctacggccggaacctccgggacaggtaggcaggattgagcccctagcagcaggacaccagccctgtgccatgacatctcgactaccgggccgcagctcgtgtagccttcatttgtcctaga

SEQ ID NO: 35259 - DNA, 1501 bp, Oryza sativa
acccacaagacacatcttcctcacgcgtaaccacgtgccacataccaccacggcatatggacggaagacatgacatagtttccaacccatcctagccatagacaagagtaccgacccaaccccacctacggccggaacctccgggacaggtaggcaggattgagcccctagcagcaggacaccagccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgctttgcaacagaggcccgaagaccggtccttatatggccgaggtgctactatccaaaccatgcaccctgagcccagcctaaaaccattttgggggttttgaatagagggggcggtgtgaatccaattccacaataatccaacaattccaaagtgtccaggtgatgagaatatcccaaagtctagagttgtaaaaccacctaatgttacctaattaaacagcgaagcatctacctaaaatcatactagtggtaccgtaagtagagtatccactagttggggttttgtttaatctagggtgaacaaggtaataataacaataacaataataataaggtcataacaaaggtaaataggcatggctaaataaaacagtgataacgcgggaatttaaataaagcgacaatgcaataatttaaatcaaaataattttataaactgggatttaatatgttcaaggatgatgtgacttgccttgctcgctttcccaaacgccggcttcaacttccacgaagagcggatcttccgaagctgcagcgtctacacgaccaacagaaaagaaaaggcttttactctaataaactccatataacaagcagaaacaaagcacaaaaatgggttcttgacttcttaaggaaaaattagagacttgaacggtccaattccgagttcaaatggccaagttatggccatttgaagtttatatgctctttaattgaatatttgcgaatttcttcatttaaattttaatttaaaatcggaattattgcgtcagccgaggggagagggcgcgcggaccgggtccacgggagtggggcccacgcggcagcctcacggtccacggtggaccgggtgcacccggctcacaccggccggcgccgtgggtcccacgcgtcagccgcacccgagggcgcgggcggcttacggccgggccccacacggcagccactcgacgcgcccgagggcggccaagccagcgcggccggcgggaggcggcgtgtcacgcccagaaattcacgaaccagaatttctaagctgattgtgcattaaacccctgtccaggaccagccagggtacacaaacgacaattgttgacatacagatccacgtcttacaaaaatataaaagattacaaatgcagcggaa

SEQ ID NO: 35260 - DNA, 844 bp, Oryza sativa
catttcggcgcacgggaacttgtcgtggagctgtttcttgtgggtccagttgacacctctgatagagtaaaataattggaaaaccggtgccgcaggttatgggcggtcgaccaaaattcaccttgattagtttcaccctagttagcttttggaactggttagttcaggtggtggtttgggcctgtgcaacgtggtgtaacgttggacagtgattggttaatatggattaattactacaactgttttactgctttcaactactgctttgaaatgccggctttatgcaaaagaacctttagccccccttggatatatcttgcatcatacctcctcttctggtgtgacttgctgagtacagtgggtagtactcagtcttgctctcttttcccccacaccagagttgaagtccttcccagttgaagatgtctcgaagaggttggtttcgtcgctgccgtcaaggattgcctgtggaatggagtcgcccgctgcaggagtcaagtcttcaggcttagctcgcttttatctttttccgctgcatttgtaatcttttatatttttgtaagacgtggatctgtatgtcaacaattgtcgtttgtgtaccctggctggtcctggacaggggtttaatgcacattcagcttagaaattctggttcgtgaatttctaggcgtgacagcaaggcaagtcacacagatcccaaacaaccctttgagcatgttgatcccgtttaaagctattgtttctattcaactattgcatttattttcgaatgtcattgggtgaaattaacctattgtttgttatagcccttttgttcttgattactttattccttgataccttg

SEQ ID NO: 35261 - DNA, 1385 bp, Oryza sativa
ggggcgcgtagtaataagatgggccggggagtatctggaggagcgtaactccggcctgtttgggagccggaaaaaaagaagggaacaactgggggagaaaacagaagagggggatcgcgaggggaataatttcccccccacattttaatgcggccagagaacggcgagcatactgcatgtattttccgcgtagtgagtggacctagtggctcggcaaggtcggcgagatccgccggaagaatagggattacaggttggccccatccgtcaggaagggtggaggcgggcccgcctgtaagcggcgtgcttggggagagccgaagtgggccgcggggagtaggatagacagggaagcatatgggccgagccggcccaagaggggaaggggggagaaaaagactttttaaggtttttctttttataaaatcattttaactttgtttatttcttaataattattatttgtgctctgaaaattccactaaaatttgagggctccttttagaccaaggagaatttaacaaaaattctccgggccacatttgaatttttcttgtacgtattttagtgtttgtcaatttcttttcgaattttaattaattctattattccttttagcgaatgatttttaattcgggatgaatttatcaggacgtgacattaacccaacgctatacaacataccctgttgcataggcccaaccattctgaacaaccatcccggctgcacagttctatctccaaaccaggaatataccattccaaaccatcccggttggcacggttaatgtttcacagccgaaactcgtgaaccggtccttaattgtcatgagcacgaccatcaaaaccatgtgctcacaacccaccattatcaggttttagttggcaaattaattaattaaccaatcacgattgaccatcgtgagctatcattaagacatcattaaataatagtgaattataagttatcccaatagtgtgctaatgtttctaagcatggctaagcaatcatatctaatatctagctgaaccaatatataaagcccaactagtcaagttataataacccaaggtatcaaggaataaagtaatcaagaacaaaagggctataacaaacaataggttaatttcacccaatgacattcgaaaataaatgcaatagttgaatagaaacaatagctttaaacgggatcaacatgctcaaagggttgtttgggatctgtgtgacttgccttgctgtcacgcctagaaattcacgaaccagaatttctaagctgaatgtgcattaaacccctgtccaggaccagccagggtacacaaacgacaattgttgacatacagatccacgtcttacaaaaatataaaagattacaaatgcagcggaa

SEQ ID NO: 35262 - DNA, 1088 bp, Oryza sativa
catccgtttgctccgccgcgccgtaattcgccggcgagcatgcgcgcccgagatgccgccggtggtgacgtcgtcgctgacgtcatcgtcgtcgtccatccgtgagccgcggtggatccgatcgatcttggccgtccgttgtagttaggatcgatctcggccgcccaatcttgtgaaccgccgccgtgcacccggttcaccgcgaaccctagccaatgacgcaataattcccttttccttttcaaaaataattcattattgcgtcataattcaattaaaatctatataagtgttttaaaccgatttaatctttgaaaattcataactaattcatcttagctcggatttagttggttcaagtctctaaatttttctaaaattgagatctacatgttaaaaatatctacatgtactgttcatgcttgttaatgtgctgttttggtgttttgctcctttctgtttagattccgacgtttccggagagtccgttttcgcaggagaagaatttgaagagttccaaggccagcaagtgtcacgccctgaagtacccctcccttactctaaattcataaaataaatcattcgaagaaattgtttaatttaacctagagatgaatccctaagtaataaatgcaaataataatcggaatcgacatgtagaatttctcttggattctacatgtcaaaatatgctaacaggatttttagtggaattttcagagccttggaaataattttaaccaattaaaataagcaaagtgcaatattaaatccctggaaaatcttttcttctttttctttttcctcctttttctctcttcttgggccgtcggcccagtccgttcgcctcccgcgcgctcgccctcctgtcagctgggccggcccactccctccctcctctctccgggtcaccgacaggtggggcccacctgtcggccccttcttcctcctccagccgacggcgccgccgccgccgaaaccgccaccgacgccgccggtttccccgtttcccgcgcccactccgcccgtaccgcacgcccacgtcgccgccctctccccgcatctcacggcccgtgcgcgcgctcgag

SEQ ID NO: 35263 - DNA, 275 bp, Oryza sativa
agtaataacgacttctccataacagtttgaagattggctcgcaacgcaagtagcggcaagaaaggagagcaagacttccttttctaaaagaagaaagaactagacttctataagaagattttgataatcgtagatcgtggaatattcatctatcttattaggtaactactttagctgctctcgaaactgaaccatcgtgaatagaactagcgcttaaggaagagtaggatctgttagcaagtcatattcaatcacccggtcttctccttcctagc

SEQ ID NO: 35264 - DNA, 1138 bp, Oryza sativa
  unsure (1)..(1138): unsure at all n locations
ggtgggcaaaagacgncggcgcagnagagcaaggcgtaaagccggnacnaggagaaggtggggaagaagcaggggaaccaccgggggagctcgcgaggctcgcggcggatctcgggcgnnccgagcgggcgnacgcggaggcaacgncgnagnaancgaagggagcgcgtggtgtgccggtacncggcaaggtgcgggcacggcgncggctcgaacggggtggtcatcggggcggggaatgtggggaataagccggtgggcgcgggagtggaaggcgagcggtgcggggatgggggggtggagtgccggcggctgctggtgatggcgcgggggtgaggtgaaggtgacggtcgggatggtggtggtggatcgtatatcttctcgtggactcgtgggtcgcgctgagcagaggcgtgcacggcgatcttggatgggcgcgtggcgcgggtgatcactgatcaggtaatcaggttactactgtggtgtgtagcgctaggcacagcaaattcaggcgacggtcatcctatcaaagttcgggctaacacgaacggaaattacacaaaattatatgaattcgaaaccttatatagggtgtgtttagtttttaaaaaaaagttgaaagtttgaagaaagttgagagtttaaaaaaaaaattgaaagtttacatgtatagttttttatgtgatatgatgtgatggaaagttgggaatatagggaaaactaaacacagccataaactatacttgagaaacagagatcaagattacaccatttgcaaagagagatgcgaataatttagagttgactcttatcacttcacggagacttgggagatactaccagcaagttcttcgtctgatattctctcatgcgtagaggcttcttgaagacttgaactttaaagcgcatgaatgcatgatcatacccatgctgtatgttggcatttttgccaacagtggcatatgtaaggtaaaaaagactctgcatcagcatttggccatttgctttgacgagttaccgtagctgggctctttgggggaaaggtaaatcacgcaaaacattttagcactatgccacgctagccgtatgaatgaatcgattttcacatcaaattcaggtcactctgaatctgcaagca

SEQ ID NO: 35265 - DNA, 637 bp, Oryza sativa
tcgcttatttaattggatttctcgactagggacagtctagggtttggtaaaagtttatttggagtttatttgacagtcagttgggaatttatcgggtgatatgcattaggtcgtgtctatgttcgatggggcaatgttacgcgcatcatttttcatgcatctagtttatgcattaagctatagtttagtcagtcgcattagtgtctttatccgggttcatgaaaaatgttctatgcatacaaatcatcatgcttggctagtggtttgggccatttgttgcttggtttaaatttggatttgagcatgcattgattcctatcccttgtctaccttagaagtcagacatgttcttcgatcgcaagcgccgctccgagcttcagagtcgccgcccttagctttatcgtcttcttagtctgtttgcgtgctagtttttgtgtttaggtttgttgcttgtgggttaatcggcggtcgatatcatgtgtgagtggtatgacagccttaattaggaattgcgtgcctctttttcagtgttttaatcaagattaagataattgcacttaattttataagaaagattagtttccgagccatctgttttcttcctttctcttatttctacctatcctcctccagatgg

SEQ ID NO: 35266 - DNA, 597 bp, Oryza sativa
tgatcaggttttgcaaagttcagtggagccaccactcataagaagaggccacctgggaaagagaagatgaattgaaggccgcccatccgcacctatttgtcagctcttccgaatctcggggtcgagattccgtttaaggggggtaagcttgcatgcctgaaggtcgactcttcccttgctctaaattcataaaataaatcgtccgaagaaattgtttaatttaacctagagagaaaccctaaattaataaatgcaaatattaatcggaatcggcatgtggaatttttcttggattctacatgtcaaaatacgctaacaggatttttagtggaattttcagagcattggaaataattttaaccaattaaaattgagcttgtgcaatatataaatccctggaaaatcctttcttcttttcttttccctcctttttcctttttcttgggcccggcccattccctccagcgccggcccgcttcacctcccgcgccgaccttccctcggctgggccggtccaagccggcccactccctccctcctctctccgggtcaccgacaggtggggcccacctgtcggccccttcttcctcctccagc

SEQ ID NO: 35267 - DNA, 1501 bp, Oryza sativa
gatatactatttagaagacactgagcaataattgctataaagagtcagatcaatgtgttcgatgttggattatcaagcctacatcttacaattagtgctatcgacccaagtcttgataagcatatgttcgatgttgcattattgcatatgctcgatagtactaaatagggggtgtttaatgcagtggtgtaaagtttagcgtgtcacatcggattttatatagggtatcgtatagggtgttcgggtactaataaaaaagctaattataaaatccgtcagtaaacaacgagacaaatttattaagcctaattaatctgtcattagtaaatgtttaatgtagcacaacattgtcaaattatggagcaattagatttaaaagattcgtatcgcaaattagttgcaatctgtataattagttattttttagcccacatttaatacttcatacagttcaaatgtttgatagaacaaggtgtaaagttttgagatgggatctaaacatggacttttagtgcttttcacaagtacgtattgctctggtcattaataaactacaatttttctcattttccgtgttcagcagcaggtgaaatagagaagatttgtctagttttctgcgctcatactttttaaactattaaaaggtgtgttttttaaaacaatttctataggaaagttattttaataaatcatattaatccatcttgaaaatttaaaatagttaatacctaattaattatgtgctaatggctcccttcgtatcttctcaatgtttactttttctctcctgtcaaacactcccggtatactatagtttagacatgaaattttggaaggtcacttatggtgtggtggtcactatggttcaaatgttggtgtacacaaatagtatgcatattatgcttttaacagaaaattaatttaatgaggttagagatttatcgagtatgtgttagaaagtgcattcgtgcgtatgtgaatgtggtttgtcttacgtgtaattaaaaaattaataggtttttctgaaattttaatctaatttggacattgagatctataagatttattagggtactgtccagatttattgcgctgtgatatgttctattcgatgtggaggtagacaggtagtatatgattttcaatttcccctattcaaacaggcttgcaaccactggggaacgatttttttttttgacaacaggcaaatgcattacccgggctttagaaaaagcccaagagacaagggaactgttcactttgatgtcaaaaaaaaaaccttaccaaattttggcattaccaaaattttggcatagttaccagaattttggcaggatttcttatatagttaccaaaatttgatagcaaactaaatgtagccacttttttttgacaactttcccaaaatttgataaggttgaaaatggcatcaaagtgaacaagcccaaggtctttacttgggaacgatttgtgcccagccggccgagaaatttgataactc

SEQ ID NO: 35268 - DNA, 1501 bp, Oryza sativa
atatcgcttttatgtctcagcttgtaagcacttctgaggatgccactctacttactgagagagggataattgttcatatgctggataatgacgatgaagtgtcagctatgttcaccaggctcagcacacatttgatatttggttctgatacctaccactaccttcaaactttatcctatgttttggaggaccattaccaaagcaggctgaacagatggatggcttggctctggcgtaatcacttcagcaatccatggttagcattaggtgtgttggctgcagtggtcgtcctactctgtaccattgttcagaccatattaacagtcctagcctacaggcaaccccattgatgatggcatttttattctctttctaagtgaacacattcctatttcttgttcaatttggtactggtatatatgttatctggtgagaatactactgacaggtatgtatccaattgaaatatgatgctagagtaaagtgcaactcaccttagatcatcccggtataaagtgaaacacgatgtaatttacctggtgcgaagtataatgtactagaaaaacagtaatttgcatggtcttcgattagtaatgtgaaacctatcctacttaacattcttttcaaataatgagaattccctttgcaattgcgtgacttgacaccattacatgtttgtatttagagttagaattataatgtgtgcaattactgtgtttgttgtttaaaataaaattgtacttctttcaacatttttgtatcaatcaataccactggaatctaggccactacaatcaacagtgtagaactaatttttgctcataaccttcgtaatttctaatccttgagagcaaacttgatgatttcttttaaccttttatgtactttagtttaatataacaaacataagaagtcttttaggaatatatagctctcttgtgcagcattgcaatagaaactactcacaattttacatgatggtatgcttgcatgtgtaatatttgtactaaatttactaccctccattgaaactaacatcattttctgggacttctattctacatattaagcaacaggacaaattatttatttagcaatagtgaactaaagggtttgttcagattgatgccatttcaaaccatatcatttttttggtagaattgccgaatatgcgcatccatttagtttttttttgtcaaactttgataaatacataagaaattctgccaaaattttggcaatttaaaaatttggtaagatttattttggctacaatctggacagcccctaagaatattgtgggggtccctttattttcccacgtgcatgctttaaatagaatctactagatatttgattccccctagttcgctatgctaagtgcatttgatcgaaactataccatgtgactagagttgggatcacattttacattactatataaataggcatgcgagctgcttatttcatcatctcgttttcacttccttgcagcgaaaga

SEQ ID NO: 35269 - DNA, 840 bp, Oryza sativa
tcttcccgatctctccccacagttgctgcaaccaaagccaagctccacactgtctgccagacagccaaaagcccaaaaccacacggcgtgcatacgtgtagctcgacgccggcgcggagaggccggcacgaacaaactaagaaacgcgcccgcaccataagctcggcgagcagggcgccgcagccgccggctgcctcgacgcgggacggcggacctgcacccgcacgcctcctcagtcctcttgctcggctcccgtggtggttagggttagatggggaggggaattggggaaaatgtcgaaatgggctgagatgcggcccaattagggtgcgggctgagaggaaagggggaggaaagcggaaaatttaggaccaatagagaagaaatggtaaaataaggcccaatataagcagtataaggtttcttttttaattttttttaatacatatacacactgtagggtatatatacctattttttgtccaaaaaacttaggtatacatctgaatacccttgaatacatactgggcccgcccttgatatacaggatgagaagaagatgaatttgatgggtttcgtcatgaaaacccaacaagaagtcgacgttggatagcatacatactttggatatgggccaaaacgtaagcacggactcatgcatcagaaacgaacaatatttgcaagcagacatcacatacgttatccagaattaaattaaatcaaattaaagctaggcatcgcttgcaatttgcatcatcatatcattatcatgtatcaccttttcctttctctttcagttcagtttgttcgtaatttcgttgtgtgccagctagccatcca

SEQ ID NO: 35270 - DNA, 226 bp, Oryza sativa
aattcctgcagcccttgagatatgccatcggtatctcaatgacatgcaggacccacatgagtcaatgacatgtgggtcaggatggcatatctcaaattttgcaaaattataatggcatggttccaaatttccctatatttatacccataggtgtcccattgtccaagtagaactagggaaaccaatatggatacaatccgagtagtccttgtcgtttccatgtaga

SEQ ID NO: 35271 - DNA, 1501 bp, Oryza sativa
cgaagataatcaaaatcaagaatccaactaattaatttattaaccaagaacacttctccactcatgcttaccatggcggcggtaatgtcgtcgtcgccgtacagcgccgccgtcgacggcgaagcggccggagcggcggcgaagaggcggcggtggttgcggctggtggcgtggcagacggagaggtggaggaggaagaagaggaggagacagaccatgcaagagcagcgcatgatctctcggcttctttttctctactccctttctgagtcctcgactcttttttctacaaggatttttgagggtttttttttgttctggtcttattttgatccgaggcgtggttggggttggaatgtgacgcggtttggagatttcgcataggtatttgtagtcgctcagggactcgtattgtcatacataaccaatcaatttatgccaggtgtctagttaatcaagctttgtgttttttttttacgcgaaagctttgtttattcaaagacaaccaagactatatattcatatatactcctatatttgcaatctcacaagtacacaaactagtacaactgttatggcctagatgaaaaaaagatgttcattagttttgaccaagtattataatttggctagagaacactactagaaaactcattttcggcatcgtaggggattgattttcgcaggcgggcatgtaatttggagccaaaaccccgccggcaaaaaaagtacctggggtggagggggcggtccgcctgtgaagattgatctttgcaggcgcctgcgaagatcgatcttcgcaggcgacgcttatatggcccgcctgcaaagatacccctatatagtctttttcctccccgagccctgttcattctccccgacgtttctctctcctaaagtgacttaaatataggggggaggttttgaacttcaaatcttcgggggaattttctacggtacttagatctactcatttccacactaggtatgcaattttttaagcttttagaccttaatttgtgatggatttatgcatccaaaattgtgaaggaagagctccatgttttttaattttatttcttttcatatgttgatgttagatgtatgtgtaatacttgatgcctcttgttgtagtggtttaatatggtaacataaattctcttttttttatttttgatatcacatccaccacctagttctagatctagatctagatcttgtcatatatagagagagaataaaattttaaatgtctatttattcggtgcaatcaaaaaatagttatagtattttgaatatgccgatgatatgatttttttagattttcctaatgtactaatttggcatgtctgtgtaaaaaaaattgaaataaactttgattttttattactttacacttaacctttagttaattagttttgaatagcgataagttttttcaataaaccctacaaatttggtattaattgtgcaaatatttgacgtatattttttttagaga

SEQ ID NO: 35272 - DNA, 1501 bp, Oryza sativa
gagtaaagattgtgtgcataccctctcagctgagaggatttgctttcgctccactggttcagggagttgctcttgatcatcgtttttcttctttggtgctttaaactctgcaaccatcttcataccatcaacagtgatatttggctgctgagcaccacagccaccccttttctttactggctcatcagtatcttgctgctcctgaacatcgaggtcatcaccccccgcgcaaacttttttgctcttgcaagcatcatatattcttttcagtctattttttgggttccttattttaagagcctgcttgaacttggtatcatcctgcaacaaaagcattcacccattgataaataaactcagagttgagaaaagatggaaaacgtaagagctagatccggtacaaagataaaataagatttacgtttgcatgtatagtccgaataaacattttatatcaatatgattccagtttagcatgtccagcattgaaaacaaaggcatcttccggtttttgccttaacagtaaaaaagaggacaacagaaggggaaaagtaagtcgcaaaaaaaaattgtattttcacatgttaaacgagtgtaacataaaaggatattaccagatttagtttgcaaacacaaaacatgcaaaacataacagagttaaaaatggcaaattacaagtatagctgtgtttccatgaatagtcaggaatcagaataaatagggttcagttccagtttagcatgtgtagcataaaatcaatggtgcctcctttgttaagatatttttcatataacaaagtcctgcaaaacagccaaacccgagaagtggggtccatgtacctcatccgcaaggatcttggaacaattgaagcagacgcaacgcattatggagagtacagtcttgatgaagccgatatggaacattggcttagcaagctcaaggtggccaaagtggcctgggcactccgccatcccagccatgcatgtctcacatttgatcttctggtcaatagtccccaaccgagggtcactcaagccaccaggcttgggcttccccctttccatggtttctgcatgctctatctgcaccactgacatttgcctctacaaagatgcaaagcaacacagaaaccacatcaaataccatcctaaaaattatgtttttttacacactccacatgcaacggtaatcttgtaattgagcacttatcacattgctgaagcagaaccattaaacctgatgactcaatactatcaaatccatctagtccatgttattatcaacacaataactaaacctcgggcgtactgaaaaatttaaacttcattgtaaagatcagagcttcccaactcaacaggtacacggaaccgcacaacaatgactctgcaaagtacaaattcgattcgatgcctcacaacttatgacaacagtacatgttccaccgattgcttgcattataagtacactgctagcaggttcaatcctaattgcttcactacac

SEQ ID NO: 35273 - DNA, 657 bp, Oryza sativa
ccgcaaggatcttggaacaattgaagcagacgcaacgcattatggagagtacagtcttgatgaagccgatatggaacattggcttagcaagctcaaggcggccaaagtggcctgggcactccgccatcccagccatgcatgtctcacatttgatcttctggtcaatagtccccaaccgagggtcactcaagccaccaggcttgggcttccccctttccatggtttctgcatgctctatctgcaccactgacatttgcctctacaaagatgcaaagcaacacagaaaccacatcaaataccatcctaaaaattatgtttttttacacactccacatgcaacggtaatcttgtaattgagcacttatcacattgccgaagcagaaccattaaacctgatgactcaatactatcaaatccatctagtccatgttactatcaacacaataactaaacctcaggcgtactgaaaaatttaaacttcattgtaaagatcagagcttcccaactcaacaggtacacggcaccgcacaacaatgactctgcaaagtacaaattcaattcgatgcctcacaacttatgacaacagtacatgttccaccgattgcttgcattataagtacactgctagcaagttccatcctaattgcgtcactatac

SEQ ID NO: 35274 - DNA, 450 bp, Oryza sativa
tgagtttgggtggatgggtgaacttgctagcttaagattgctgttgggcgagtttggtatcacaagttccaattgaacattacaaggagctcgaaatgtttgaaattcggatcagtctttggttgagtcggtacttggatgtttcaaggggaatgaggttatcacttgtagcgtatgaacaaccacgtgtaacttaaaattttgtgcactacaattacaaggaaacggtgttctgtttttgttgtaacttgtaatataaggtgtatagtgacgcaattaggatggaacttgctagcagtgtacttataatgcaagcaatcggtggaacatgtactgttgtcataagttgtgaggcatcgaattgaatttgtactttgcagagtcattgttgtgcggtgccgtgtacctgttgagttgggaagctctgatctttacaatgaagtttaaatt

SEQ ID NO: 35275 - DNA, 1501 bp, Oryza sativa
gagaaaatagtcatgactgggcccaataattttgtctggccgacgcgccctgcaccgtgcagctcacgaacctgctaaatcaaccacagcttttgctgcatgcgacgtcgctgagatgatcaaaatatctttctatatctgccattttctctgtattgtcgaactgctgatgaactatggtcggaacgcttaaataaaaagcaaaggaagagtgagagagacacaaaattcttgttttacgatcttatcaccactcgtttactatgtttccgtttaattaaatgtggtattgcgatggatgataaaactagttataacccaacgatgcctcctggatgatccatgtaatggaccgaatggtagccatccaatgcagaaaaaactggcaaaatagagttgaacaatcgtagattcgtagtcaaactggtgattgaaccgtttttacggtagcgctaaatcgctaatcgcgcagtgctacgctcgattagtagcgcgcctcatggagcccggtttctcgttttttttctgttttccaacacgcacaacaccgttttattatttttccgccgcactccactcttcttcacataataacagagtaaaacaattgctccaatcccctctagcactctccaacaccgttaggctgtgttcttttatccatttcctaacttcttcttcctcatttttcgcatgcgtgctttttaaataattgaacgatatgtttttttaaaaaaaaactatagaaaacttgttttaaaaataatactaacatatttttcaagttattttagtttatgtgtaattaattatacactaatccccagaggtatgggttgggaatcacccataccccaacccatacctctcaacaccaaaatccccatttcgcgcataggaatgtgtcacgctcaccatgcgaccagccacgtggcacgctgggagaggcgagtgggtcggcgtgcacgtgggcgaggggagatggaacgacacatttttttatacattgtatatgtatatatttttatacgtaaaaaattatgtatgtatataaaatatatatacacttcacatacatacatacgtatatattttgtatacgcgtatgtaaaatttatacctatgaatataaaatatatacatatgtacagtaccagagaggggatgcgcgggggaggggtgtttgcgcaggcacacattagagcaggtacaatagcaagttataagccagttataaccacatatcgagaagaaaagataaaagagagagaagaaagcggctacagatttgtagccggctgcaacacggactccaaaacattatgtgtgtatgataggtgggaccggtattaatggtgtagtatatttttatagttaacaattatatgaatgtgctattagattaattatagatgatttggagtcattaattggctatagtattatacttgctcttagccccctctccccagtccccacaccccacagccttattaattat

SEQ ID NO: 35276 - DNA, 519 bp, Oryza sativa
cttgagttttcgaagtcacccttcacatgaccctcggtttcgattaaaggtggctcccattaaaagattattaggccataaatcggaccctcatatcaactccagaactcatcgggttagttctcttagacggaatctattaagtaaagtccgctcattccgcgtaattttgatttttttggtttgtatcctttcctatgccttaaattatgcattttgtgcaaaaaaaaagtttatataccaaaaaacgatgcattatcctcgcaaaaaaaatgatgcattatagtaattctttcgaaatattttttgcaaagtacttttctcaactttatagtagttattgattcatttatacctcaggttgctataaaagaaacagattattgcatcaatttcagctatctcagacgcggccgatatcttccatgtaaattcactgtgaaactcgtgcattccatctgaaaacttacccttcattcctctttccccagtccccttctttcctcgcctcccctgagt

SEQ ID NO: 35277 - DNA, 1184 bp, Oryza sativa
ttcttgttccagatttgatctgatcctaaaataggttactttgctttccgctctatcggaaaacgttctaacgtattgattccgtaattctatttcaaaaaagagtgagactcaatctccttatgccatcccacgctaccgaagtagactcgctccgtctatgtgtcctgaacccgaagatagagaccccagctagacctatttagtttagttgcctcgggtgagctgaactaccagaactagttctttacaactcgtgccccggagccctctatctagaatagctctctctagatttcccagaaatgttaccagaataagttacaactgactatatcttcttttcccagcgacgcgccctcccactaagctctcaaccaatccaaggttaagaaaagaaagaaccaatggaatagttgcgaatagatcagtcaaacctcatcaagtccaggttttgtaggcaggtatccggataggtttatggttggaagagatagacacgaacggatagccttgtatgtatcggtatgaacagtgttcaggtttaggaagagtaatttgaacagaagggctagctgtgcttattctgacaaggctgaacatgagttgctctcaaaggacttgacttctgaaatctctattctacgtttttcaactaatccacacgagaaaatcctatctttcaagctttctctcactaacttcgccaattgtccttcgctccagatggtcaatgtcttcagactagccatcagcccttggcttctgtacccttcaaacgcaaataaataaaaataaagaatttcagcacgcgcatccgttttcttgctcgaaaaaatgattcaatctgactttatcggtattctggattgagtaaaaaagggatatatgaagttcaaggccttgccaaaaccgtcatggccctattatgtataggccgtactaagccaatagtgaataacaaactctttcctgctccctcgaccctaattaactcccatcctgccaagcctcagctgccagcgcattgtatctaagcacactgcggcaaattgatacaagtagctaaagatctcgcatccgacatccccggccgaacggttaggcaacactagggcgcctgggtcccaattccgtttaccaaacaagatgtcgagaggcgaactctgtaattcccccccagc

SEQ ID NO: 35278 - DNA, 246 bp, Oryza sativa
gtatagctttccgaaactagaatatgagttaatatagaaatagaataataagatttcatatagccgtttattagtaaggataggtttggtaagtagtagttcttggcattagtaagctagcttcactagactatctatgacaggaaatccggtaaatgcacaatatcttttcaatgaagaaagattcataggaaatgacaatagaaagagtactattcttcagttactcttttttcttgtcttaga

SEQ ID NO: 35279 - DNA, 206 bp, Oryza sativa
agtttcgctatttaaatttgtttgtactaattaatttagcataacagtaagtactagttaaatttggaaatctcagagaatttaaatttgttcatacgacatattgttaatatacaatttatttttgtactaattagtttgtactaatttgagtaatttaaaatgtggacgataacacttttttttacattagaggtttgaaacga

SEQ ID NO: 35280 - DNA, 538 bp, Oryza sativa
atctttccacagtgattcatagactgaactttgatacgcaccagtatttactgaatttttcacagatatactgaatttttctatgggaggctttgtactgagctttgttatacgacagcatatagtatgtactgaattttgtatgtggtacatactgaacttttctagaagatagcatatactgcatttttccacatatatacagaggcttttccatagtggtttacatactggaccttgttacgaagaagtatatactgcacttttacatagagaggtatatgctgattttttacatacagtaatattctctaaactttgcatatactgacttttctttcagtgcacatgattttttttaattaagagggtacacataggtagaatttgctacgcagtattttgtacttcatctttccatacatatatgagtgtatgctgttttttttaaaaaaatagaagtatatgttgaatttttaaatacactggtccatgtagtattgtctatttatgaaatgaaaaactaattatctgcagg

SEQ ID NO: 35281 - DNA, 610 bp, Oryza sativa
acacacagctgctagcaaactagagtactcgcaacaacgaactaatcacatagtacacgccgtatgcatgtatccggcgcctaaactaattataagtgatttctcgcgctttgttatgaaaattaataagtaattttcaacattattttccgttacaattgagctagaaaaattaaatgaataaaaacaatcaaatcatagggcttattagaatttatcatgaaacatacaaacgaaatttgcactttaatatattgataagtatatattaaatatataaacatgatagagagatttgtaaaactactgtggaaataacatgaggtgatgattggatatgcttacatgttaatttgtagaattaaatagattgtacatgatgttacatgcttgtatgatgttaaatatgtaattattgctagtgggtgatgagatgacacgtttgtttgtatgttaagtttgagagttaattaatgagttaaaactttatagagagtatagattacactcgatcggcgccgctaacacgtagcataacacgcagacggcaagaaacgtcgacgtagtgtactagtgtactagttttccccaaccgcgcacgtaccatgca

SEQ ID NO: 35282 - DNA, 1167 bp, Oryza sativa
tcgcttgggaggggagggagcgatcacccgcccattaggagtacccgatctgatgcgtatattagagttctgtgacgctaatgcatactcctcggtcctaaaataaaccaatttttaagatttaaaattattttaaaataaatcaatttatacctttttacctaccattggttggcaaatcaagaattgtcttttcaatgcccctcaccaaccccctcatcaatataagtttactattaattaagggcattttggtcatttgtctctttttttttcttgtatctatcttgggaagtttgtgggagtatgcaaggatattattttaacttaatcaaatgaccacgtgctctagtattttaaataattactcgtagtaatatctgcggccattattaatttgttggagctgtggaaagggacgaaattgcaacatctagcgtgaagcaaacgagtagcaaagcataatagttgttggcattatattgagcacatgacccttggctgccaaattcaatttataattctactatagcaattgattaacacgctaaataagcaagtactactactacaacaatcctaaaatataacctctctttatgttttctatctagctatataaaaacattgattcttctaatttcttttaatatataattattgttgatactgaataattgaattagccatttccaaacagatgctactctttcataaaatacactcccttccttctaaacagattatgacggatccttgtgataattttgaacggagaaatatataagatacaaattagtactacgaatgtagacataccccttataaatatcagtttatccagattcatgtagataggtgatgcctaatccaatattgtttgctataatataatattatgatactaccgaggaagtactgttttggcccgtttccttccgttttcatgctggtctcgagtgagagtcggtcggtcagaattcacactctgaaacacacgccggtcgccgtcgtcaacgttggtcttgggcacctcgcgtttcacacttttcttctgtaccatttcgccgagctttaccccgcggctcgtatataaatcctctcgatctgacgcggattctgctcattccaaatcgaatccaccaacatcccccccccccccggcat

SEQ ID NO: 35283 - DNA, 1501 bp, Oryza sativa
accgccggcggacggaggggcggccgtggcagcagtggtggatggcaacagcggtgggtggtggattgtggatggcgacagcggtgggtggcggattgtggatgcaggcggtggtggatggcggcgaatatggaggcagcagcggcggcgcatcacgcgtcggcgccacaacggggagatggcggcggcagatggtgcggcggcggcggaggaagggcggtgccccccctcggcgctccctcggcggcgtcggtggcgcccaacggcggcgtcgatagcggcgaactggcggcggtgggcggcgaaaagggcggcggcgacgaaatcgtgggggcggttagggttaaccctaatccccccgacggctcccccctgcctttttgctgcgggccggatgggccgacccaccacccccccttgcctgccggcctagtgccacacggtggtgggccgaatcctttagattttgtcccaccacccaatttaccatttaattttaatttttaattttatttgcagcagcaattacattttagtccctatgttttatggaatttagtcgaagcagttcatcagttgtacaaacaattatgtaatggtcctatagaccactgatgttatgtgtttattaacataggtgtttatttaaataccatgtttcactaaatttattgttgtcttaataacatgccttttgcatattatttcaagacacgctctactttctcgctttattaatctacaaaattctataaattttgtactttgatttggcaaattctcttaattatgtacaacatgattaatggaggatttaatgcatgttccacttcacactttgacttggaaattaatcacatatcgatggagtcctatactttggttatattgaccataacttgggcagcgagtatctcgcccatcatcaagtggtctacaatttgagatgattacccgatggagtcctacaaattggccgcactggtcataacctaggaagcgaacaactcgcccatctcacagaggtctacatctcacgatgattacccacatgtgttattttccgagaatatgttttgaaaaatgagattatttgaaatttggttgagcacaaggtagtggagtcctaaacattggctgcggtatattcactagaatatatttgcctggagaccgtgtattaggcagcaagtataacttgcccactattaagagatctactccactgtttaattacttggagattatccacattgtgccacctaatttcgaattctaactaaattgtcaggtctattacctgcattttttcaaaacattacaaaatatgaagtattacatttcgcattgagattacaaccttaatatcatgtttttattaatttacctctataaattgataatgttaaccatgattgtagggacatggcaccaaaaaagttcgacgaactcgccctcgatgggactaactatcccatccgggcttctaatatcaaaatca

SEQ ID NO: 35284 - DNA, 244 bp, Oryza sativa
aaaaagaaaaagaagaaaagattttccagggatttaatattgcactttgcttattttaattggttaaaattatttccaaggctctgaaaattccactaaaaatcctgttagcatattttgacatgtagaatccaagagaaattctacatgtcgattccgattattatttgcatttattacttagggattcatctctaggttaaattaaacaatttcttcgaatgatttattttatgaatttaga

SEQ ID NO: 35285 - DNA, 153 bp, Oryza sativa
  unsure (1)..(153): unsure at all n locations
tcaccgagaagtcgttggtggtggtggtaatggtgtagaacggcaccggctgcnacggccggcggttcgagaggcagaaggtggcctgcgcaaccacgggctcggcggtggtggcggactcgtcgccgttgtcgagcgagaggtgaaagnaga

SEQ ID NO: 35286 - DNA, 1501 bp, Oryza sativa
gttgtcaacctccacatgttgaccaaccgatcacatgtataaaaggatatgaataaataatgagtattaatcaacaccaaaagtgtcatatactcaaatatatattcaaatgtaaagatcccaattaaatgaaggtgaataacttggatcgattacatgcataactaaagtataggatttgctccccctaaatatatgcatacaaaatatttgtgtgaagcaagagtatgcataacaagatattaaacattgagagcttatcctatacaagaatagaaggcatttatcaaatatagccaataaaataaaaacataccttcaccatctccatgttctcaatgtaaagagactaaacaagatatggctcaaacaaaacattagtctcacatgcttatgtaatcacatgaaaatattatatatgaatatatcaatatgtgcatggatagaaagagtgatacatatagcttgatctccatgcatttcatccttgtgatttaggtacaccatcaatgaacgtttctctcttaactcatatgaagtccagaaatcacctctcacatattccactttcatatccatatgagactagtagacaaagaaatgcttataacaatgttagtctcatgtaattggatttgtcattaatcatcaaaaccaaattaatggcacttgaactttcagtgtcgatagaagacacatgtgagactatctagtagatgcgtcaatcaaaaccataatgtacctgaacggtccagatcttggcacaatagggccacagatatctccttgaatgcgttcaaggaatttaagtggttcggctctaattttgagataagatggtctcaaaatcagtttcccagtagcacatgcagtgcatacgaaatcagaggatttgggaaatttgtcagtgatcaaatgatgaccaatagagttgccaataatttttctcatcatcccgataccggggtgcccaagtcgatcatgccacgtgtggaatgcatcaacattttgaaaaattactttgtacgcaacatgtgcaatgggcttaatgtatgcatagtacaatcccgatgtgagtgatggaattttctcgcaaatgcgtttgccatatccgttttgtttggttaagagaagaaattcttctcgattatccatatgggtttcaatgtgaaacccattttgacggatatctctataacttagtagggtacgggttgaatcaggatacaataaagcatcctcgattgtaatttgtgtacccattgggagtgtaataattgctcgtcctgagccaactatcacagtatcgtgcccagcaatagtcaaaactttgccttctctatttttgagagtttgaaagtatttgatctccctaagtatagagtttgtggtaccactgtccacaagacataattcctctccaatcggagtgatatccttagacatctataatgaaagaagaattgcttgattaagaattctttatccaatatatatacat

SEQ ID NO: 35287 - DNA, 252 bp, Oryza sativa
ctctctatatatgttttattgtgcttcagtgtttggagagattaaagatacgtcttagagaaagcacttggtagtctaaatagtacacttaatggatatgaagataaaatgttctgcaaaagttgacactatatatattttttaattcaaatatggggggcaaaattcatccttgggcaaaatactactccctccgtttcaagttataagatgttttgactttggtcaaagtcaaactgcttttagtatagg

SEQ ID NO: 35288 - DNA, 291 bp, Oryza sativa
ttgatttgatggaaaataataaataataactaacaagtttggtactagctgaaataaccaatttatggaagaacaacgtagtcttgcaccccaaatttccccaagctaacatatttgtacccactgtattattcagcaaaagatgtctaacttctactgataacagaaggatgtaaataaattgcttttgtaggtagagcaatgaatccaaattattttccatggccaaaatagtgggaacatatttgataattacaagataattgaaactcttttctaatctttttggca

SEQ ID NO: 35289 - DNA, 1501 bp, Oryza sativa
cgtcggacgcctcctgggcaatgccctccttcaacgaagccgccgtctggtggtccgcgagcggcccgatgatgtcagtcatggggagagcctgcacaacatgaagtcacgatgcgatctaaagagttaaagggtaaagggtcatcgattacactcacgttgattgcggcttcgcgctcagccgcctctttctcgcaaagagggatgggggcgttgctcaccgtcgtgggaccactgatcatcacctgggcaacacggcgctccacggttgcgctgttcaaacctgtagttcgagaaccaaatttcgataagtcaggaggaatgcgcatgaaaggagagaaacccagaatacaagaaaaataccctgaggagaaacccgggtcgtgtcctccggcccagagtagtcaaaggctggatgggctcgagcctggagcagctggatccgtctaccaatgaagtcggcagcgacttcatactccaacaaccctcgtactcggaggtcatcgatgatgtcaatgaaagactggagggatagggtcaaggcgggtttggcggtccaagacggaatcttgtctggttgctcctcagaaccacctcgcccgccatttgctacgagaagaggggcactagaaagggatatatcgtgacttcaggccatcttgaagtcaaaaaccaacacacccggatacctttttaggttccatccagcgcaactcgtagtaaaaacggaggaggtcaagaaacggctctaccccaatgtaggcctcacatagatgataaaaaatgctaaggaaggctatggagatggggttcagatggagcagagaaagaccgtagaagttcaagacgagaaggaaaaactcagaaggcggaggaagaaagccacagagaatataatcctcaaccgcaaccatgcggcccaggacgggtttaggttcagtacctcccggttccctctccatggtcccgcgaccggggagagcgccctcctcctgcaacttcttcaaagacgcgctggtggaagtggacttgtcaaggttcatcgccgttggagatcaccggagaagaaaccgaggcgagcgaattagggtttgcgtggaagcggagaagacgaagagcgttcggaggctagaatgttcttgcaacagccggactccaaaatggattcccaaaactcctttgaataggcgcactaccgacggtgcgaattccaaggaaaggagagagatggccgccggaaatttctgggtccgttgcgcgaggcggttttttggacttcaatttaaattcactcataacagttgaacttcgcatggtgttgtcgaccactccttgtctctacagtcctcacaccgagatcgaccagtcgagaacgacagcaactccgacatcagaagtcgcgaccgattacataagttcatttaagctcaagtcgggggctactgtcagggttacggataaggtataccctctacccttggatgtacgctatacggcaata

SEQ ID NO: 35290 - DNA, 1501 bp, Oryza sativa
atattatgcatctaacagactccctccatcccaaaatatagcaatgtccagattcgttgtactaggatatgtcccatccagtcctaagtcgctatattttgggacggagggagtacttggtttcaaacaattctagatatcaccaaactgtcatgtttgacaatttaaaactaaattgtcagacatttaaaatgtataagcaccactgaactgaggagataagtttgtaactggctctcttcctgatattggaatggattagcttcagtaatggtcaatgttgaattatgcaacttaatagtagctccagaggaaacttgtaaggctatgttcagcataaggagaacgggaacttgtctactttgcctacatacaaagtctaactcacagtacaaagcacattttctgagcacatcaaaccatatagccttaacaaaagaaggctttagcttccataatgcaagcctctagggacatattgtttacactatgctaaggttcctcaggttacttgtagataacatggacagcaaatagaaatatcgataccatcgtgaagtccaccagcacaccctcctataactaagtttaattcacggtagtttccagatgaacaaaatccacgaccagtccacagtcacacatgctcagccccatctttttgcttatgcttatgcttatgcttatcggccaaaatttgaattttcaactttaaatttgaagttgattttgaggtttttttcatcgaagtttatttttcagactttgcttttaggtcgctaagagtacgtatataaaagttttattcacaaattattttccatttgtaaatatgccgtttggcttattcctagaataagccaaccgacggagccggatattggtccaggaattaaacagatgcatttctacaagtacacgtctggagctcgatgttacataaaaacgtaaattttctgctggaatcaacaaatttgaaacttatggttaagagcacgtgatttgtaaatgacatgaattgattgaattaatctccgtgcgagagatatacctgcagctcatcgacgaggcgctcgctctcttcgattagcgcgaagtgctgcttccacctctcccagctccacttcccctcttcctcctccacctcgcccctaacctgctcttcgcgacgactctcaaccctcttcccgagcccagcatccttcccggcaggcgccaagggccagtggctgccgacgtactcgctccaccgccgcacggcgccctggaacgcgtcgtggaacagcgcgtcccagcccctccgccgatcgccgctgccggcgtccgcgtcgtcggggctccgcacgccgctttcaccgccgtcgaaccgcaccacggacgaaacgcggcggcgtggtgccggtgcgggcgcggcgcccgcaagccggcgcacgcgcagccgctccccgcgccgcgccgcgaggaacaacctgctgccgctgtcgctgctagggttcgggct

SEQ ID NO: 35291 - DNA, 1501 bp, Oryza sativa
tattttttatatatagtatttctatacatctaaagtttataagtcaaaagtttacatacccgattcaaatttgaatttgaattcatatattttttatatatagtatttctatacatctaaagtttatacacctaaagtttatagacccaaagtttataagtcaaaagtttacatacctgattcaaatttgaatttgaattcaaatatgagtttatagacccaaagtttataagtcaaaagtttacatacccgtttcaaattttaatttaaattcaaatattttttatatatagtatttctatacataaatttttctaactttattttttattatttttttaaaaaaatttatggtgtagtaggaatagaagaaggagaggaggaaaaggggaaagagagcgtaagggggatggggatcgatcgcctattagccacaccctgctaaaatgcaccaataagtgtgtaggttagttttttttaacagtatgttagtatttgaactatgataaaaatagagttatgcaaattaaattttggttgtttggattgaagctaattttatcaaatgagaatgttggcaactttaatagaaccacttagatgattgatttactaccactttttatccccattggttatctattaaccgattggttaagttgaatcataccacgtttggaagtgttaacacttgcggttttggccctaccaaagttttatagggtggaaaattgatatggattttttactttttatcttcttagaaaacttattctaaaactagacaaaaaaaacttattatagaaatgatctttttcatggcgccaatatcattgacgcgtggtccaacatgacggcgtcatcccctagccccgatgaaagctaagtcaactaatttgaaggggaggacatatttgcattttttgaaaaaggtcatatttgtaataaaaaatatttacaaataagtcctcggcgacaatgtcattggcacacaaatagatcctcagcgcaaggatattaacgtcgttcctcttcatgttagtgacttagctttcacccaggggcgagggaaataacgccaacgccattggtgttgtcacgttgcactgctcaacgttgatgcccatttattaagcatttgtcaagttgattcgtaccatccatgaaaggtcgtgtgtttcgcgaacgatgaaaggttgtgttgtttagcaagaatcatcttgcttatgttgcttgtgaatgtccattgcgattgaaatacgacgaaagatgagttggttggttttacttcatttgtttcacactgtgcgctgaatatatgtggaacagagtgagtaaacatggatacatcacgatgataaaattgataatgataacatcaaagagatggataaaggttgtctcatgattgttcaatctcgaagagagctttaagccatgtgatcgacattcgtcaggtcaagtgatggagtgctcgagaggattcagggaagcaaaagct

SEQ ID NO: 35292 - DNA, 1038 bp, Oryza sativa
catacggagtgacttgctctccccgtactgaaaacaactctcagattttggaaacaaaaagaacatcacgatgctaagcattcttctgttgtcgttctcagttactgtgacttgccccataccatccctctattttcttatcagtcgctattgcaaaaattcaaccagaagcgatgtacatatggaatacttaattagcctcgttaaaaatttaaattgtgtcgaaatattattagctaggtaatgccagtgaaattgcaatactgtttttttaggttctgaaaattaaaactgtttttttactcagtactacaagatttttagataatggattaatactacaaggatgctttattctttgagaggaaatgctacaataattaagatgctactgatcgatgactaatctatttagtgatgcccagcagctagcatgaacggcatcgatctgcagatccaggggagggagtgcagattcagagaacagcacagggccggccagaaaaccacacacatatagtacagagtacagacaaatccagcggccaaaatgcaagtacgaaccaaataaaaagaagcacgcacacacacgcacacacaggctgcagctagtagcttctcctcagtcgtcctcgcaccgcaacacatgctcaagactattagtcgatttatgctcgcaagtcatcacaacgtctctctcgctgtcgcacaattacaactctcgctttctccctccctgctgctggcctcagcctcgcctctctctcctcttactctcccagctccgcttccacctcccggcctcttgcggcggcctagctaagcaagctctcgctagcggcgcccggccattatatatagctcagctcgcctgcaactgccaatctcaggcatcaaatctagctataagctacgcacacctagcttgctcttctagctcaactaagctattagtactatataagctagctagatagctgcactgcaagtggttgtaatttgcaaccatgtcgagcagccggaggtcgcgctcacggc

SEQ ID NO: 35293 - DNA, 245 bp, Oryza sativa
tgtttaatactccaaattagcgtccaaacatccgatgtgacatgggctaaaaagttttagccccatctaaacacccccttagttcagtctcttacacgggataagatcctgtttttcatgtttctcttagcttatcagtctgcatagaaagacacttttataatatatatatgaacacgaataatgcaggcatgcagcaccagagatgaactgaggtgatttgtacatgagttactctgggtgtt

SEQ ID NO: 35294 - DNA, 1501 bp, Oryza sativa
agcgatgcagattctattacaatgatcatcaggatgtgatcatgcgagatgagctgctagatgcaagtgctactgatcgagtagcctgctggtactagcttactgttagtcacactactcatgtcggtgaaacggggcaaatgtgcagcagatgtaatagcggatggtagcagtcgtttttgatgtctttatcttcatgtgccttttagactgatcttgctgcagtattagttactacaggtgatgccaaatcaactgtttgatataccatgcatgcatgtacctgtgattcaataggagataccactatcctactggaaaagttcgcacgttatatcgatataaagtactgaatgcccatgtgaaattcttcagcattgcctttctgaattctctaaactgtcgaaggtagactggaggagaacgagactgataagtatgctaggatgcaaaatactaataactgaaacaacaatctgcatgatccattatcaactcatcgttagcaggtagactcactaataatgagagcatagtttcagtctttcagagacagctacaccaaagagaaaaacagaagaaacacacccatttggacatctctgaattcgtctgttcatctttaccaacttaccaaaacataatcaacgcatatatatctctctttgcatctgtactcatcgaatcttaaagatcagccaaacatatcgagtttcagtaaccaaagcagaaggaaacaacagctacaggacagtttctccaaacgaaccctattaatgcaacagcttcctgtttcagtctgtactctgtagcagatgtaaaaccgatgtaaccactcgaccgtacaaggcccagatacggtccacccccggcagttcaagtgggccccaaaatcctgactctctctctctcccagcccggcccaccagcacactaaatgcaagcccaggcagcacggccactggtccccaattaatgcgcacgcgcagatggtgggcccgcgtcatagtcaatgaccccaccggtcagcccgtggcgactcactgtacaccgcccacaggaacgggacccacctgtcggcgtgaaaggactcgtcgaaacggtgcagacggggagagccgagccagtaaaggcggctgggtcccaccgcgccatttcgaatttgcgagtagggtcacctcccaccgggtattgctccgccgtttacgctccgaaacgtttcgaatttccgaggtcgcgacgcggaaggtggatccgcggtgagagtcacgtgggtggtgaccggaatcggggtggtaaaaatccaaaagcgaacgcagcgcaacgcctagctcgtctttcgtctctgtgtgcgcgtgttgtttttttggcttctttttcgcttgccattcgcgtggaggcgtttcgaaaagtttgctcggctctccccgatcgagagagagagagagagagagagagagagagagagagagagcagcggaggagatggcggcggcggcgg

SEQ ID NO: 35295 - DNA, 690 bp, Oryza sativa
tcgacataaggattatatatcattaatatctacagccgatcaagtaggtttagttctttcttattcatgactgccgaccgatctacatatgacatcgactcaaagacaaatggtacgtcatcggcaactagccgattgactattgtttatggatttaaccgcggtttcttggtctttgtttcttgttgattataggatcaaatcaactggcatgctcacacacccaaaggcaagttttgaacctgcactggagtttaattagatcttccaggcctcgtgtttttacatcaataattatggatggaggaaatagacttttaaaagaatcaaagaatgaaatggtacttttatacttttggaaggagggactcgaaaccagccgtccactcctcctcggtcgacggtcggtctcggtccactcatccttggttggtctcgggcgcgcgcacggcgcaacccgaccggacacgggcgcgcacggtcgtgccggaccagacccagttctctccgctcgcgtagttgtatcctcttccccgacacaaggccctaattgatcgagcactcgcccggtcggcggtcgccccttcgtcttcccgccgccgccgccgcctaattttggaactcccccgacccgccatagaacgccgggtgctaagaccctaggcatcatggcgatgagctccgccacaa

SEQ ID NO: 35296 - DNA, 157 bp, Oryza sativa
tcttcgatgcagcaagcgtggcaatggagtcgttggtttgaagctgtcttgcgccgccgcatctgcctctcccgcatcgcaagccttgcccccactaccttggtgggcaaaggaattgaaagaggaagatgagaagttttttcctctcgtggatttg

SEQ ID NO: 35297 - DNA, 1501 bp, Oryza sativa
ggtctccaagtaggactcggagacatcggactctgcatgatacagtgacgacccagtcctatacgggtagggacctttccattggtggacttcgtgatggatttccttagcgtatacagtgaacgtctgtacacgcgcagatgtaccatattgccgtatagcgtacatccaagggtagagggtataccttatccgtaaccctgacagtagcccccgacttgagcttaaatgaacttatgtaatcggtcgcgacttctgatgtcggagttgctgtcgttctcgactggtcgatctcggtgtgaggactgtagagacaaggagtggtcgacaacaccatgcgaagttcaactgttatgagtgaatttaaattgaagtccaaaaaaccgcctcgcgcaacggacccagaaatttccggcggccatctctctcctttccttggaattcgcaccgtcggtagtgcgcctattcaaaggagttttgggaatccattttggagtccggctgttgcaagaacattctagcctccgaacgctcttcgtcttctccgcttccacgcaaaccctaattcgctcgcctcggtttcttctccggtgatctccaacggcgatgaaccttgacaagtccacttccaccagcgcgtctttgaagaagttgcaggaggagggcgctctccccggtcgcgggaccatggagagggaaccgggaggtactgaacctaaacccgtcctgggccgcatggttgcggttgaggattatattctctgtggctttcttcctccgccttctgagtttttccttctcgtcttgaacttctacggtctttctctgctccatctgaaccccatctccatagccttccttagcattttttatcatctatgtgaggcctacattggggtagagccgtttcttgacctcctccgtttttactacgagttgcgctggatggaacctaaaaaggtatccgggtgtgttggtttttgacttcaagatggcctgaagtcacgatatatccctttctagtgcccctcttctcgtagcaaatggcgggcgaggtggttctgaggagcaaccagacaagattccgtcttggaccgccaaacccgccttgaccctatccctccagtctttcattgacatcatcgatgacctccgagtacgagggttgttggagtatgaagtcgctgccgacttcattggtagacggatccagctgctccaggctcgagcccatccagcctttgactactctgggccggaggacacgacccgggtttctcctcagggtatttttcttgtattctgggtttctctcctttcatgcgcattcctcctgacttatcgaaatttggttctcgaactacaggtttgaacagcgcaaccgtggagcgccgtgttgcccaggtgatgatcagtggtcccacgacggtgagcaacgcccccatccctctttgcgagaaagaggcggctgagcgcgaagccgcaatcaacgtgagtgtaa

SEQ ID NO: 35298 - DNA, 1501 bp, Oryza sativa
gtcgatgttctgttctccgctatggcgggaggatccttcgacacagggtcgtttgaggttatagctacggcgttctcgtttccggtcattgatggaccagccgagattggtaccgtggtgtaaaccgggaaaacaatttcgctgacttgagtccacaccagcattgttgaagtagggactccttgaatggggccggtgttgacgccgttgtcgacaaagcttgatgtcatagtagtagaaccttgagcaccaagttcccgtacctggcgcgccactgtcgacaggggacacccgtagaccggatatagagggtattggggtacgctgctacaaggatctacgtagtacgacatcaaggaaacaggagacaaagattttactggttcaggccccttaataggtaatagccctaatccagtttatatgggattatatggagataaccacaaattacaaagggaataatagaactcgacgataccgacgagatcgtagtcgagttgattcaactagatcacctggcgacttcgctcctgtagactccggctccgtaggctgtggtcattgtgttggctatgagattcgatgccttaggccttctcggggggtcccttttatatcgcaggtcaggtagtccccaagtaggactcggagacatcggacccttcacgatacagtgacgacccagtcctatacgggtagggacatttccattggtggacttcgtgatggattttcgtagtgtatgcagagaacgtccgtacacgcgcagatgtaccatattgccatatagcgtacatccaagggtagagggtataccttatccgtaaccctgacaggaaggatgatatcaaactttaaaatctttaactataagtaagttataaaatatttctcttggaaatatagagacacaaatatagattagcattaaaaagtacttccacaaaataataataataataatagtaacaataataatataatagatgatagtgctcaaagttattatttaaataccgtatccttgtccaaaatgataagtgttattagaaccgaaggaagtagtagatgctactcccttctttctaaattgatcatcatataagtttatacaccaagttcgagaacaatttaaatcacatcaatcaagacaccatgcatacattctcctacaatgcatgcatcgattaaaatctcatgccaattacacctaagtatgcacatattctcccatactgcattaattgtattccgatgaaatccgtgtccatgcagttatataatgatcaatttgagaaattttgaattctattacatgatgatcaatttaggaaggagggagtaatacgttggttagatgaattgacttgcatcaagcagcactagaacggtaaccaccatctcaattgggcacgacgtccatcatagcctagaaatcacaaatataacttcccgcctctcccaggctggaccagtcttttctacacactttgtcttc

SEQ ID NO: 35299 - DNA, 1501 bp, Oryza sativa
ggatgtaaacgcgtgccataattttcgtggcctcgctccttcaatctcgcgactcgtatggcgcttcgtgatttatctggcaggtgcgatagactcatcgaccccatagagtgtcggcgtgcagcccaatggtccaagcagccatacaagcatgtaagccccaatgaaaattttgacagtgcaaggccctttttttttccctttggctatagcagtaattttatacatcagggaaggagatgcatttgtgaaatttctgaacataataagcaagctttcaacagttgattctctatcatcacatgcttaaccttcttctgaaatgcatatggatttcccactctgctaataagaagcagcaaattcacttaggttgtgtttagatccagcggtaaaattttttaccgtgtcacatcggatatacggacacacatttgaagtattaaacgtagtctaacaactaaacaaattacagaatctgcttgtaaactgcgaaacgaatttattaaacctaattaatccatcattagcaaatgtttactgtaacaccacattgccaaatcatggagcaattaggtttaaaagattcgtcttgcattttacacgcaatctgtgtaattagtttttatttttgtctatatttaatacttcatgcatgtgtccaaacattcgatgtgagtgtgaaaaaacttgccagggaatctaaacagggccttatactccatccatcccatttgaagtgcagccatgattttccgtgctcaactttgatcgtctgtcttatttgaaaaaaattaaaaacataagtcacacatatagtgctattcatgttttatcatctcataaaaacaaaaatactaagtataaaaaaaattccaataagatggatgatcaaatttgggcaaaaaaaactcatggttgcacttacaattggacgaggggaatatcacaacataatagtgtttaagaatttcatttgaagtcctcctgacctgaatgtcaaagcatgctgcctttgtaaaaaaaacacaagatttgaagggattgtgagcgtgttggatattaaacacgggacctgggggttgagaccatatacctcctatgaccgcatatcaagtgtatctcctatgttgcctttgtgacaatttcagtgtgtcctaatcagtaaataaggaaaaacatttgtcagttgattgtttgacatgtttacataataaagttgtttcttcagtagcttagaatttaaccgaccaactttattctgttcactttgacaatagagatacataagatagccggataggtgatgatggatcatataatacttgaaattaacaatcaagacacacattacttggcaattgatttggtagcatagaaataccacaggttggaaaatgtatattatatgttcctttcaagaaacagaatgtatcaatgctatcttatttcctgataacttggtttcacagtatagaatgaattctaaaacgtttagata

SEQ ID NO: 35300 - DNA, 1501 bp, Oryza sativa
cggtctttcactacctaggaccgaattgatgactgaatttttcggtctcggtttcgatctttttggttcggtttttttctgtccatcctagcttttagtttgaccaagtttgtagaaaaaaatattttcaaatcaagacaaacttattatgaaaatatattgaattatttatttaatgaaactaatttagtagtataaatattactatatttgtctataaacttagtcaaacttaaaacagtttgacttcgattgtcttataacttgaaacgaagggagtctggatttttcacattttggtccttttgaaaaacttattttgcaaatagacccctgaaaaaacttatcccagaaatggtcctttttggggcgccagagtggctggcgccatcgtccaacggcgccaacctctttggcgccgtccccctgccgacgtggcggggcgatgctgaggtgactagggggagcgcgccagagtggctggcgccccccccccccgaaattttttatttttcttttatttttttgatattttttttcacgcttagggaacataagaaccaaccatagaaaaaataaactcaaatggacgtaatatgtgacctgtagaattttttctctcctctcctctctctccgaactagtgcagagagatatgtgcaacttttttatttttattttatttttttgatatttttttcacacttaggaactcacaagaaccaaccatataaaaaataaactcaaacagacgaaatatgtggcctgtggaatttttcaaagctctaccgaaaaacttctcttctcgaaaacacaatcttgcaagtggaatttggaggttgtaatatcgctgaacccggcaaagcggggagaatcgggtgtaactttttctgtagatatccgtggatatattatttgcctgattccgagtccgtatgagaaagttacgcctatttcaataaatggcatattttgtctgtttcggtagagttttggaaaattctacgagtcacatattttgtccgtttgagtttattttttatatggttggttcctatgttctcctaagtgtgaaaaaatatcaaaaaaatgaaataaaaataaaaaattgcatctctctatactgtttaacttatggctatcatttcatgtggttatattttgaattagattaagtaatttcatatagtctaatttactaaaggatctctcctatgtttaacatgctgatcaaagggttttactaaaggagttatggtctaattttactgaaggtgcaaagtagactaattaagcggtatgttagctattttcagacttagctaagtggtagttcgagtttaaattttttttgtggttggctgtatcgtgatcctaagtgtgaaaaaacatccgaaaaaataaaaaaaatgacaccgttgcaactccatacagagaaacatgaatggaggtgaggggtggggaggggggcgacgccagccatgctggcgccctcctccct

SEQ ID NO: 35301 - DNA, 1501 bp, Oryza sativa
gcaggcacgagcagcagccgcctgcgccgccctcctcctgcccgccgccgccgccgccgccgtactcgttgtctccccgacgtcgcccaccatgacgatcctcgtcagcgcgcatcgcggcgtcccgaccgcgccgcgccgcgcaccacgcggtgtggtgatcgcgatcaccgccgccgccgcccggcgcgccgcggcggcatcatccgacgccgcggcagcatgccaccaaactaactgtgtaacgtacactcgcgatcccggcgatcctccggccggcggcagatcgatcgatcgatcgaggaaggaatggatttctctgggaggcgctcgcgcgcggcgtcgcttgatttgggcgtcgcgcgtcacgaccggcgactcgtggaggcgaccgtctcggcacgtcgaggagcagaggtatacaagctagtactagcagttttcaatacgataatttaaggcgagaaagcgaaggttttttctgggtttttggaggaggagaagactaaacaaatttaaatcttccttttttttaaaggctaaacaaattagaatcgcgggagactctgaccaactttgaagccaccgcgtgctactggcgccagtgaggagggggatatgcgatatgcgcgctagcttgcaacaaacttgttaagaattgcgaaacaaatttcttttggattattaagaagaatcttggcatggatccaatggtccaaaatctgtatgatttcatctacaaatttcattcgaatgctatatagcaatcccgttatttatttattaatgtaatgaattaattgtttgagaaataaactttacaaatagtttagaactgattttttttaaaaaagtatttctataagcgtgaaaaatatagacaaaatgctgaaaatgggcctgaagttattcttctggagatcttatcaaggacaaaattacttggaagttggaatgcatacattatattttgtaggatttttgcagtaataagtttgtctttcgtacaaatatttttgatgtcctacgtttataaggccttgacaaaaaaattgtttatttaggaccaggataggattttttttttcaaaaaagagagaaaatatatcagacatcgatcgtgtcatacaagattcttctttgtcaacattctgattaaaaacttgggaggacatccgtctgcaaatgcttgccatgttgaaaacaggggctgaccggcttacacatgagctagctttcgtagtactataacgtacctatggacatatggaatacaataaacaccaccaatggatcaatatattacggaatatcacaagtttatctattcttgaataacacttttacttgtcggaatttcgtatgtatttaaaatacaactggcattaacaattcaaggatattcctcgtattacattgtttatattattgaaatgacaatattgcactcaaggaatatatgatgattctttttagaaatatgtataaggcttatgtgttt

SEQ ID NO: 35302 - DNA, 1501 bp, Oryza sativa
actcatcacctacctctgtcttcatcatgtccttcaacttaaatagcttctcatggaaatgattaattgatgtctgtttttcatccttggacatgtatttctcctttgacaaattatcacgcggcagtatcttaggatcatgcaatgtgtttttcttgctcccaccatacgtaaaacatcttgcaatacctgcaggtgttttagggaaagattcgaacacagagcatttattcatactacatgagaccaaaaaaggcagtcaaagcatatgcatttctcaattgaaacagacatagtaggattcccattagcccattacccatatcagcatacgttggaagacacttggacctggacaggacagggtagacagtacaatcttgcaaactaacagtacatgatgttttcttatttttatctctccctatttcttgctcgtctacaatttcaggggatcattgctacctaaaaatttcctccctatatcctgcctttgtgtggtatcagtaatttcaattcagcttcatatgacaagggggtaaagtgcaattagcatatgaacgcatatgaagcaagttaagaggtacagtaacttataaactcatgatatttggaaacaactgctgagataagtaagagcataagactcaggacaataaaacatatgtgacagtcctattaaaaccaagaaaaagattgtggcgtacttctatcagtagaggaagaaataatgatatatgtgcgctagtcaatattgaaaaactaaatgatgaggcaaagtggcaaacacttgataaatttatgccatcagagtccaaaggaagaaggggaaaaaacaagatggtgcatggaaaagattttgcataaccagtgcaacatttactgcatcctaattgttgaaggaaactttgtttgagtagagctgataaagaaacttcggttatgcagtacttgccaattgcaccaattgcatcaagacgatctgcatcttgtacaattgcaaactcaagagtaggctcaacaacagacttctttgaaacttcatttttgaatcctgcacataagatttgagatgttataacgtatgcattgcataactagggatacactaagaactacttatggccttcatatgatacaacattatcataatgggattgtactacaggaaaaaaaacggattttataaactataagatttatatggctttgaagttcgatgaacaattaagtaagctcaagccagctgctgtttgccaaatagtttcatccacagattcataaacatgaagaactcacccatccccttaatgatcgccacaatttcctccctctggccctgctccagttccacctcttcaagaaacctctccacgatgctcatatcctcagcattgtccctatccactcacccaacaaacattttttcaaaaaactaaacaggcagaaaagctgccaattatatttcaacaagcagagtaaaaatccaaacgggttacaa

SEQ ID NO: 35303 - DNA, 1501 bp, Oryza sativa
ttggagtatggtacccttcctagctcccagctatctttatggaaaagtcgtttttccacaaaggcaacttaaatcttataacaaaccaagctgaagttgacgaaatcctagcccccaatcgtgaagttggtaaagccaatttccgattacacggcttagttaatacgcattcagaacagcgtaaagggacgaaaggatcgacttcaagacatggcgatattagaaaagaggatcaatagataaatattgcatatacaaacacttatagaggttgtcggagaatccatctcttgaacccatctcgtttaaactttgaagcaccaaatttcctctacctggcatgccactgtcgactactattgggtatatggtatccataaccatgatacataagtcagtacaatcttcttcctctatcctcccctcttctctctatcctatcttcatcttgttttcaaatgtgactgacaacgaggagggcgttggcaagggaggaggatgagcgaaggaggctgatgatggcggattgccgctgatgggaggtcgacggctcccgagctctaccaccgcggatgggagaaagtcgaagacgatggcgacgacgatagtagctcccgagcccacccgccgaggatgagaggatgtcgacgagcgacggcggtggctctcgagccattccgccatggatgggaggaggtcaaagatggcggcgacgacgacggtgaggtcgacaacggcggtggctcccgagcccacccggatggttggaggtcaacgagcgacggcggtggctctcgagctctcccgccttggatgggaggaggtcgaagatggcagtgacgatgacggtggggttgacaacggcggtggctcccgagccctcccgttgtggattggaggaggttgacgacggcggcagcaacggcggtggctctcgagccctcccaccgtggaggtggtagacgacggtggcagtgatggtggtggaggatgatgtcggcgaggtggtcaacgacggcgccggagagagagagactagagaaaggtagggaaaagagaagagagggaagaatggtgaacaagatggaactgacagctagatcctatgtgcagttgaggctaacggagattttttacagatttcgtaacagagtggcatggtttcaatttcctcaaattcaagtggcgcgtagccgatatcgtgaatagtagtgacattatctagatcgacatatttgcaatggcatggatctaattaaccatttgttttatagctggtctctctggcatgatttggcacagatattagtgacggtggatagttttgtaaaattctgaatgcaacctgcatatatgttctaaatgtttacttattccacatgaattagatatgcaaccacaaaaacttacctatgttttcttttggttgctgtggttggtgacggtttttatattttggatgcacaagatgtagccagcttggcgtagatgggcacaaacc

SEQ ID NO: 35304 - DNA, 1501 bp, Oryza sativa
agcaagccataggaaataagtgtttaatgcaggcttcaaagaaaggctgttgtttttgcaatttattttatttgagctcttttctaaaaacaactaagtgagtgcttctcaaacgacacggatgagacagtgctactcgtccggtcggagtatgtgcaatgtatcaatctttagatcttaaaacaaggttggcacccggccaacagcttttcaaacggccacccgggccaacaacttttcaaacggccacctgggcctagctgatcccgtcagctgctgatttttcaaacatcgaaccccttttcaccacagtaatttcacaagcagttgtcaaacaaaactacgctaggaatcacctcacatccgcccatgaccgtgggcacggctgttcgaacagtttgttaacctctgcagagggggtacactttacccacacgacattactaacccggatcacccagcccgtggggatcagccacgtcgggagacctccaagctttcatgacaaggcatttccaaagccgacacaggcttaccatatgccgacgagaggggtcccagaccaacaacaggttaggtcccagaccatactgtgccaggaagcccaggggggtcctctccgacaccaccccggcgaatccacatgtctctcggcatcatggctcccctgataagctagttactcagccaggggtgtcccattccacccatgtggtcgtacttgtcttatgttcagatgaaattccaaggaaacggtccttaggtgcaagagcgggaaaccgtacacccggtaggttccccggtccgcggttttggaaattcatttagttcgcaagcaccgacccaggtgtcgggttttccaagtcttttgtaaaacccaagttttacccaagttgtttctcagattttaagtttgaaggcgaccgtcgatactcgcacagagtgcacgaatatcgaggcgcaactgggtggttacaaggggacatggtataacaattaacaaaggaaggatcaaatgcaacaaattaggcaggtccgccaatctgccttgcagacgggacaacagattaagtgcgatcctatcaatgcataatattttgcaagcaatataattaaattttaaatataggctcaagatgttcaaaggtggcttgccttgctcgagatctggagcttgatcctcgaaatcctcgcactgcgggtcttcgggctccgaaactacacgcgaaacgggacaactcaacaaacggcgaaaataaagccctattaatgacctctaagcgtgccattagatagatctcgagatttggggaattttggaagttgaacggagtcaaacggacttacggtttggaagatattgaatttctaagattattggatttttggtctaaaggaaaaaggatttaattaaatcctttttggaaaagaaaagaaaaaaaaagggagagggagggaatatagactttcctcgggcggctagggcgtggcccgagaggaa

SEQ ID NO: 35305 - DNA, 178 bp, Oryza sativa
tgcggtatctacctattagtggatcgtggatggtattttgttttaaaaattgaattaattgactgctcgtgtataactaatccctgaagaatcggtctgtacgcaggtagtgggcggtgaggaatggtatttaaatcatcaaaccacatactgcttcatttgttcagggctgcaggaa

SEQ ID NO: 35306 - DNA, 982 bp, Oryza sativa
accaattaaatttatcgccaaaacccaatattgccgatctatatgtgcacataagtacggacgtttagtaggtattaaaaaaaaggtacgtacatgtattccaagataaaaaagtacgtacgtatgtacataagaaggccgggttaacgacatatttttatcttctttttttctcactcggatagaaaaaccaaactgcccatattaactatgctctacttacgctgtaaaaatataggcacatgtcatcgaaacaccaatgaaaagcataaattaattaaagtatatattatgtaatagttaaattagacttgcattttttaaaataaaaacaattctaactgtgactagcaattctcaaaagttacctattccttacttaaaaaaataatgatatgtcaaaatgatatcactaaatttatcatgaatattctgttttctctattcgtataatatttaaatatcaaagattgtatatattattttcacaccgtactgatctcctttatcttctacttaggattcatttgatctagctggatggctgagcttattcaggatacatgaaaagacacatatcattagtgcaagattaattaaatattaaatataataaagccaaaatagatttatttaatttttaaacttttatataaaatatattttaataatacacaagttgcttttaaatatatacgatgtaggttatggttgtcaatttaattatagtgcataaaatggttcagatggatttagatattattatcaaaagatatgtcttttgtaataattcctatatcaatgggtagataactaggaaaacatgcttacgacaaacaaggagcaaccaatccgataattactctagaacttattgcttatttactaaaacgtttaatatgtagtatgtaatatactttatgaataaaaaatatcctaatatatcaatcatatgccaccaaggatccataagtacataagt

SEQ ID NO: 35307 - DNA, 1501 bp, Oryza sativa
taaaatacatgttcttaacgatgtaaaaataaaagctaaaaaataaacttcgatgaaaataactcggttagcctcagtacgcaatgtttttaaggttaaaaataaaattttagctaataaacataaacattagcgaaaagatgaggttgctcgctatctttcgctgtcgagctacactcatcttctaattttacaattacttgtggtgtaaccaatcgatatgctatctatgtgtgaatgattgatcaatggatcagtgatgccgctgtgcagtagaacagaggtgagccaggggtactgttgggatacccgtaggttacgatagcttaatcaaaattttatatcgtgtaaatcaggaaccatacaagtattagatcatagatcgttaccactcgacaagctgcacagcggaagacgctgagaagttgaaggaactctcgcgaagtagcgggcgtcgatgtagaggaagtagtcgatcacaccggctcgaccttctcctcctcgtgctcgccgtactcccacgccgatcagcaccgtaaaccagcagcgcctctatcggtatccacacgtacagggatggaacgccacgcgcagatgtgctgcaccctcgtgcggctagggttctgctcgggaagggagtggcggctagggtttctcacgtgatgcaatatctccgccggtcacactcctcacgaatatataagatccattactcggacctccaaggcccgtaggactcatatttggattcctatccgaattaagctcatattagatctccatccaatccccttattccggcccattaagcgtgcgaccctataggttcatgtacactcggctataacccgaaaactctttttcggtccacgcatcaacagcggcccctagcagaacatattgagccaccgggcatacaaaaagatcatatcgactgaacctctagtgtatacttatatgaacccctttgcctcacgatatcgattaagctcaaggctagatatgtgccatcctctaatagctcaatcattcactcgaacctgttgatagattatataactcgtgattgactcctcaatcacctttggcatggccatgcatttccataatctacaacatcgaagggcccagagatatttctccatagaaggggcaaatcccatcttgattattcatattccactacatatttcatagcatacccgaaaactagttttataactacccaattacagagtagcgtttagcaatccctaagtaagctactacacatgttagctaggaaccatgataatctaaggattcaacaccaacactaaatgagatcactgatgacacaacacatatggctcttgcagtgtctcatgttggatctatccaacaacatgttcaccaacatgtgtccacattattaatttgttatctctataccatgatccatgagacatgatcattaattaacatatgtgctgatcatctaaatatatttgttccacatatg

SEQ ID NO: 35308 - DNA, 1501 bp, Oryza sativa
atattttaaagtacttgaattttcatcgaggactgtttttacatcagatactactcatcctatatgtttgttctgcaagatccagatccagatatgcacaaaagggattcatggctttaagcttatctcttacgctccaggaatgaatcagtcagaacatcaccaccagcttgccgtcgtcgccgccgactggtgtcttcgcctatacggttggttggtcacaccaccgttgttgggcgtctacgtcttcaccgaccggccgcctcatccgccgccgactggtgtttccgcctacacggctggcctattatgccgccgttgttgggcgtctacgtcttcaccgaccggccgcctcgtccgccgccgactggtgtttccgcctgcacggcttgcctattatgccgccgttgttggatgtctacgtcttcaccgaccggccgcctcgtccaccgccgactggtgtttccgcctgcacggctggcctgttatgacgccaactgatgctatcttcttcacggctggctacgtcgccgccaccgctaataggcgtcatcatcttcaacgcaagctgtctacgtctgctgccgactagtttattcatttccatggctgcatgattctgccagtgttaattggccttatcttcttcactgccggtcatctcgtctgctgttgactagtgccctcacctctacatatggtttataccgctaccactactgatggacatcatcgtcttccgtcgccgactggttatgccaccgccgactggtgcttttatcttcacaactgcgcatcttcactaccggtttgcttctgttgccgctgactcatgtgcaacttcattactgctatgcaactttgtcaccatggtggagcaacttcatcttcatggtcttctgcaccggcaatctctattgctgctacttcgcaagttgtgctacttcaccaactacgacgtctacatgagcctcgacatattggcatgcgtcacgaaatttgacgtcgtgctaatctactactacaagtagttctataattttcaagacttatactcggacatcttcaacatgtaacctcacttaagcaatgagtactcgacgacaagctacagttctcgactctatgttcagttgtttcccaactaaccaaagagtcggaggctacacaaatacaagactcaaaatccgacaagttttatgtcaagataaagcaatcaatcaatcaaggagtcaactttaggagtcattatcttcgtctttacttcagagcagacgttctacttcagcaactcttattatttcactggcaattttgacttctggatgccgccacaatctgcttcaaattgctcaagtgtcaagtttgagatttaatatacatgtccgggagtttagagttatcaatcaatcagctcagtttcgacgagttggacaacaacatctacattcctctaagtgaagcttctacaacagctataacatcaagttctactgtcatt

SEQ ID NO: 35309 - DNA, 208 bp, Oryza sativa
taaaataaactttgtctgagattgttataaggctcaaaagactaaggagcccccactatattttatcctggctccgccactgctcactaattttgcctataagcgggttcatgggtcggcccgcttgcatccctatcagtagcccttattaattcacccactacctttataggaggattactaactaaaattggttacttctgcaagg

SEQ ID NO: 35310 - DNA, 206 bp, Oryza sativa
cccatccacatcggcagaatcgtttcacgtcacgtccacccgtgcacgcatctcgctaggctagcattacatatagccagcagcgcatggtcaccaccatgatcaactctcgagaaaaatcgagcagctagttagttcctcacttctagggattcgctttggctacgtacattggtgtacgatggcgtcgtctcgctccgtcgtgc

SEQ ID NO: 35311 - DNA, 1043 bp, Oryza sativa
aaaaataaatataagggtgaattagatataaccataggaaaaaatactttttttcaccattttgaggtatatttttgctcttgcatataccatatatttttttaacattttccttttgttttttattttcctatgcgtaagggtaaattagacaaatcatatagattttgcatagaaaggtgacatggcatgtccatgtggcaattttggtgggaccaaggactatattagcccacatgacaaatttaaaggacttgtttggacaatatgaaagaataagaactaaaatgacccaggatcgaaactttaggtaccatattagctattctcccaatgtatttttgtgttgtttcatgtatcacaaatttataattaagttgacatgcatgtgtctatataatgtagcgtatgtgttcatgcatgcacgatgattaagttggaaacgatgatgttcaaattagccccaaatttctagcatgcttaacaagagtaacgcaagttattagttagcaagttcaaatatttgggacgaagatgtgagaataagatcaggatcccactaattaacacagttaattactatagaattaaagagaaaacattttttcttaaaagaatttcctccattgtagcgattgcaccctaatcaacacaataataaaaaatgacacattttttttgtccaaaataacatggctgcatgatcaacaaaacatatcaatttccttcttcacttactgtcatatatgttgtactttgatattttttttaagactttgtactttgaaattatagtatctacctatgttcatgttattgagggagaatatgcaaagatgaacaaacatgtaaatatagcgtattgacaatgaattacatatgaacctacaaaccgatgatcttttactgagtttatatgttctttgtgataaaatatcaattttaaaataaccacacgaacattcggtcatattttatccgattgtgttattagacacaaaatatcgggggcgtctaatgggcgggtgatcgctcccccgtcc

SEQ ID NO: 35312 - DNA, 442 bp, Oryza sativa
gaatcgatttttacgaccaattgaaggaaggaatgccgacaaaaaggaaaaaaaaaagagaacctgaaacggacgaaaaaacggcgggtgaaaaaaaggaaaaatgaaccaaaggcaaaaaaaattggagggacggaaaaaacggaaaaaaaaggcgaaaataacaaaaaaaaaagtgacggacgaaaaaaaatacaaaaaccttacgtatttttataataggtatagatatagatatagattttccttattttacggaagacggaaactcttttgtcgcaccttttttgggatcggcagaacaaaatttttgcccttttctcgcgcttgattttttttcatacagtaatttttctttcctttttttcaacggaatttccaagtgagtcggaagttttgtttttaatgggaatcggaccttttttttcgtttttttctcagc

SEQ ID NO: 35313 - DNA, 1498 bp, Oryza sativa
cgtcgagtggggtggtgctagagcaggaggccgcgagcgaagagtcaacgtctcaacgacgaccgtgactggagatagcttgcattggctcaatgatgtcgacgtaggccgtggtagtgagcagggtggcgctggagtaggtgtgcccctagcttgggagaagccggccggggaggaagggccgaatagagagagagatagagagaagggaggaaggaagaagggaaagaaggagataatgatacgtgggcatcacatgctaactcagcaggatggaacaggtcaatgttgcacgtccgtgaaaactacattcaacactatttcacttctacttgtgatacaaaatatataagatttcattcccaaattttagagttattttttttttcagtgaacccagcgttatttttggctggctccacccctaacctcatactagttgatgccccgcgtttttctgcgggatatatgttagataatggagaaatgataaatgatttgcattgaaatattatgaaaatgatttgagaatgataatttagcatatgtatgtttagttttaaaataaaataaattgtagatataattactatgtgtttgcatgttgagttttgtgagcttaattgggtgatgcggcatgcttgcatgtaggtcttagtagtgctaataaatactatgtttgtatattgagctttaggagtgtagtgggcattagctttaagaaagaagagatgtgatgggagcatgaacatgttgttgtctgttgcatatggctgaagaacatataaagtccaagatttgctccgttccaacaaaaagtatctcgaggtatcgatacctcacatcaatatcgtttccgattgttgaatctagctagacaggattgacattattataccaagcaataaaaaatgatttggtaccgtgagatatctgtatctcgaggtggaccggagcaaatctcatcaagtcaacgagcgaatactaagggcctgtttgggggagctttaaattctgagaagcagctgtttggtagccagcttctgagaatctggaaaagctctgaaacccagcttctggcttcttcattttttagaatctataactgcagattctcagaagctgttgactgtttgggacagcttctaacagaaacagtttttaggaaaagctgcagctgggacaagctcaccagacaaggcctgagacccggcttggttgggctctcgcgaatactcagacccggcttgtctcgcctcgttctcatcaaaaacggcccggttcggctcgtttagcggcgcagccacacgcagccggtcaagccggcctctccactcacggatggcccagcccaaccaagctgaggtctccccggtctccaggggtgttttctactcggtattggaattgagaggcaaattaaataggatagtttgagacggtataaatacactttatacaccgacccccgatcgaaacccgtacgtttttctgcagc

SEQ ID NO: 35314 - DNA, 1501 bp, Oryza sativa
attgcgacctccacagtatcaaattaaatttgaaaatatcttttactaagaaaaattaccggtcttgaaattatttgagaaaaatatatgaaaatatttaaaatcgttatcagacataaggcgatgcgacgagacacaagaaaaccggttcagagagttcagctgggttaccaagcaaatccaaatccgatacccgtgttatatatatcagtgtgtcataattagtatatggtataatcggtatatattgcaacgcacagatcacttatctatatacatctagaaaaaaaatattcccattgtctatcaagcgtgacacgcgaataaaacctctgcacattcaaccacgttggcatgtgttattctccatgcgtgcaattgcccgagtcagcccaatgccaccagctttttgctgtcagtaataggtgtagcccaattgtaagttatgtctctttctcggtaggagtccatgtcatcctcgacgccgtcatgttaataggcttgacttagctacgtcatcaaggaaaatattgctgccacactgtagtctctgtgtcaacatcccctccctcataatagggctcccatatcctcaccctcaagcccctctagagttgtcgattgccctagctgtagcacaaagtttcgtatctctccatcatgcatcatcaactctagtcatcattgttgcccttcgaagcaccatcgatccacttcaatgatcgcagaagttacaagatccttgggcacaactctctcccattgaagcctgctggtgaacccccttttttaagaccaaatgagttgcagtgcaaaaactcgtggtcgattgtcttccattgttatttacctttgcgtgtatgctagtcaaaatcgtttcattctcctccttctgctagtcccctctgtctattgatgtgcactatctccagcaaccatatggagtagtgtttgatcacccgagttgataggtgggtctaatgcatcagttgcccgtcgattgacatgtggatctcgattggtatacccgtcttagatccgagccatccgaactataggttgatcctagctgtcccttgtatcatgatctaatctagctttcgaatttccgtggactccctttgtgcaccaaatcatggtagaccaccatctctcctctaaccggcgcgcatggtatgcatgtcaccaacaacttctttatgagggtaaacatcctaaacgcataattcaccttttgtcatcttacttaaaaaaatatatagatattatgttcgtcaccctcgctcacatggtgtggccaattttaacgagttgacatgaaagaatacggcaatggcccacatcgtggattgtgtcgctcccaccaccaccaccttcaattccaaatatgttatgatcctattgcaaaacacggacatcttgtcagtattccaataaaaaacctagtgtagttttaaatttagttcacaatgtggctggtctcattgatgcgcatcggagc

SEQ ID NO: 35315 - DNA, 983 bp, Oryza sativa
attcctgcagcccatatatatatatatatatatatatatatatatataaatataagttggtcaaatgattttaaagaagttaaatcgtcttataataaaatgaagggactaataaataaagtctcaaaagataacataatttacacaaaaattttgtctaacagattgaaagtaagtttgaagtgggatttttcacggcacgcaaaatgaacaaaccattagagtgtgattaacggtgtgtttatcactaacttaaaaattagattatttgattttttttaagaaaaacttccatataaaaagcttttaaaagtacaccttttagaagtttaaaaagcatcctactttaaaacttaccacccataactcactaccgaatccgcaacctaaatggctaaatctctgtttggatttcaggagaaaaatgtggataattttaaggtaaacatggttgtcacgtgaagctttacaaaaatgagtcatcgttaaggtctgcctttgtttgacacaagagtccggttttaaccgataagagatcaaaacaacctctaatacttgctatgtgaagatttacaaagagttatagtagatcatcacgctctgcctttgtttaacatatatatgtgtccagttttaacaggttagagataaaaaaaaccctaatgaagaacatatcacaatatcaaactcccaaaaagaaaaaaaaacagaagaaaagaaaaagaaagccacccccggacggaaaacgaagatccaaatatagagcaggcccgtataatcagaaggaaaccaaaaaagaaaaaaaataggagaattaaacgagcaagatatatcgtcgacgaggcccatcgcgtgcgcttcccctcccctctcgcctccccaaattcgcgttcgccaccgtcgcgtcccccctcgcctctgcctcgccggaaccctagggagatcgccggagcacggcgctggctcacgggcggcggcggaga

SEQ ID NO: 35316 - DNA, 1501 bp, Oryza sativa
tgaattttcagggtggtagatgtctaagctaatctaatctagcaacacgatttagccgataccggcagaaaccctaaaacgagaagcagccgatagagctaaattgatatgctaagactagattaacagagacatatgataaataggtaagcaagtatatcatccaaaccagagcaatccaagaggtcgaacgtactgatgcaaccttgaacgacgccgatgtagatgagacaattgtctgggccgacggaacattggacttaccctttcgccggagatcgaacaccgatgcagccccgcgtcaggtgccaagtcccgccggacgataaaataaagtaaaaaaggtaaaaggtggcgatgcgccaaattgtattgatcgtgagatagattacatagaccctaggtgtacatatttatacccaagggttgatacaagtccttgtcggataagaaagaaactaacctaaagataaaaagaaaatataaagtccttatcggacactaaacacactttcctaaagataaaaggaaactaacaaactattcctaattaatagataaactgccatgccgcatcctctttaaactcggtcacttagggataagttccctttagtagattgatttccttaaccgaatatagcaggaatccgactattggcgacttgataactcccatcggctgattccgagatgctgcagccgataatgattctaagccgattaccaaatttcactgttaacaggaccaaacaagaggcatgtgcgagtgtgcggtctgtgtatatggtggtgcgtgatttgtgatccgtaagcacttgcaccatgatggcttggctccgatgcgcatcaatgagaccagccacattgtgaactaaatttaaaactacactaggttttttattggaatactgacaagatgtccgtgttttgcaataggatcataacatatttggaattgaaggtggtggtggtgggagcgacacaatccacgatgtgggccattgccgtattctttcatgtcaactcgttaaaattggccacaccatgtgagcgagggtgacgaacataatatctatatatttttttaagtaagatgacaaaaggtgaattatgcgtttaggatgtttaccctcataaagaagttgttggtgacatgcataccatgcgcgccggttagaggagagatggtggtctaccatgatttggtgcacaaagggagtccacggaaattcgaaagctagattagatcatgatacaagggacagctaggatcaacctatagttcggatggctcggatctaagacgggtataccaatcgagatccacatgtcaatcgacgggcaactgatgcattagacccacctatcaactcgggtgatcaaacactactccatatggttgctggagatagtgcacatcaatagacagaggggactagcagaaggaggagaatgaaacgattttgactagcatacacgcaaaggtaaataacaatgg

SEQ ID NO: 35317 - DNA, 270 bp, Oryza sativa
ggagtgatatattacatattgatctatcttatcaatttttttaaaattttttcgtaaccatctaattgacatgcaataggatggacgtccactcgaactattggaatcctctccccccaccaccctattttaaaatttttcgtaaccatctaattgacatgcaataggatggacgtccactcgaactattggaatcctctccccccaccaccctatttttctggatcgtacaccatccacttccacgttgatttcccggatcgaacaaga

SEQ ID NO: 35318 - DNA, 216 bp, Oryza sativa
agaatttttgaggttttattttctacgtatagtgcgttatttgagactagtaatatgtccgtactaacgttacggcaaaatttggtaatacacgtgcaaagcatatggtaaaaatataagttaaactgagagcataaagctttactggtaatgcagccggaaaagtttacctggcacatgaaattcatgttaccaagtaataaataaataagcatg

SEQ ID NO: 35319 - DNA, 1121 bp, Oryza sativa
acatatcaaaaagagaaattagcaataagcaaaagtaaacaagctattaaataaaagagcataatacacaacatattcttccaatgcaaaattgcaaaatagcacatacaaaaaattagcataccattttggtgaccagcacagcagcataaatatttaagctaacacacagtaatgatcaaactattaactactccccccgtctcaacaaagagagtaaattaaaatgatcgccaccttccaaatgaattaacttgcacaagtaattgtggcactaatcatgcagagatcgactgtgatcgactcatgtcacagaatccgatgaatttattattgcaaatgtcaattgtataagaaatggaatataaccaattgaagtaaacccaacaataacattatgatcagatattaatacaccagtcataactattctggcacataccgtggtccacatgagcaatgacggacatattacggatgttattcttcttgtccatgatccggcggagctcttctactgtgaacttcaccatcttgactagctttgcaaatcacgctacaaatacaaattcctgtaccaaaaaaagaaacccagttagaaccatgcaaaacacaaaacctaaaatcaaaattctaactacaaatatatcacggcatgactcaagtaaaaacatagcaatgcaacaaataaaaatataattgatatcgcaaacaaaaattaagcatcatacatgatacaaaatactaaatacgattttttaacatgtccagttttactaaatgcgaatttttaacatgtccagttttactaatactacctccaaataccacactgatgcagttacactgttaggtttaagacgatcaaagaaaaaaactcacagcttgatagatgcagcattaataagaaaaaaaagatgaaacttgaaaacacacatcaaatgtaacaaaagcagcaaactgatacacttccgccatattcattaccatcagcacatcaccaattcaccactgcagtactgtacatgcaggatatgggagtactcataacagagatacccagtacataaaaattctggcgggaccgcgagaagcacttaaccagtaagaaaaaaacttgt

SEQ ID NO: 35320 - DNA, 1501 bp, Oryza sativa
tgtagctgcagctctttctcctagaggcattaatatgttgcggcaactatagcaaatcaatatgaaaaagaaagaaaaatattatccattaccaatccttgaactcatgacctcttgagttaactattttttatcttcaatgcactaacaatctcaacctcatataattacatgtaaatatgtgatttgtattatttatatctagttacttgacatatattaatatttggaaaaacgtctttacatcgttttaaatgccttaagaaaatgcctttacatatgaaacaaattttaaagtgccgaaaagatgtctctacaagataaatttaacaaagtatactaaaaatgtctctaaagtgtctctagagtaaaaatattttaggcgattttgaaagtgcctctaaaaagtgtctctagactatagagcttcaaaacttagaggcattttgaaaattgtctctacaaatgagcctctacataaggtttttgttatagtgaaagcaaaggtgatactgatcaattatgtgatttgcaatgtatgtctatggagtgatatgtgggaaaagtgttttcatccctcgaggggatatctcctaattttgtgcatgtcacctaaatagttataaacaaatttgaaaaaaaaaatcacaagaaatgtgcaccaatactcaaatgtatagctcaatgctcagagcagcagggtttttcacgagcaccttatatgcataaaactacacacaacctatatggatgcttggcgctgttcacagcagcaagtccacgaggccaaggtctaagtggtcgatacagcatcatttagctttttgacatgcacagctaagagctacgaccatcaatccgtagcttcagggaacaaatatataagaggtagactcagtgtagaaagcagaaaattgagaaccataggataaccatgaagagaacctgtcagtcttggctgttctatactttgctatataagagtagcacaaaatctaccatcgcaaaagatatggagaacataaagatatcaattcttctctaagatcaatgtgtaaactaaatttgtaaacactttatcacatgatatctcaaagaaacatgtatgctgcccccataatttcatttgaaaatacaagctgatgcttagattatcatcgatagtacgattgtaacatatatactctatagttattatactccgtcttgagctgcacctccttcctcggtgcccgcagatttactggtcccaggaatatcttagaaaagcaccttccaagcccaaaaagcacagaaacaatattagaatatcacaaatccctcaaaaaaacaggttagacagaaagcaagaacaagttcaaaccttctctgttgtaaaaaagaagaaataccatgtgcattgctcaggagtagagacgcaatgtctccgtcgcttatgaggcacgttgctcgatccaagtcctactcaatctcatcaagtccatccactgtcacaattagc

SEQ ID NO: 35321 - DNA, 1501 bp, Oryza sativa
gtgttgcccccgactctttagttagttgggaaacaactgaacatagagtcgaaaactttagcttcttgtcgtcgagtagtcattgcttgagtgaagatgcatgttgaagatatccgagtagaaatattgaagattggaataccacttgttgtagtaaaataacatggcatcatatttggtgacgcatgccgatataacgaagctcttgtagacgtcgtggctggtgaagtagcaaaactagcgaagtagcggcaatagagtttgtcggtgccggtgacaaagttgcacagccgtagaggcgaagaaaccaatcggcagtagtcaggtcagccagcaatgaagatgaaggcgaccaacaataatggtagcggtataaaccagacgtagaggcgagggcactagtcagcagcagacgagacgaccggcgatgaagacgataaggccaatcaacactggcagaatcatgcagccatggaagtgaagaaactagtcggcagtagacgtagacagcttgcgttgaagatgatgacgcctattagcggtgacggcgacgtagccagccgtaaagaagatagcatcagttggcgtcataacaagccagctgtgcaggcggaaacatcagtcgacggtggacgaggcggccggtcggtgaagacgtagacgcccaacaacggcggcataataggccaaccgtgcaggcggaaacaccagtcggcagcagatgaaggcagccggtcggtgaagacgtagacgcccaacaacggcggcataataggccagccgtgcaggcagaaacaccagtcggcagcggcgaaggcaagccggtcggtgaagacgtagacgcccaacaacggtggcataataggccagccgtgtaggcggagacaccagtcggcggcgacgaaggcaagccggtcggtgatgttctgactgatccatttctgaagcgtaggagataagctttgaaagccatgaatccctattatgcatatctggatctggatcctgcagaacaaacatataggatgagtagtatctgatgtaaatataatactcgagaaaaatttaagtattttaaaatatttataaatatgtatttctcctcttgtcaattttgatttccccgagcagatgactccgtacgtttaaacactctgtccgactagtcatagcccccaagcatcgggagtcagcctaggcacttcccaaacatgcatatgagtgacatgagtttgtcattaatggaataaagtttcacgaatcataatttactactcgggtacttttgcaattgtaaagagcagaaaataaatttatcttatctctatgcttttgatttattctgaataatacttagaaccttgcgttactcagtccatccaacgagcccccgggtgctaggaatcggcccaaaggcaactatccatcgacaaaccaaacggaaagcataggaagatagaactccataactcgataggtacttttgtactcagattatgtc

SEQ ID NO: 35322 - DNA, 1501 bp, Oryza sativa; identical to SEQ ID NO: 22246

SEQ ID NO: 35323 - DNA, 1501 bp, Oryza sativa; identical to SEQ ID NO: 22252

SEQ ID NO: 35324 - DNA, 1501 bp, Oryza sativa
gctgaacatttgctgttccgtcgaggagatagagactgattttgcattaatcgcagtgaaggtgacttggtcgacttttaatatgaaaagttggctctgtgatgagtgggctaaaagtggggcgggttatgcccctaacccaacgggctggcccgcatcactaaccatgcctgccttgactgatgcgggccaaagcggcagcctgcactaacccaacgggcaatgatgtcgcattgctcaccattccagtccaggggaagtccatatcgctgctagcgagagatgatgcatggctagctcccttcgctcccctcagctaccattgtaagtttgtaagtggatcttgcttggtggtagtaaaaagaatatggccattgcagccatggccgcccgaggaaacgatgacagcatcgatctatatgcattcttcacgaatcagccgggttttttcagtgcttttgcttcaggagttccaagcacaggcggatgcaaaagcatgacctggcgataatggcatggtgttcgaagaacgctagagagcaggaagatgacattttagtgtgataacaaacacaaaaatgtaatgcatgaacggcaaggaatgcatcgaatgcatgtcgcagacagaatcacactgattttgccatgaacttcatcgaacacggaataatacagcaatgaaaggcttcgacagcagttcttgcctggttttatgtatcataaaaaaagcgctgcatctgacagcactgatgatggacgtccatcgtttttgccctgattcgtgtaataacccaaaagagaaggtcaaagtggctgcttcaaagctccagtgtggagatccatttgctgcaattttgttgcttgcctcaacaagcgccattgaattctgttactgcctcacttaggaaaggccgtaaaaacttcaatgataaatcgtactagcatatttcaaacacactgcaattaccaacattgtccagagcaccaaacttctcattgaaactaagagaaagtcttgactaagtactacccccatcccatatatttgaaatttttcagaaatatccacccaaagtgcttcagcaaacacaaccagggaaaaaacaaagagagaactttgttccgcaaatcaataggcacattatgaactcctaacagggtaaccaagttctcttaagtagactttgaacggatgaaatcaagaatcgtatcatgaactcagcaggatttcacctcaccaaacttgacgttatacctttggttcgatcgaaaatgtattgatcacccataaaggagcaggaaagatgatgtgagcgaattgaagagggagattgatcacccatagaggagcaggaaagatgatgtgagtgaattgcaacgcacgggtgtggagattatgggtaccccatacccacacggcatggttatccgactagttataggagataacttttatctatgtaatatgtaacagatcatgacttgggtattacgtttcctt

SEQ ID NO: 35325 - DNA, 187 bp, Oryza sativa
gtcgcctctctactcggttgcggtggcctctttgcccggcttcgtcgccatagaggccggcgctccgtccggctcagtcgccgcagaggcaggcgctccgcccggccgcatcggcgctgtctccgcctagctcagttgcctcagaggctgccactctgcccggccacctcggcgccgtttccgcagg

SEQ ID NO: 35326 - DNA, 1501 bp, Oryza sativa
tgcaggcttcaaggaaaggctgttgtttttgcaattgattttacttaaactcttttctgaaaacaactaagtgagtgcttctcaaacgacacggatgagacagtgcgtctcgtccggtcggagtatgtgcaatgtatcagtcttttgaattgatcaaggttggcacccggccaacagctttcaaacggccacccgagcctggctgatcccatcagccgcagattttccaaacatcaatcccaaacctcatcagcaaatttcacaaagcagtagtcaaacaaaactacgctagaaatcacctcacatccgcccatgaccgtgggcacagctgttcgaacagtttaataacctctgcagagggggtacactttacccacacgacattactaacccggatcatccagcccgtgtagtacggccacgtctagagaccttaaggctttcatgacaaggcatttcgaaagccgacacaggttcaccatatgctgacgagaggggtcccagaccaacaacaggttaggtcccggaccatactgtgccaggaagcccaggggtcctccccgacaccaccccggcgaatccacttgtctctcagcatcaaggctcccctgattagctaattactcagccaggggtgtcccattccacccatgtggtcgtacttgtcttatgttcggatgaaattccaaggaaacggtccttaagtgcaagagcgggtaaccgtacacccggtacgttccccggtctgcgattttggaaattcatttagttcgcaagcaccgacccaggtgtcgggttttccgagtcttttgtaaaacccaagttttactcagaatgtttctcagattttaagtttgatggcgaccgtcgatactcatacagagtgcacgattaccgaggcgcaactaaggggttgcaagggaacatgatataacaattaacaatggaaggatcagatgcaacaagttaggtaggcccaccggtctgccttgcagacggtgcaaacagattaagtgcaatcctttcaatgcataatattttgcaagcaatataattaagttcaaatataggctcaatatgttcaaaggtggcttgccttgctcgagatcttgagcttgatcctcgaaatcctcgcactgcgggtcttcgggctccgaaactacacgcgaaacgggacaactcaacaaacggcgaaaaataaagccctattattgacctctaagcgtgccattagatagatttcgagatttgaggaattttggaagttgaacggagtcaaacggacttacggttgggaagatattgaatttctaagattattggatttttggtctaaaggaaaaggatttatttaaatcctttttaaaaaaaaagaaaagaaaggaaaagaaggagggagggaaattagactttcctcgggcggctagggcgcggcccgagagaaaggggcggctcggccgagcttaatgggccggccggcccaagaaggcggcccaaagcg

SEQ ID NO: 35327 - DNA, 518 bp, Oryza sativa
tttcctattttttatagaatttcccttctattttctacacaaagattcggacaccttcatccgaaacagacactaatcaggacaaactcatggtgatattcaaaagtagcaagttgcaattgttgatgcttcagctgaacataagcatccatattacaaatccaaatactactacctggtagtacctcaactgtactcaaattacttaatggtaatctacaatcgtctctggccactatcggatctgaagcattgttcgccacaccggcgttttgggtcttcttgagccggctccgtcactacctccatctggtgttgccagctccaagccactaggagacataaccatggaggaggagctggagagcggccaggagggaatgaatcgacgcagtggcattttggatgggaaggacaggaggtgtggccgccgccggaataggggatcgatggaggatactgtgcagcagtacagatggagagggggccagcggtggcgatagggtctgatgtgacca

SEQ ID NO: 35328 - DNA, 268 bp, Oryza sativa
catattaggataacattgtatcttttttgctgcgtaccatttgatacccactttaactgaaaagaagatcatatatgtgtatgctcttactggaaaacctgatcagtagtaacttagtagatagtgacttttttttttaatcaagtgatcttattttcatcgcacttgttggggcgagtttttttttttgggggggggggggtgggggatggtaagatttcgttcttttgaattgttatacaggctcacaactctgtttctctgcagg

SEQ ID NO: 35329 - DNA, 184 bp, Oryza sativa
tatatatatatatatatatatatatatatatatagggagagagagaccgtatatgactccagttaatttacgtgatatcgcttggatggtaattgcaggttagatggaaagcattggctgttacgtcttagagaaattcccaccttgtaccgtaattgattctaattaattgatttaggtgaca

SEQ ID NO: 35330 - DNA, 262 bp, Oryza sativa
tatggatatataaatgtcttatttccagaataaggagaattaatttgtacctacctttgggcctcagtcttactgttttgcatgagagtgaatgctgcattttatattcttaggcctttattcgataagtgccaaaactatgtgcctaggcgttgctatttgcagtattaatggcatatgcaagaatgcgatatttagattcccattaaattgtgtctagactaatgtattattttctgatgcaaataatttaccatttgca

SEQ ID NO: 35331 - DNA, 1267 bp, Oryza sativa
gcccagcagcttcaccatttcctctctcgcttaacacttcactgttctttgctttgccagtagatttcatactatattgattcccccgcatgcttaacaacaacaaacgatgatgacgtgtggatcactggtgttggactgttggtggtgaatgctgattagcgtccagagaaaatgctgcctgcgtcctgaaaagtctgctgttcgggatcacggcgcgacgcctttttcggtgtcgtgttgcggcgcaaatcttgatagtgggagtaatttagcagccgatatttggagccatttgtccagttgccctgtcactgaaagctcagcaatggttaaactaggctgatgggtttgcaactatggtcagatggctctaagtaaacatgtaggaatgtagaggaaggcctcaatggtgaaagcgacatggaagtttctctataggcattggcattggctagaactgcactctagcactgtactagcaatcagttggtggtttgagactcacacaagatagaaaaaaaaaagcagcaacgaaatggtttttgactaaccaacctaatcagtactgcagagcacaattgggttggggataaacatatcattacccaccattttataaggtgatactctgaaatcattgtgattttctagttgggggagaagatctcggtataattaagccagatgaattattgtttcccccctatttcttccatacttcgtcgaccggcctgttcgacatcagaaaactagtttttctccttcagatcggagtcaataggctgatattttatttttatctagtgtgaattgcaaccatgtccccaacaactatgcatgtggtgtgtttcctacttgctcccccacactgccatcaccagcctgattagtagtactcctacgtaggtgatgcattcatgtcagcatgttgctgttagtaccatgtataggacaagactcttgttcgcttggttcatcatttcaaaccattcaattctaaggcaacttgcaatgctgataggaacagttgctgaaattgcagtggaaatgcaaatgcaacatgcaactgcgaaattgtgacagaagttagaacaattcagtgtctcctttgaatccggcagatatgcgaaatttttcggttcattgacatttggtgctgctttgccatttcttgtgtgcatgtaccagaggactaccttgggacactgggtgttcaagagcaagagcagccagaacagcagcagcccaaggggagcttgcaagg

SEQ ID NO: 35332 - DNA, 465 bp, Oryza sativa
gtcttgccgatccagcggcgccgccgccgcagcggccgcgccgacgaaggagtcggtcatgagatcgttcatcttgggcgcaattgggggagattgctgagatcgatctcgcaaatctggggcaacaaaaaacgctgacttttttttccatttcttttcgattaaagacgacggcgacggcgaggtcgagttgtttggttggaattttgattttataagataaccgcacattcaagtttgaatatccatagaatttttgaggttttattttctacgtatagtgcgttatttgagactagtaatatgtccgtactaacgttacggcaaaatttggtaatacacgtgcaaagcatatggtaaaaatataagttaaactgagagcataaagctttactggtaatgcagccggaaaagtttacctggcacatgaaattcatgttaccaagtaataaataaataagcatg

SEQ ID NO: 35333 - DNA, 1501 bp, Oryza sativa
ttcaactaggaacctagttaattactccatatatcaccgccttttaatcatgaaaagattccctctactgagtagcagatgagattcttgataattgattaattgtattgagtagcaacctaagaatccaagtacatgatcactatttttaacttgacaattgtggtactagcatgcatgttcgtgatctcacgaagcttctcaatgttattcataaagagtttacaataatatgtaggtttgatttgcatagcaacccctgaatgatagcacttgttttttttttcggggaaatgatagtacttgttgttcggtgatggtgacacatctttgatgatgcattccatagctcttgacgtttcagataggttaagataaaacaattaaaacctagactatcaacaagttaatatttagtttaaaaacactagaaaacgatagatatatcttcttaaaactaattgaacataattaaatgtttacttacttttttcaatatgtaatgaaaaatatagtcgaagatatattttgaagaccgcaacatcattcataatataaaaaattatgaaaccgcatagagtatactccgtataacaatatggcattttagaagtcaacagatataatactatatggcacaataaaatttagcgtacacattgatttaatcatagcactaagttaaactctcgtggaatcatatatacatatatagttatatttttgcatggacataccgtgtacactaactaacaaatatcatttttttagaaaaatatatatctatttaagataaaatcaaagtcaaattttaaaaatttgaccaaatcataaacctaaataataaacctaaatagatatggctaaatctttagaagtagggatgccacgggccattagccaatttcttacccacatctatctccgaatgaacaaaatataattttcagcttcttctacaagtatatttcctttatcctaaaataaatcaaacgaagggaatatatttttcagcttgtcctgaaagtacactcccttaatcctaaaataaattaggatatgacacaacctaatataataaatctagataaacatttgtctaaattcgttgtactggattttatcacatcgttagctaacttagtttattttgagacgaaggtattataattttaacagttgacaccacattgtctcgctaacacacgagaacgtgatcacccctgctgcaatctctgcatttttccctcgttgcttccctgacagcttaaattagcgtattttagccatcgaggaacataaatagaaatggcgcgaaatctgtctgccgtagctttctttgggcgggtcggtggtggcagtggcagcaatggcagactgccaggcgggtcacgttggttgacccctcttctctctctctctctctctctttctctctcctactcgcgcgtcgtcgcccataaatctggcgggaaccaagaggcctcgcgccattataggc

SEQ ID NO: 35334 - DNA, 443 bp, Oryza sativa
agtccatcgaacggttgaaaattcaaaagtttcaaccacataaaacttttttttttgcgggaaaccacataaaactgttgccagttttttagcaaaaccgttcggtacattgttcctccctccgtttcaggttatgagatgctttgattttgatcaaagccaaactacttcaaatttaactaaatttatagtaaaatatagtaatatttctaatatcaaattattttcattaaatcaataattgaatatattttcataataaatttgtcttgggttgaaaatgttattatttttttctataaacttagtcaaacttgaaacggtttgactttgactaaagtcaaaacattttttaacctgaaacggaggtagtactatcatatcaaaatagggtcactatgctaaaataccttttctctcctttttatgattgttttcacagc

SEQ ID NO: 35335 - DNA, 160 bp, Oryza sativa
atcgatcaatcatttcgcttcaagaaactctgaaccattctggtttcaggaaatcaactctgaaccatttcgtttcaagaaactctgaaccatttggtctcaagaaagtctgaaccatttcggtttcaggaaaattaactctgaacaatttggtttcagg

SEQ ID NO: 35336 - DNA, 1501 bp, Oryza sativa
ttccagaacataattatggaacattacacaattgagtacatttctcaggtcatactaaatacatacactcagtatgactgacgacccattttcatttgttacatatggctggcacaaacacatgttcagccacataaatgcatatatgaaaactatgagatctacatagatacgtatttcttgatttttttttcttttatcagtttgtattttcttgattcttgattatatatcacgtagctaggcacatttataatgtcgtatcaggagctagcacttgtaggggtatagtagagtgagctgagctgtacatgtctaggccaaggggtcgccagcgacgccgtggccggcggctttgggcggcggcggcgacggcgagggcgcgggaggcttgggcgtgggcgcgggcggcggcggcgtgggcttgggcttgggcggcggcggcgtgagggcgcaacgcaccatgcagacgatgctgttctggttgcagctgacgacgcagagcgtcgtgtcggggcccttcgccatgcacccgaaggcgcacccgaacatctgcgtgaagcacccgatcatgcacgcaagcatcccgttcacctccttcaactccgctgccgtcgtcgtgctcacctgcgacgacgacgacgatggcgtcgcgccgccggcggcgaggacgtcggcgaagccggcaatggcgaggaggaggatgagtacgcagctggctcggccggccatcctcgctgtcgctggctgcgtttgtgcagtggttaatgtgtgtggagggagtttgggttaattagtgtactggagctgctaatcaggtgtcgttaagatgggtttatatagtgccgttgttgctgatgtagcgtgcgatgcttggatttgcgtttttggtgtgtgtgtgtgcatgctggtgttgcttttccgcgcacgggcacacgcgatccgggtgattagcgaatttggtacacggaagatgtgtgatctgtaatacaaactgtttcaattagaatataataactggttgaccaagaagttgagatggccgagttggtctaaggcgccagattaaggttctggtccgaaagggcgtgggttcaaatcccactctcaacaatatgtttttgtatttaaagaacattattttatttttaaaattttatttaaaggagtaattaacaatatgttttgtatttaaataattttttttatttttaaaattttatttaaaacaatatgttttgtatttacagaattttatttaatttttaaaattttatttaaaggagtaattagtaaagaaaaatgtatagtggttactgatgaatactgattaactaatccttacagttatccccactaactccttaagcttaacatgcaaagatgccacatcatcatccactaacaagatgccacatcatcatccactaataatcatcacatttaaacatcatgtaaacatgttatattatctatgattttatagtttttataatttaag

SEQ ID NO: 35337 - DNA, 1501 bp, Oryza sativa
catcatcatgttgctccctctttaactttctccgtctctcttcgcgttcctatgaaacatggtagtgattaatgaaagatataaacaggtagcaatgatggatcataactcaaaagaaattggttaaaataataattaagctcgctttgcaccattgctgtttttaaaaagcatcaactacttaattagtaataaaataaacagaacatatgaaaaccaaatgccgctggctatatgaaacaaaagaagatcgcaccaaatgaccagttggtccagataatagagatgtagattgagtaactagaagaaaaatgttaagttaaaacgtggtttgccaggtctgtctattgcagagtattatattctaatatacttcttatgatatcgccttcaccacaacccataatacaaagtccaaaaactccatggtctcatctcaaggggaatgctcttctaatgctgcaaaacagttgcatggtttaaaacaagaaagtattttatttacccttcgcattatctcaacagcagactcagcatgttcactctgtgaaaaatcagcatgctcttcataagactggtcatcttcctcaggcgatggtgaagcattcaaatccattcaggatactccagctagacctttaaagctaagacctaataacagaggggaagaaaaggcatcttacatcagtgtaattacgaataagcagcttcacttccaaatagtagagtgacttcagctgcacttgatgagtacaatacaatccagacactcagataaggcacactaaaattaggacagtttattaaaggaataactaaagattgaatgagaaaataccatcttgtgctaacagagaaatatcacttgtgttacagagacactcagataagtcacacaaaaattagggcagtgtattaaggattaattaaaagaatgactgagcaatataattcttgtgctttcagagaaaaaaaaattatgttacagagaaaaatgggcaagatgattaaaattccaattcattgcagtaaagttgacccttgttaaagttactccaaagcttcctgtcctaatcttgattgaggttgatttggaagttccaaattctctatgtgttcttatctatggaagatttgcagtgaactgcagaatcaaaccatatcaaggatgattcacatctgtttctatacaatactggtaggagacagatcaaatggggttttatatacttgatgagcagctatcaggttgttgatcatcaaattgccaaacgcttatcaggtaaaaaatgggagccaaaccacattgtcagttccgtgaaactatactaggaattcctatggcaaggaattgttgtattatctgatgccgtatccattggatccatttttccctccgaacatcgatatgcaactgatcatgcaactagacttggctttcttttttttcatgtaatttaacttgttcagtatagaactatgtatgctggccaatttacat

SEQ ID NO: 35338 - DNA, 445 bp, Oryza sativa
actatagggcgaattcgagctcggtacccatttgaccacctcgttttcaatgattgcacagtgtcaattttcttgtggactcactgctttagtccattaagaagatgacacgtgtcctcagcatttgaaaaaaagtgtggtctctgtgcagggagaccagacggaggagtgccctctccctccctcccctcccttgccaagaacggcaaataaagtcatgtctcccagagtctccctttctaaaagcagcaaacatagtcacgagcggaggagacgcagaaggggagcaaacagctcgcccccaacaagttcatccccagtccagagagagagaggcagccaccaccaagttctttccaggccaccctcctcctcttccccccaccgcacgcctcactcaacaccggcgaactcgggagcgcgcggcccgagtgtgtcggcggca

SEQ ID NO: 35339 - DNA, 1501 bp, Oryza sativa
cccaaagccgcctccgctcctccgcgtgcgccgccgccgactcgatcgaattcgatcgcttccgcctcctccaccacctcgacgcccgtctccgtcggcggcggcggcgagctcccaaatcctaggctagctcaggccccccaacatcaccacagaaaccacgggggtctcccttccctcaactccaccgcctctcatcggccgcgggagaaatcggtcgaatcccctccgcccgcgctgccgccgggaggtatgggacgcgagccccctcctttgctgctctcccttatcgcgccggcgccccgattgtgattgctggttgttggagttgcctatcattcgatctggggggggggggggggggagtagattggtcgctagaattggtggggtggacatgattgcccgatgagtggattgcgccgccggctagcttctaactagtttgattggtagcttctaactagtttgcacactactttcatggcatgggctcggaaaacaagcaaggaagaagaaattctgaaaaatcagttgctggcacctgtaattctatactaccgaacaagtaaacctacatattataaatgtaaattggccggcatacaagtaaacctacatatgtaaatgtaaattggccagcatacatagttctatactgaacaagttaaattacatgaaaaaaaagaaagccaagtctagttgcatgatcagttgcatatcgatgttcggagggaaaaatggatccaatggatacggcatcagataatacaacaattccttgccataggaattcctagtatagtttcacggaactgacaatgtggtttggctcccattttttacctgataagcgtttggcaatttgatgatcaacaacctgatagctgctcatcaagtatataaaaccccatttgatctgtctcctaccagtattgtatagaaacagatgtgaatcatccttgatatggtttgattctgcagttcactgcaaatcttccatagataagaacacatagagaatttggaacttccaaatcaacctcaatcaagattaggacaggaagctttggagtaactttaacaagggtcaactttactgcaatgaattggaattttaatcatcttgcccatttttctctgtaacataatttttttttctctgaaagcacaagaattatattgctcagtcattcttttaattaatccttaatacactgccctaatttttgtgtgacttatctgagtgtctctgtaacacaagtgatatttctctgttagcacaagatggtattttctcattcaatctttagttattcctttaataaactgtcctaattttagtgtgccttatctgagtgtctggattgtattgtactcatcaagtgcagctgaagtcactctactatttggaagtgaagctgcttattcgtaattacactgatgtaagatgccttttcttcccctctgttattaggtcttagctttaaaggtctagctg

SEQ ID NO: 35340 - DNA, 682 bp, Oryza sativa
aagggatccggcgagatcgtagtcgagttggttcgactagatccctggcggtttggctcctgcaggctctggcttcgtaggctgtgggggttgtgttggctctgagattcgatgccttaggtcctccccaggggtcccttttatatcacaggtcaggcggtttccaagtcgaacttggagacatcagaccctacacgatacattgacgacctagtcttgttcgagtaggactcttttcgtccgtaaactccgtgaaggatttccttaatatatgcagagggtatccgtatgcgcgtgggtatgccataccgatatgcgacgtatatcgaagggtaaagggtatacctaacccgtaaccctgacagtagcccccgacttctgcttaaatgaactcgtgtaaccattcgcgacttcttgtgtcgagactgttgtcgttcccagtgtgaggaccgtagagacatgacgtagtcgagaacaccatgtgaagcccaatggtcacgattgaatttaaactgaagtctaaaaaactgccgcgcgtaacagacccagaaatttccggcgggcatctctctcctttccttggaattcacaccgtcggtagtgtgtctatttaaaggaattttggggatccattttgaagtccgcctattgtgaagaaaacatcccgcctgcaagcgttctt

SEQ ID NO: 35341 - DNA, 225 bp, Oryza sativa
ctagaaatacaatttaaaagtaactgaaattcagaattaaaaataagcaaaattgaaagaagagtccatataaaaacccaatacgagattattaaaattaggaataaaaaataaaataaaatccgaaattagcaaaaaaacaaaaagaagagttcgaatacaaatactgtcagggttacgggttaggtataccctttacccttcgatatacgtcgcatatcggta

SEQ ID NO: 35342 - DNA, 1501 bp, Oryza sativa
cgctgcaaatggcgtcaagcgccatcctatcctcatgaagctcgacaccgcctggatcgatggcgccccacaggcaccgggcttgcagtttgatcttcatcagcaaagaccaatcgttgtagttggttcttgtcaacagcgggtagttcgccgcacctcctgcttccttgaccacgcggtggatcaccagcccgcggtcgctcccgccgctgcccgaggcgcggccgccggaacctgaaacatgcacggacggtgacgccgaccgccggcgcggggagtgcgtgcgtcctcgaggcatgaagacaccctcaagagcgcgatctcgcgtccacgctctgaaccgagctctgataccacttgtcaggtttccctaagtgatcgacaaacaagctgtggaaaaacacacgcgaacacgaggaaacacgctgagttttgtggtgcgatgaagcttcaccttttcggttttttttcttctccttttattatgcaaataacagacttaggattcgatcccacgtcccggttctttcgcgtccatccccgcgatccgagagacgcgttcacgtcccgttgtccaggccagtcgcgagttaatctcgttgacagccactacgtgcacggcatccacaacccggagctcgcgcatgcaacaacagaaaaactaacatgcatgcatcaacagaaaggaacgtaaaactagctactactagatacatcgtgtaaggtttatttccaacaaggtgggcaacatgcggggagcagtgggatgatgacgaaagctgatcaatgagcttaattgtgggacaagggatagaatgcatcttcgacctctcagatatatatactccctccttactcataaaggaagtcgttttgcacagcgacacggtctccaaaacacaactttgacttcttgtttctataataatatttattgaaaagtgatatatgtatatttttatgaaagtatttttcaaggcaaatctattcatataattttaaattttcaaactcaacaacttaagagttattcatgatttaatgttctcaaggtttgacttaaatattgtcctaaacggcttactttacgagtacggagggagtatatatctaggatggctctgtacatccattttagatgtaaaggcctgggttttaatttattatctaaaaactataatagacgtagaacgacagctacaggttgcatccaacaaaccctagcgtccaccgccgaacacctccctttagggtcagaagtgatgtgtctaggaaaagcttaactttaatcctaacgcaatacttcaggcactggcaacccgttgttctcagatttcgctctactacgtacccggacagggaggacttaagtgctcttgagggctgtcaccacctctagacccacctcaaacgtactgtgggatatgcatcaaccactggagattaattacccaggcaccgcatctacgcaattaataactactttagtgccgatcaaaca

SEQ ID NO: 35343 - DNA, 832 bp, Oryza sativa
ctaggcggttggtaaatcctttatgagtttatttactcggattttacaccacatatgccatatatttctaggtgtggtgaaaccatgtgtcttctagggacttaagcacatctgttaaagcagtgtgcgcatggcgtatgcccaatactttggaaattcctttattcacaatatacaagcttctttatagctattttgctatatcactcatcatattttacaaagcagttggtatatcactcggatcatgttatttggaggattcacaccgcatatgctatatattgatatcaagtcacttggttgattacgattatcaaaaccactcggttggttggattatttattccttgactatatgcttggtttgttcaattaaccacattgtcgggggctacacctattaggtgcatctagtcggtgcacctgactttattttccagccctccacagtcttcagatttggtaaaagtactcgggagaccatgacaaagatgattgaagcactcggctttggagtaatatggttcgagagaagattatcttttcgactgcgaaggtctcaggggctactgtggatattatgggtaccccatacccatacggcatggttatccgactagtcataggggataacttatatctatgggatatgtaatagatcatgactcgggtattacgtttccttatatattacggaacagcctaaagtcctggtttgataatattgtaaagtagatttaggaacccgataccgtattggttaaggtttctatcttgtaatcctgccccccaccctatataaggtgggcaggaggccctctagggggca

SEQ ID NO: 35344 - DNA, 613 bp, Oryza sativa
  unsure (1)..(613): unsure at all n locations
cgtttcaaccacaatcacaatataattctcatgatttaatttttacacaatgaaaatttgatttgcgaattaacttcagcaaagaactgcaaaaatactcannnccaaaacggaatcgtcatggcggatataatagatttccgtgaaaatactcgagttggtttatttattcgttggagttttttttattcacaggtcagagaacacgtgcactatagagcattgaaaggctttgacagcaattcttgccagggtttaaatacaatacataaatcataaataaagcaccgactatttacgtccattgtgtttgtgtgcaccctgaatttcttataataacccaaaaagaaaaggtcaaattggctgcttttaaagctccagggtggagatccatttgctgcaattctgttgcttggctcaacaggcgccattgaattctgtactgccttcttagggaaagctgtaaaaagtacagatgataaaaacatattagtgtagttttaaacacactgtgcataccaacactttccagatcaccaaacttcccattgttttatcagaggcaagaaaccaaaagatagtcttgactaattattatccgaaatttttcaga

SEQ ID NO: 35345 - DNA, 1046 bp, Oryza sativa
aatatttgaaatcaaagtcaaatttgaatcgggtatgtaaacttttaacttataaactttgggtctacaaactttaggtgtataaactttatatgtatagaaatactatatataaaaaatatttgaattcaaattcaaatttgaatcggatataattcaaattcaaatttgaatcgggtataaaaacttttgacttattgtcagggttatggataccacatacctaatagtagtcgactacatctcggcaggacccaccacataccatgtcctacacggaaaccgacttcagatatggagggagttccggataaggaaagacaaccagagttctacatggaaacgacaaggactattcggactgtattcatattggtttccctagttctacttggataaggggacacatatgggtataaatacaagaccccctaggaggagtggggacacaagacaatcgacagacgatcgacacgatcaacatgatcgacacgatcaacacgatcaccacgatcgagacccacctcaatcaacaaccaccacaatatacggaacaacagaagccaatacaagccaacatacgccaagacacgccgccggatatcgacttcagggataggcatggctattcccctacggtgtctccggataccgtcaggagagacgaaagcgctatctctgatctcaccggacacggattcgaggagcaagactaccttgttgtcgactacgagtcagaccttcagaccgacatgtcgacaacagttagataggttacccacatattgtactggtgttattatggtgaataaaagcaactccggctccggccaacaggatgtagggttattacctgacaactcagggtcccgaacctgtataaaaatccttgtctccatctcttttacctcagtctcgcatatatcctagtaccgacgatccccatactatgcaaataccataattgcgacatcaaacgtcgacagtggcgcgccaggtaggggtattttggtgctctaggaattcgacgagatgggttcaaaaga

SEQ ID NO: 35346 - DNA, 1501 bp, Oryza sativa
cagcagcagcagcatcggacgcctccttggcgaccttctccttcagtgacgccaccacctgatggtcagcgagcggcccgatgatgtcagtcagaggaagagcctacgcttaatcaagtcacaaagcgatctcggaagaaaaacgcagaatgcctattgagtacacttacattgatggcagtgtcacgttcggctgcctccttctcacaaaggggaacatggatgttactcgccgttgtcgggccactgatcatcacctggccgacacgacgtcccacggtttcgctgttcagacctgtgaatcgagaaccaaattttgataaatcaggaggaacgtgaacacgatcatgtcaggataaatacaagaaagataccccgaggagaaacccgggtcgcgtcctccggtccagaatagtcaaaagctggatggactcgagcctggagcggctggatccgtctaccaacgaagtcggcagcgacttcatacccagaacaacctcgtactcggagatcgtcgacaatatcgatgaacgactggagagaaggggtcaaggggggctttgcggtccaagacgaaatcttatccggttgttcctctggaacaacgaagacagggtccgaatcttcgatctgaaggtagaaccacctcgttcgccatttgctgtgagaggaagggcactggaaggggatataacgcgacttcaggcaatcccgaagtcggaacccgacgcatccagacaccctgttggactccatccaacacagctcgtagtagaagcgaaagagatcgagaaagggctctaccccaatataggcctcacaaagatgagaaaagatgctaagaaaggcgatagaattgcggttcagtacctcctacttccctctccatggttccacgaccgggaagggcgccgtcttcctgaagcttcttcagcgacgcgctggtggaggatgatttgccaagatccatcaccgatcggagatcgccggagaaagaccatagaagttcaataccaagagaagaaattcggaaggtgtagggagaaaaccgcagagaatgtagtcctcgatcgtaaccatgcgacctaagacgagctagggtttcttgtgggagcggagaagacgaagaacgcttgcaggcgggatgttttcttcacaataggcggacttcaaaatggatccccaaaattcctttaaatagacacactaccgacggtgtgaattccaaggaaaggagagagatgcccgccggaaatttctgggtctgttacgcgcggcagttttttagacttcagtttaaattcaatcgtgaccattgggcttcacatggtgttctcgactacgtcatgtctctacggtcctcacactgggaacgacaacagtctcgacacaagaagtcgcgaatggttacacgagttcatttaagcagaagtcgggggctactgtcagggttacgggttaggtataccctttacccttcgatatacgtcgcatatcggta

SEQ ID NO: 35347 - DNA, 353 bp, Oryza sativa
tatagggcgaattcgagctcggtaccctgtaaaactgatggttaattcaatgtacctagaattacgtggattttgtaaaagaaaaatatttgattttcacaagatggatgtatctattttaaatatgacagtattaattaatcttttttctcagggcaagtagtgacaatattgatcttattctatgataaacatttcaaagaggtgctttgcaggtaataaatatgaagagaggattttgatcttattctatgataaaccagcatcgtcgtctccgccttctcagtctgccgcgccgcgccatggttgatctgacgccgaggcctccatcgtcctccgccgctccgcgcaca

SEQ ID NO: 35348 - DNA, 1501 bp, Oryza sativa
ctagattggtggaggctgtagttttcggttgcattccagtcatcatagctgatgatattgtgcttccgtttgctgacgcaatcccatgggacgaaatcggtgtttttgttgacgaggaggatgttccaaggctagactcaatcctcacatccatcccaattgatgatatcctaaggaagcaaagattactcgccaatccatcaatgaaacaggccatgttgtttccgcagccagcacaacctagagatgcattccatcagatcctcaacggccttgctcggaagctcccacacccagacagtgtatattaaagccaggcgagaagcatctcaactggactgcggggcctgtagcagatctgaaaccttggaaatagaaaagctcacatgaaaaactcggctttgatgttattgtgaagttttaagttatgtccttttccactgaggagtttctagtttcacatagctagatgatatttatcaaagttgtatatctccaatgtcgctgagctaaatgcctactctgtggaagtgagtggaacagtttgtagctttgtaattgtataaaaaaaattaaagcaatgaatgtcagaatttgttcttgtgttcactaaactagctgggtgacccgcgcaattgcgcggctagcacccatagaaagttatatatattttaatatgattttacttaaagtttattaaatagttatctcgttgttttaagactttgaaataccaaaccttataatccttgtgtttctaattttatagtttttaaaagtcacaccgtaccccttacttctgtcatatctttctttatttgcttgttcgacctagcactatttctattcattcttcttgggacttttaaaaattggatcttatagattttatagtttaatgtcccattgggtttcgtttttataatttctagaagttctgtcaaacgttgccattatattcctttacggccgtccactgcctctcctattgattgtcattggcattataaaaattgaatataattatcatttaggttcattttttaactttctagaagttccgtcaaaacgtcagcgactttgtcactgtacttctctacgactcgcttgatgcctcccttctttattatcattgagattttaaaatcaaacatgagtattattggttttttttacttttacctctaaaaattggacctatagtttttagagtttattgtctcgttggatttcattttttataacttttacaaatcctgtcaaacgctgcactatactcctctacgacccgtccgccgcttactctttattgccattaagattgtaaaaatcgaatataactattgtttgaatttatttttttactttctaaaagtcccaccaaccatcggcggctctgccattgtactcatgtatgactcgcccattgcctctcatttttattgtcattgagattttaaaaatcaaatatgattatcattggatttttttttttgctttc

SEQ ID NO: 35349 - DNA, 1501 bp, Oryza sativa
tcgctcaactggctcagcttgtttgtaaatatttttccctttacctgattcaaagttgggatgctgttgctaggcgaggacgtgtcagcctaacaccactcagttcttaggccgaaattctcctctaatctagtagtagtacttcaaccatggatattcatatgcaattgcaagttcgacctgataatgtgcattgtacaacaacacccgtgctcttagaatcgcacattcgcactgatatgcttttttccccctataaaaaaggaaatccggatgtccaatactagtttgatgtaaattcagtactgactgcaatggatcgctgattctcgtgcttatcgaaggaatgtaatctctccgcgccagcaaagggttgtgtgaacatatagaaatgttgaattaccatttagcacctatttctcctcctcttccgtttcttttacttgttacatagttaacatttgatagttttaagacaatcatatatgcttgtgctacctgcagacctacacttgttatgtcattgtctcattgacaaagtcctatccaactaacgttagttattgtcaagatactgtgatctgcttggagccaatccaattgtgcatataacttttccgataatggaattggatccaattattgtttctatttaatacaataattccaggataaacagttaccccataaatgcaattgtgccaaataaaagagaggagaatctacctgagttttttaggagagtggtgcattctgagtttatgtttcagagaacaacagaattttcgttcaattattcatgatttattgaaaatgaattcccctaagcttgtattgagttttacattctttcttcttgttaacatttatttccaccttaaatattacttattaattatatggggaatatccaatgaaaaccatcaaataagcggaaacccgtgaaaaccatacctaaaacttttctaaattcatgaaaaaaatactagatatagctatagacatgaaatacattcataccaaatctcaagtccaaacttagcttcatttgagagaaacaaaaaagagaaattctaggtgaatagtgtcatgttaccattcacccaaaatgtcttttctgttactcctaaataaagttgagtttgaacttgatatttggtgggaatgtatttcatgcctacatccatctcaagtattttttttcatgaatttatgaaacttttaggttaggtttcatgggttttcacttatttgatggttttcgctggatatgtccccttattatattataacttcatgactggttttcttggaatctgcttatcagttttatgaagatagtactatgtgcttctactcaaccaagatcattgacctgcaggaagtgctggtgatgtgctagaagacaatccagttgggcggttgaaggtttttgtttatgacttgccaagcaagtataacaagaggatagtcgccaaggatccccgatgcctcaaccaca

SEQ ID NO: 35350 - DNA, 197 bp, Oryza sativa
tataatgacatgttaaacaaaacatattaatttaccttctaatcatgtcacctaaatcaattaattagaatcaattacggtacaaggtgggaatttctctaagacgtaacagccaatgctttcccatctaacctgcaattaccatccaagcgatatcacgtaaattaactggagtcatatacggtctctctctccct

SEQ ID NO: 35351 - DNA, 1501 bp, Oryza sativa
tctaaatcggaagatgaattctaatcacttgggtggagatccacctgtttattgcatgtcaactaaatggttatgattttttttaaaaaaattttgacaagatagatcaatatgtaatattcactctgtaaacatgcaagttcagattcaacatttacaggttgtaacaaaaataaaaaatataattgcaaatataccttactaatttgagttttattttttatttttgttacaatttgtagaagttgaattttaatgtttgtggagtgatatattacatattgatttatattgtcaattttttttataattgtttagatggcatgcaataaacgggtgaacatccaccaggtaattaaaagagtttcccctctcaatcgtgacaggccgtcttgcgtgaaaagaaaatcacacggagtcctccaaatggcccagagctactttcatattccaaattaaagggtatcaatgaagtacctacctgagttcgccttgatctagcttgggtttagaatttggtgcatggttcccttattgtgtttatttatttgtaaatagaaatttaatctaaattgaatgtcacaagctttggattcctatagggttttagaacacataaattttgggtttgtgcactggaagaaggacataaaacatttatagaaattttgaaggaagttatttaatttcatgcaagagagatgctcgagagggaaatcaagagagcgcacgagctgacgagctaggagaaatgaagaaaaaatttctaatgatcaaaatcctccaaatttcatttgaatattcttcaattatatcctaattaataatagatatgtattataccgttccactatatagcagcgcatgttatctcagagcaactctgaacagctaaatccatgaggaattaataacatgaaaaaacattcatacccttgtttttttttaaatgatcctataccttgcaagtcgtacatataatagctcacaaatcacaatctaatcatgtaggtgggatctaggatgtgccgctggttctcgtcttttagagttttagagtttgtgttaagtattcacgggggtgagagtgtggtgttgtgtgtgtagcggtgcgtgcgtctgtggtgtaaaaagaagagtgtgtgtgcgcgcgccggaaggcatgtgcacgtagggaaattaacaaccacgtttgaggtatacacgtaagagggatgccaaggcaaactcaaagactttctccgcttcagtttgcttcttttcttcctccatatcaaagcaaaaagatagtattctcccgacgagacccatatcgatcatatccattcccagtatccaacttcgaattaatctcgagcgattatatttctcctgtggctccactaattatctagtactacgtattttttagcttgataattagctcaatcaatcaagaaagcgatcgattcagagagctagcgcgaagctgaccaagatctccaaagcagcaaactaatta

SEQ ID NO: 35352 - DNA, 1003 bp, Oryza sativa
cgtggaagcttctagaagtcgcgagagcttgatcgctggaggaggaagcaaagggaggcagcaaaaaaagggggaagagagaagggaaaatgcaaagtggtgggggggattttgttgcttgtgaatgcaacaaaaaagagagagagagagagggggaaaagaaattgtcaagtcaaggtggcaagcgtaggtgagagcagcgcctccattgaccaaatgaccagctgcatcaggacatcaggaggcactaatcaagatttatgatgttgctaattcgtcattagcatttacttaattactacattattaggaatttagggttagaagatactactcctatttaagaagcctcaaaactaggtgggagcaaccactaactgcttgttgagttggaaggggattactagattagatctgaccacttcagtctgttaggtaccttaggtaggtagaactgaaatctctgctagtacgacggcattaggatctagcaaatcagatccatttacggtgttactgttgcgttttttcatattagccgggaagtaaggttttgcttgtactatccgagtacaaaattcagggatgaacatgtatgtactcgtgtagaggacaatttcgtcttaattaaactgatttattgcatgtttgggcattaattaccatacccaaaaacagatcgttgttccggcacaagggaatattattatgttttccgtcatttcaggttcttgtttaagtacagctactacagtttctccgacggcgagggttcagaaactaatactctcccgtctaaatataaattattttggagggatatgatacgtaggtggtgtttgaatcttctaaagataaagataaaaattaaatgtttcacgtaaaacgaggtaataacatgtgactaattggattttaattactacaaacttaaaaaaatggattaatatgatattttagaataacctttatataaaaagttttcgcacgaaacacatagttt

SEQ ID NO: 35353 - DNA, 650 bp, Oryza sativa
ccatgtcagttgaaaccatcatccaaaccgtcttaggattaagtttgcaacagtttcaggagttgaaaggcgcgttatattaagtattttggtacgtggatcaacctaagggatctatggtgaacttattccattcaggaaaaaggaaaatcgaaggcctggcccaaaagggcaggcccatagccatagcagcacttgccacccccccccccgatgtcctgaaccactagacgatagggccatatacaaccgctcctcattatactataatgatagtatgagcagttttttggaattgtcgatatactcgaagagtataactagatccaaagcaaggagtccttcctacttttccattatgcttttgtaggattttttttagttgatggttaggttaattcacggatcatcccctactttttagggaaattcgtttataaaggatatggaatcccccccattatgtagggtttctcctccttgtttatccatctgccgccgctcgcctatctacgctgccggggcacgcaccgcctccgatctgccgggtacgctatcttctctcttcctgaagggctctagaccctcccttcttcttctctgctatgcacattcttagccatttcatttacttgtttgctggcatcaga

SEQ ID NO: 35354 - DNA, 1501 bp, Oryza sativa
tggtaattaaaccagaaagaaattttactgaagtatcaaaaagaggcacaaatctaactatggatttcaacaactacctaatgcctggctagattaattactaataaaaaccataatactgaacactatagcaagctttcaaacttgcattttcaatattatcataccaagcttatctttgctcagaacagtgatcatgtagagaatcatctaatatttctgtgctgtggtatgaacaaggagatctcacacatgagtatacataacaattctaagatagcattcacaaggacttacctaaaagttgctctatctgagtgtgggtcatcaggaaagtttgcgcgtgaagaaaaattgcacataattatatgatccagctatccactaaccaagcccacacgtgttcagatgaagcatctcatatgccacatagacattacgcatgactatttacgtatctggagtgagcacaaatcaatcaaaagagcgttcacaacgaattcgactcagttgaataaacggaaacacaccaaagcataagcataacatcaatcgtggaaaacttctaatatccaatcatccctctagccgctaaactaaaatacaaatccaatcatgcgctcgcaggctaggaacaaacaaggtatgaacagagaacgcatcaagcatgcatggattacatagagatcaacgagctccggaagcaggaaagcatccaaaaaaaactaatatcaaatcaccgatcaggaaccaaacaaccgcgactaccgggatccccctccgaaaccctgggagagcaggaagaaaagctggatcccccccccccaccccgaacccacgcagatcagagggcgggaggcatgcgggccgcgtacatacccctcgaagcggcgaagaacggggaatccacggcgaagcgcggcctctggggctcacgcgagaattcgtcgtcgccggggagggagcccccggcgagcgggcccctggcgccggccgccgcggcggggcgccaggcgagggcggtggtgaggcgcctcccggcgaccctgagcatggcggcggcggcggccttcctctccggcgggtggatcgggtgggtggagaggagatcgggtcgaggcgaggcggcgtggtggcgtcacggagtggacgagaattgcaggaggagagagagaaaaaaaaaacaagaagggaaggggagcacggaaggatgctggcccaggcccagtactcgctgggccttgggctacttgcttacgtcggcctgattaaccctcgtgatttttcttttttttttctttttttactggttctatctaactagttgttgacttgtttccttggaatttaatgggttcagatcggaatggctcaagtgatcggtttgcgttggcgtggtaaggaacgtgccacgtgtgtctgttgcagcacacgacttggccacgtgcatacggtgctgtttttctgtcaaacgaagcatctttttcttatggttgaaaaa

SEQ ID NO: 35355 - DNA, 157 bp, Oryza sativa
gatgatgttggtgacggggtcggcgaggccaaagcagtatccgaccgcgccgacgcagtggaggagctccggcatctcctcgaggggtagccggcgcgccgcctcggcgacgtactcccttatggactcggatgatttgtcggccggtggcagccat

SEQ ID NO: 35356 - DNA, 324 bp, Oryza sativa
cactataaagtattataataacctatggtctggtttcaaagttcaagttgtaaaatggacaattgtgccattattttgtcacctgctgctattttttaagggaattgaaacagcaaatgacaattatgagagtttcagcagtatcgcaaatacaaagctgagatcagtccatctaattcctaatcttgtgtaccaatctgaattgccttttcaggccacccttgtgaaaatggtcaatgaagccactgcaaacattccagggtgggacgaagaaaggtgattaaatggttttgcctcgctgatactcaattcagctgatagtgt

SEQ ID NO: 35357 - DNA, 1501 bp, Oryza sativa
aggctcaaaagatcgtcacgcggtttccagacgagttataaaattagttttttcattagtgtcaaaaccccttccgatatccggtcaaacatcttatatgacaccaaaaaattttgttttcgcgaaataagtaggccccctgagtttgctgtcccgtttgcttttcatttttcgctcttctaacgcccccctgagtttgctatcctttaaaagaaaaggagggggctctaaggcactatgttacacaattctttcgctcctgtcatggcccgagtctttggctcctatttgttctttgcgaccagacatgttgctgacggttctttgcgtctaaaaattgctaattttgctccttccaaatctcccatgatactagaaggataaggctacgcaagcctttctttggcaccccaggattggaggctagacccatccaccactcatggcctgtcgcatggttgttccaatttgctggcttaatttactcgtgggagattcaagttgatatcaatccccaaattctcttcgtgtacctacattccgccgtgaggtgcatagccatctctagggtatgctagcagagtggatgttgttctgccatcagcgggtctcgaggcgatctgacgtccatactctgttttagatgataagctatacaaagaacttgcattttctcggtgcccaggacttccatatgattgttgtgtagtttctgctttggatctaaggaaccacactttgtatgcagacatcgttatgtactctccatgggttgtgagtttccgtgtgatttgatctagttcggcgtcaacgagttgcacatcttggactatgttctatagggagactagttggtctaggagctcaactagcatgtcaccattgactgagaggtcaaggttttgtatgcatgtctcaccttcgaatgctttcttaagcgttcttttttccttgtggatgttgtgtatacctgtggtgccaagtctttcggccttcttcttggtagccatgcggagtcccagaaacgagctatggattcgttccctagggatattatggttgtcgccacaaataggagtatgttcgtgtagtcgcatggtgtcctagtcccccatccaagtcttttcgggggcattccattactgatgaggactagggtcccgatcttccgataggtactgataagacaattgtgaagactcggcattgctgatccaaaggctccgctcaggcactgatatgtatgtcatttaaatagttatgaatttttttaaagaaaaattaagaagatttattaacatatgatatatcactccacagacatgcaatttaaaattcaacttatacatatcgcagaaaagataaatttgactataaatgtatttttagtttatacgttaacccaaatgcagatgatggtttgagcggtggcatctaggagcggcaccgatggctcggaggtggcgagctccacctctgcccatctgcatcatcggacaca

SEQ ID NO: 35358 - DNA, 346 bp, Oryza sativa
agatgggccgagagaaattcggcccatcgaccccggggaggcaaaatagacttttgcggagggatttgatttggaagtatttggattcgggattgaactcgacgatagatcggggatttgagatctgagatggcacagacactaaacaacaagcaaggaaacaatttcgcaattagggtttttaagagataattttccagctaggcgccacgacggaacgggcgctacagatttcaccaatcttggagactaaaatcttgtattgagttttcaatataaaagattgtatacctattaataattataaaaatatccaatgcacagtgtaaaatcgcccttccccagg

SEQ ID NO: 35359 - DNA, 449 bp, Oryza sativa
ccgttttgtattgagctatataaaaggagaacttttacggtacaatatactatagaagggcatgttagaaattttatagaaaataaaacaacactttagtaattttttgttcaaattaaatctaattgggagtacctcgtcctaaatcttatcatacactagggaaggaacattctaagcgccatttgatgacaaaacacgtgacgatagcatgatctgataatagaataatgaagaaaagacaaaattaccctttcaaacattataatgcaatctaattaactaaaaaatcaaatcaatctacactattagatcatatatacttgtagtatattgtaccgtaaaaatacagtataaaagagccagagagatgtccttgaaaaagaaatagaacaacaatcatcttctctctacattctctattgccatcgtgctgcgttgccataaga

SEQ ID NO: 35360 - DNA, 1501 bp, Oryza sativa
tgtcaattgccacaggtttgtgtgtttgggagacaggaactgaacggaggcagtagtggagtagcaggttcaaaggaggacaagggtgacaccctcatctccccagcaccatggaaagctaaggggtaaggtattcagggatagcatgcctataaaaatatgtcaagttgtcaacacaccaatgaaggtggaaaatgggatgagaagtgagtagtccagtatggacagacatggtagcatgttgacaactgatgtggctttctgacagaattgcagtttttttttacaagtattgctctttaacatggtagctctcagctatttggaattcgaatttgagtttgtggttccttgatagaagtgaaaataaagttatgggtttgcaaaatctattcacaataatttctctaaaaatctaatgattcttaactaatcaaaaacagagatgtcatgcaatagtaatgctcatcgtagatacctaacagaccagaataccgatcagttataaactgaaataagaaaatagcaaaactaacaaaatgcaacaagtgaaaacctggagcataccttggtaaagaattcttggtcgcccaaatttgatgcagagagagataactgtttcaacaggttatacagagttcttgtcaaaataaaacacaattaaacacaccctcatcagttcggtaattgcatttctatcagtaaatccaaacaagacataaatttatacaatgcacatgcatcataatagtcatcacatgaagcaacatcacagtattaaatatttgaagtttttggattaactaccaggtcaggtagtatgaaatgacagaaatacttagccacacaacttgcagactcccaagcgttcaggcacaaaatcttactaataaaccacaaatacagtaaatcatcttttacgcaacgttatcaattagaagaacatcagcagccaactgctgcagccgtcagaacatcagaatgttcagtgccgtgtcaaaccaagagcacacggcatgctcagatttcacgcccgctcccaatcatcgtcgtgtaatggttttttatcccgatcaacacgaaatccctcgggttttttctcctttttttttgtttgtttgtttgcaaggctgagaacaggtagcggagtaaattagctgaggcacagaccacacgcatccgctagtcccgtcgctgcaaggcgcaaaccacgagactcacgcagaacggcgcgaaactggagaaccgccagcgacgcacgcaaccgaagcgcacccggcgcaatggcacggccacccacgcgcgctcgctcgcgagcacctggcggcgcgctactactactactactgctatggtgtgaagcagaattaaaccgcatggatggggcgtgaggcggtgtgtgcgttgtgtgtgggttttccgcacctcgacctgcgtggacgcgccggcgccgcgggagcggaggaagcggtcggccgcggcggacgcggcctccgccgcc

SEQ ID NO: 35361 - DNA, 864 bp, Oryza sativa
acgccggtgtggcgaacaatgcttcagatccgatagtggccagagacgattgtagattaccattaagtaatttgagtacagttgaggtactaccaggtagtagtatttggatttgtaatatggatgcttatgttcagctgaagcatcaacaattgcaacttgctacttctgaatatcaccatgagtttgtcctgattagtgtctgtttcggatgaaggtgtccgaatctttgtgtagaaaatagaagggaaattctataaaaaataggaaaatgtgttgtttaattttggtttcatatagtcatccgaatttttaataggattattcttgcatcagagtgagttagtgtcccaatgttaacctctacttatgtaattcgtgagtttctctgcaaatcttgagcatgggtcaaaatgattgcaatatatttgatgtatgtaattttttgtatcaataatttcattaggaagcagcaaattcatggttgccagtaatggctgtcatttgtagatcttttgaacaaagctgaagccatatccagaattaaccaatggatacaatgcattaggagaaggtttgttttttttttttggcggatcatggatagttgaatcctctatgttgagagtatgacattatttatacttaacaggatagtttgctactttgcttgatatgccattattctttatttcctatgccccttcccttccagagcataaatggtcttttagttcgaatctactaagcatcttctgctattgtcttttagtgtttctgcaattggtttattacttataaaatcatggtgttaaccacctaattttgtttacataatttctctcatgcataatccttttcagg

SEQ ID NO: 35362 - DNA, 1501 bp, Oryza sativa
acaatgcattaggagaaggtttgttttttttttttggcggatcatggatagttgaatcctctatgttgagagtatgacattatttatacttaacaggatagtttgctactttgcttgatatgccattattctttatttcctatgccccttcccttccagagcataaatggtcttttagttcgaatctactaagcatcttctgctattgtcttttagtgtttctgcaattggtttattacttataaaatcatggtgttaaccacctaattttgtttacataatttctctcatgcataatccttttcagggcaatctacagcatgaacacactggtagcagttgtacgtacatacctaaacagtttaaaaatagggaaaaattttccaaaaataaagtttaagcccgaccgtggggatcgaacccacgaccacgtggttaaaagccacgcgctctaccactgagctaggtcggcttctgaccatttttgcaaaaaccaagaataaatacatattttcaaacaggagaaacgagcacaccgtagccctgaaacagaagtaacctggttttcctctattcctttgttggttaccgttcatctattcaactataaaaatccatttttcaaatatgcacgtaatttcggtaaaggctgtgaaaatatcaaggtgccctcactagctcattttttcttagggctttcacaatgtgtataggtgtcatttagtctcagtctcctacatcaaagatttcacgccacatatgcttctctgaccaagtgaagaacggggagccaaaataggtcgtgagtttctcgtcagggatttctcagggaagggagaggaacggcgcttgcgcggtgatcgttccaagctgcattgtcgcctccaacatagtgcgggagatttgctgggggaaggagatgattgaggaaagtgattttcgtggtggggctggcttgagaaaaaaaaattggtggtgggcccacctaaagccatgcgtgcaccagggagatgggagcttcatttgttttgggagtacctatacatctttcgaaagatttttataatcatatcacacagatttttaatctttatattaaaatccgatagatataataaaaagcaaaaagcaattaagaaacaccataatgaacattaaattaccatatcctcaagaaaaagaccaaatccaatacaaaatttaaaatttacatgtgaagattcaaaaattacagtgtaacttacaaaagttacagtgtaagtttcataaattacactgtaacttacaagaaaatgcactgtaaattcgagtgagaaaatcgagtgagagataagaaaaaatctttcgagtgagatatagcaaaatcgtttgttttttcctacctggagagttgggcttcttgttgaggcccggacgtgctgctattacccttagggcatagacaatgtatagagatcaggttacatacatacatacatacatacatacatatatacataca

SEQ ID NO: 35363 - DNA, 373 bp, Oryza sativa
aggctagcatcaaccgttcaacctagccttggatgacttgaatggcagcctagccaagcccaaactctgtattgtgatggatattgtctgtatagcccagagttttcataacacaagggagagatcacactaagcttccccttttcgggtttgcagcccagctcgtgaggcaaggtcacgctgctgctgtaggatcgtaaatgatctttcccacctcaaaagctagccaatgagggatgggctcccccacttatatattaagtttcttgtccttctataaccaatgtggactattcaataatctccccccttcatatattggtgtccctcagccgttcaccaccccttcaccgtttccttatggtctctcagg

SEQ ID NO: 35364 - DNA, 174 bp, Oryza sativa
tggaactcatcgttggtgccttcccatctcgtccgaactgcgacagatggctattgtggccggcatcctccccatcccatgccacctcgtgatgtctaggctagtggtcggcaggagaggagcaaggcagcgatgacaatttctagagtagctcccggttgatcctaccccagc

SEQ ID NO: 35365 - DNA, 255 bp, Oryza sativa
gcctatttctcccagaaataccataatagtcaaacggttgttaacaactcttcgttaagttgtatgaaaagacattcttaccctccagacaaccatttgctcacacaatatcattttgtattgtttgctcacacaatattattttgcattgatccatatttatgttagcttccaaattcacggacatcattattttgctatcaatcaaattatttcataatgcccctgtgtcgttgcctgccacctcctcgcagc

SEQ ID NO: 35366 - DNA, 1501 bp, Oryza sativa
cctaactatgccttcctggtgtttcgagagactacccctgattgccgagtttcttacggcaacccatcatggccattcatcggtaatgaatacggaggagtacccataccagaaaattgtcttaatactatatacccacgtagaggaatacccgtaacgagctgtcaccatcagcagctcacctctaccaaggttgtcaggatcgggatactacatagtatcattttgtttaaagtaatatcgtatcgtagtatcaggatactatgatattttcttttttaagtttaattaatatttatattaattatatatagccattctatataaaaaagtagtaattatatatgtcatgcaaatagagacatttatcaagagaaaccacgttggttttgatatatttaactgatttttatataaatttgagcattttatttacattattttcaaaccatgttattttaaataatattttgtagtatcgtagaatcgggataccacctaaaatttcataggatcgtgtagtaatgaatattaggatcgagatactataaaaaataggatactaggtgggatcggtatcatttcggcttggtaggatcgtagtatcgtaagatactaggatacgaatcaggatactgacaaccttgacctctactgcctcgtggcatataataccaattaatgatatgtaataatttaagcaccacactgacattactaaatagtactccatatcgctgcagcagacgtagagcaatcatcgaaatgaatattaaaccacaccattgcatatctctggtaagttagccacatcattatatcgagacaagtataatataaagttggtacttagataatataaatgaagtaaaggatcgaagctatataaagaagaatatttcactaataatagtataagtcttacaaaagaaggaagagctactagagccatacctgaaatctcctgaagattcaaggaaaatattctattcctactccactagcaatagaacagataactaaacttgagagagctcttgattcttcttcttgagtgtgtgttggagtggagtgaggcctactccttaaataggttgccaatgacagttgtggcggttgaaattgtcggaaatggcccgcaaccgtcattggggagcaatcctggacatccacgtggaaggccgggatgagaggcctcggctaaggttcgaccaaacctggtccagcccctctggcctccaattttggccgaggacttccttgttaggacttattcttcgtgacatggcagttgggcttatttgcagatgttaaataagttttgtaagcccaagcatcataagtctaccagtcggcggtcattgattatttcctgctgattttcctccgtttatgtagaggtcgttgtgttcaaataaaatttcaagcacaagtggaaatagattatttctaacaaattatgcattgcaagcatagctagttctcctttattccggttata

SEQ ID NO: 35367 - DNA, 1501 bp, Oryza sativa
agtttttttttgaagtccctcaagctgcgcgtgcgcagcaactactcttactcaaatacttggttctctagggtccaatcttctattgattttttttcattcatttcagcgcttgtagcggtaatccttcggataatcttgaagagcctttatatatagtatatatatattcactctgtcctaaaatataaaatataagtacttttagactctaacgcggtctccgaaatactactttgaccaataatatctataaaaataaataaaataagttatatattacgatagtttatttaacgataaatctagtaacatcaatttcacataattgattattttctttttgctattaatagttaaagttgaaaatgtttgaacttgtcactatgctaaaaatgtttatatttcgtaacggagggattaaaaaaaaacaacggacggaaggttctcgttgtctaatcatgtgccgcgtagtaacacatatatagtcactcactgacatctctaaaattcagccctcgaatcatatggaaacatatggaaaccacatgactttccatcgttgtctgctcaacacaccgttggttgggagagtataatacgtacgactcctgagactttgcttccgacctgctacgcgataacaccaaaaacaattactttgggctcgtttggtttggagttaatttttgccctatcaaaatcttgttagtgtcaaaatattgacaaatattgacactaccaaattaagtagtattcaatttaaattattatgagtaaaatttgatagcaaaccaaacatgctactattgaaattagtaaaattttggtatggtaataatttagaatcaaaccaaacaggcccttcatttccatgtcgagtctcatgctcacttaacccacaagtgaagtagatcccaaaatattactaggagaaaatttaacccatcgtagaataacgaatatggatagacctctgtctagattcatggttctaggatagattaaatctcatcataaattgtaaaattttgggatgaacaaaataactacatagccgaaagttcaactgatagaaaactaatataattgcaataaaaccgagcaatcaaatgggtagggagtagggatggacagaaaggtcatgacttttgttagctcgctcagtttagctcgactcgtttcattttcttaaagagctaagctgacatttaagctcggtatagacaacgagccagctcagctcgtgagtcttaatgagctagggtagacaacacctcagcatgccacaggtgggttgtttctgcttctgggctgtcggcccaaacaaagagtaacaaaacacgctcaacccaagccactaggcaccagcgccgctcgtcgcccgctcattacgctggcaatgccgctcacgaattttttttattaaaagttttacaaaaaataattttctattttaaaaattaataaaagtggtcgcccgccgccctctggatcgccc

SEQ ID NO: 35368 - DNA, 1501 bp, Oryza sativa
acatagaagttgattgatggaataagtgcaacttccattcgccccaccatctgtcaaatactttgctcctaaaggttgctagctttatgttgtcaatgctgcctagaggaggtccttggagattgagcagccgatccatcattaaagttgatgagatttctcctcggcattggatcttatcggcaaagaataagccgattgggagttggcccattccaaattgcctggcagaactcattggatgataaaactcataggaaacttggatgtttctcccttgatgaatgccgacgggaaggatgcacggagtgattgcaactgtgaagacttccctggatttttggtatctttcatgattgatgtcttcgaatctgaagtcctatgggagctcgaggtctgttgagtctccataaagaaaccacaaactcgagcatctttttgaataccctcatagaagctgcaaaaccagtctttgagcagttcggctgataactttgctccagcatcggccggtgtggatgcatattctccatatgacatacatcggcgatgagtgtgttcttctccatcatcatctgtgatcggctccagtcttgggaattctgcttctgtcacggatggccgattgacaactttcatgactaccagatttagccaggattgcagtagccaccatggtccacctgctccgactactgagccgacagctagcttagccgatgcattatttagcatttggtacaagtagccgaggaggattttgcctaaaggaaattgtcttttcgtttccaaggcttcggttacgaactgccaattggttgtaggaccgcagctggatccacaaaagagaaatttctctagccacattaacaagaaagccacatgttctcgaggggtgatcgaatcctggcccatgtatgctgctacatagcctgaccagccgcctatgctcttggtcttgaagtcgtattgattctttgtgtttaagcccatagcgttagccgatgaagtgacgtccaaacccgtaatcatgctgatatctatgagagttggagtcatcggcccatggttaaacaagaaggcattgatggtgtttgaccagaaataagaggcagctgccatcaggggttcgtccttagctgagttggctatggtaaggtcgagtgcttgcccgattccgatttcgtcctagtgaactcttttgctggccgacatgcgcttgaaccatgtagtccaaattttctcgggtgaagttttctctagagacggccaagatttaaaggtgttcttctagtggcttagatctgggttggttaatctgaagggaatcctattggtttcacctatgatgaactcagtgggatcaggattgccgactgggccgagaaagtagtagatttcatgcgatagactgggaatcacaactaggttggagagatgctacaaatccaaagcggtcgagaagaggaaagcgatataaggcaaaataaaattgatttgc

SEQ ID NO: 35369 - DNA, 348 bp, Oryza sativa
gcccatctccccctccctcccggcgctcgctctatttctctctcgctctctctccctcctcttcctccgctccgctccgctccgctccgctccgcccgcgcgctgcacgcgcgagcgcccctcctccgctccctccgctctgtccgcgcgtgcgtgagccgccgcgccgagcgcctccctcccccctccgctctgcccgcgcgcgagcgcgtgagccgcccgcgccgagccgagccctcctttctgctccctcgctgccgctccccgcgcgtcgttcgcgtgcgcgcccgcgtggtcgtcgcccgcgtcgcgtctgcgccgcccggccccgctgccctgccgcgcctg

SEQ ID NO: 35370 - DNA, 1501 bp, Oryza sativa
gaatagaattagttaaatcaggtaagatcggctgaaactccgatactaatctaatcagcaaccagaaggcaggctagatattatggttctaagcatgacttaatagatcaaactcaactaatgcagcattaagtatgaaaagaacaacaatatctagacaatcaagccgctggatgtttcatagagtgatagatatatcacatagtctaagtcaacatcgttatttaacctaatcagctgccttctattgacaaatgctagccgattataggttagatcacgatattatcaaagattatgtgagatatatgatagctcgacgaattacataaacaagattagagtgtcatgaagatggaagcactaatctcgataactcaagtcgtcataacaagttttacctcttgttgaagatcgaaaccgatgcagctcaacccgaaagcaagaactcctcgaaacaaagcaaaagtaaaagggtggcgatgcgccgaaattgtattgaatgtgtgttcatatttacatagggctcggggtctatttatacccgagaattacaagatacgtccataccggacacgactattatctctaacaaactgtaagataccgtaagtctttgcggcagacttttgcccacatttatctctaaggaatttacatgaaatatcctaattaatagatacaattgccttctcaggactctatccatgtacgacaatcatcttcaagcacatcaactcagacccggcgtcataaatgagtcatattgtcgtaatcggccgtatcacttaacctagtctgactctgacttagccgacctcatccgtggccgatctggactcagccgattcatgctctgttcttgaatcgatcttcacctctaactccgcttcgatccaaccaccctttccgatactgatattaccaaatttggtcgttaacacatgccccccaagtccgggatatttgataatgtttcggattggctgtatacatactccgaaccggtttcgcactttgctgttttctgaccgttatccaagcgctttaaatactaaccgctgcccctgagtaatctcacaccgttactcccgttttcaccgctcaagcgaagctctaccttctctctctccggcgattcctccggcgcaaaagcgatttccaagtgactccatcttcagcgagatctccgcccgcagcgatgtcgtcctctgccagcccatctgatgcgccatcagccgagtatgctgaggtaagtccccatcggctcaatcccttttcttagcagcaaatcaattttattttgccttatatcgctttcctcttctcgaccgctttggatttgtagcatctctccaacctagttgtgattcccagtctatcgcatgaaatctactactttctcggcccagtcggcaatcctgatcccactgagttcatcataggtgaaaccaataggattcccttcagattaaccaacccagatctaagccactagaag

SEQ ID NO: 35371 - DNA, 1501 bp, Oryza sativa
caaatttgtcacatttggttcaaatttcagccaaaatttccaaaattcgtccattttggtggaacccgaatttttgttgctgtaaccggattccaaaacctctggttaataacgaagtagactttaaaagctgttcctttctgtttacgatgttaacaccaagaaaaggtctgaaaagagatagaaacatggctggtaagttcaggctttcagcatcccaaagaaaatggatgtgttcttacttatatttcaatctttactgtatgaaagaacttgggccctgtttagatcccaccgcaaaaattttcaccctatcacatcgaacatttgaacatctgtatgaagtattaaatataggctaaaataataactaattgcacagattgcgactaatttgtgagacgaatcttttaaggctaattgctccatgatttgacaatgtggtgctacagtaaacatttgctaatgacggattaattaggcttaataaattcgtcttgtggtttattgacgaattttgtaattagtttttttattactgcccgaacacccatgcgacgctctatataatacccgatgtgacacgtcaaaactttacacccctgaatctaaacacccccttggtggtgatgagtatattatcctaccaccacctctagattggtgggatgctccatgagtggataacatgttattttcagcttatgacttatggttggttcccaaactatccctagacgccgcccctagtaccaatactatctgtaaatttctacaccgatattgcatagatggcttgtttgaagctatttctaaattttaaaatatatattatttaataatccttataaagaattgttcataattcaatcaagtatatatattagtaatgccacaacatgtgcaagacaacttttcagcctcgtatcgctcctaaatatctagttcctttgtcctaaaaagaatcaatttctgaagaggagcatttgtcatagaaaaaagcgatctgtgatgcattaaatgagatagcagtacagtcacagcagagcaaccaggatagcagtctacccacttgttcacgcaaacttctctcctctctctctcgtttctctcgtctactccctctctcattcacacacgcactctgcacgagagtagtacttgtgcacggaagtttgtttttttatttgaatgatggaatggatgttgtacttatacaagggtattttggtctttgataatggtagctaaaattacctcgggcatccaggaatcactatttttggggacagagggagtatgcacagacaacatgtcttagaatcaacttcaggtcttcagcaaatccacattattcatatcaaaatattagactttacatttcaaacccatctcattcttaggataggtgggaaaaaatattttcctgcttatccccgatttgtccaggactaagtgtctcttgacaattatctatctgttatttttctcgttagtactc

SEQ ID NO: 35372 - DNA, 1501 bp, Oryza sativa
ggattacttcagtacacacgaatctgctcgtgctaattggtactgataatgttggaaaaccgtgactctaattggtgttcatgttctgcctgagattttttcagttaataactttgttctatctactttgttaccctcagattgcatttatgtttctttaattgtaggtagtacttcagtttgcaagagatgatgatactaaatttggtggaagtcacttggcagttggcacaagtgctgctggcaagagacaggaggctgactggagattggcaggtacccttgtacaatgtaaagtcacccatccacaggaaccctgtgcatctatgatccaagatccaacacttccgcagaagtggagattgggattcaggagatgagacctggaggcctactgagttcacaaaatgatggcacagtgaatggtccggcattgtcatatcttcagcttgacattaacaagttttgcagagatagctgtctcttgttgcattggaacctgcgaaattgttgtaaattgttgaggatgatagatgtcttcgtttcagtatttcagtagatgcaaatataatgtaagatgtaattgtaagtgttgatcctggtacctgacataagttaggggaactacagctctgttttgcagctgctagtgtggtcgttgtgttataagtgacatttgcagtgcaaataaaaggatgtgattcgaatatttgttctatattcccagaagtcagaatcatatcacatatcaccactaaggtcaagatggtcttgtgatgagtgattgtgagccttttgttgcatgtaatcacttcagtcaataattcagtaagaatggtgcatgcttataaacattgctcatggtgaatctgaaactgctgtttccggagcctgttgtcaattcttgaaggattatttcattatatccatgttatgcaaaacctgaaggatcacaacatgctggctatatccatactgacaacattaggtgttgtcagaacaacaccggagttataactgaatgtttacttgggatatttgggatatttatgactccactcataaagaatcagcacttcactgaatctgaaagaaagaacttcattgaatgtgcaccactcaagatgtttggcagatcaatgcagtatattgattttgaatagggaatataatgattgaaaagggagtatattcattacttacaataatgttacttacattgagttcaatcaataaacaaataactcatctatgcatagattagtcaataaactaaggaacatctatctactctgcctctagtctacagattacaccagaatatcaacaaatctcgcctttgcgctactgattacagctcttcttagaaagacaatgtcaatgccagtgttcttggtggcttgctatctccaggatgctaactaatctgcaagatcgaagagctcgtccatggagaagtcgcagctcgcgccatcggtgctgaagtcgacatagctgagca

SEQ ID NO: 35373 - DNA, 1501 bp, Oryza sativa
tcagaaatggcaatgagaaagtcgggattggtagagcattgtgaaaaatattctgatcagggaaaagaaaggatatgcagattttttatatttcattagctgttttttttcccttttgaaagcagatagatgttcatttttgagcttacagcaaatatatttgttgcagattgctatggcgagaggatatctacagttactcctttttttttttttgccggtatcagttaaaaaaaatatctgggtaaagcagggatgttctcttgggagatttgagaaatcctgacagcaccatggttttttccccttttttttaagttatgcttgctttgctatagcagatttgtagtagcaaaaaatctggaagatggctaagtatagtgctctacggtagctcaacagtacagcagtgagcccttcatcatgtttgataatataatgctaagcatgctcctgcttgtgtagcagaaactacaggtgttcttggtgaggtattaattatgtcccgttcttttctccaacaagagtttaatgaagattaagattttcgtggcacgtttttcaaaccgctagacggtgcttttcgtgcaaaaattttctatatgaaagttgctctaaaatatcatattaatctatttttttacgtttgtaataattaaaactcaatcaatcatacgttaataccatcttgttttatgtcaaaaacttaatctttatattcatcttcatttttaggagaaaaaaacctcacctaaaacttgcgtgtgtttgtttgtctaaagaagaaaatattagaacatggtgtggagttcctaacgtgtatatggtattatctgaatcacgcttcaaacctgaaagttggttgtgatggaatttgaatcactgaattatagaatctaccctgaaaagcacacaagaaaaatggatcatgtcattgctctgtttgtttcctaggttgcttaaaagtacacgacagtatgaacgtgaaaaatacctttagtaactaatacctcacagatttatgaacttgtgatggctttcatatgtaaacaacgattgatactcaaattattgttttcaaataaagacccttatttgtcatttatttatgaagtaaacttcagttgtttaggagaaatttatcgcttttgtaactataattctcattagagatggaaatgaagcaacaatccagtatttttatttttgaaacaacatatatgaaaacacgcattgcacgtgcatgactactggtaatcaaataaaaaccgaaattctgccgtttggtatgttcgatcttggaggcaaatttatttaaatttcatcatcacgattattgcctggaattttggatggatttgaagcaaaatagtatacaaatactcttaaacatataatttttctccccccccaccccacacaccacacacaattaaatattttcaaaattcattttaatttattttagtcactttttcaatggtttttttctttaatatta

SEQ ID NO: 35374 - DNA, 238 bp, Oryza sativa
ccccccatttttccctctctctctctcgttcaaacggcgggatttgcccccgcaaatctcgccggcgccattcatggcagccggacctcccgcgcaggtttcctcccttccccggccaccctctctggacccggctatatttaaaccctccccgcacctcttccgtccgtttccgcctctcgccgccctttctcctcgccggaatagagctcgcgccgtcgctctctctctctgcagt

SEQ ID NO: 35375 - DNA, 1501 bp, Oryza sativa
aacaatgtcacacacaactccgtggcctctagcgttttcatcatcaatagcataccatggatcaccataccggcttggtatgatggtcaaagtctcaaagagtgccatttggcatgtgctgcggtgaaataccctatgcttttgagcaagctagaaaagttcaaaggatgagtcacttgaagccctactatattgccaatttgccattgcatatacatgagttcaagcaataacttgacaacattagttagctaggaaagtttcatgctgatcaaatttcctatttcactgaacgtggaacttgaattgtatgccatcaaattcaaaatttgtaatccagatcatcaagtcgtacaatggcatacgccacatgggagctcatcgaacaaacttcagttccaaaggagttatcatgatttgcctagtggtacggggagctgaaggaagttgggtgaaggctttagaaggcgctctgcatccagtctggtcggaaggtggcctccccttcctctccttcctagcaccacctgcaaactttgtgggcaaaggaagcctttgctacaacgtcagcgagagataaaggtcggcggatcacgcgcgcaaaggagcaaggcaaccccgcgtctacgtaagatggggactgatgtgccccagcacccatcacatgaacactcaagacaatcatttgacttagccgctgataagagccaatccattacaccatttcaaggaccgattacacgtagacgtgcaaagaaactacaacaagagataaactcgctactagctgaaacatatttcaatattgacgagaattatatactacctaaatcaagtactttgctattgcttaggtttacacatgcacaacacatgatgggcatcgacaacgagctagaagatcaaagtgacgatgggttacgtgaagacgacgactgtttatgtcatgctgattttggagtgcactgtctccaaacatttgctccaacttccaaggaatgtgcgacccaaccagtcaactttctccatgcttaatatatatggttggaaagataatcaagtttagtttcacctccaacaaacggctcatcatttcgacttcccaataaggagtaatagacaaatcattgatgactgctaggaagccaaacagacgcgcgagtcttctcgggaattcactttttgtgacctttgagctagcctatgtccagtaaactcccaagacctttcattcctatataggagggttgttcctggtataaatattccctatgttttatcatttggaggacttttgacaatgaaaatatgaaccccttttgttcagctgtgtgctaacaaattcagggagaaatctctacccctctgcttttgtgattttcttgtgagagtacagaagcggcgttcgacgccccccaattggtgctcctggtcccttcgaggtttttccttgattgattccaggttgtgttggttggtaaacttagagtgtggttaggcg

SEQ ID NO: 35376 - DNA, 1501 bp, Oryza sativa
gttgcagtaaaataatattctttctatgatgtttgaaagtataataaaatgttatagtcaatattgtttgtttctggcaatctggcataaaaatgagaaaagaaagtaagactcagtcaatcatattaagcactgtaatcagcaaatgatcgattcaataatatgataaaaactatcgcatatacaacaaattcttttgtttatttatctggatatagtaggaaaatatgcatgtggaaaacatagaacaaattattttgtttatttatctggatatagtcttgcaaattgagtggtatacaataataaaaagtgtgccatattgtgtagcgcagaaccattaaaatgttggctaaaatagctcaaaatgaattatactagcattcatcgtttattaagtcatatcttcttaatgttctaaaaaacgtcatttcttcttaatgaaaggaaacatggagccatggtgattgagaacatcgacatcgcaaaaaatctgactgaagtacagaatgttcttttttccaacgagcatatcgcaatgatagcagagttcaagttaagcttgaatgcttatttgtccgacttgttgtattccccagttcgttcccttgcagatgtcatagcattcaacaaggcacatccggtggaggtatgtatgggagctacttgaattaattaattaatcttgcatcacaaattctcttggcttgaaaaattataagattagatatgaatttgttcttgaaagtgcaaattttgcaacccaatgcagaaaattaaatttgagcacactcttgtttaattacgatttaattgccaaaaaaaaaaggtacgcaagaacttagtgttgtatgacgctttgttacaggagaggcttaaagattttggacaaccctattttattgaagccgaaaagaccaacggcattggaccggtggagaaagcttcaatccaacatctcaataagctgtctgctgatgggctggagaagttgatgaggatgcaccagttggatgcgattgtcacgcccaatgacaacgggagagtcttcttcgccgtcagtggcatgccagcgatcaccgtgccggctgggtacgacagtcaaggagtgccatttggtacttgcttcggtggattgaagggctatgagccaaggctgattgaaatggcctatgcttatgagcaagctaccaaagttcgaatgatgcctggcttcaagatgtagtgtatataaaatttgtgttatataattcacggagctttttgatccttgcccaaataaattgatggaactaaatagccatctagttttgttgtccaattcagggatgccaaaaatttggtagtccagagtattatatgttcaatgtattataataatttataattcaaaaattaaatatctggtaaataggatatcctattttgaaaaaggatggacgctaacgctgatagcgtcaaggtttggttgggacgctgctttctgtagcatactagtgtg

SEQ ID NO: 35377 - DNA, 387 bp, Oryza sativa
tcctgcgcggagtggaggttgtgtgctcccgcaagaattctagatttattaaatcgataaagagataagcaaatagggtagcacatgttttagcataaatggcaatgtgttctaggtcctgcgcggagtggaggttgtgtgctttcgcaagaattctagatttattaaattagaagtgtaaccctttatttaagcattaataaagctctctctttaccctaaaaaaattaacgtgactcctctccctcctttcggtctgtacgtaatcacgaaccgatcaaccacgtgaaccggtgaggcggtgaacataacaaacttcgtccaagcgtatacgtacgtgcaaacataaagaattaactcgatcgaagcgtcgttagcaatgtagca

SEQ ID NO: 35378 - DNA, 1501 bp, Oryza sativa
taaatgtataaagaagagtattctaataaaagtacaaagcttacaaaagaggaaaggaaagctactagagccatacccgaactcttccgaagacttccggactcctgatttatactctattcctatgagagagaatatgagagaactaaactaaacttgagagaatatgagagagctttgcttaaggtgtgtgagtgaagtgagaaggtgaggggtttatatagcctcccaatgacggttatgacggttggaatggtcggaaataccctccaaccgtcattgggagctaatccacaccatccagaagaagccctgcatccaacggcgacgagggaggttcggctgaacctggggccggcccaaccagcccatggtttggctggcggactcctctgttgttcttctccgcagacttgtgatttttagcccagtttgtcatgtcaattctgagttcttggcccatttatacataagtctggttctcgacatcgtccgattgatttatcgtttgagttgatgtcgattctcctccactttatggttattctctgcaaaaggttagtgaacctaatactagtggaatattattattctaacatatatatgcattgcaaacatcactagttctcctctattttggtaatattgacggtcgaaactggtcgataatgaccgtcaacaatcacttcccattcctagtgcgtagatcatccggtggtggccactagagcgcggacccgccgctgttgggcacgggagcagtacagacgaccacggtgacctctggagcgtgaatccctcatcgctcgggaaggagcgacgacggcaacagccgcggcctcaggagcatggatccaccaccgccaggaatgggagcggcgacaacgacctcaacatcctgggagcgtggatctgccgctatcggcttctgtagcaacggaaccgtagtcgctgagcttggcagaggtgacgatggcggtcgagcatgagagcagcgacgacaatggccctcagtggaagtaaaccggaggtagggtttcaatttttggattttttttttctctttttgatgattttttttattgtaggcgggtggcacaacttaaccgcttgcgcacggcacatacgactgcggcggcctctacacgcgtgattgcgctgcccgcttgaaaaagtattggctttttaaaaacatcttggggaggcaagccactggccatttgcgaaaatatgtttttgaccatttctgtagtagtgattatactgcacttgcattttaaaatttttcatctataaaaaataccgaatatcgaaaagctacttggttttcttcgagcaaagagaagagaacatttatgcgacaattaataatggagaaatgggggcgtcgtcactcgtcaggcgtcccactgctccgctgctataagaaacccactgttttccactacttagtgtgcttactcatgggctcatggcgttcgtgtctgaattaaccaacgca

SEQ ID NO: 35379 - DNA, 324 bp, Oryza sativa
tgcctgcaggtcgactctagaggatccccttaatgattaatttaatatgtggatttttttttaaatgttctttgcatggctaaaattaggaattgagctccgaaaaatccgagaaaattccagagagtataattaaccatggagaatttaataaaaaataaatccgtccatgctttatatttaggaaattttatttcccacatttaacttctcttgtaaattaatgaacatttaatataaattctaataataatttattaaataatttataaatcctaaaacgaaaatcaggatgtgacagtcatcctcctcctcgcttcgaga

SEQ ID NO: 35380 - DNA, 1501 bp, Oryza sativa
cgagagatagtttacaatgacccctggtgtacatatttatacccatgggtagatactagtccttattggacaagaaagaaacttacctaaagatataaggaaaacataaaatccttattggacagcaaacacactatcctaaagataaaaggaaactaacatattcttcctaattaatagataatctgctatgccgcatccttcttgaactcggactcttctagataagcttcccttaattgaccaatttccttaaccgaatacaactactggcgactgatagtttccatcggtcgattctaggactcttaagccgatactgactctagggccgatgatgactccagggcttaccaaattttggcgttaacaagtacatagattgggaggctccaattcgaaacaacgaagaacagtgactttaaagatttttcgcaaaatttttaccatgaaaaatctagtatgttacaacttgtcccccatcagtgttactgtagttttttttcgtctcgctactaaaactgatatctcttgttactgcaggactatttttcccctacattgtaaaactgctatgccacctccatgttcaaataaccactgccaagatgttaatggcgaaatttggtaagcccagaagttgtcatcttcctaaaatcaatatcgtctacagagttctagaatcggccgatgggagttatcaagtcaccagcagccggattcttggaggattcagttcaggaaacagatctattcaaggaagtttatccagaataaccgagttaaggaggatgagatatggcaagttatctattaattaagaatagtccgatagtttcctttttatctttaggaaagtgtgtttagtgtccgataaggactttatgttttcctttttatctttaggaagatttctttcttgtccaataaggacttgtatctacccatgggtataaatatgtacacccggggtcatcgtaaactatctctcgatcaatacaaattcggcgcatcaccaccatttttatttttcaacttttttcgacgagtttatacttgtcatggttgtttgcatcggcggggctagggcttcgacaatctgatctcgtcaatgtaagcacctatctatcatatatcttagttaggccctatttgtttcagcttaaaattattgtactctacattattgagtcagagtactataagctggattatactaagccgatatagaataagttgttagccatttgtttctttggattattagctagttgttaggtgttagccacccaataatctaaaaaagcacctttaaagtggattactagattatagtaatctggcttatagattataataatctatcataataagctatatgtttgtttcagcttactcctaataatccagattataataatcctaagctgaaacaaacggggccttaatctagcttggtagttcgatttacttatatcggttgagatgcgctttagtgttt

SEQ ID NO: 35381 - DNA, 249 bp, Oryza sativa
cctgcagccctatttttggttgaagtttttggcgagggttagttttcaaaataagttttttaaaaggaccaaattgtcaaaaaaaaaaaacggtaacaacctcaggtccacggcatatgatccatatccatgttccagctcttggtcagcacatacaccgtttaaacgcttgcacaatcacggccaaatccataacaacaaacgctagcactacgcttgagctcgcactggtagttcacagcatggagt

SEQ ID NO: 35382 - DNA, 1501 bp, Oryza sativa
ccacacgatagtttgtgaaacaaatcatgcatataatttaaaacaagataatttttcaagttaggatcaacatgttcaagggtacacttgcctttacccacgagatcgttagacggaaccttcacctgcaacaacaacctcctcagcaacagcgtctatacgatcgcagaaaggagcaaacaaataaacaaaaagaaaaggcagaaaaaaataacatcaaatgaaataaccaagtaaatcaggaagtagagctcaattttagaataatttaggaaaaagaacgggccgaatcggagtttggatgaaagagatgtgacctctggaagattgaattattggaaaaccatgaataaagaaagagaaatatttagaaaatattctctggaatttctgaaccaaaaggattattttttacgaactggcgggcgtggtccacctgtcggtaggatgacctacggttaattggttacaaggaggagagttgtggaccaattacgaggatggctgagatctatttgttgagatagataacttgattgattttgggttttaggaggctagcctgaccagaacgcatgtgacgtggtgccacacaaaatggatctcatcaacgtgacaacaatgaagcagcggattgaagtagggagaatcaaaagcacagcgggctagaagatgacgtcgggctcatgaaagatagcagcagcggtggtgaaggctgtggagttgaagcacaacggcaaggcaatggcatggtggagctcgacctcttggtggcagagagacatggagtagtaggggaaatacgagtagtggcagccacatggcatggactactccggtgtacaaaacagggatgtcggtgcagtgatttaggaatggaaccatcatgaccacagcagacaagtggtaggaacggtggatcgttaacggtgaggtggtttcaccggcggacaatagcaacttgacaagagacagtgccggaggcagggaagacaatggaagcggaggataagagcagtggtgctgctagggccttggagcttaccgaccgcagcgacattcataggaacgtaatggtgacaatgtggttcagctcgggttccattgtgacagcgaccatcgtggtgcgcaaacagatcggtgatgactgacggccacctttatgatcacaagagagagaggtggcagcaagaatggaagattgaattaatagaagatagaaaggaatattctctcgcgttttcaggttgattggaactattttgtgtaccaactggtgtggttcatatgtcatctaaagagagagattaacagtggtgcacgcacatgcacactgtgggcatggtggccgaggcaaagcagcagtacgacagcatttggacatgtgcgaatgaaaagaaaagaagataagggctctgttaaatacatataaaggaggaaggttgacagtgacaggggctgctttcgtgatggacgaaacaacaacatatagtgctaccac

SEQ ID NO: 35383 - DNA, 1501 bp, Oryza sativa
taatttgtttcatatgaataaaatttatcttataagtagccagtccggtttattttatccatccatgattgaaaagaaactccttgtcttaagataatccattcatctccccatagaaattcagtggtgaacaaataattttagttacaaaaactgtagactgatttattgtgttcaaaatatttgtaaaagaaactaatcaagcattgaaccattaaaatgatagctaaaatctattcttttaagtatagatcaacaaaatatttcacgtatatgttgtggaataataatatattagaactcgcaatgaaagactccatctagtatatagtaaattatgtcatcatttaataactcctattctccaataaaggaaacacggagccctggtgatagagaatatcaacatcacaacaaatttgtctgccgcgcaggatgttctttattccaacgagaatatcgcattgcaagcagagttcaagttaagcctaaacgcttatttgtcagacttgctgtattccccagttcattccctcgccgatgtggtagcattcaataatgcacatcctgtggaggtaagtattaaagctagttgaattaattaatcattcatcacgagttctaatgccttcaaaattataaaactagctagttgcaaggaatgtcaaataatttatccttcaacgttcgaaagttatacaataatagtgtaggtttaggttattggcaaagaagagaataccaggttaccgattaacaagaatagcgaatttactttatgcacagtgcacggtcgagtgcaaaaattaaaccagcacttgtattttctaaaaagtattgaatacctttcatatgaaaaacaagaagccatgaaaaaataatctttgctgcaggagagacttcaagattttggccagcccgacctgattgcagctcaaaaaaccaatggcattggtccagtggaaaaagcggcaatccagcgtctcaacgagctgtcagctgatggattggagaatctgatgaggatgcaccagctagatgcgattgtcacccccaactctcatgcatctagcttttttgccatcggcggcatgcccgcgatcaccgtgccggctgggtacgatggtcatggagtaccatttggtatctgcttcggtgggttgaagggctatgaaccgaggctgattgaaatggcttatgcttttgagcaagctaccaaagttcgaaggatgcccagcttcaagccatagatggcctaataatttggcattgctgatgactgccattgtaccaaaataaattgtcagcaatgtagggtgagagagagagaagtggaagacattatatcagcaggacgcatacttaatcctttcttacggattgatacggttgaaggataaacttagtggtacattattggtacagacaaactgatatcaatttgttcaagaagagcaaactctacaacattcttatctactactatatgtctaaattcatt

SEQ ID NO: 35384 - DNA, 525 bp, Oryza sativa
atgcagcagataatttatgaatgtactaggctaaccgaatacgtgcacgtatgccaaaattgacagcctgaatattcgggtgtgtgtgtctccagcagtagttcttctcgatcgacgaatctatacacaactacgtgcgtatagagacactcgtcctacttagtactcctgccgtacgtatttattgtacgtactcccttcagttggattaatttcatgagaaaagcgagagtccgatccgaatatattcatgtgggttgatatataagtttttcatttagcaactgaagacatgcttggaagtttgaaagcgcgcagggagtttcgcagcaaagttcactgcaaatgattagatcctaattcccagacaggaactaatttcaatttgtctgctacaacggatatgtcatgagtatacacggttgaaaaaatatttcaagattattattcgtgtagtacatgcagctagcatatacttatacttttgtgcatgcatggcaggcaaaactttttcttgcccgcagg

SEQ ID NO: 35385 - DNA, 217 bp, Oryza sativa
ccgcggcgaggacttgcctgagccatgcgacctcaggctactcttccgccgcacctgctccatcgccgccggccaagaaacgcccactccaaagatagctagtactagtagccactctcctcctcctcctccctctccccccactcctctcggccggcgtctctgctatacttagccagagtttaactaggggattaatactgcctctcgtttcagt

SEQ ID NO: 35386 - DNA, 289 bp, Oryza sativa
gatataccgatgtagcacttctccatacggagtattctaagggtatcgaatccaagggaacgtgtgtggtcagatcttcctccagttcatccaaggacaccaaccagggaaaacttaattttaatcctaacgcaatacttcaggcactaagtgatagtagaaaaagatttaaaatatcgagcactgatataagggttagaaacatataaaattcatcatttcaatgatgaaggataaagtagagactaaatttataaatattgcatgtcctatgcatacttgctacagg

SEQ ID NO: 35387 - DNA, 603 bp, Oryza sativa
gccctgattatataatcttcctcgttaatcacagtttctaaatcttagttaccgaatgctaattccacttacaatcatttttatttctttacaaaatgctaattgcgacacgcactcccgaatccccgccgctagtctcgcccacagaagattcgaacacatacagaattacacggaccacaatcgtttggttaccactaatcacatattctaattgatcctgttcctgatcatgtaccgaacacctgccatgccatgccacgtacgtggagtggccaccaaaccccgcgccgctcgttgccgccggcgcgagtggctgtgccggtacacggaagacgcggcttccgtgcgcgccccgatgcgggggtggcggaaaggaggacaagcgttggcagctagctgcgcgcctccacgttgttccggaacgttccatcgcatcgttaactgaaacgagaggcagtattaatcccctagttaaactctggctaagtatagcagagacgccggccgagaggagtggggggagagggaggaggaggaggagagtggctactagtactagctatctttggagtgggcgtttcttggccggcggcgatggag

SEQ ID NO: 35388 - DNA, 1501 bp, Oryza sativa
gtgaagttatgttgaaagagtatgaacgagagagattttgggagagagtacgaggaaggaaataaaaataaaagaattacctattaatctatttgacatttggcggaaacacacaatttttttttataaatttgaatcgttttaagatttatacagtaccacaatcttaatttctatctcctccctcctaactctcacagtcccacatgctgccacttctccacctccgcttcctcactaggtcattgtgtgtggcctcgctagtgttagcaaagcttatgtgtggcttcgctagtgttagcaaagcccatcatacattctctccctcgtccccgcctatcctccttaacccggtggtgtattcctgttgtcttcctcatctttgacggctcccctcgcttgttgcatcgtcactgtctctacctgctaaccactcactctattttatccctatcatcaataccgacccactataacaccactcgcagtcgactctttggcttaatcatcgccgccgtctcaccgcccactacgaggctaccgccactcaccgctatctctttaaatccgagtaactttctctgtctccgcctatacctcatccctgatagccaaccggtcggggtcgcagtcgttgaaaatcaacgagcttgccagagtggaaagaacgatgtaatgtgcacgaatctcggagtgtctagggtcgaaaatctgccgaatcgggcttaaattcaaaagaaaaagataaaaaaaagaagaagaagaagaagaagaagaagagagaaaatggcgattacccccgtcgattccccctcccctccatctccgatcagcagagccaacctgcacttctcccgcctcctcgcgctcccggccggtgacggcgagctggctctcggtgttaacacggcgaccccccaccctagcatcctcctgtgtgtgcggcctccttgcgagcaggtctggagcggcggcgcgcgcggccggccccccatctcggtcctcgaatcgaatcggaggtatccattcctctctcatgtgatggcttggcattggtggggattttgtgctctgctgatgctaattggtagtagtaatttggtactgcgcactgaactactgatgatgatgttggaaaaccatgacggcagttttatcactgaattgaactagtagtgtgtggcaacttctgccaatctacctggaatgtgaagtttctgcagataactaataacttcgcttctgccaaatttcttaccctcacattgattatatttgtttgcttaattgtagatagtacttcagtttggaaaaatgtcaggagattaaaattggtggaagccacttggcgcaagtgctactcttcactcttcagtcactgaataatgaagtatccctgtacaatgaaaaggtatttctggcattttatgatgagaggataatcaccttttttcaggaataagtaaaagatttgggcatcattgcatcaagccgaacaaaa

SEQ ID NO: 35389 - DNA, 1501 bp, Oryza sativa
ggcttggccgggccgggctgcccatttggctacaatctcattctagaattgtgggcaacttgatccacgcaatgaaaccaaatcaacaccctctaggaagatggaagaatctgttggccctttggatcagacgacaccttgctgatcttgtctgacctgcaatagtgtatcaatatagcttttgcaaataaacagcagattgtatttttggtgtacagaaaagtttcctgttgtaaagcacaaaaggatatagttgcgcaataggaatgacatatgaggtagtattatttatattacggacctcttcactttgatgctaaaaaaaccttactaaaatttggcaatgccaaaattttggtaactataccaaaattttggcaggatttcttatatagttataaaaatttggtagcaactaaatgtagctatttttttggcaactttaccaaaatttgttaaggttgaaaatgacatcaaagtaaacaggccctacattaacatataaaatgcttatagctgaaaatatgataaggaacataagttttttgttgttgttgttgtcgtcgtcgtcgtcaagaagccttctttgaacttctctgaattctgatgtccttgaattgaaatcgccgaaccgatacaagtctgaaggcttcattccatttctgaacttctttgaattctgatgactcggaatgatttccatctcttaactttttggtcctgacaagggtaaaaatagcagaaggacactgacaatattgagaacaaggctattcttcgagagatgctctgtaaaaatcttcagcgatactctgtttttccccttccattgaattatcccaatataattaccgaagttgaggacttggataggataaaatcttcagaagttaaggaattggtacttgcaaggtgcaccgaagcatagcatcagcggtagttcaaatctctagtcgaattcagaaatgtctctgaacttctcttcgttaaaaacttacaatccctgcagacttcacttcattacagaaagacagaaatgtctctgaacttctcggaatgctgatgactctgagtggttgagatcagaagtacttcagacaatactctgtcccccctcttcttcaattaccctaattctactttcggtatccttcagaaagttcagaacatggacaaaatctccataagttcaggacttggtaaaaacagcagaaggacactgacaaacctattcttcaagagatgttctttaaaagtcttcagcaatagtatatactttttctcctgcaatttgactgtctacataagtactagcaacactcttgtcatccctccaattgaattgccccaatgtattactactattttcagaagtgcaggctgtacggagcttatcagcagcagcgatagttcaaaccactgcttcgattttagaaactaatcaaaacaagttccaattccaaaaccaaatcgcacagatttcatcaaacttccagaagaa

SEQ ID NO: 35390 - DNA, 1501 bp, Oryza sativa
gaaaaggagcatgctgcataaatagcggcaagaaaaaagaatcttatataagaaatctagctatcttagtaaaacattttttttctatttataagttagcaagttaaaattggttagaggtgttgttttatgaacttatattaccaaaattgtctggtgtatcacgtgcaaaaaaatatggttttatgcaatttaattataacacgcagtaggagcctcctactattttcccgtaaaaaaataactataacacctgggattttatgtgatccactctgtttcaaggctaatctctaatatgaaactttcacatcttaaattcttctatgaaaacatatttacaagggaattcttgctaaaattttaaaatggaccaatatgttactactccacgcgtttcatattataagttatttgattttttttagtaaaacttctttaagtttgaccaaatttataaaaaatataataacattttcaatacaaaatatacattcataaaaatatattcaatgttaaattcaataaaactaatttggtattgtagacgttgctaattttttctataaatttaatcaaatctaaagaactttgagtaaaagaaaaagtcaaatgacttctaataagaaacttgggagtaacatttaactgtatggcatcaacatataacatattagtgccaatcccatgaactggaccggctaaggctctgtgcaagagttggttccctacccaaacatccctacccaaacagtacgcacgaaatacggaacggtctattaacatatgattaattaagtatttgctattttttttaaaaaatagatcaatatgttttttaagcaactttcatgtagaaactttacgtaaaaaacacaccgtttagcagcttgaaaagctacgtgcggaaagttgggaacaactattgcgaatagagtctaaatcctcttcaatggaacccatcggtgtgtagtggtacggattggagtaaggttgtcgccaatataacttcaacgttggctcattgccactgtttgtcaaatctgtttaatcccggtcacaataagctctctctgaagtgacaaaaaattaaattattcctcattagaatatttttttctaagaatataccactattttgtagaacaattttgataaaagtaccaattactgcatccgctttcataaattcttgacgtttctccattgtacacttctacttatattatactttttaagataaatcttatattgttttaatgattttaaactaaatattttttaaagttttggtagttcaaattataaaagtttaatctcaacagagattagaatcggagggggtacaaaatttgcagccgtagtaacagagattagaaggaaaaataataaaaacaacagtctgtcaagtacacgcctgccttgccggttgcccctcgccggcggcctcgtagccggagcccgtcctctccgccgcgcccgcgtctgccggcttgctggc

SEQ ID NO: 35391 - DNA, 564 bp, Oryza sativa
caaaatatttagtttgaaaatacaaaaatcacatgcgtacatagatttaactatgattagacttttaaaactttaataataaacatctctcaaaatatttagtttaaaaacataaaaatcatatgggtacattgatttaatttataataaattaacttttaaaactctaattataaatatctctcaaaaatatttaatttaaaaacataaaaatcatatgggtagattttagttaagtaattttaaactataatagtttattagatattattgttgtattataatagaaaaatagtggtcaaagttgcacatatcctgtactttatcttcctagctctcgcactatatgggtatgaaaatacaacacaatagtcaataataataacatgctaactggttgtagatacatacacatcgtcgtactacgataaccgacactagttaaattgtggctaatatatgtgtgtatatatataatatctcatatttttcatgattattatacaaagatatactaacaaaatcgataatacaaacttatactccctccctcccattttcagt

SEQ ID NO: 35392 - DNA, 183 bp, Oryza sativa
taagatatttcatatttcaaagggccggggcgtaagaatacatggctgaggaatgtacgtctagggatctataataaattatcggtaaaatcgagggtttttttgaaaaataaccagatcccacagctcggcgctcgctcgcgaaatctggctacctgggcttcggggcgcgacgtggatagc

SEQ ID NO: 35393 - DNA, 1501 bp, Oryza sativa
aaggagaaataaaattaaacaattattttcgactggggcggacggaggatttgggtggtatctggaaaaggctagtaccgtccccggtcaattaaggaccgagccatgaagctaagcatgaaacgacccctcgtacaaccgcacttctcgtatgggtatagacctagcggactagatagccgagcggaggcagtatccctgcatagatggttcacccctgagtgaggcaggtgcgctacggtaggacagccgttgaggtagggccgagaggcgagccctacatcggtgtcgccattggtaggactgccatgagtgtgtgagagagagaacttaacttgaaccataatttaatatgtgtgtgagacttctctttcccaggagcgccagaactcctctcactgctagaaacatgaacgcctagagtgcatgaggatttaagttcatggagcgggtactgccaatgcgaggttatcgaaaagctttgccatgacgcgtctcatatgttgggacgaggctcatgtgttgggcagtcgcggagtgcgggtaaagtgtgcatccactgcagtgtgagtaaaccaaatctattcgaatagccgtgctcgcggttattgagcaccgggacatgtattacacttggctagactctaaattctttaacttgtgtgggatgggatattacatgatgactttttttatgctgacggagccacttcctgagaggcgggaatgtggacgtcctcagaaaaccatgacgactcaatggcgggaagctatccttgggatcacaatggatggtggacagaaccatcgttgtttaatgtgaacactggtattaaaacttgatcagtctatgctaggtcttaggcttgtgaaaagaattacaaaacttgctttgcgcaaaagaaccatagccatcctttgaattcctctgtcatgtgcattattgctgtggtggcttgctgagtacggttggtactcacccttgcaatattcaaacttaatcagaggccggagatgaagcttcggaggatccctatgcctattaccaggagagtgatgaggatgatggcgctcagtaggtcttagttacggtcgttgcctgtggcaatggcgtgccgctgccttaactccgctgccttacctacttctgtttttggaatgtattctggatcgctcggtccgatgatttaagactgtgcctgcgggcttatgatgtaataattcgtactagactctcgtgtatgtgcacttgatatttcagctatgagttcgtgtgtaccagactacttgatccagggaaatggtacggtttatacgattgattcctgttataaaaatgggggtctacacaagaggagcttgacgcttacgtggcatcagaagtcaagagacaattcaagcctcgaagtctagaaaagaagattcctatagacccgagtgtcaggaacttcttcaggggtatgtctgcacctgtcaaggaggccatcaagctatcggacta

SEQ ID NO: 35394 - DNA, 1501 bp, Oryza sativa
gcatgtccaaaggccgatgagatgcaagcgtgctagtcagtttgatcgtgcaactgacaagatatgtaaacagttgatcaaatagccgatcggctgaccagctgatggagcaattccatccgatgccgatactagccgatagcgatagggttttgagctatcggctatatgtttgatgtagattccgacactttatgcaaataaagacaatcggctgatgatgataaataacaataatataatcaagtacaaaccaatcggctaataatgataccatagaacaagtattgatccgaaggttaaagcatacatcagttggaagtccgatgtcataaaatccacaagattagataaacattgaaaccttttttgcgatcggctaaatccaacttgtatgtaatccttataagccgatggaacgtccagataactcatcggctgaaaccctgataaaacccttattggcaatcaaaagcaggccagagattatgtttctaagcacgacttagtaggtcaaatgtactgatgcagcactaagtatgaaaagaaacataatatctagacaatcaagcccttgactaattttcagggtggtagataccttagctaatataatctggtaaagcgatttagccgataccggcataaacactaaagcgcatctcaaccgatataagtaaatcgaactaccaagctagattaaggccccgtttgtttcagcttaggattattataatctggattattaggagtaagctgaaacaaacatatagcttattatgatagattattataatctataagccagattactataatctagtaatccactttaaaggtgcttttttagattattgggtggctaacacctaacaactagctaataatccaaagaaacaaatggctaacaacttattctatatcggcttagtataatccagcttatagtactctgactcaataatgtagagtacaataattttaagctgaaacaaatagggcctaactaagatatatgatagataggtgcttacattgacgagatcagattgtcgaagccctagccccgccgatgcaaacaaccatgacaagtataaactcgtcgaaaaaagttgaaaaataaaaatggtggtgatgcgccgaatttgtattgatcgagagatagtttacgatgaccccgggtgtacatatttatacccatgggtagatacaagtccttattggacaagaaagaaatcttcctaaagataaaaaggaaaacataaagtccttatcggacactaaacacactttcctaaagataaaaaggaaactatcggactattcttaattaatagataacttgccatatctcatcctccttaactcggttattctggataaacttccttgaatagatctgtttcctgaactgaatcctccaagaatccggctgctggtgacttgataactcccatcggccgattctagaactctgtagacgatattgattttaggaaga

SEQ ID NO: 35395 - DNA, 227 bp, Oryza sativa
gaaatacgcaagcaatatgcaagaattaaaaattgtgtaaaagattctagtaatccatctatattcagccatttcccattcaacctattaattttaatggaatattcaatacatccaaaaatagtttacatcgtgtacacaacaattcgagcaatacattggcggtgacggttgaccacacgtagtttctcctcactattgtttcttccttgtgatcactaggtgag

SEQ ID NO: 35396 - DNA, 1501 bp, Oryza sativa
tttattggctcactactcactgccaaccactactcactgagccatgcagcacagcagcacccacgtacatatagctagctctccaggccatgcaacacacacatgcatatagataaacatgctgaaattaacaaacgacaagattaatttctaacagaatcgacgatcagtcacaacatcaaattgatttgatagttgccaagatattgatgatctattggatcagttgagaggtgccaagatattttctaagattgagctgagatcaggatattatcaatagatgattaagaaagaagataggcgaaagacaacatttacaacaaggtatggactgtaccaattcacagttatgccatttggagttaccaatgctccagctgtgtttatgagattgatgaatcacacactgttggattatcttgataagtttgtcattgtctttcttgatgacatccttatccactcaaaaagtaaagaagaacatgtgctgacggtcgttatagacaaatttcgaccatcaatatatccaaaataaaggggaactagctatgcttgcatgcatattttgtttaagaataatctatctccactagtacttgaaattttatttgtttgaagagaaaattacgtaattggaggagaatcgatggaaatcaaccgaacaatcaattgaactccattgagaggtagacttataggttgatgggcttataaatccagtgaaataacaccaaatgggcacaaccaccacaccacaggaccgaggaatctacaggaggcacaccttccaaattgtggtccatttaggccaggctagggttcttcgcatggaaagcggtagaggctgatccgtagctttggtcgtcgcactctaatccgctttagaagaagcagccaagttgtttcttctcccatgctggtcctatttttaactatacattggttacgcaccaaggttatactaaaaagtcgagctcacgggagttggttactgttgcgtgtctacacttgcaggagatggcgaatgagagtcttacctaggtaaattggtggcgatttactcttggtactgatggtccttaatgcttcttggacctcccttcttttaaattggttcgcatgtgttttggctaagcgcatccttgttatagagacgtcgagagtgttcttagcgtagttgtatgactttgatgtaatagaacaagtttaatagaaccttccattatctaaaacaagtaacctgttaccatggccatccaccaaacacctagctgctcgctaacgacatgttattgggagaaatgcgcggtgacccatagacatggcacatatgcattcaaccaaccaatttatgaccacaaagctcctacgccttacagactatttaaagaaatcacgtcccactttcataatagcaagcaactcatcgatctaggttagctagttcttgttgcattgaatcatccctcatcaaatcattaggatatatacttcatga

SEQ ID NO: 35397 - DNA, 819 bp, Oryza sativa
actcttgaaggttttgggctttttcagcaggtgaggaaaccgcagccgcacaccattgcctactacctgcgacactattctggcttgtagctcgacagccgaacatgtcttttttcccctaaaattcttgaaaggagtttctttagtattgttacccgataccatacacatggcagtatatatatcatttagatcttagcgctacgaatgtaatttaaattttcgcgcgcaatttctatacattatttttttaaaagaatatttttctctcgagaaaagaaaagtaaaatttgcggggctcccaaaattgccagcccgtctccctctcctcgtttcctctacctctgtgactctcttctttttttttcgtcagtctctcctctattctctctcctgtgtttccggcggaggcacgagcgcacggacagcctcctccccccgcctccacctccgcgcggtcgccgccggcgaggaggcggcgccggacgagctcctctccttccccgccacgccgtagcatcctcctcctcccccgcgcgcgcgccgctgggcgagcaagtctgggggccaggagcgagcggcgcggcgcggcccggccaggcctctcattccaccaccaccggcgcccatctcggcggctcggatcgaattcagaggtgattcgagagagactcttctctcgtagcccctccgttcactccctcctcctcctcgttgtctcgtgttccggcgtggcgtagattggagacctgtattgattttttttttttttttgcgccttcgcacgcagtttcgtcgcttgctctccgacggcggcga

SEQ ID NO: 35398 - DNA, 1501 bp, Oryza sativa
tagcttacttagggactgctaaacgctactccgtaattgggtaattataaaagtagttttcgggtatgctatgaaacatgtagtgggatatgaacaatcaagatgggatttcccctcctatggagagatatatctgggcccctcgatgttgtagattatggaagttcatggccatgccaaatttgattgaggagtcaatcagaagttatataatcaatcaacaggttcgagtgaatgattgagctattagaggatggcacatatttagccttgagcttaatcgatatcgtgaggcaaaggggttcatacaagtatacactaaaagttcagcagatatgatcttaatgtatgcccggtgggtcaatacattctgctagaggccgctgttgacgcatggaccgaaaaggagttttcgggttacagccgagtgtacatgaacttataaggtcgcacgcttaatgggccggaataaggggattggatggagatccaatatgagcttaattcggatagggatccgaagaggagtcctacgggccttggaggcccgagtgatggatcctatatattcgtgaggggtgtgaccggcggaggtattgcatcacgtgagaaaccctagttgtcagtcccctcccccagcaaaaccctagccgtgcgcgggtgctagcacatctgcgcgtggcattccgttcctgtacgtgtggataccgatagaggcgccgctggtttgcggtgctgattggcatgggaatacagcgaggagaacgcacgaggaggagaaggtcgagccggtgcgaccgactacttcctctacatcgacgcgcgctacttcccgagaattccttcgacttcttagcgccttcttccactgcatagcgcgtcgagtggtaacgatctatgatctagtacttgcatggttcctggtttacgtgacaaaaaaaattgatttatgctatcgtagtctacgcgtatcccaacagatcaatcctgcaccatcatcttcctgctactaccgtctcctctttgctgctcacatcggaaagttgtgctgcctcttctctgctacggttggtaagcagttgcacaccataaaaaagtctttcatctgctgtgctcatccgttcatcatgtggtgttcgcataggttgggacatcgtgtccccctgctgctccgatctgtgcaaccaggatgttgagttccgacaccacgtcatcgtcgtcgcagctgtcatcagtgaaccaacgctgctccttcgtcatctccttccaaacaaacttctgtcaccattaacgccacttgcaagcaaacaagtcatcactgtccttggaacccaagccgttgctaccatgtcgtcatcttgttgagaccacatctacaagtgagctcttgatgttcatcctccattatttccttccatttttatcacccggtggtagcactatatgttgttgtttcgtccatcacgaaagcagcccctgtcactgtcaaccttcctccttt

SEQ ID NO: 35399 - DNA, 551 bp, Oryza sativa
  unsure (1)..(551): unsure at all n locations
atgactgtttcccctccaccnnccnaagnnncggacctggcaatcctttggcctctactcttaagatcttatggacatgtaataattctctatttgtgtggatgtaatgacagttagatgctcttagctgctctttatttatattgctcttcatttatgctatgagtgtcttatttgttgtttgtgatgtgatgttgattttatccttttgagtgctcaccatgtcgtatcttttgcatatcatatttattcttactgctttttgcatcccacgaatgagtagggatgaaggaaactctcctcggttgctccgttatatatatgcatatgagcttcactcatattttccatatgcatacactaagggggagtttcattcacctctaaccattcaaaacaaaattattatcaatcttttgtaagctttaaccatgttgtcatcaatcaccaaaaagggggagattgaaagtgcattaatccccctagtgggttttggtgattaatgacaaatgtggttaagggactaatgagttcattgagtatctttcagg

SEQ ID NO: 35400 - DNA, 1501 bp, Oryza sativa
gtcatatgcaaggagtcgaactcctaacctccacaccgcgagattgcgggtgttagctaaccaaatcatagttatatataagttatatcatcatagttatagtttcagtacaattacaaatgtaatagattatcagttttctgccaggaacatcatttttccattttgggtcatacgtgaaaattatgcgcaataagcttgcaggcctgccgtggatcaaacagtacgtaattgaaaatgcacatcaggaaatcaaattaaatttcttaattatagcggctgctttatgcttttaccacctccgaaacttatcggcttatgatcacaatacattttctgcgaaattcgatcgcgtgtgtggatcgtagtacactcatacaaactgtcatgcacaagctatgttaaaacaaacaatcgaccgtacgttgggtatatagacgatacaacgacgctcgcgtggatgacgccgccgatcaccggagcgtggcgaacgcgccgccgcgcatcatctgcttgaactcgaggaagtcgacgcggccgtcgccgtccctgtcgacctggccgatcatgcggccgcagtcctccgctgtccggccctgcttgatccccagcgacgccagcacggcgcccagctcgtccacggtgatgaacccgtcgccgttccggtcgaacacgtcgaacgcctcgcgcatgctcgcctcatccacgtcgcaggcgccgccgccgccgccgccgtcgacgcgcatgacggtctcgtacagctgggtgaactcgtccatgtcgacgcacccgtcgccgttggcgtcgatgcgggcgatggtggcggcgagctcctcccggtgcacgggcatcccgagcctctccagcgactccgtcagctcctcccgggtgatccggccgtcgccgtcacggtcgaacagctcgaacacccgccggagctccgcctgctggtcgcacgccatcccctcgccgccggccggcgcccgccgccgctagctggtggtgcagccggctgcacgtacggccacaggggagcgtgtgggagggaggcgtcggaggccgcggtggtggtggtggtgggatggcggaggaaggcgtgaaggctggcctcctcttatgggcattgcaaaggtgaggaggtgggtgcatgcgtggtggctgcccgccattgggtggtgccgagcgattggtggaggacttggtggcttcgagcatttcaagattgtgttgccaaaaaaacgccattttcatgcgatattccgctgaaaatgctgtggatcgatcaaatcaactccgtggtgaagaaatgcgtccagcttgtatgttcgtctctggctataatttttttttctttttgagggatcgtctctagctattcggagctcggcatatttgtaaacgagaagtaatttgtaaataaaatttttatatacgtattattaataatctaaaagcaaagactgaaacattaactttgatgaaaaaacttcaaaatctttct

SEQ ID NO: 35401 - DNA, 666 bp, Oryza sativa
  unsure (1)..(666): unsure at all n locations
agagatagcacttgcgaaggtctccgccggnaaacgaagagcaatgccggggaaagggaaggccgacctccacnnccgggggaagccgaatgccacggccggccggcttaactnacncggcgccagggcgtgttgaagtcgnccggtgctaggaagtgaaaagaagccggcgtgaaggtggctaaaaactcgaaagggaccaaaatgtacggagggagatgaggactttcgttttataggccaagaaggaagtgccagtcacggaagaggtcaaagaagggggattaaatcccggcgattggggatggaattaaatggggaaagttaggggaactagagaggaagggatgtggattccatttctctacccaatttgaattaatccggcatgaatggaccggattcggggaagaaattggtgcaagggttaatggaagagaggagagagaggagccggctggaaggtagaagacgaccgggtgggtgtacccattggtccggcgcgaggcgcgcacgtgcgccgcacgtgcagaggggcgcgaggaagaggaggaaggtggcttggggcgtcaggtcggctggaccgggatagggtaggggcggcccaagcggaagaggaggaaaaaggtgggccgggagtagaagggnaggcctggaatagatagt

SEQ ID NO: 35402 - DNA, 1501 bp, Oryza sativa
tgtctttttgttcttggttattgatctcgaagcaaagcaaacgcactctgtcccaagacttgtcagtgttttgtggcaatttcttcgtttgcgagaaggatgttccgagaatctcgtacgccggtgaggtttcccgtgatctggccgaggttttctggatacattcaacgcggaaagctgcttttaattttgttccaatttgctgtctttgtaggtctgcaccaaattcgatctgaatgtccttgtgaagcgtgaaatcaaatttggaataacatagtacggagtagtgcagaaccgaaatccgcatgaaagtactctgtatctgttgtctgataaactgagaatttcgaataaaccggaacataagcattattattatatgaaaaacggagcattgaaaatttcgttatgaaaaacggagcattgaaaatttcgatgttttgctcgtctggtagacgagaagcttatttttcgaagatatatcttccaaatcccaattatgtttgcgcctaattcagacgctcccactccttgagggcttgccggctcgtttacctacattttttgatttaccgaattttattaaggtaacaaacttttgccaactgccagtgtcagtttgtcactatcaacatttggtatttcaggaagtttacttgtgtacctatacaaaaatttagaaagattgcaaactaaacacatctaacattgacaaaaaattattaacgagtctacccagattttgcactgtcaaattttaagaagattaatttatcaacaaactgaactagggcttaagtcatggataaattcactcgcactcacgggccaacattacgctcaactggcttgtgggcctaaattatggctgctggaattgctcgaactgatgggccaaaatgaagaacatttgtgggcctgaatgttatcatatcatccaagatttaaatttagaaagattttgaagttttttcatcaaagttaatgtttcagtctttgcttttagattattaataatacgtatataaaaattttatttacaaattacttctcgtttacaaatatgccgagctccgaatagctagagacgatccctcaaaaagaaaaaaaaattatagccagagacgaacatacaagctggacgcatttcttcaccacggagttgatttgatcgatccacagcattttcagcggaatatcgcatgaaaatggcgtttttttggcaacacaatcttgaaatgctcgaagccaccaagtcctccaccaatcgctcggcaccacccaatggcgggcagccaccacgcatgcacccacctcctcacctttgcaatgcccataagaggaggccagccttcacgccttcctccgccatcccaccaccaccaccaccgcggcctccgacgcctccctcccacacgctcccctgtggccgtacgtgcagccggctgcaccaccagctagcggcggcgggcgccggccggcggcgaggggatggcgtgcg

SEQ ID NO: 35403 - DNA, 1501 bp, Oryza sativa
tcttttaaatagtccaaagaaatccttaaacattatcaaaaggcctagaataatccttggtccaccaaaaccgtcatatggatataccatgtcatcattcatacaaaatctataatgaattgtccagtttacctttacgtatatcatagaaaaataaatgtaagggtgaactagacataaccacaggaaaaaatacttttccttttttttcacctttttgacgtatatttttgctcttacatgtaccatattttttaaaaattttttcttttgttttttattttcctatgatatatgtaagggtaaattgaagaaatcatatagattttgcataggagggtgacatggcatgtccatgtggtgaatttggtgggaccaagaactatatcagcctatgtgataaatttaaaggacttgtttggacaatataaaagattaaggactaaaataacccaaaataacccaggagtaaaactttagggaccatattggttattcttccatttaaaagccccaaacaaattagctacttctgagataactttttatatggcaatttgaaagacgtgtgttcgcatcacctggttccatccggagtgtgcgcagaaaacagagtggtccattagcacgtgattaattaagtactagcttttttttcaaaaatggataaatatgatttttttaagcaactttcgtatagaaactttttgcaaaaaacgcaccatttagcagtctgaaaagggtgcgtgcagaatacaatggagaggggttgggaaccctgggttccgaacagacccatatgctacaccctaacaaggactcccctattagagcaagtttaatagtatagcccactactagctccaaattatttatagccaatgtaatagccaattcatacaatagttgcttactatactatcaatatctagtcccacctgtcatatacacattacgtcttgtagtcagtgctgcagctagctacagatatgtagcccgctgctcttctctcttttcctttatctctttaaaatatttttatagctggctaagcctgctattgtacctgctcttaggtagaaggtggtggtgggccatagattcactactcaccaccaccattaaaatatttttggcctggtcagattgtcgccaaaataaatcttaccaagttttggtaatgccaaaattttggtaagatgacaatattgccaaaattttggcaggatttcttatgtattgactaaatttagcaacaaattaaacgtagatatttttttgataattttaccaaaaaaggtatagttgaaaatgacatcaggccctttaaaagggtataagattatttgatgatataactgttatgcaatattaataaggctcttcatgtaagaaaatattaataaggctcatcaaggtcttaaaaaacttatccctatttaaaaacaattataacactactctagatctgaaaatcctaattgttttagtgaaaacaagg

SEQ ID NO: 35404 - DNA, 1124 bp, Oryza sativa
cagctgctgcagccacaattaatttttcgattgctactattgttgctccagatgcctgcagctggaaagtagcacaaacgatcaaccccattgtgggatggaggaactaaaacttaatttttatcttgttcataatacttccgtgtataactattctcctcctccttcatcctctatctatctatctatctatgttcatttcctcatttaactagctgagactgtttggatggaggttaactttatcactatcggttagtcacaattgtgataaactttgtcttgaaaataagagtatatataatgtgtgagctaacatactaataaagtgtgacttaactccaagtgtaacacacaatcaaacactgtataagaaattacgctacacctaagatttgacatggtaaaattcgactatcaaccaaacagcctgccgttcttctcgagctccatgccaactaacctagctctatgacgacctggtcattgattcatatcaccgtcctttaacccatttctgaaggatgtaaatatgtgatgtcgacgaggataaatagaatgaaccggcaaacaaaagtatgttgatatgcaatagaataggagttctaacagggcaagcaaaagagttcgtatctcgggcgttgctagtgaggtttgagccagacatatatgctaccctctttgtcacgcgtacatatgaggtgcacttggcttggaccgaatgccatgagctagctgttccgctgtcgtgtgccaatgttaattaagtgtgtaaggcggaagaaacatgattgttgcccttcttgtaaaatgagaatttctattagcacgacccatgactattattagtgtttttacagtgctccaatcctcttgcccctcgaggtactaggagttgttaatgttagttgttcattgactaagactatatttggcaatagtatgcataactctacaaatagcaagccaattataagtaggaagggtatcctgtgcacacgggagtacagctgcactcgtgtacacgtgcgtccggatccgttcgatcgacatcctacggccaagtctcctagcgtggcaattttacgaatacacgcccgcctcctccacttctgttttgcaga

SEQ ID NO: 35405 - DNA, 1501 bp, Oryza sativa
attacaacacccaagctgaatatgtctagcttgtttgagagtacattcttctctatgtattctggcggcaggtatccgctgcatatggacacatatgtaagcgcatccttattagaaaaggattcaatcaaataagtaattgagcttacactgtcccaattggagtttgtgtgacccttgttttctcttcggtgaagagcttggacaatccaaaatccgcaagttttggcaccatgttcttgtccagcaatatattgcccggtttaagatccaaatggtaaataggtggcttcagtccctcgtggagatattttaaaccctcacatgtccctttaataattttgaaccgtgtaggccagtcaagaccatgaaattcgtctgcaaagatacagaaaagaggtatcaacataataataaacataatctaaatacccaggattatttttttcttagcgtgctaaggaatatactagaactggagaaacatcgtacctgaaagatgattctcaaggcttccaccggttaaatactcgaagcagagcgctctatgtattattgcagcaaaaactattcttcctttgtactctgcgtatttatgttgtgtttcatagcagtaggcaactagccgtacaatatttggatgctcgagcctcataaggttctgaaattcattctcgaattgcttatcgtcaaatcctagagtatcattatgaagcatcttcactgcaatctcttttccatttctaaactctccctgttaaggatctattgtcagtacttaatacagcttgatttagcattactggtgaaaacatttgacaaggatgaaattgtaaagcatgtctttatttgctttgtagtcacagtatactacaattaagtatcatggacaataaaaggcggggcatggttaattgctcatcatagtaatataagtatgtgcaaacatgtagcgcatgcttattctttacaacccatacagtgctttgtcaagttattcgcaataaacaaatgatgccctcaacttaccttataaactgttccatatgcaccttgaccaatttttcgctcctcggagaatccatctgtaatttcttctaacaatcggaatgttatatccgttgggtccatagttgaatctggagcttgatgtcggtgtcctggtttatgctagtaaagaaggccttctgcatgaggacaatacaaagtaagttacgctgttaaagagcaagaagttgctactagctctagcactcaactcaacatcatctggctcttttttcttgccctttcattgttttgccttttgggttcctgatatcatccagattcaatcttgcattttgaagttgcgaagatggacaagtgatgagagagcagaaatttcacctgatttttgtagagaaaaaaattctgattcaccatctaaacaaatcattatcaattcaattttacccccaccgtcgctcaacaagtaaaaactctcagaataattgaaatc

SEQ ID NO: 35406 - DNA, 301 bp, Oryza sativa
aatcatactacattattatttatgattatattaaatggtagctcatgatggttaatcatgttatgataattaattgataattaaaacttgataatggtgggttgtgagcacatggttttgaaggtcgtgatcatgacaattaaggatcggttcacgagctactgttgtgagacattaatcgtgccaaccacaagccagcgtgggcaacagctttaccttttgtatagtatggctcattgcggggcaccagactgtgaagtggtgagaagtccgtgggggtcgctggggagtccatgcctct

SEQ ID NO: 35407 - DNA, 421 bp, Oryza sativa
atcacccatcacctcgccaccgatggataacggccagaacgccaatccgcgtcatccctagccctagccaactaccttaggacgggaaaaccgccccagcaagccgccgctccgccacagctcccatgtgcgcgcgttccgtcgcccccattcgcgcccaatgaataaaacggagcctcctgccacagctagagttagaacgcacagactttaggctttaggtacgatgatggagccacataaccttaatggaggaggagatcaaaccttatccgcgtcatccacctcattgctcttatccgatcaccattagtactccagctcgcctaggcatgtgctggtgatcttatccccatagtttgcttgcatcctaagcgaagccctcaacaaaatcctcatccctctcagccttcttctcgta

SEQ ID NO: 35408 - DNA, 631 bp, Oryza sativa
cttagcatacatgactagctctttcattcttagcatgcaatattatttgagttttaatataagattattttatttgtaattagacttagtatataattattgactacggaattggtgcgactcctagcaattgacaattttagtcttaattagacttagcatatacgacagttacacttagcatacatgactagctctttcagtcttagcatgtaatattatttgagttttaatataagattactttatttgtaattagacttagtatgtaattattgactacagaattggtgcgactcctagcaattgactattgtagtcttaattagacttagcatatacgcacgaaacacttagcatacatgactatttaagtcttagcatgtaatattatttgagttttattataagattattttatttgtaattagacttagtatataattattgactagctagggttgtataatatacgtcacctagacttagcttatatcacgatttgtaattagacttagcacgtaaggttgtgtagggttctaatgtacgatagttacacttagcatacatgacttagattgttaaaacataaatgtctcatgacttagcagatgtttcttgtatcaacaga

SEQ ID NO: 35409 - DNA, 1501 bp, Oryza sativa
agtatgaacgtcttgtaatgctgcgtcttcaagagatggacgagtttgtcctctgtttcttgcggatattggtcgagcattgcgacgtttactctccgagggtcgatgaatccagtatcgaaaaccctccgccgtcgggccctttgaatctccattctacaacgataaaagggagtattttattttatatagtctacttatatacaaggacctaattaattaaaggagacgtagtaattaagaaatataactgaacgaaatacttacaaatccagcaactcataatagacacgtcgagggcgtccagctggtatagttcgtagattcccttgaaattgatccagagaatgtcatctccttgcaagaagtccgggtccctgatcctcgctccgatcatctctctaccggtggcgctcatctccatgtacagctgatggaacttgtacatttgtgtgggtagggactgcaccagctcgggcttaacaagcggtttaccgagttcgtacatgtatttcagttccgccttttctattggttcaactcctagcaattgatcgtagttagaccggtgtcagtaataaattcttctatcgtcatgtcttccccggtcaccaacggctcgatctcctggtttggttgctctccaagctgagggactggtttggactttgcagaagatgctttcttcagcgttcactcatagtccgatagcttgatggcctccttgacaggtgcagacatacccctgaagaagttcctgacactcgggtctataggaatcttcttttctagacttcgaggcttgaattgtctcttgacttctgatgccacgtaagcgtcaagctcctcttgtgtagacccccatttttataacaggaatcaatcgtataaaccgtaccatttccctggatcaagtagtctggtacacacgaactcatagctgaaatatcaagtgcacatacacgagagtctagtacgaattattacatcataagcccgcaggcacagtcttaaatcatcggaccgagcgatccagaatacattccaaaaacagaagtaggtaaggcagcggagttaaggcagcggcacgccattgccacaggcaacgaccgtaactaagacctactgagcgccatcatcctcatcactctcctggtaataggcatagggatcctccgaagcttcatctccggcctctgattaagtttgaatattgcaagggtgagtaccaaccgtactcagcaagccaccacagcaataatgcacatgacagaggaattcaaaggatggctatggttcttttgcgcaaagcaagttttgtaattcttttcacaagcctaagacctagcatagactgatcaagttttaataccagtgttcacattaaacaacgatggttctgtccaccatccattgtgatcccaaggatagcttcccgccattgagtcgtcatggttttctgaggacgtccacattcccgcctctcaggaagtggctccgt

SEQ ID NO: 35410 - DNA, 1501 bp, Oryza sativa
cggtggagctgggggggcccttgactttgaaggtgtcggaagaggagcttgcggaggagtaggtgtaggagcccgaggaggagtcggtgcaggatcctgaggaggagtcggtgctggagcctgaggtggagacggtgctggcggagcatgaggaggagacggtgcaggatcctgaggaggagatggcggagccggaggagatggtgcatgagacgccgcttgtcacccagggaggatgatgtaccgcctgcgccatagaataatggcatggcttgtgtctcgtagatgcgtctcaccatctcctccagggtaatccagctcgaggtcctcgtacgcgccttcgaccaactcaacttcgaccttcgagtatcctgctggactcggcctgcagtggtaagtacctgaagggttcgttgggatggccatgcccgacgccaccttcaagttgtgagagattatttattagtaatcacatatataagcagcaactaccggaatggctaaatctaaaatataaactacgagcttacctttattgataagttcttgaaaggaatatgcagctcacatggtgtccgctgagtgatgtcatcaacgggacaggtcgattcgtcctgtgtttgcatggcgtccatgctctgtgatcctacctgtcccgttgaggcgcagctgctacggtttcctgacgggctcaccattgcaggaggaatggtcggctggggatcatgggactgatgtgcggccatgcattcatcaaccttccctgccacctcctcttgcatgctgagctcgtagctcgatacccggaactctagatctgcaatcttcgcctcggtatctctcttgctcctcatctgactcctgtacgtgtggatgtcctccttaaaaccaatcttccaaggaatcacccatttccctcgtgttcgtcctggatgctctggagtctgcagggcgagtgtcagctcgtccctatctctgtccggtcggaacgtgccctgagaggaggcttccactgcatctgttagtcgtcgcgcagcctctcgtatctgatcgccgaagactagtgagccatcagctaggttgagcgttccaccgtaagcatagtaccagaacttcgatcgttccggccaattggcggttgccggttcgatacccctctcaagcaagctagcctccatctcctcccacttcggcatcgcgacgctatagcctcctgaccccaagtggtgatgatacttcttcttgggggcattttctttgtttctttccatcatcgcctgcccttgttcacctgtcttatatgcaacgaactcgtcccagtgatcccttagctttgggaatgtgtcgaagttcggtgtctgccccttcaggatatacttctggtacagatctcccttgaagctctgaaactgttctgccattttcttcagagtccaccttttcactttgtcctctgtacccgcaggaagggtgaatgtctcgagcattgtggtccacagca

SEQ ID NO: 35411 - DNA, 187 bp, Oryza sativa
aaatatatttagttttggactcgtttgttcctctcaccatcgaaaacataatagaatacacatattacaaactctatacgttatacatgcaatcatttcaaatctcaatggttatatgaccaacaatttattatattatttaaaaggaagagaagggctctttacaaaatgcaaacgccggccaaca

SEQ ID NO: 35412 - DNA, 1501 bp, Oryza sativa
cggtgccctgcgatgagactgatagaaagctcttcaatgtggcgacggaaataactattggaaatggcgcgctaaggctaagttctggagctctaactggctcaataatcaatcaccccgaagccaagcgccgctgatttttcagatttccaggagaaaaaataggacaataaaagatgctctcaccgggaacaagtggatcgcagacctgcaaccacagctcttcacaactacgcagcactttcgagaatttatcaacctttgggcagccctgcatatactgcaactccaaccggacaccgaagatacgatccgatggcggctcacagaacatggccactacacgaccaaatcagcctattggctacagtttgaaggttctatcccaacactccttaagaaaatcgtctgggacgcatgagcactgctaaaatgcaaatttttctcgtggctaatcttccaaaacagagtttggacagcagatagattgcaagcaagaaactggcaaaaccaagtcatatgcccgctttgtcgcgccgagccggaaacagcagtccacctcttagcccactgccgcctctccaaaagaatatgggacgctgtacgtgattggtcactccttcatatccaaccatcagaatgggccaatgttgaaacagtacaagattggtggattcaaatcacctcagcacaaaacatgccaaagaaagctctcaagtcgataattatacttgttgcatgggaattatggaaggagaggaactcaaggatcttcaggaaccttgcaaacactccggcctccatcatggcaaaaataagagaggaagcacacatgtgggtaatagcgggggcaaagtgcctaacagagctctactcgttatgtgagtaatcccttttactcccttggtctgggatgaccctaactcccattttcttgtatctatggactctacttctctatcaatatataaggcaaatttcttgccttccttttcaaaaaaaaattattatagaactcacatgaaaaaaattcacacaaatttcacgatagcagaaagaaagctaagcaaacacaaactaatagataccaacagaagaaaaagatcccctaattagtgaattctattatagaacctccacccaaagttggcaaataaatgcacaattgtcgtctcaagtttacaacattcatcatttattagcttgatattttcatcatgcctttgtaattgagcccatccccgaagccaatacgttgccctgaaaagcatctgcaaataggattttgatgttgttttatcaaaaaccatattatttctactaaactaaagagcccaacatacaatggaagctccaaaaagaataagttttttttatttttttactaacaaccacaagccaatttccaaacatatgagatatactatatggaggataaagtccaaaagagaattgtatagctctccaaagaaatttagataaatggcactcaaagaataca

SEQ ID NO: 35413 - DNA, 238 bp, Oryza sativa
agttatagcatcaataattattgtgagaggtgtgagactaatcacgaaaaacattgctcaacccgcccatgaccgcgggcacggctattcaaatagttttactctggccagaggtgtaccactatacccacaagacacagagcctcaaaacatgttaccatgcccttagtaccaccacgatacctcgaaacgggattgtgacagtacccctcgcacaacacaatccaccacagaggca

SEQ ID NO: 35414 - DNA, 1501 bp, Oryza sativa
aaacaggacaatggcatgtttaagagagttgattttgagaagaagccgtttactctcttcgtcatatttgaattatttttatgattaatatttttattatattagatgataaaatataaatagtactttgtgtgggacttttttttagaaaaaatataaattttttaaataaaataaatggtcaaacgttaaacacgaatatctacgactgagacacatcctattccaataaatctagacaagagactatccaaattcagattatatttcgtttagatttttatactttatgacagaggtggaactattttttaactcccatctggttggtgagtccgcagcttctaagagtcagcagcttctagtagaggagtattttctaatccggacgaaaagctgatcgttttgggagcaaccatacgagaagacaccgcgaaattggttactacgagcgggagacgagcaataaaattgcgttgggggggtgggcaggggcacaaatcaagcactgcagtggcagtgcagctagcctaaagtttgccgattccccatggagtgaacgcaactagaccttgggagtgagggggaggcggccatggcggtggcggaagtcgggggaatgcttgcatctgccgtcctcaaggtggcgacccagaagctgggcgccgccatagcgggccgggtcatgctccagtggaacttcgacaaggatctggaggggatgaaggccacgctggagtctgtggacgcggtgctcagggacgccgagaggcggtcgatccgcgacgcggcggtgcggctgtggctgaggaggctcaaggacgccgcctacgacatctccgacatgctcgacgacctggagaacatcacttccaaatcggatgcggggaaggtgcgcaatctccactgcagcgattctcgcctctttttgttattccttattattattattattattattattattattacggttttgcctattattactccctatgacacctacgtttgaccattcgttttatttaaaaatttttaaataaaacgaatggtcaaacgttggactaaaagtcaacggcgtcatacattaaaatacggagatagtattatttattgccgttgcgtgccgtcagttttgggctgttcagattaataccattttcaaccataccattgccaaaaaaaaaatgttcgcgtttattttgttgccaaatttagtaaatacataagaaatcctgctaaaatttgataagttttattttggctacaatctgaacaggccctttggttatggatttactagtggatgtttccgattttccccatctgaaatacagtaaattttattgacgagtattcctctattactaactcaaatcagtaaattctctgcagttgggatgtgtgatgatccccaatctgactattgctcacaagattaccctagctaataagatgaagacgataagtgatgaactgaaggagatcactaatcaacatc

SEQ ID NO: 35415 - DNA, 389 bp, Oryza sativa
accgggactaaagagaggataggggcagtcccagttggtccattttctttttattttctcccaaatcgagtaagatgtatataccagatcaaacaccaaaccctcaaatcgagtgtcatacatatacccaaatccccaaattaaattaacatcccaaatcattaacatcacaaatacaaatcctaagttacttacacacaaatcaaatacatcacaaatcttaaaaaaaattacacacaaatcaaatgcatcacagatcgattatacatctcagatctatgcaatgaatcacaattttaaaaaagaaattaaacatctctcaatcacaaattataaaaaaaaggagaggagatccggcgcggtgccgcccgccgctgcttgccacaggt

SEQ ID NO: 35416 - DNA, 1501 bp, Oryza sativa
gaatctagttttaaacttaaccaaattgatatttttttctccttgttttaaacgtgggtttatttattaagatactgactagaccacctttcttttgtttcgctttgttccagttgctttcgatccagtactacctccgtttcatttcaggttataaaactttctagcattgcccatatttatatagatgttaatgaatctagacacatatatatgtatgtgtagattcattaacacacacacacacacacatatatatatatatatatatatatatatatatatatatatatatatatatatatatatatatatggataatagtagaatatcttataatattaaacagaggaagtattagctaagtgcaaggaaatatagggtctgtttggggagcttaagattctgcgaagtagctggtcggtagccagcttatgagaatctggaaaagctgggtttcccagcttatagcttctaggctgtgtttagttcacactaaaattgaaagtttggatgaaattgtaacaatgtgatggaaaagttggaagtttgtgtgtgtaagaaagttttgatgtgatggaaaagttgaaagtttgaagaaaaactttggaactaaacatggccctagtttattttctggtttatacaattacagcttctcaaaatctagaccaaaagctgaactgtttgggggagcttctgattctggaagaaactgcagcagctagaagctctctcaaacagggtcaatccttgcatataatttttttactcctttcttgtcattttcgaaaagaaaaacttcgctttagttagtactactctattggttcttttgacgccgtcaatttttatatgcgttttaaccatttatcgtatttaaaaatcttatacaattatgcaaaaatagaagtcttaaatgataaaattaatcacaataaaacaaataataaaataaatgatattatagcatttttaataaaataaatgttttacatatgttaagtcaatgatgctaaagagatactatacacaagcatgatgtgtgggagtggtaataatatttaacaatgaaacatagagaggcgtttttaagggtggcatttctggttgtgtgcgagtccctcccgtaggggtgaaaatggagcggattcggacggatagtggtcataccatatcctaaatcattgaagttaaactttatccaccttacattacccagtgcaacacacaggcattgtgcttgtttaaagaaaaaaggaattagcaacatctatattagataagtttcattaaatttaacattgaatatattttgatgcaatatttgttttatattgaaatgttaccatattttgctataaatttggtcaaaattttaaaagtttgactaaaaaaagtcaaacgacttctaatataaaacggagggagtatgatttttcacatgcaggtctatttttaagatgtggtgcttttaacataaccgcctacgaaaatcgca

SEQ ID NO: 35417 - DNA, 1501 bp, Oryza sativa
ttttcatttgagatcatatagggactcaaagattcattacaatacaaggtctcatatttatctattaaccgcatataaaaatggaaacaaccctatcccaatgaaaaaaaaatcataactttttatatgaagtcggatgaaaacaacattctttttatgaaaagtttatctatcaacgatatagttgaatgttttttcattccatatcgtttaggggctcaaacacttgttacaatgtctcaaatctatttatttaatcacctgtaaaaagtggaaacaatcatattccaaaaaaaaaaaatcacaaccttttcatatgaagttggattagaacaaacttatatgaaaattatgactctcggtgagatagctttgtactttaatgtttttattttcatttgaggtcttttaagggctcaaacatttgtaacaagcctccatatcctttttttattatttgtttacttattctttgaaaatgcttgatatttacaaattcttagaaaaatcattttaattctgactgaggtcaaccaaagttatttgggattcctacaatatttcctttaatgttatgaggtcaatatttcctttaatatagttattcactaatatctagtttcataatatgtcaactcacatagaggtaacttgacataactgaataaccatactaatagaaatattgtaagcaaaacaaggtgattcatagtacatgggatagtaaagtggctatgtatggagtgtgaggtcctaggtttctcaataacttgttttttaattcaaatatttagatatatgttttctcgagggactaatatttggttatatttctgataaagaagccatggatgtaaaaaagaaacatcttttgttatttaaaaatatacttcctccgtttcatactataagtcatttgacttttttcttaatcaaagtttttaaggtttgatcatgtttatagaaaaaaatagcaacatccacaacaccaaattagttttattaaatttaacattgaaaatattttgatacaatgtttgttttgtattgaaaatattactatattttgctataaatttgatcaaacttaaagaagtttgactaagaaaaaagtgaaacaactaatatgaaaccgggggagtatatactatacacactgtaaatagaattcatcataagttatctcatgcttaaaattttagcaagttgaaatatgcttttgtatgttcaagaactaagattttttccccatatatttgtccacaggaaacagtgaacctgattcaaggctcatatggaccactaggcatgcttcatgacttgctactgatcatgcatagtctttaacatagtgtcacaaatcacaacaatgctaacttatttacaaactccatctctacagttatcgcggccaagttcatcgcgcgaaagcaatggtttgtggttggacatcaagatggtttcataagagtttacacatatgagtccccagtaaagcaag

SEQ ID NO: 35418 - DNA, 1501 bp, Oryza sativa
aacaccatcagattgaccaactgcgtcataaattccacagagggtaacataattgctagcactgccttcttctaactcaaatagcctaaaagctgcaatctctccaacatcgacgttattatgcatagcacatgcagagagcaaagctccccacacgctagcacaaggttccatgggcatcttccttataagcccaacagcttcttcaatggctccagcacgccctaagaggtcaaccatacatgcatagtgctcagcagcagggtggacaccatgaaccttagtcatcgactcgaagatcttccgaccctcggttacaagcccggagtggctgcaacttgacagaactgatgtgaatgtgatccaatttggtttcactccctcagacaacatttccatgtaaaccttcaatgcctgttcccccttgccatgaatgctgtagctatgaatcattgtagaccagctcaccacatccctctgctgcatgccagaaaacactgcttgtgatacattgacccggccgcactttgcatacatgttgatcaaagcgttccccactgcgatatccgaatcaaatgcaaggcacctcaccatcctaccatggatttccctacccttcatcagctccccttccttcgcgcagatattcaacacgctgggcacagcctgcagaccattcaccatgttcaccgcctcaacctgcgctctgctgaaaatctcaaaggtttctactgccctcccagccctcgcataccctgcaaccatgcagttccagacgacagcatccctctccgtcatctcgtcgaacaccctcaccgcatcatccaggaaaccagccttggcatacatatccagaagcgcagcggccacaacaacgttccccatcaagccgagccggacggcgaagccgtggatcaccccgccaagcaccgcgtcggggagctcagcgcaggcacgtaccacggcggggacagagtaaccgtcagggcggagccccgacgcgaggaggcgggagaacacctccatcgcgtcgcggggaggcgacgccgcgaggagcacgttgtacgcgtgcatggacggcgcacgcattccgtcgaacaccctgcgtgcgcgccgacgctcgccgcacctgcagtacatcagcacgaggtcggtctccagggtggcgtcggggagccacccgcccaccaccgccctcgcgtgcgcctgctctcccggccggaccgccccggccgccgcgcatcgccggaggagcccggagaggcggccggccacgggcgccgccattcccaaccaagcagttcgctcaactgcgtcatcgtgtcacatgttttaccatccgtaaagcccaactcggcccggcccaactaaacctttgggctgagagctaggcccaaataagcgtcttactaactatcagcgctagtgcgtgctagtctgctgcgtgaggggggttttagtcccacctcggcggcgcaggcggatggcgagagggagagag

SEQ ID NO: 35419 - DNA, 1501 bp, Oryza sativa
actttgtgtgctatgtaactcactagaaaccacaagacatattctctttagctgccccatggccaccttcatttggtgtgtctgtagagatgcttttgggtggcactctgtgcctaacagctttgaggagttcttttctctgattaaacacacttctctgaagagttttagtacttatctggccttactcgctgctatttcctgggtcctctggactaccagaaatgatatgatttttagatcgcggactgtttactcaccactaatgctcccctttcgaattgtttcttacatgttacagtggaggggtttaagtcacgcgaatgaagctgccctgatggaggccctgaccgagaaactgaaatctgctgttacaaatgttggcgcgaccagagcaggaattggctagtctgtttcagtccttgatgtagttcttcagaggctgcgagcttttgttctttttctttaacctgtcgttggtttaagatgttctagagttctggttcttttgtttcgaggcgttgccctcctgcgctataaaacgctggctggtttccccagcataccttctggctttcaatataagccgggctcttgagccttttctctaaaaaaatacagacatcttcagtttgcacttgttcctgtttgggttatgtaatctgaagaaaggaagatggatagttgatcatatgttcagttcttggtgatataaattgcctgtcagttaactacatcagtaactttggctatcaattctagctagaatgacatcagctgcatgctgatcgggatggagcacaacgacaatgctggtcagagactgagagtaacgaagcaactatgtgtctcaatgctatgcaagaaacatagtaactgcagtctcctgcagaaaaagtaaaacatgagcttggtgccagcgggagctgggccggcggcaaactgtggcggtgggggcgctcggcggcggcggagtgatgtgcggggcgtcgagggcaggcggcggcgcttggtggcggtggggcatcgactgggccggcggggtggtggccctcatgctcgcggcgccggagtggatgtcgatggcgctcagatcgatcgatccagactccaaaggatatctcaccctttgatctgacaagtgggcctaggggcaaaacagtccaaaatgcctggaaagaaatacaaattgatttaagaaatgagaaatacatcaaaaactgagaaagtggtaccaaatagactaattagtagtcctaatgatatattatagagggcatacggattgggttgtaaaagagttgaggcacgcgaattggatggtaaatactctaaattatcttttttatgaggtcaggatgcctaacttataccttttttttaatgagaatagctagagcacgagataacttttaatgaatctaacaaattaaatacccctaagctctttttaaccataccctcgagcatatgcgggattcctctcattaaaccacccgat

SEQ ID NO: 35420 - DNA, 410 bp, Oryza sativa
aatgctagtcatttctgccataggagtttcctaggtacaaggttgtcatgtctctcattttcctacagctcattgcattggaaaactcgattaattagccctaatgaccaatgactaatgcaagtgcttaatatatatacatagcatacgatctgtttttatatccaaatctctcgttcttctcgagggagcatatgtaattttatttttatttttttggtttggaaatatacttggctggacctggaccatatgagattctgacaccatatgctacaaacactaatccaaagagcatctctcattggactaattaatcaggtgcagacatacgtacccacgcctggggatattatattagtagtactaattaatctgcattttgctaatatcatggttagcattggcaa

SEQ ID NO: 35421 - DNA, 675 bp, Oryza sativa
gccccggttggtggtaccaaccgagactaaagatcttaactttagtcccggttggtaataccaaccgggactaatgatccggtgatctttagccccggttggtgctaccaaccgggactaaagtcccacccctatatatatgtcttcttcctcctccagctgcccgagcaagcttcaaaatttcttcaaaaaagaggggaggtcatgccaaaatttctattgaatttattttggtgattacatcaaatcggaggtgcctaaaaggtttgcaacttcatcctccaatgtttttttttgtcatactacatttgcacctatgttttgcacacttttttttctccaaaatttagttgtaagttgatgagagagaaaatgtgtgtggggaagaaagaatatatagaaatttagttcatttgctaaacaaggttttataaaatagttgagaaggaaaactctagtgaaagttaatattaaataatagaaaacaaactaaaataaaaattaaaagaagtaaaacacattaaaattagtttaaaactttacaaatagtttttaagaattatttggtgtaatattttataatttttgtatgaataaagatatcttataattattgtatgactgtcattattgtaagaataattatttgtgtgcggtttttttgactcatgtaga

SEQ ID NO: 35422 - DNA, 1501 bp, Oryza sativa
gctcaattacaaaggcatgatgaaaatatcaagctaataaatgatgaatgttgtaaacttgagacgacaattgtgcatttatttgccaactttgggtggaggttctataatagaattcactaattaggggatctttttcttctgttggtatctattagtttgtgtttgcttagctttctttctgctatcgtgaaatttgtgtgaatttttttcatgtgagttctataataatttttttttgaaaaggaaggcaagaaatttgccttatatattgatagagaagtagagtccatagatacaagaaaatgggagttagggtcatcccagaccaagggagtaaaagggattactcacataacgagtagagctctgttaggcactttgcccccgctattacccacatgtgtgcttcctctcttatttttgccatgatggaggccggagtgtttgcaaggttcctgaagatccttgagttcctctccttccataattcccatgcaacaagtataattatcgacttgagagctttctttggcatgttttgtgctgaggtgatttgaatccaccaatcttgtactgtttcaacattggcccattctgatggttggatatgaaggagtgaccaatcacgtacagcgtcccatattcttttggagaggcggcagtgggctaagaggtggactgctgtttccggctcggcgcgacaaagcgggcatatgacttggttttgccagtttcttgcttgcaatctatctgctgtccaaactctgttttggaagattagccacgagaaaaatttgcattttagcagtgctcatgcgtcccagacgattttcttaaggagtgttgggatagaaccttcaaactgtagccaataggctgatttggtcgtgtagtggccatgttctgtgagccgccatcggatcgtatcttcggtgtccggttggagttgcagtatatgcagggctgcccaaaggttgataaattctcgaaagtgctgcgtagttgtgaagagctgtggttgcaggtctgcgatccacttgttcccggtgagagcatcttttattgtcctattttttctcctggaaatctgaaaaatcagcggcgcttggcttcggggtgattgattattgagccagttagagctccagaacttagccttagcgcgccatttccaatagttatttccgtcgccacattgaagagctttctatcagtctcatcgcagggcaccggcagtcctagccagggtctctcaggctcttgccactcaaaccaaagccatctgacacgaagggcgtgttggtatttcttaacgatattactagaaatataatttttcagcaatggcgcagaaatacttctggtatatgatggttacagagttcatccgcaagcgcacggatataccattgtagcattttacccgagagtattccaagggtatcgtatttattttatcccgtgcgaagatcttgtagagagaactcaactaatattt

SEQ ID NO: 35423 - DNA, 1501 bp, Oryza sativa
atggagcattgttccgtcctcggttggaactcaaacttttcctccttcccattgatatggaaacggatgctccccattcccacgtcaatgttggctcctgcggtgctaaggaacggacgctctaggatgagcggcgtatctttccccgtgtccatatctagcaccacaatatcaaccgggatgaagaaatcccgtatcttgactggcacctcctccgctatccccgtcgggtaacggactgacgagtcagccagttggaggcgcattggtgttggtgccaacaccgtgaagttgagcttgtcgaagacgtcttttggcatgacgctgacgctggctccaaggtcgcacaaggcctggtgaattgttgtgccccgattgaccaggtgatcgtgggacaccccggatctttcttcttctccgggagcttgtggagtatcaggttgctgcaatgttccgtcagcttgaccacctccattgttgggagcggtttcttgtttttgagtatgtccttaagataacaggagtatgttggtacttgcatagcgtccaacaacggcacgttcatgtgaattttctggatcacttcaacaaagcgagcgaactgctcgtccactgacggtttcctactccgctgagggaatggcaacaaccgtgtgtcgcagtaccccccgtggcacggtcttctctggctaagtctccttgtcagccgaatcagtagatggcgtttccttgggcatcccattagttcctgtagggttaggatacggcggatcacgagtggaattacctcccctcgtcgtgatcgccttaaaattttcaatggaggagtcgggttgccccggaatcctcccagattcatttgcagggactaaagatgccaacggagctaactgggtttctatcattttattaaagctcagctggttttgaaatgcggaagcgaagccatctagcttgacatgacatttatgttctctaagatcttatcattggcagcaagcttttttgcttagcgcatcagtggttttagcttgcgcaaaaacaagatccttcaaggagggttggttagagaaattaccgttattattacctcattgataatatgggcgtggttggttccacccctgacctccttgtggacgatacccgttgttgttgttgcccatgtacattgcctcctcacgggtttccgggcggtcgttcccagaatgacccgtgccgccgcagacttcacacgtgatgtgtgagtccaaggccttgacggtgccttgtggccgtttctcatggtcgtccaagcgtttcatgaggaggtccagcttggcagcaagtaactccgtctccttgacggtgtgcatgcctcgctgacgggtctggagtcattcctcgcttcaacccatattggagaccatcttctctatgagttcaatggctccttgaactgttatagagaagaaggctcctccagctgccgcgtctaggtgatcgcgggacatcggggtga

SEQ ID NO: 35424 - DNA, 1501 bp, Oryza sativa
ttggaaccatataaaaggtggggtgtgagacatgctatctggttatgttcacacgagtttgtggccatctgtaaaactgggtatttttgtgaagttttcgatacacgccaatatgctgtcatcgttttgattgagcctggtggttcctaaggcttaatttggcagaaggatccagcaccgatgattttgatgtaatttagtgttttagcattaaagcaatttggtttgtccaaaacaaaaacaaaatgagaactgctcttctgcaaggacaataatggttttagcggggaaacaatcaaacaaggacgctgtgtttgatccaatcattcagtgttgctttgtttgcagttgcggccacggtacgttagttttttttacacgtattgtgtatgttatggatgaaatatgatttaagatgcagagatacttacaacactaaaaataaacctgtgtcattcggtaaaaagaatttgcgttactaaaaaaagaatgttaaaaacaaacaaacctgtcattcaaagatttcgaggtaagaatttgagttactacaaaggagaattcgaggtaagaatttgagttactaaaaaggtaataaagatttcgaggtactaaaaaaactggtaagaatttgagttactaaaaaggtaaactaaagtacttttcctccgtgcacgcttttcaaactactacatggtgcaattttttacaaaaagtttctatacaaaagttgcttaaaaaaatcaaattaatccatttttgaaaaaaaatttagctaatacttaattaatcgctccgttttccgtgtacactgtgcgcgctgggaatggatggagccgaacacagcctaaaaagtaagacacgcccagtgggactcgaacccacaatcgcctgattagaagtcagacgccttatccattaggccatgggcgccttgttgtattattggagtttttatattatgtaaatctattaacatcataaagtttttatttcttcaggatgtagtcgaaatggaacaaaaataactaatagaaataaaatacagagtgtgtcattccctggagaaggtatgaactttgtgatataaattaggaccagataaaaaaaagactttctatatagatagaattctcgccccttctctaacagtagtagtaacaataataatgaatgatataaatgtttaaacaaaatattacaaagacaccagcaagaacaataaacaggtctgaacatttttgtacatggcttccccagtgtcctgtctctctgcaaatgagcaaacctagccgacctaacacggtaacaccaccctttgtattgcacagaatccatttgtacctgggtttttttcccccatcacatataaatggaagacacaaactattcagaacagaatgtgtaatttgcaacattagaatcatggaacttgcttgttcatgctaaattcttttcatgtctgaggccggttgtaaattaagcttcttgttgaagatgttgc

SEQ ID NO: 35425 - DNA, 387 bp, Oryza sativa
tcctgcagcttatgatgtttgtatttcaatctatctttcatatagaaatatacagtactccctctgtcccactgaataaggcacatgcctttttgaaattcaactcttcaaatatttgaccaacgattagtctaatataaattaaagtttagttgataaaaataatatcattagttgacatttaaatttactttcacatggttatgatgttgttacaaacattgtagatatgagaaatttaaattcaaagattatttttgaagactctgccaggtttgacagagggagtaatacaatttccaggaacacctcttttttgctaatgctatatacagtcaatttatttaagtatattgacacttaaaagttcactctggtatttgcagc

SEQ ID NO: 35426 - DNA, 1501 bp, Oryza sativa
gcataggagctcaagctccacgacatagaggggcgccgccgccacgacatgggacgcgcgatgtagagcccataggttccgggaccaggagagacctcgtgcgcggtccgtgtgtgttaacgaccaaatttggtaatttgagtatcggagatgaagattagatcgaagcagaatccaagacaaaaatcggttccggaaacaaagcaagaatcggttaagtccgaatcggctgcgaccttaattggcccagttcgagtcggacagggttagccgattgagccgattctgacaatacgactcattacacgttgtcgggttgagttaatatgcttcatatggattgccacactcggatcgagtcctggaaaggcaattgtatctattaattaggatattttatttaatttccttagagataagcttgggcaaaagtctgccgcaaagacttatggtatcttagagtttgttagagataagagtcgtgtccgacatggacatattttgtaatctcgggtataaatagaccccgagcctcatgtaaaacaacaacacatgttcaataacaatcttggcgcatcgccacccttttactttcgttttgtttcgacgagttctttctttcgggttgagttgcatcggtttcgatcttcaactagaggtaaaacttgttatggcggcttgcgttctcgagattagtgcttccatctttatgatactctaatcttgtttatgtaattcgtcgagttatcatatatcttatataatctttgacaatattgctatttaacctccaaccggctaacatctatcattggaaggcagccgattaggttagatatcaatgttggcttagattatataaggtatccaccaccctatgaaacagccaatagcttgattgtctagatattgtccctcttttcatacttatagctgcatcagttgagtttgaccttataagtcgtgattagaatatcaatctctagcctgccttttggttgccgattagggtagtatcggggtttcagccgatcttacctgatttagctttatattttatgtgctttattgatatgctagatctgtcctttacattaagatattgtttcatctagatatattaggctttttgtttgatatattttacttgttttaatatcttaatatagaatagtatcggagtattagccgatacatgctagatctatctgatcggctatgctatgaacatctataatcttatttttaatatatattttgatctaagtggtttatactgtctcggcatggtgacagatctatcccaatcacttggtttaagtatatatcgatataagggttatatattgttaatatctacagccgatcgagtagatttagtctcttctcacttatttatatctgccgatcgattcagatatgacatcggctcaaagataaatgatatgtcatcggcaactagccgatcggctatcatttatggatttaactgctattttcc

SEQ ID NO: 35427 - DNA, 1501 bp, Oryza sativa
ggccgaggcggtggaccgtgaggtaggcaaggcgggcagccggcaaggccggcggcgggcagccgagcaggcggccagcgaggcggcggcgctccccgggcgggcggcggagcccgaggcggcagcgggcgggcaccggccgttgaggcagcgggcagcgggcggcgacgctccccaggcggcggcggagcccaaggcggccgggcgggaggccagcgaggcggcggacggccggcacccgatctctgcgatgtggttttttcctgatctgtgcgatgtgtgcggccgatctgtgcgatgtggatttctttttctgatctgtgcagccgatctgtgcgatgtgatttctttttctgatctgtgtgatgtgtaatgtgtgaatgaatttgtggagatgattttgtgattttgtgaatgatttatgatgtatttggagatagaaaatgcagcttgatgtatttggggattttgtgaatgatctgtggtgttcgaatgatttgtggataatatgaatgatttgtggggctcgaaatcatggaagcagcaaggaaaaaaattaaaaaaaagaacattagccccggttgttaactctaaccgggactagatctcccggttagtaactccaaccgggagtaaagatccttctttagtcccagttattttaaccgggactaaaaatgggtatttttagtcccggattcgtagttccggttgcataaccgggactatagggggttgtgaaccgggactaaaaagggtttgtccaccagtgctagctagctaggttatgtgctactgcaccttatgtgccttttttttttttgacaaagcgagaatgcaacattcccaatattccaatattccgagcaaaaaggccgccgcaatatcaaacagtactatctctgtagagtatgtatccactacttccgtacaatccgtctcgataagattaatttgtggttaacgaggaagaattggattgagacgatacagtcagaggcaaaaattatctcctttaatttccctttgcattccttaccatttaaccatagttggtgtcatggggtgtgtgattttcttttttatattacatggtagctagatgcacataccactacacacgcaacaccatactcacacaccttgtgaatgtgtcccctaacatatactttaagagacggaaaccagcgacatatcactgatctcactaaagtcttattgaaagtccatatgcatgtgtgtaatattcttagacattaagattttaaactctgatagatagattcgtacacctacgactctaccaccatactattggtgattcccatggttgtatgattttgggcctttgaggtgtggagaaaaacataaggtagctcctaaatcaaacttaaagttaaaaggaccaaatactgccccagttgacacgtaattagcactaacctggagattaactgaagacccttctcgagaagccggagagaggacatcaaccagagga

SEQ ID NO: 35428 - DNA, 1501 bp, Oryza sativa
tttaacttaccttgtaaactgttccatatccaccttcaccaagctttcgctcctcagagaatccatctgtaatttcttctaacaattggtatgctacattagttggattcatagctgaatttgtaacttgtccgttttaccaatatctcctctctgtgtgatgagaataaagagtaataagtttctgagaataaagagtaataatttgggtaattttactatgcttgataaggtactgggagatgttatattttctagtgtcaaacttgatacctccagctaccatatatctcaaaataataaaattttgatacttacaaatactttcttaaataccgtaaaattttcctaataatttactcgttttatgagaagagaaagactggagttaacagtagcactctaaatcttgaactgaaatttctcaaagcctggtttatggcattgactaaatgtgaatgaagggattaaagaaagttcaaaatgagccccgagatatgcatcatttggagaaaaatcaagtgaatttcgactagttttcttactcccaacaactcacttcggaactcatagccacggcaatgtgtaagaatttgagtgagtactagtggagaaaatcctagccttgtattaaaagggaaaaaaaaggaaagaaaaagaaagaccagcaggccaagcttgcttatccatcaacagagacacaccatcagtaaccaacattccatcagaccaatgtgaatcatgaatcaaatgtaaaagcccaagctaattaaggagcaattgaacaaacagtactgcctgcacaggaattggaagcagtaattaattaattaattagcactaacctggagagagataactgaagatcgacctagctttcgagaggctggagaggagaaagtagagacgggatcaggctcaactcaatctatcgcaggagatgagatgaggagatgattataaactgcagtttacgccggcgccgtagacgacgagccagctgtaacgccggattgcttgactgattgattgtaccttctgatgatcagttcatggaccacgatcgagcaagttgaaattaaggacatctagggcacgcgtatacagtacagttatcttgtccaaacctgcatgcttattctagcttgctattccctcaagtcccattttaagtatagttgtgggtttctatgtccaatgtttaatcatttgtcttatttaaatttttttttaaaaaaaataagttaagcataaagtattattcatgttttatcatctaataataatatagatactaatcataaaaaaatttaaataagatgaacggttaaacgttggacaataaacccacaattgtatttaaaatgagacggatggagtacggattagtagtggtcattggccaagaaaatccgtagtgccaaaggatgagatggctaggtggggataattctgttctctatggaatcctagatttgtcaccaggtgtacctttttgttt

SEQ ID NO: 35429 - DNA, 1501 bp, Oryza sativa
ttgaaagctgaaacattccaggaccaatatctagagcaacatcctgcatcatgtaacacgatcctctaatataaagtcaaacactcaaaggagcatggttactgatatgtgagcccgatgttgatgggtcccacatgatagtgatcacttgggcatagtatgtcagaggattctcttcccatgcatcatatatgcatcatgctgtggggcaaggagagcaagagggcagggattgaaatttcggtaatttcaaacctccccccgccataacaatatcaaattttcgggttttctcaattttttgtgaatttagtcaaattcagttaaattgtgtcaaaatttcagaaaatttcgctccaaaaattaccaaaatttcggacatttcgattctactgaaagggctgaaattttagccaaaatcgaaattgaaaaccctgcaagcgggtagctcttttagctgaaacggttggtatctattctgactgccatagtggtaacactcataggattaactaggtaataccccgcgctttgctgcggaattcataaataagtatatattaaatattgttgaaatgatgaaagttgaaatgttgagaaaataatatgaggaagatgatttgacacatacttattaatctctataatataatattgtagatgatgtgccatgtttgcatggaatttaaaataggttagaatagtaattgctagtgagtgaagatgtggcatgcttacatgggatttaaaatgggctagaatagtaattgctagtgggtgatgatatggtatgcttacatgttgagctttaccttctaataattgttagtgggtaccaactatatagaaatatatagaaagatagatcagcatatggctcaaatatagtgcttctgaacattgcataagggaaattgtgaaaatcttctccaaggataactttttaagagttcctttcagccaactggaagggatggggtgaattcattcaaactagtcaatcatggttatgacgggaacatatcctatgcatataaatttcccgtgcacactccatacacactaattagcaaatgccacgaaacattctaaaaaaaaattggacatatactcctaatatttatgcatggttcccttcttggagtacagcatacctttgctggtttgtctctccataacgagttcaacacagcaaccaaaggaagctgtgcatagtgagtgtcactctccaaggtcacaaatgggttaatttgttgctgtgattgctatcaagcaaatctgtttgtttagtgtcgaaggaaacgaaaccgtcattagttttggagcaccgtgtatgagaatttgcctttaatttgcaccactcatgcggaagataaatggagcaccaaatgacccaaaccttgcgcacacgctggctctggcctatataaaggcattacacaacccatgaacaatttaccagtacgttcaccaccatggttagctcagctgcctgcttctt

SEQ ID NO: 35430 - DNA, 193 bp, Oryza sativa
acttgagaattttcgtatcaatctttactacacatggggcatggtcagagatattcctagttagggggagaacagttgtattgcggaaggttaaagtccatgatgcagaggtgaaaactcaatcaagtctttctagcaaatgattttgttgcatattgctccaggcgacccttctcccttgtaaagggtaagg

SEQ ID NO: 35431 - DNA, 353 bp, Oryza sativa
gcacataatgatttaatttattccataaataaatcatgacattgcagatgtaaactagattgaacgcatcattagatctacacatgtaataagcagtaaaacctgaaaaaccccccaaggggggaaatttcccccaaaaaaaaattttaaatttggcggcaaacaatgttggaacacaataccgaggtgtggcggaaagaccggttgctcggcaggaactactcgcagttgcgagcgtctacgaaggcgcgaagcacgcgagcgaagaggaagacgagccgtcgcgaacgaacagggagcagtcgcgcgaagcgcttcccaaaaaccttattgctaccttctcccggtgcagg

SEQ ID NO: 35432 - DNA, 1501 bp, Oryza sativa
caccgtcacctcagggcgcagccgccaccattgtcattgtaggccgcagccacaaccacagccaccgccatagcacccgggggagaaacagagaagagtggggatggagggattggtgcagctcatcgccgctgcaggtcgcagctgtagatgccgctatagtctgttgaggagagaagaggagagggcgagagactaagaaactgataggtggagagaattggagtttagaagtttattatgggttgtatggttatatgggtcgttcaccaatttcagcccgtcgagtttagctggcgctaattgaagatccatttggtggctgtcgacggtggatacccgtagaccggatatagagggtattggggtacgttggaacgaggatctacgtaatacgacatcaagcaaacaaaagacagggattatactggttcaggctccttggtaggtaatagccctaatccagttggtctgggattatatgatggaaataacagattacaaagggaataacagaactcgataataccgacgagatcgtagtcgagttggtttgactagatcacccggcgacttggcttctgcaggctacggcttcgtaggctgtggtagatgtgttggcggtgagattcgatgccttaggtcctcccgggggggtctcttttatatcgcgggtcagttgatctccaagtaggactcggagatatcggaccccttatgatacagtaacgacccagtcttgttcgagtaggacttctctcatgtgtggattcggtttctattacgtgatggattcccttaacgtatacaggaaacattcgtatacgcgcaggtataccgtatcggtatacaatatatatccaagggtagagggtatatcgtatccgtaaccctggcagtggctatccctcgctaacaatagctaatagcaatatagaatgtgtatagtacatatcttagctgttgttttttaagtaggtatctttagctatagcggtagttatagttggagatttaaattcttaattataaaatagtgtaatgtggataggtttgagcaatgtgagtcattctggattcgaaaaaaaggtggaattgtaaatggctgtatatttaaaaccgagtttggattctaagcaggctaaaaccgaaccaccgcatgcacgcatgcatgtgtactttacactgagattgttgtaccggtcaggcagaaatagagtactagtacgagtagtagctatcgcctatcagcatgcacgctgtggagattatgggtaccccatacccacacggcatggttatccgactagttataggggataacttatatctatgtaatatgtaacagatcatgacttgggtgttacgtttccttgtatattacggaacggcctaaagtcctgatttaggaaaccgataccgtattggttaaggtttctatcttgtaatcctgccccccatcctatataaggtgggcaggaggccctctagggggcatata

SEQ ID NO: 35433 - DNA, 426 bp, Oryza sativa
gctgagatcgagacgaactcccggtgtgtctgctcgtcacctggtacgatctgtacaggtgcttgcgtaaccttcatatgacacggggacaattcatgtccatgggatcaacagcgactgagtgcttcacgtgcatgtgttgatcaactgatatgcacgggttaatatcaaaccctagcttgatatatgcattacacaattaagcgtgtaatattttaaggctaatcaaactatatctgtttgttttgcatgtatactggagcgatggttggtcgcatgcacaggatggcaatcgagatcaaaaaatcgttccttaatgagtgatgggatttggctgtgctgccggttcctaacctccttgtaatttatatatttagattaattactaacgtatactaatcttctcatgattttttattgcatgta

SEQ ID NO: 35434 - DNA, 1030 bp, Oryza sativa
atgataaaaatcagattgagtttccccctgactgatttggatcaagtcagagaagaggagcttgaagaagtggtcgacggaaaggaagtgaaaactcccaaagcgaaagcgaagtcggcgactcatgaaattgattccatcgcgctcgttgataggaaactcgacgcaacccctacctggcgcgccaactgtcgaaacatgaattcggcaataataaaacggggtagcgcacgagacctaaaagtggatggatgtggagacaaaggatttagacaggttcaggccctctcaatgagaggtaataccctactcctgtttggggatttgaatccgccgagtgtgtattgatctgacgatcaggttgtctcatatatgccccctagagggcctcctgcccaccttatataggatggggggcaggattacaagatagaaaccttaaccaatacggtatcggtttcctaaatcaggactttaggccgttccgtaatatacaaggaaacgtaacacccaagtcatgatctgttacatattacatagatataagttatcccctataactagtcggataaccatgccgtgtgggtatggggtacccataatctccacagcgtgcatgctgataggcgatagctactactcgtactagtactctatttctgcctgaccggtacaacaatctcagtgtaaagtacacatgcatgcgtgcatgcggtggttcggttttagcctgcttagaatccaaactcggttttaaatatacagccatttacaattccacctttttttcgaatccagaatgactcacattgctcaaacctatccacattacactattttataattaagaatttaaatctccaactataactaccgctatagctaaagatacctacttaaaaaacaacagctaagatatgtactatacacattctatattgctattagctattgttagcgagggatagccactgccagggttacggatacgatataccctctacccttggatatatattgtataccgata

SEQ ID NO: 35435 - DNA, 232 bp, Oryza sativa
gccctcccagagggcggtaggcgactatttccgtcaattttcaaaatggaaaattatttttgtaaaacttttaataaaaaaaattataaataaaaaaaattcaacggctgcatctccccgacctccaagtcccaagacgaacttttactggaagtgggaggtggcatgctgctctagtgctgttcacttgtaacgcagactagttacataatgtcgttactttttctcaagg

SEQ ID NO: 35436 - DNA, 559 bp, Oryza sativa
tgtgacaattcatcaatctttggacgaaaattcagaatatagaccctcatcgtttgggtgctattatgcgagcagaacactagaatctttcgacacatcgccatccccaacctccgtgattgcaaaatcaaataggaggctggggcttgggtcaaagtaggagcgtccaagttctaagagtttctatttggggggagattacgtactttgacctttttaagtcgggcgaggactttcacacgtcgatgtacatactttaattttgtttactccctcactatggggtgtttggaagagaggggctaaactttagcccctctctcaaaaatataagtctctaggagatggacttatatttttgagagagttagatttatttgttcaaagaaaagacgcttaaaaatcattcagggctcttggtatcctttaccacattcactttccatattccctttctttagttcagacgctatcatacctcagggaaaaaaattttctatcaacgattcccacccaactctaaaatgactctcccctctctcccttaacatatcgaagg

SEQ ID NO: 35437 - DNA, 1501 bp, Oryza sativa
gttctttatgaacaccctcactattctcgtctccattggattagcagatgcagatttaccaggtttccttttctttgccgcgttgtttaagatttccattgtatttcttgttttgcaattcatttggtgctccaagattgtggctttgactacatgtgtaagaagagagctctcttcagtccactctcagatggctgtagggttttattagctgccgaatcatccattcacctaccaagaaagttgcaggagtgtatctcttggtagcggactggatgacgcgggagctaaaatttagctctgcgccgtttgtggttggactgaagggtgctcccttgctcaagcactcgtgcataaaatcatgccctaatgttaataataatcttcagatttctatatgagttttatgtccagtgtgttcagtttcaagatttggactttttttttatatcagtggtcaatgacctgggaaatctacagacagaaatctactgaagcattgactagactatccaagcctgtctggatatggcttgtcatcaacagtgctttatcatcattcttaagctgtatctactgaagtatgatttgattcggtttgtgtttttactatactggtgaggaaggaatatatgtccccaactgtatgctgttattgtacatacaatattcagggtgtgtttagttcacgctaaaacttaaagtttagttaaaattggaacgatgtgatggaaaagttgaaagtttgtgtgtaagaaagttttaatgtgatagaaaagttggaagtttgaagaaaaagtttgaaagtaaactcggcctcagttcaaaactacaggcatgtaaagcattattagttaaaaatgtcaacgttaacattattgtaaatgtgtctatgcatggaaatctctttattcacatcctgcggcccgtacatattgcataagtgctcagattaccacgaggcctagaaggttttactgagatcattgccgaaatccactttcaggggcagctagccagctaaacattgactttctgttactcagattcttcaggtcagttaattcagaagttggcagtttgttaatgaattctcttacggcattctgtaactagctagctattgtataaattaagacctatatttaatttactatttgggtagagatcgatgagttatatttgtgtaaagagtgattggatctactatctctaggatctgttgtagggaattaaacgcaacttcaaggattagtggtgcttacatgcatgcatgcacattggacacattgagattgatctgttgtatacatcatcagaggaggatgtaaacccagaggacatatactagtactatatggttaaggatggctttcccggaacatatatatcaaattagcaatcatgtagtatttttcttttgcatctccatcacaattatattctctgtgtatcaggcatctgacaaattcattttgtcaatgtatcctctcgtatcagt

SEQ ID NO: 35438 - DNA, 457 bp, Oryza sativa
atatcgccatctaacctacaatcggctatcgtctgttaatagaagccacccgagtaggttaaacaccaatgttgacttagattatatagaatatctaccactctatgaaacatccggcggcttgattgtctagatattgtccttctttttatacttatagctgcatcagttgagtctgatcttatgagtcgtgattagaatctcaatctctagcctgcttttggttgccgattagggtagcatcggggtttcagccgatcttacctgatttaactacttttatcttatgtgcttgattgacatgttaaatctgccctttatgttaagatcttgtagcatttaagtatattaggctttcgtttggtatattttacttgctttaatatgttaatatagagtggtatctgttaacaaccaaatttggtaatatcggcattgggaaagaagattagatcga

SEQ ID NO: 35439 - DNA, 1501 bp, Oryza sativa
tgggctcttggatagttttatgatacgacctctgttgcagaacttgccggaattgaccgtggtgttctcatgagggctttgaagttactggaacagaagggcaaagcagcgatttttaagggcacttcagctgatgatgaaggtgtaaaattttcggcttagtgtctggggcctgtgtggcagatcaattatcctgaccagcatctttgaatgacgagaattcttgccaaccaggacgctgatcacgtcctccccaaacatatttatctgccttactgttcactgctgctgctgttaaatgccatgttggcctgtccatctttgactgaaaaaacactgtaatcagaacttaattcatttccacaagcatacctacaaaaccctcctgttgttgtgtgataaaactaggaacttgtcttgcatctcatgcaaataaattttctatttaatcaggtctatttagaaagcaacagccaagcattggcagacctttattggagagtacctagtactaagtactgtactacctatggattacgatcacttcaggaagatgcaaaagaaaacccaaacccaaccaaggagctttcattttcccaactaaagcactccgtattggtgagcaccacaagtccgtaactcgagaaacttctgagaaccaaattcttaaatctttcggttcacactaccaaacagaaactgggatccacaaatccaatttgtggcaaaaacacgcaagaattcgatcctctcgatcctgccactgacatgtagaccacgaggaatcaatcatcagtcggcgaaggcccatcaacagaatctgtgggtacagcaagccatttcaacgcttttatttttttgatcaccacgatgaaaaacgcggccggctaaccggtcaaccactaccgtttttgacgtcaatttcaatgctcggaatgctatacagtcaggtacaatgcatacatctctactacctgcatctccatctcaaatcaaatcgaattttttatttaagaagagaaggaaaaagaaaaagaggagaataattgttctgttcatgagcagccactaatatgaaagggggagttagtggatggcatttgattttgatttgatcgataccattccgctttcacctgccgttgttgatcagccatggcatcactaaagtaaaggcccccaggaaccgatgatttggtgaaaggaataaacaaaaccagcacgcaaacctgtggtagcaagtggggggagttctttgacatatatacccctccttcctcttggttcctttcccccaactccattattgattcttgcaaggaggaagagcagctagaggcgaggcaagaaaagaagtgaaatctctccgttagacaggtttgttttcctgcgagtgctctctaatttgcactgattaagctttgatgatgcttgatttgtggtttgattgttcttcttgttgttggagataggaagaggaaaagcaagggggaattgggga

SEQ ID NO: 35440 - DNA, 1401 bp, Oryza sativa
tttgtaatatcggcattgggaaagaagattagatcgaagcatagttggaggcggagatcgagttcagaaatagagcaggaatcggctggagtccagatcggctacgattaggatcggctgggtctgagtcgggctaggtaagccgatgcagccgattttgacaatgcaacctgatgtatgatatcgggttgaattaaggcgcttcgaggtgattgccgcacatggatagagtcctgagaaggcaattgtatctattaattaggatgttttatgtaatctccttggagatatgcttgggcaaaagtctgccgtacagacttatggtatcttagagtttcttagagatagtagtcgtgtccgttatggacatatcttgtgatttttgggtataaatagacccgagtcctatgttacttttaacacacacgttcaatacaatcccggcgcaacgctacctttttgctttagttttatttcgacgagttcttgctttcgggttgagctgcatcggtttcgatcttcaacaagaggtaaaacttgttatggcggcttgcgttcttgggattagtgcttccatctttatgacactctaatcttgtttatgtatttcgtcgagttatcatatatcctacataatccttggcaatatcgatatctaacctacaatcggctaacatccgtcaatagaaggcagccgattaggttaaataccgatgttgacttagattatataggatatctaccactctatgacacatccaatggcttgattgtctagatattgtccttcttttcatacttatagctgcatcagttaagtttgatcttatgagtcgtgattataatctcaatctctagcccgcttcttggttgctgattagggtagtatcggagtttcagccgatcttacctgatttaactactttttatcctatatgcttgattgacatgttaaatctgccctttacgttaagatcttgctgcatttaagtatattaggcttttgtttagtatattctacttgctttaatatcttaatatagagtggtatcggagtattagccgatacatgctagatctatctgatcggttatgctatgaacgtatatagtctcattattaatatatatttcgatctaagtgatttattctgtctcggcatggcgaccgatctatcccaatcacttgatttaagtatatatcgatataatgattatatattgttaatatctacagccaatcgagtagatttagtcccttcttatttattaatgactgccgatcgatgcatatatgacatcggctcaaagataaatgatatgtcatcggcacctagccgatcggctatcatttatagatttaactgcggtttctttgcttctatttcttgttgattacagg

SEQ ID NO: 35441 - DNA, 448 bp, Oryza sativa
cgagtaaaatttttactcgtgatgacgtggacgaatctcagccgttggatttgttttggagggccaagattcaccctatgtcaccttgtgacatgtctaccctatgtcacccaatcccgctagaggcgaagaaggaggatggcgtaggagagactagagatgagtaagacgatgaagcagtgacgccgtgatggctcactggaaaggaggaattttaagtgtcggattgctgtacaggaatgcctgcacaagctaggtgtgtctagtggtttttgtacatgattgtgcgatatctatgggcctgcaagagtttcatatctgtgcatttagtgaattatattttttactgaaacatacttttttgtgtgactattttcagtacttatgatatggtttagcatatgaccaatctgtacgatgaaaatatgcaggaactcataaaaagtca

SEQ ID NO: 35442 - DNA, 1501 bp, Oryza sativa
ccaacggcgcgcgcgccggcgtcggttgaggtgcgtcagctgaattcgccgggcacgttacgacgtttggccggaggcgtgcaaccgtgccaccgcgtcaggtggttggctggtggccggcgcacctaaccgcgcgcaaagtagaaagacagtatgggttgcgaaagagcacgtaatctagtcattgcagtgacctaggtagcatcatgaaatattagagttcgaatcttcctacgagtgaattttaggttggtttatttgtggagctaagtttccaatttaaaagactgtatatatccggttgggtctctaggtcgggtaaaaaatacatttttctaaaataaaagaaagatagtatagatagaatggctggattgatgagaaaatgatctcaacagaacctagtagaaagatagtatggataaaatggctggattgatgagaaaatgatctcagcagaacctagtagagaagaaaaaggaagaaagaaagatggtgcctctggtaaccaataggcgaggatgatgacattgattagtgacatctgtgctgaagaaataagagcagtaatttttttttgagaccaaaataagagcagtaattgacaagctagtgtgagaagtggatggcagccatgtgtcttgcagttgcaggttggatttgatcaaatggaagtcaaacatatggcgatgcttacacacgacttttcaggcgatctgttgcatgcactcacactgccgaggagtaaatcaaacatcggactagtttgcatttgttctataaacaaaatagtatagtagcaggggcgtatatatcgttggggcttgtcagggctcaagccccagctctgccgccaaatctatcatcccttgcaacatagtacagtactgatagccaatgagaatggtgaaaacttaaaaagctgtgagtactaattagctagaatatatgccagattgcttcttactagtagtttgataattctatcacataatcgatcccaatttgttaacgttgagattaccagtttactaattttggttgatttttcattgtaatgttcaaaaacctctaaagtaatagataattcggaaatttggttatacggttaaacttttgatatggccatgcgcagcacaaatagttttaaatcatactttggttaaacaatgcatatttcttttgttttatttatgtattaattaattgagttagaaaagtgataagcatatgtatatttacttttgccgctaagataatttctattatgtgagcacacccttaatttgtatcctaaattcaccactgtacagtagaacacactagcctatatatctccctctcgagtgcagcgtgagttgacgcgccaaggcctactagcaacagagctgcaagcagagtggcagtgtgagtcgtaccgagagttgaagcacacatagccatctctctcgttgtttctccacgtaagctttttgtagcactagctttctagttgcaacga

SEQ ID NO: 35443 - DNA, 1501 bp, Oryza sativa
tcgcttttggtggcttgaagatagcctgtatgtacacacaatagctatcaaaaatcttaaaactaactgaaagcacgcaaattataatgtgttattatatctacttttctagcacacaaatatttcagaaacaaaggagaatccaaggccttaagcaggtaattcagaggtagagaaaaaagaaaaccaaatttgagcctgtaatttaccatcctaaattaataatagattagtctctcctttcaaaaaaaataaataaataatagattagtctcatactctcattatacagtatgccccaaagaaaggcttctactgttttaaaaaaaagtctacctttcttttacccaatcacaaacagacgaatttcagttcacatgcatgtctatcagagaaatttcagcacaaggacgttgctccagcataaattgcatcaactaagcgcaaaaaaaaaaaaggaacacgcacattccggctgcaattatgcaagtacttcgtatatccacaagagagaaacctgatgaaaccaaacccttccccaaccacatcgcacgaatccgatcatcagttgcagaaacaaccacattgccaggaaacagaggcaggatcggtacgcagaggcctcaccttgctgctggtgaagaggagctcctcgccgcggtcgttcctccaggagacgacctgcccgccgtgcaggctgacctacaaccaccgcatcaacccaagggacccgcatcagagtagcgcgtgcgcaggagataaaatgccggcgagctaatctaatcgccagccagaaacccgcaaaaagaagagtgaaaatttgcgcggcgactcaccaggacggacgccccccgcggcgaccggatcatgacctggtcggcgccgttccagtccttggtcacctcgaaccccggcctctgctcggagtaatgccccatgctcatcaaccaatggcaggagcgagagagcacacgaacccaccccacacgatcgtcgcaagaacttcgctggcgcgcacgaacgcacgcacgcaacccacaagactacgacgacgacaaccaccacttgtaccactactactaccccctcccctagtaccggcctcaccaatacatcgcgcaaagcaacgccaccgccaccgccccccagagggtcgccattagaacagttcggatgtctacggctcccccaacacttcccttgcgagcaaaagcaaaccaccccctgaatctcgtgaccgcaaagcgccacggcttttctctcctctgtcctagcttagttagccttttttttttcccgctgctgctgctgctgcgcgttgcgcgcgcactcaccaaccacccgcgcccgcccgcgcgccgggctcccctactcctaccacgctacgacgacgcccgcaaggcaagaaagcaggatacggcgagctgcacccgggagggggagaaatggagaatgcggcgtggatctctacgtttttttctctctctccgtctctcggtct

SEQ ID NO: 35444 - DNA, 457 bp, Oryza sativa
atcggaggtgcctaaaaggtttgcaacttcatcatccaatgttttttttgtcatattacatttgcacctatgttttgcacacttttttgtctccaaaatttagttgtaagttgatgagagagaaaatttgtgtggggaagaaagaatatatagaaatttagttcatttgctaaagaaggttttataaaatagttgagaaggaaaactctagtgaaagttaatcttaaataatagaaaacaaactaaaatgaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttgtgtacggtttttttactcatgtagatgacggcgtgcactatttttttactcatta

SEQ ID NO: 35445 - DNA, 1501 bp, Oryza sativa
gaaaacttgccttgatcagagaaatgttagcacctaatccacttcttcaccaattatgcaattatctagataaaggacacgatatgcaattaaacaccgaaagagctaaaaatccaaaatgctctaaaatgcatgatttatgcacagtgattaggtactggtctaaaatgaatttagtgaaataattcctattttatcttattccatttggatttgggagttatgaattttagaagttttatcggtttatagtagtatagtcttaggtagtgttatgaaatacttttgtaaagtgatttttattatattagacttcacagaggtgtagaggtgtgttttctaagactaatacatttggtttcacaatttttggagttataatgattttcttatagattttacaagttacaacgtgttttaggcatatagtgttttatatgtgcatgactctcaagttgtaggttcagaacttgctacttcatgtttaagttgaataaaaggaataatttggttaactaaaacatttttagttcacatgtttatgatctttactactatggttcatattttataaactagatatgctctaatctagactagcaatatattatattaacctagaaattgtatatgagctaagttcttctaagttttagtggatgaggatggaactatggcttcactggtcaatcaagtttttatttaggtttaattagacctaaagtgtatatatactgatacatgtttatgtattacttaaacaacactatgtgtttaaattcttatttcactaagttaaggttttgatctatgttctctacaaaaggtgccaaattttattttactatgttgaagataactatttgctggttctatagaaactttgttcatttcatttggattaaaaatgaattttctacaagttttacaaattaatggctgctctatgttagtaaatccttatatgaatatttagagacttttactacacagtaagtatataatcttatatcataacatggaaatacatgttttggtgatcctacagaacttaagtttactcaaattgaagctaaattgtgttctacatgaatttctaaagtttagcttatctaaaactaatcattctagagataatagttttagaggcatttgatgcaaagtaagtaattacttttatttcacctaatcagagagtgcatgatgatgaatctgtagaatttgattttgtttcaaaatgagttgagatgaattttctatgtattttataagcttgtacatgttttatgtatgacctatcttagataaattttagagacattatttgtacagtgagtgtcaagttttatatttctaaaatagagttcataactttaagaatctacagcaactggaatcatctcaaaatgagtttcatttgattttatatggattttacaactttgtgcatttttctgctaaacatatatttgtttgggcattttattaattattcttcaga

SEQ ID NO: 35446 - DNA, 1501 bp, Oryza sativa
tccagcccctcatgtgcaactgcaagctcaaccggtcgctacccaagtacatcctcaaccgcctggccaagtgccacaaacaatggtagaaggggcttcggctctgcaggcgcagctccaagctttccttcagcagctcagccaacctcacaacatttcaagtacagccccttcggcctgcccggaggggaatacaagtcaaggtgcgcctagttagttgccttcgaatcagccaggtctgggggcttcgccgtggagtcaaggaccacagttcgactctatcaatgctgctcaggcgccaaccgttcggccgcaagcaccaacgccaggcttcggagcaaaccaagcaccaaaccagatcgccatgacatggtcacagccaactttcgacccattcatggcggctcatcaagcatcaccaatcggggccgggcagccgaatgccatggcccaacctcatgcgcaagccgtgatttcgcccttcgccacgccgtacccgcagcaaggtgccatgaacagggcagggggcgaaaaggggctaccgctgagtgggggaatcaagacccgtccaatcccaccccagttcaagttcccacccgtcccacgctactcaggcgaaactgacccaaaggaattcctctccatttatgaatccgcaatcgaagcggctcatggcgacgaaaataccaaggcaaaggtaatacatctcaccctagacggtatcgcccgctcttgttatttcaatttgacagccaatagcatttactcatgggagcaattgcacgatgtctttgtccttaactttcgaggaacctatgaggagccgaagacgcagcagcatctactcggcattcgctagaggccgggggagtcgataagggagtacatgcgtcgcttctcgcaagcccggtgccaagttcaagacataactgaggcatcagtcataaacgccgcttcggccggtttactcgagggcgaactcacaagaaaaattgccaacaaggagccgcagacgcttgaacacctacttcgcatcattgacgggttcacaaggggcgaagatgattccaagcgacggcaagcaatacaagctgagtacgataaggcttccgtcaccgctgcttaagcccaacaacaagttcaagttgccgaaccacctcctctcgttgttcgccagccccagccggcgatccaagcacaaccgccaaggcaaggtcaagcccccatgacctggagaaagttcagaaccgaccgtgcaggcaaggctgtgatggctgtcgaagaagtgcaagccctccgcaaggagttcgacgcttagcaagcaagcaaccatcagcagcctttccacaagaaggtccgaaaagacctctactgcgccttccacggacgctcttcgcacaccacggagcaatgccgaaacattcggcaacgtggcaacgcgcaagatccaaggacgcagcagggagcagcggccgaagcaactcgtgaagtagctcaagaa

SEQ ID NO: 35447 - DNA, 493 bp, Oryza sativa
ttgtcatctatgtacatgtgtcgtctatgtaattgtggaaactaaatatataatatgtttgcttgtttgaatgttttatcctaggttctattaacaagttgattgtccatatgcacaataaaaaaacaagcactagtatttcatagagatgcatgacatttcaataagatgttgaataaccatatattccaaaagatgtcaccaaacagaaccacataatatataacatgataggatgccactatgcacctgactaattatgagttcgtattttggactaacaacaagaagtacgtagacggcacatgtcacgcccagaaattctcgaaccagaatttctaagctgaatgtgcattgaatccctgtccaggaccagccagggtacacaaacgacaattgttgacatacggatccacgtcttacaaaaatagaaaagattacaaatgcagcggaaaagataaaagcgagctaaaccgggaagcttgacttcagc

SEQ ID NO: 35448 - DNA, 1501 bp, Oryza sativa
atgcaatatcccatcccacacaagttaagaatttagagtctagcgaagtgtaatacatgtcccggtgctcaataaccgtgagcacggctattcgaatagattggtttactcacactgcagtggatgtacactttacccgcactccgcaactgcccaatacatgagcctcgtcccaacacatgagatgtgtcacggcaaagcttttcgataacctcgcattggcagtacccgctccatgaacttttacatcctcatgcactctaggcgtatacggtttctagcagtaagaggagttctggcgcaccttggaagggaagactcacacatgcattaagttataattatgtttagattctcacatggcagtcctaccgatggcgacaccactgtagacacccgcctcgcggtcctaccaatggctgccccaccgtagagcccctgcctcacacatcaagaaaccactatgcatggatactgcctccgctcagctatctactccgctaggtctatacccatacgagaagtgcggttgtacggggggtcgtttcatacttaacttcatggctcggtccttaattgaccagggacggcactagccttttccggacaccacccaaatcctccagccgccccagtcgaaaacagttgtttcactttattttcctttcacaaatcatgtcatcaatatcatggcaatgtggcgctcatgtctccacatgccgcatttcaattaccttcccaaaggtaattgcccaagcatatagcatttgacaaatatgagtatacatgattctagagtggcatctctaagcatttgtcatagttgactagagactcatacgtaatcatggttacaagggaataaggttaaacaataatcaaggtatggcatattcacaaataggatgttcatcattgcatgcaatcttatttgtaaataaaaataatttcgcaattgggatcaacatgttcaaggaatagtgatgacttgcctgctcaggataatccttattattgatataatcttgatcaaccttcacctcctggaagttgcagacgttgcctcacgactaaccgatacacaaggtctataatacgcgagaaaaaccaatattcaaacaacaatcaaatatgcgcaacaaaatgtactattcgtgtttgctaatggatcccaatcatgctaaggctaaagtttcttaatctttctattgtcatcgtggcctatttaggagttaaccaacatagcatttatgggatacatatatatttggctaatcggtggtttagtctatcaaatagctatggaaggattatggctacgtatgcatatatctaaatagcacggttacatatcagaggttctgttgttagatggatttaggatcaatcaaataattacagtgaatcatttgtattattattttattgatggaagctttactttaattatgaacatattttacttgccattataaattataaaagggctaataattatcca

SEQ ID NO: 35449 - DNA, 1501 bp, Oryza sativa
  unsure (1)..(1501): unsure at all n locations
cacgtatatataaaatcaattattttttagcacctagggtgaaaaatgaactttgagccaaattcaaggaccgaaataaactttaccatgccattataactttgtaaagtttgagatatgttatcggtatctcaatgacatgtaagacccacatgagtcaatgacatgtggatcaggatggcatataacaaattttgcaaaattataatggcatggttccaattttcccactaaaaattgtagcatgttgttgatgttacttggccaacttgggacttggcaaatacaaccttcatatgttacattttataacaatagtaaaatagaactcctgttgggttaaatagctactccatccatttcatattgtaagactttttagcattgcctatatttatatagatgttagtgaatctaaatacatatatatgtctaaatttattaacatctatataaatataagtaatgctagatgagtcaatgacatgtggatcaggatggcatataacaaattttgcaaaattataatggcatggttccaattttcccactaaaaattgtagcatgttgttgatgttacttggccaacttgggacttggcaaatacaaccttcatatgttacattttataacaatagtaaaatagaactcctgttgggttaaatagctactccatccatttcatattgtaagactttttagcattgcctatatttatatagatgttagtgaatctaaatacatatatatgtctaaatttattaacatctatataaatataagtaatgctagatgagtcaatgacatgtggatcaggatggcatataacaaattttgcaaaattataatggcatggttccaattttcccactaaaaattgtagcatgttgttgatgttacttggccaacttgggacttggcaaatacaaccttcatatgttacattttataacaatagtaaaatagaactcctgttgggttaaatagctactccatccatttcatattgtaagactttttagcattgcctatatttatatagatgttagtgaatctaaatacatatatatgtctaaatttattaacatctatatgaatataagtaatgctagaaactcttacatcatgaaacggaggaagtatattcttcgtatagtatgaaatatcttccgcctttccacatcacgcttacgctttctatccaaagaaaaaatatcctgatggagcgatctctccattacagtcaaacggacagaaatggccactccatccggtcatccgtattccccaaaacacccttaaaaagcgtccgctgctgccataaatatctaaggnnnnnnnnnnnnnnnnnnnnnnncaaccgcatccgccataaaagccgtcgggtttagcgataagggttttaacatttggctaaaaaattttcgagccaaaaactttaccaaaatcctccgaaattcctgcgtctttcagctcggatcaggcattcaggcccttctcc

SEQ ID NO: 35450 - DNA, 267 bp, Oryza sativa
ctgtgccaaacccttgccgctgagctgctcagcccgggtgcatgcaaggtgctcgacacggtgccgcaccgcacgtgcccagccaccatcaacccgaaccctgtcgcccgccgccttgccgtggtcgtcgcccggtgtgccactgccggccgcttaccagctgccgctcggtgagaacttggtcgtcctcccctctcctcatccctcgcgtgccgcgttcctatgttgtcgcagcccgcaagatcgtcggcgccgccgcactcggca

SEQ ID NO: 35451 - DNA, 1342 bp, Oryza sativa
atagctattgcctttttctgatctgaatattgatcccatgttcttcagttttgtcagatttcagaatttataagttccaagtggcatacaaatagaaaaatagacagttcaatataattcccgtagatttaaactcccaacaaatggaaatggaatccgtctgttaaaattctatgcatccaaatgggggcaggaaggaatcagaaatcagaaacaggctatggtaaaaaaattatccccagtcatcatcagtaaagtaaaatatgagaaacaaaccgatgtcctaccagatcaaagtgatgcttaaagccatgattaaagtagcttaaatgctcctttcctgacatagcagtgacttcaatgcataaagtgtaaagattggcgagctgtttcaatcatctacatgtccagcaaatataatgtaatcagctacttgttcttcaaataatatctagtctgatgcctgtctccacttgtagatgacattgcagtgacttcaacgcgtgaagtataaacattgctgacctgtttcaatcatctacatttccagcaaataatatcgcccacagtttgtcttacaaatactgtttgtcaaatagtgtatgatcccaaaagtaataccatccacggtttgtcttaaaaatcctgcagctcacaagctctgaaactggttaatagaaggcggaaacacaaacgggctcactagaaggcgctcaatggttcttttgcgcctgttctcattcttaatcccatctggagctgtagaaccatcaggatgtgaagaaacacgatgagcaacagagtgggtatttcagcatcactcctagtaagtagatttcggtgttacagtaaaatttatgtcggatacacttcagagttggtttttgtagccttctgttgacctgctatgatccacttttttcttacctgtctgcacaagattttgattactggaaatgctttggcgatattggttttcctctatttgataagagaccatgatcttgtgcctctagttggtcattctgactctaaagctatttcaccttttggaccaaacagaggattttattttatatttcccctgctattattttttaaaaaaacattaacaataatagtatcacatatattgtaatttaacatgattgaactattatcttgtatttgtgtttttttatgttcttcactaatgaattagttcacagtaccatcaacttttgtttttgtatgctaggactgaagctgatgtgtagctattgctagtgctttgtgttcttaactaaaagcaaacatcatcatcgttgctatctatataataaccagatagaataaatggctg

SEQ ID NO: 35452 - DNA, 486 bp, Oryza sativa
cgatctttagctgcgtcacgaaccctgtcgcgctaaaaaaccgcccgcttcacgtaccctgctgcgccaaaaaaccgcaccgtcttgatcttgatacacaactctcatcatatttcattcgtcactatgtccctaaaatcggccgaatccccatcgattcagatctgacaatttccagtccctagtgtcttcgctcaccgacgctatccagtggagacagagaagaagcccctccaatatagttttgcactgaaagacctacttgggatacttctccaggctactagtttttacattttgtttatgaacgtttgactaatatatcataacatctcaatcgatcatgaaaacaagatatcaattctacatgttacaccctttatttctctgaactacacgccgcaccttgcaaaatttagaaatacacctaagcctattaagtcaaataggtggcaaagtgaccacccacctttctttctttcttta

SEQ ID NO: 35453 - DNA, 731 bp, Oryza sativa
ccatattgccattggccattgcaatggatgaatgaactctttagtatactagtccggacctccggtggactcgagggaaaggagaacaaattttgaaagaattacttgtctttcgccgtgtttaggccttgttcagttccaaactttttcttcaaacttttaactttttcatcacatcaaaactttcctacacacacaaacttctaacttttccgtcacatcgtttcaatttgatccaaacttttaattttaacgtgaactacacacaccctttattggataagtaaattggcatctaaacacattttagggtatgttaacaccactctaaaatggcatgactaaacggaatcgaaaccatgtgacggtagagctagttgtgattctcagctcttaaacgaagcacttgctgatttaagctaacgttccacgcaagttaagcctggcacacaaagtactctgacaatctgacatccctgcaccactcgcggactcgcctcatcttctttctccctttccactgcaaaatgccaaaaaccccaagaccaaaacccccttttggtcttagctccaaaccgcaaaacccacagctgcatcgccggatcgccccctcccacccagccccaatggcgaacgcgcatcccatggtcccgttggtgctccgaacctcctcccgctcctccgcgacgtcgacaccgtgcagttcgccctcgacgtcgcccacgccagga

SEQ ID NO: 35454 - DNA, 1501 bp, Oryza sativa
  unsure (1)..(1501): unsure at all n locations
ttttagcctgaattcattcgtgatatgttgtgatccaactatgtatgtgtgtaccaactactgatccagagattggtacggataaacacagaagatttccgatttccaaaatcgggggtctacaccctctaagctacatcttcacctttcagtaactatatagatagtatatatccatttgttttaatgtcctcaatgctccttccatccatccatcccagtttgaccatcctctaagcaaagcgtaccaagaccaaggacaccaacatatccatcattcttaaattaatgctaaggtgttccatcgcttcgtatcccgtgaactgctcttattttaaatattatgatattgcactaatagaaattaatcaattttagttacatgcaacacatgcaatgatgtacatttactcatttcataaataaacgaaaagacactagttaaatgatgatcattttaggaagatcttagaaaccttaggggatgatcaaattgagatggagagagtacttttcactgaaaatatcttgatactagaatataagtaaattttgtttgttgaactcaaacaccacaaacttgtcacaattacatgtgatgatctacatgccatcttttttttttggtgggtgggcgatcgattgcaccacgtatatataaaatcaattattttttagcacctagggtgaaaaatgaactttgagccaaattcaaggaccgaaataaactttaccatgccattataactttgtaaagtttgagatatgttatcggtatctcaatgacatgtaagacccacatgagtcaatgacatgtggatcaggatggcatataacaaattttgcaaaattataatggcatggttccaattttcccactaaaaattgtagcatgttgttgatgttacttggccaacttgggacttggcaaatacaaccttcatatgttacattttataacaatagtaaaatagaactcctgttgggttaaatagctactccatccatttcatattgtaagactttttagcattgcctatatttatatagatgttagtgaatctaaatacatatatatgtctaaatttattaacatctatatgaatataagtaatgctagaaactcttacatcatgaaacggaggaagtatattcttcgtatagtatgaaatatcttccgcctttccacatcacgcttacgctttctatccaaagaaaaaatatcctgatggagcgatctctccattacagtcaaacggacagaaatggccactccatccggtcatccgtattccccaaaacacccttaaaaagcgtccgctgctgccataaatatctaaggnnnnnnnnnnnnnnnnnnnnnnncaaccgcatccgccataaaagccgtcgggtttagcgataagggttttaacatttggctaaaaaattttcgagccaaaaactttaccaaaatcctccgaaattcctgcgtctttcagctcggatcaggcattcaggc

SEQ ID NO: 35455 - DNA, 1501 bp, Oryza sativa
catcatgcaatatcccatcccacacaagttaagaatttagagtctagcgaagtgtaatacatgtcccggtgctcaataaccgtgagcacggctattcgaatagattggtttactcacactgcagtggatgtacactttacccgcactccgcaactgcccaatacatgagcctcgtcccaacacatgagatgtgtcacggcaaagcttttcgataacctcgcattggcagtacccgctccatgaacttttacatcctcatgcactctaggcgtatacggtttctagcagtaagaggagttctggcgcaccttggaagggaagactcacacatgcattaagttataattatgtttagattctcacatggcagtcctaccgatggcgacaccactgtagacacccgcctcgcggtcctaccaatggctgccccaccgtagagcccctgcctcacacatcaagaaaccactatgcatggatactgcctccgctcagctatctactccgctaggtctatacccatacgagaagtgcggttgacggggggtcgttcatacttaacttcatggctcggtccttaattgaccagggacggcactagccttttccggacaccacccaatccttcagcggcccagtcgaaaacagttgtttcactttattttcgtttcacaaatcatgtcatcaatatcatggaaatgtggcgctcatgtctccacatgccgcatttcaattaccttcccaaaggtaattgcccaagcatatagcatttgacaaatatgagtatacatgattctagagtggcatctctaagcatttgtcatagttgactagagactcatacgtaatcatggttacaagggaataaggttaaacaataatcaaggtatggcatattcacaaataggatgttcatcattgcatgcaatcttatttgtaaataaaaataatttcgcaattgggatcaacatgttcaaggaatagtgatgacttgcctgctcaggataatccttattattgatataatcttgatcaaccttcacctcctggaagttgcagacgttgcctcacgactaaccgatacacaaggtctataatacgcgagaaaaaccaatattcaaacaacaatcaaatatgcgcaacaaaatgtactattcgtgtttgctaatggatcccaatcatgctaaggctaaagtttcttaatctttctattgtcatcgtggcctatttaggagttaaccaacatagcatttatgggatacatatatatttggctaatcggtggtttagtctatcaaatagctatggaaggattatggctacgtatgcatatatctaaatagcacggttacatatcagaggttctgttgttagatggatttaggatcaatcaaataattacagtgaatcatttgtattattattttattgatggaagctttactttaattatgaacatattttacttgccattataaattataaaagggctaataattatcca

SEQ ID NO: 35456 - DNA, 1501 bp, Oryza sativa
cttcttctccttgaagagggcgaggagagagacgccggagaccttcaccaccttgaaacggacaccgggaatgtctcccacagcatgtcccttacgaccaaacccagcgatgagcacctcgtcctgcatatcccgaacggaaaatggtaagaacatgataagcaacaagaaagctctgtatggcagcagttgaacatacattttcctcgatgaagttcaagcaaccatcgttcggcacaaaggcagctatcttcttcccattcttcaccaactgaacacgagcacacttacggatagcagagtttggctgcttagcttcaatgccactgcagataaagtaatgcatgttggttattgaatgttcttcagagcaaataattgctctacgtttattgcacttacatcttttcaaggacaatgccctttgcatgagatgaaccagcaaagggtttcttccattcattgccaagatggctcttcttgtatgctttgtcggcccacctctggtttctcctgtgggtcttgagcttgcgcccagctcccataccacgtgtcttactgcaattgcatccaagaaatatatgtaaacaccaagtgcatcaataaagttctaaagctatacgtcaaacagtttcaacatgagcatcaaaggaactagaaatattagcacagtggtatattaagatgagtgtaattgcttttgttctaaaagtacataggtacaactctgtctgacagatcactccattgaagaagattcaactacccaaaagtatgagacgaattttgaggactcaacaaccagtttactgcaagcatcactcatgaacaaccaatttgctaaagggaaagcagcaaaagagattcgacagtgcaatttaagttcgatcaggctaagggcaaacgcaaatgtcccaccacctcttatagtcgcctccaattggaaaacatttcccaagggaaacactatgcgtctaatatgcatccactatgcaatactcctacaaggcaatagcatagcaaacagatgtatgcaactagatatggttgtggtgactactacttaaatcagtagagcacaatccagcagacagaaaatgttaacaagcctgctatatttacactccagtggagtctagccatggaaatattgaattaggggtgaatgctatgctgattgcttaagccagtgaattgagagcatttcatcagaaagagttactacacccatgagattatgatccatatttcagcatatagtgtacactgccgtagcaaaacgtaaaaatgtatagattgctaatgactagggagacctggagggtaattcataatttcgaacagcaactaaatcagctccagccacaagaggcatcttatagctcatggacacgtatatctctcaatatgccactaaattatttgaaactacatcaaacaaagtctctggaatggaatcagacaagtaaaatcacaacagcgcatcgttagatgaacgaaa

SEQ ID NO: 35457 - DNA, 287 bp, Oryza sativa
cagctcaatcaatccagatttgggagatccccaattcgagatgaatcatgacaaatcatccgtgtgactgtcacttgtgaggctgtgaaagatccaaaaagttggctgcttctgcatctgcttctgcttctgtcagtcaagctttgtactgtactgtgctacagtgctactagtaggtaccagccacatcgacaataaaagctccaggctcacaagccacagctctctcacacgagagctcgagtctctctcgtcggcgacaatggcgagcggcggcggcggaggag

SEQ ID NO: 35458 - DNA, 529 bp, Oryza sativa
accccccctcggggaaatcaggaggagggcggacacctcaccctcgggcccgacgtccccgaaggtgccaggccacgtgggcgattgtgtctgcctcaagcctctggtcacgatactcccggtcccatatcaccgacagggctcgtaagtcgtaatgcctacctttgtcagccctgctcagcccctgcacctaattacgatcggcccatatatgttgggtcagaacgggagcgtggtgtatgttaggcttatttatactcggaataggttcactttagatttctcatttgacatggagtttccgtttctaaattgaaatactagatataacctattccttaactaacaaaaccggattactgaaggtcccatgaaagcagtattccttattttgtctaacgtggcgagttgatcgtagtcaacaacgctaagtcgacgtgggacctacatggaactcgcgtgttatggcccttatctccccccctccgctctgttcccatctcaccagggcggtaggcggtgaggagga

SEQ ID NO: 35459 - DNA, 1501 bp, Oryza sativa
  unsure (1)..(1501): unsure at all n locations
cgtgggtcccacgctgactcagccgccacgtcggacaaaaccaccgagggacctaatgcgaacggttttgttagttgagggaggccagttatctggttttgcgattgggggacgattttgtatctcgatgacaagttgagggaccttggttgtactttttcctttttaaaatcggtcatgcctacataatccgattggaaagcaacggaagggatggtttatgggccttttttgggcagcaaaaggcgcatgtatatgggctgccagtccacacaatcgaagtgtcttactgggcctaatgcttatggcctcaaaacataagaaaatatcagaataagtccacctttaaaagtgacccgaatctaattcataaccctaaactgcaaaatctaattcataaccctaaactgtaaaaccggatgtcttgaccacccaaactgttgaaaccggtgcaatttgactcctttggtggttttggagggcggtttagctgacgtgacgcttatgtggtggtgttgatctagtcttcggggttgacgtggcgcttaggtggcatttgagttaaaaacgtatacgtgggacccgtttgtcattcacacacataaaaaattgtggggcccacagacatgtgggccccacatgtcatacttcttctccctgccactgacatgcggcgctgatggcattgaaaccaccggggcgtggcacgggacggaacacctgcccgccgcttccgcagctgccatggctgagctcgctacggttcaatcccgttgggctctcgggccgggggctcacgtacttgcacggttggttgatctcgccgccgtcgacgccggcgccgacctccatggtggtggcggtggcgagcttccgcttgagggaggagttctagtgattcttgacggtgttgttggtgcggccggggaggagccacgtgatggtggcccaccagttgccgaggcggtcaccgtccaattcctcgtcgtccaatccctcgccccatgccactccactagccgccacagcgcctcatcctcctcgggacttcatggcccctttatcctatcacactctccttccacccccatatccaaatgatttcctcctcctccttcctcgagctgctctaatggcggcgtgggtgattagcgatgtggatgtctcatactcgccatcaccactttagctcccgccgccgctgccgcttcaactcctgcccgtgctccctggctccccgcagccggccgaaggactgagaaagagaaagaaagagagaagggaggaagaggggatggaaggcccgcgcgacgagctattagctcagtggtagaagcggtggctctcccttgggaattcaaatttntggccngcgttcngngtntggngtnaccnnccantngnggnnnctgtgnanngggcttctcnnagccacatggatagttcaatgtgctcatcagcgcctgacacgaagatgtggatcatccaaggcacattagca

SEQ ID NO: 35460 - DNA, 462 bp, Oryza sativa
aacattttattaaaataaagagagactcttgttaaaaaaaaaaaggaaatatcgctttatgcctaggcaaaattctgaatttatttcggatggtgagctatgtaaaagtgaggaagggtgcaaaaaagcaggcaattaaatgtcagtagtcctatttagggtggcaatgtctttctttaaagaatcgggtaaaggttcatgccaatcaataagggtcactcttaggtgtagaagtgctaacatatatatgtagaagcatatctcatcatgtggtcggataatgttttacacccttgattaaaagaagagatttcttcctattttcagttaagatgtagtcaagataacaagagaggtgttaccttaaatagttaactagtgctctcatccagaggtgattacataacacttgaaactacacagtccagggtcagtcggtatattggtgccccctagtagtca

SEQ ID NO: 35461 - DNA, 298 bp, Oryza sativa
tttccgtttgaaagatcctaatattattctgtgaatggaacaatagatatactggagctttagctctgcttataatgcaccactatcttgcatggctagttgagctgttgtgctaataggtgggtaggagatagaatgagattacttaaaatctttacttttggttgatgagtgtctgtcttctgcacaagggttgcatggtgtttaacagtactttgtcgaaccactatcattttctctgtttggccatttccccatttacctgcagctgtttgaaacttgcttattgctatgcagg

SEQ ID NO: 35462 - DNA, 208 bp, Oryza sativa
agaatgaatgaaatagtcataatttcttgtaatttgtttaaactacagaagaagtaaaggattcaatgcaaaacatacccgttatcagacttctgtggaatggacacatcccatacaaatcctgctaaactgaacatatccatgatctcctttactgtaatctgcaataatgaaacaaacgcatataacctctgttatctgttttaga

SEQ ID NO: 35463 - DNA, 743 bp, Oryza sativa
gattgtttttttttttttttgaacttgatggaaggattgttaggagttaagaagaaatggaaactatggaacgattggaaaaggaaacgatggaacgattggcccagactcccattcgaaagctggcaactgggccggcctaaatcacggaaaaccaattgggcctccgaacatacaacaatgggcggaaggcggcttgagggctgaggcgacatagggcggaggaggacagcacgcgctccgctcgcccgccgccccacgccccccgcacgccgcggcccttcgctcggctgccggttgctgccgcgcccctccgctcgtccgctccactccgcgtcgcagcaccggggtgggagccggcgcggcgagtccggccggcctcggggaagcgctgccgcgctcttcccgactccggcgactgcaacggctgctccaccgcatgcctacaggtcgactcttgagcatccccctcttatactcctgcagttttagctctccgccactattcattcctttcctttcctagggcttagctgaaatttctccgtagcgaagaggaattgggtggtgggggattaaacccgatccatctgcagtgaggattttcccccatgtgtcaaacaagcatgctgtggacttacatataggatgatagaacttagacgaggtgcaggtgcagtcagtggctcaactgaacccccttgtcccgcgttaatttccgcctggttttgttgtgagtgcca

SEQ ID NO: 35464 - DNA, 371 bp, Oryza sativa
cgagccttcttgatcgcccgttgaccccgtcaggtaagtatggagcaatagtgcacggggctctctacttatagccatctctcccacccgcacctcctcgactccgcgaggtggtactaatccccgacgcttccacccgttttcggtaggaattttttttatttataattttttttattaaaagttttacaaaaataattttccattttgaaaattgacgggagtagtcgcctaccgccctctgggagggcgaggcgaaaatgacgtggcagccggccgttcgctctcgggcgacggccgtcaacgaaatttgcaggcggcccccttgccgccctccgctagggcgattttatactgtgcggggggccgcc

SEQ ID NO: 35465 - DNA, 1501 bp, Oryza sativa
gcggcgggcgtccgttggccaccggccgcgccgtgcgcctccagtctcctccagctgccgcccgtcttctcctcgaacatccgacccaggcgcagcggcctgctcccgcgtcgcagccgccacctcgtcacccaccgccgcgtcgccggccgtcggacctcctcctctcccgcctcgccccagcgacctcctcccacccgtcggccggccagcagagaggagaaaagtgagagagagagagagagggggaagggagagagagggtgatgacatggcatactgatatgggggctcacgctgactcagtcgccatgttacataaaattatagtcaaaaccaccaaagaaactaaagtgaacggttttataaattgagggatatcatatatccagttttatagtcggagatgattttataataactcgatgataacaagttgagagggaccttttatgtactttttcctttaattatcgattgatagggtcgcgacgatgccacgagggagtcgcatgcgacgatccctcgattcgcttggccaggccggcgagacgacgcaaaccacagcggagtaaactgagatgttgagaaaacgttagacaaagatcgatgtggcagagccgcagaggtgtcaactacccagaggccagaactacctcaacggattacatgcagtactaggaaacgatccaaaatcaatcccacaaaaatcatccctctataaaaaggtcgtgatggaaaggtaaacgggtttgggttgtaaacacacctgaacgagtcgaaacaatctactgcgaaggtgggaatatagtgtcattggataaagtgggttctttacaaggcccagctagtctagctagtacagaaagacttggaatcaccaaaattgaacgtcataaacatctcaaaaaaccaaaaaagcaaaccttaacgacacgaaatttgttctaagccatggaatataattatataaagaagaatgttggcatgtggcaacaatggatcacgaacggaaacagcattgacaagatgatcaacaccctgtaaggtctgaaactctgaatagctgattctcactgctataggaaaccgtcactgtgcaggtacacaacagaaagcatgccttaaaaatagttctacaggttcagcagttttaatctggacttcaaaagcaccgcccaggtatttcatttataccaattcagctcaagatttttgtgtagtacaaaagggggaaagttcgacacccacaaaaataaatcaataatgatacaagtgaacaaaaaaaaagtttttttcaaagctatacttgatgggtaacttacagtaaccatggtaaagtaacactaacaagatgaacaacgagacagaaaaaccttgcatggttgagcttttcaaagacttccatggcaacgtcccaatgccaactatatgttgtatatcgagcatcaaacatgtatcttgggagttgaaatttagcatcaaaatctttgagcagcca

SEQ ID NO: 35466 - DNA, 1501 bp, Oryza sativa
gctgaggataagggcataaggagaaccatatatatttggctcccatgccacacgtcgttttttccccacgtggcacgctcagcttgtagtgatgacatctatgatatattataagtattatattttaaaaaatatattaatattataggcatagacttttatctaaaattggtacctctatgtgcttaaaaatgtagtcttttttttttcctcagtggaggtgggaaatggttaataagtgccgtttttaatttttttcgccctgggaattacagttcttgtgtacgtttgaggtgctgaacaaaaatgaccgtccgttattagctaatccgatggttcccattccattctatggtctgtcagacatcacaggctcacagctagtaacgcctaacagcggtgaattgaccgtacatgatattaccactttaccaggcgtcacagatcagaaaagctcatatacgcaagctatcagaaggaaacgcggctagtcgttcgagtctgtgtacgtggcactgtcaaggcagtgcatagtacagacatgccaagctgggcgcatttcagttgagtttcttcccttgataaaaagaaaacacggtggcgacgagcaactggtgcgccggtgccgtcctggaaagtcaccggccggccgatttgtttcggtggatttggtccatttgcacagcaaagtgtgacggggcagctaccttgcacaggtcagacgattagtacgcaacagctgcgaattctgaagctttttcagttgtttactgtcatggtgtcatatttctcgcatcgatcctcaacatatgcatgacaacgtggactcatcatgaattcgctgtaacggtattagagctaattattatcatttctgatcgcatatggaaagcttcaacgtcatgactagttcagtcagcaagacgtagctgatttgaattaatcaagagaagcttgtgagagaaacgacgcacaagcggaatttggagttttgtagtttcagttttggctgggagagtgtttgtggcttgagttaggcttcctgctgccacgtcaagacaccatctggaagactggaaccatctatcccagagcaaaactaacaaagccacagtatgctcacacgtgtacacatctccctctaaattatttcttcgaaaaggactcggacatcctattaaaggatccaatattctgataaaacactcacaagctactgagtgcaaatcttcaattgcaactactttctgcgaacttctgatcgaccattgcagaatccaactaattgtttcttcagacttcttcagagcattctccaggacacttcgaacgaaacatggtaagcatgataaagctgctcactgcttcagaattcaggttgttgtcttgccaactgaatttgccaagaattcagtgatcagttcttcactgatttggtcataattcagtgatcagtttgttcgaagtttcagaattcagaactttatgcgtgtgtttgtgc

SEQ ID NO: 35467 - DNA, 1501 bp, Oryza sativa
atttcgtgaataagatttgcatcctgtggtgttactctgatccatctagcatggtcatcactagatatatttatgttgtgtcaaagcgtaaacataatagaaaacgtgttcgacattatgcacctaccattacagttcccaatgaccttctcaaattgtatgtttggaatatttcttagctctcttattcatatcggctgaatttcattcgtgcaggctgtacccacttcaaagggacaggctcttgctgatgaatacggaatcaagttctttgaaacggttagtgcgaagtcacaacttctgttctggtattccttcatcgtaacttgttggtgacaataaatgttgctttctcctaagcattgatgcccgaacctctgtagccaatcccatgcataatttcgtttcattatgactactgcagagtgcaaagacaaacctgaatgttgagcaggttttcttttctatagcaagagatatcaaacaaagactctcagagactgattccaagcctgaggtatgaattaactggtttgacatactttttttcaataacgcctttccttattgtgttcttttgattgcaggaccgaaccatcaagatcaaatcggaaggggaagccgaggcagcggcggctcagaaatcagcttgctgtggatcttagaagggttctcactacatggataaaatggtggtgaaatggtgcttgtaatttttatcatttcattctttgtcagctactctctttgtgcgttatttaacttattgcaattgtcttgatttggacaaatgggtgttaagtgagaacaattactttgaatattggtggaaagtaactcttgctcttgataatgatgagcgcatatagaattgggttggctgtgctgatgttgaggctacagccagtagataacatagaagtatgcaaatttttttatgtagttaattgcgtttctgcagtgttcaactacagttacttgcgacactgggttactgatcacgtagaacgtagaagaaatcgaagaccacgaactataacataatcaactccagaatttgtctattggccgatgcccgctgcaagcccagtatcacccatagtatttattttattttattttattacaaagaaagaatgatcttgcacgattcatgcaagaaaggcaaactacaattctgtaattacaagtctgtaatcaaatcgtattcatgttgtattttgaactattgatcctactgtttttttggagaacagctgccaatttttcaaatttacaaaaccaaaaaaaacgataaaaagaagaaacgatcacatggttaggtagggcagaatgccattacaggcagtctaccagcaggaggcctgtgtcgtcggcgggagcagcgttcaggtccaagccaaccacacccctcgcctcgcgtggattccgctcgggcgccggctcgccgccgcgggcgctcaccgcctcgtcggcctcggcgccggcgatgcggtgccgc

SEQ ID NO: 35468 - DNA, 1501 bp, Oryza sativa
ttataacctgttgctatacttaatttagagatgatttgttttctttccatagtttatttgttagtattgactttttaaatcgctagacatatactccataaattatttatttatttatttatttttacccataaattacccttttgttgcagataagtcatacaacttataattaacattagcctaattcatggcacccgagagatcatgtatacgtactccctccgtacttgtaaaggaagtcgtttaggataatgtttaagtcaaaccttgggaatataaatcatgaataaaaattatatgaatagatttgtcttgaaaaatactttcataaaattatacatatatcagttttcaataaatatttttatagaaacaagaagtcaaaattgtattttggagaccgtgtcgctgtccaaaacgacttccttaacctttttaaatagatacatgcacgcaacactagaatagtaaatcgatggtctcattaaattcctattgagatttgagagtgtattcacacatatatgtgtaatatttttggacaccaaaatttgaaccatcgtacgtagagttatgtaaccacaaatttaatattgcaccaccggtgttctcttggtatgtttttagataatgagaagaatttcattgaaatgaaactacacttgacctccatcaattagggatgcacacatcctaaaaaggcaaacatgaacatattgccttgcagcaactcgccctacacataattaacacaaacacaaagtattatgcacctattccaaaacaacatcttcaactcttttgtacaattttctctccttattaatgaaaattaactgtggggtcttcaagaaggtcaagacctatatgtgttgcggtcataaaaaaaacatgggtggatttttatttgaaatgtaagacaacaccttcaacaacgagacaacaaataagaactgatgttgccgaatctagatgaactagatcatagtttctgccatgccatcatcattgcttatactccatgtcactgtctagctaaagcgaatatagtaggggtaacaattgcccatggtgactattgttcgtcaaaaacatccgaagggtccgctcatgactagtcatggttgctagaccaatttcaatagtcgtcaaccaatcttcccaatcaagacggagatcactacccacgtagcaaccccatttgatcgccaacggcaaagaccaggcatcaatatcaacgtacaaccacaaggacaaagctttggtctcctctatttgcctccatcgagcgaatgaaagaaacattttccatttggaacattgaagaaggaaatgtaaaaaatcgcatggcttcaaacgaagccaacccacctccatcgaccatggcaagcacaatcaaattgaatcgattttgctccactgacatgtagtcataaactgactcaaaaacaccacaaacatatccaagtcacaaaacaatatcatgagaatcacatgt

SEQ ID NO: 35469 - DNA, 1501 bp, Oryza sativa
cggctcgtcgtctcgcggcgccgcctccgtcatcggattcgcagtggcgtgttccacgccatcctcgtctccgtgcaaccactgccggctgccctcgtcgcctcctcgccggccccggtcgtcgtcgtcgtcgtcctctcgtcgttcccggtcgtcgtggcgttcgtccctccgtcgagccctcctcgtccgtcctcggtgtttcgtcaaggtcgctgcagcccccgtcgtcgtcttcgtcctcggctccgcgtcgtcaagcctcgtgccggccgcgtctcgccttcgtccaaggatcgccaccgaagtcgtcccctcgccgttcgtctccgtcgttccgggctgtctccgccgcgcccgttcgtcgttgtcgttccctcgcctcgtcgcgtggtggtaaggatccctccttcgctgccccgtcctcgtcctttcggtgtcgcccgtgcccgttgtgcggttgtcggccccggtatccgtgtatcggtatcggtagtcgttcgcttgtccgtgtagtgtccgtgttagtgtgcccgcttggtagccgcgttgtttccacgtgtgcaacccatgtggtgtctagtggagtccgtttgtcggccactcgcctcggttgacacacggggtccgcttccgtcgacccgtggaccgtctctgtgtacccggtctaccgcggtcctttaggttgacatgtggggtccgcatgtcaacagcgcagccttcctgtcttttcccggctagcgcttccacatgttttatagtcgcaaagcctaattataataatccgcaaatctccatataacagcattaaacttcggatgatcatatcttggtcatacgaactctgaatcgacccgttcaagtctcctaatgtttgttataacctaaagaaccgtgtggtttctttttatgtattgttattgcttctttataggcttgtggctttgcttgtgtgcttcgcgtagcttctgtcgttccggaggttctcgaagcgtggttcgcggtcgtcgccgaaggttcggaaggccgttctctctgagcaaggcaagtcacatcatccttgagcatattgaatcccagtttataaaattattttgatttaaattaatgcattatcgctttatttaaattcccgcgttatcactgttttatttagccatgcctatttacctttgttatgaccttattattgttgttattgttattattaccttgttcaccctaggataaacaaaaccccaactagtgggtactctgttcatggttctactattatgaatttaggtagatgcttcgctgattaattaggcaacattaggtggttttataactttagactttgggaattctcatatcatttggacagtatggaatggttggcttattgtggaattggacacacacctccccctctattcaaaactcccaaaatggttttaggctgggctcgaggtgcgtggttgggttttgttagtcgtacctcgggtactataaggattaa

SEQ ID NO: 35470 - DNA, 687 bp, Oryza sativa
ctcacgatatggatttatctccctgactaacgttgattataaattcgtataaatttcatttatgttcatgtttcttaattatttacgtcaacaatgatgtaatttaggaattatttctgtttaactatgtaaataattgagacaacgcaaattaattattcatgttcatccataggtttcatgaacatatagtattactcgttcatcgacactataaatttggtcgagtagaactgattagatcagacgttgtatttcaattaattagtatgtaatatgctttaattcaattttctcctttttttcttcccgtagcaacgcacgggcacttttgctagtatacaatagttttaatcttgatcaaatttttaggtggtccatggcccacagtgccacctagctagctatgcgtctgccgcataaagcatctaaaaccaaaacccgctactcaagatcaaagcagagcacatcatctctaaagaaaacgatattctaaatgacacctctagaaaggatgcggcaccaggagtaactccgccgcccgccctgaggcgctaggacatgatttaaacctaaaaattcatgcaaataatgccccaagggaaaagcagcgtccgtagatgtcgctattgcttgtctgaagggctaggcttctgcccgtaagctttctaccctcccgtgtcgagg

SEQ ID NO: 35471 - DNA, 1501 bp, Oryza sativa
ccaaaaccctagatcagagaccgcgcccactcgaaccgcacccgaacagcggtgccggaattccaccaccgcgaagagccctaaaccctaggatcgaacggcaagcgcccggaatctacccgtcggagatgagagagcgcagatgcgcgccggttgcgttacctgagctggcgatcgtacttggtcttgggctccgcgaaggcggcggcggtggcggcggccatggcttccggcggcggcgtggtctcctctccgcgtgtggagtgggctctgccgctcttccgaggttttgctttgcttcgccttcgccttctcctcctcctccctgagcgaggaataaagcggtctcaagctaagtggaggcggagcaaggagaaggggatcgtgggctttggaggccaatgacatgggcctaatcgtacgccccaatattgtagctacttgggcctattgggccgatccagtttagttagcatctaccatctctacaccaactaaacaactgcacttgccataaacaagtgggattagcgacatgatcttacttgtttgacttaaagtgttattagtggaagataattaaggattaggaaggttcgttagtcgttgggggagacgaccagacatggctagattcattgtaccaattgggccattaccagacagcagtacagcacgatactactgaataagcgttgctggatattgaagatatacgcaattggagctcttgctctgattggttccacgcaaggagaaaactacacataatagctccgcttttgaattttaatttgagctaattagtcatggcttacgatcgattgagtcgaacatttacgtgctgtcctttctttctcagcactcttttctttttaataaacagtgcataaacttaacctggttttcaatttgaactaactgctcgattatggcttacagttaaggttgatcggttcagccattaaggtgatctttttttcgccatttcttgtttattaaactggatcaatgaggtggttgcagatgcttatagttgaaaaacggatttcagcgcttgttaaatgttaattatgcgagtccaaactcaaaagtcagaattgttagacagtaccaattcggaaattagtgagtcaaatgatataaaataatccacctcgaccaaacatgagaagttcagcttgcaaaattaacaattcattgctctatgatgaagtttatccgactaataactactcctaactagataagataaacaccaatattttactaaacagcaacatagctagtaattaaaaacaaatttgatttccttgctgaaagaaaaatacatcaacccccggaatgccgcggttacacgccaatgctctatttgatttttaaccatgcaacaaactgagattgaaacagtacttaattagcactagcgtaatcaactaatcgttgtcaatgtacacgtgagctcgacttagattacatggctagcaaaccaacttttctc

SEQ ID NO: 35472 - DNA, 1501 bp, Oryza sativa
tgtttttgcaattgattttagttgaactcttttctgaaaacaactaagtgagtgcttctcaaacgacacggttgtgacagtgcgtctcgtccggtcggagtatgtgcaatgtatcagtctttagaattgaaacaaggttggcacccggccaacagcttttcaaacggccacccgggccaacaactttttaaacggccacccgggccaacaaccttcaaacggccacccgggcctagctgatcccatcagctgcagatttttcaaacatcgaacccctttccacaacagcaatttcacaagcagtagtcaaacaaaactacgctaggaatcacctcacatccgcccatgaccgtgggcacggctgttcgaacagtttgttaacctctgcagagggggtacactttacccacatgacattactaacccggatcacccagcccgtggggatcagccacgtcgggagacctccaagctttcatgacaaggcatttccaaagccgatacaggtttaccatatgccgacgagaggggtcccagaccaacaacaggttaggtcccagaccatactgtgccaggaagcccaggggtcctccccgacaccacaccggcgaatccacatgtctctcgacatcaaggctcccctgataagctagttactcaaccaggggtgtcccattccacccatgtggtcttacttgtcttatgtttggatgaaattccaaggaatcggtccttaagtgcgagagcgggaaaaccgtacacccggtacgttccccggtccgcggttttggaaattcatttagttcacaagcaccgacccaggtgtcgggttttccaagtcttttgtaaaactcaagttttacccaagaagttgctcagattttaaatttgaaggcgcccttcggtactcgcacagattgcacgatttccgaggcgcaactgggtggttacaagggaacatggtataacaattaacaaaggaaggatcaaatgcaacaaactaggtagatccgccaatctgccttgcagacgggacaacagattaagtgcgatcctatcaatgcataatattttgcaagcaacataattaaatttcaagtataggctcaagatgttcaaaggtggcttgccttgctcgagatctggagcttgatcctcgaaatcctcgcactgcgggtcttcgggctccggaactacacgcgaaacgggacaactcaacaaacggcgaaaatgaagccctaataatgacctctaagcgtgccatttgatagatctcgagatttgaggaattttggaagttgaacggagtcaaacggatctacggttggaagatattgaatttctaagattattggatttttggtctaaaggaaaaggatttaattaaatcctttttggaaaagaaaaagaaaataaaagggaaagagggagggattatagacttctcctcgggcggctagggcgtggcccaagggaaaaggagcggaccggccgagctaaa

SEQ ID NO: 35473 - DNA, 561 bp, Oryza sativa
ccagggttcggcctggttcggccgaaccagtagctagcccaattagcccaattcttcatcagctggtagttatccttgtcccaaggcggttatgaccggttaaactgaagaaaccgtcactggacacatgtcacaaagagatgaagctaaggagaatatgctccttggatgcttggagcatatccactctcccaaggcaactcatgtcacactgttaacgaccaaatttggtaaatcaagtatcggaattggagataaaaccgaagcagaatcaaagggaattaacagtttcggaaatagagtacacatcggctggggtccgaatcggctacaatctacattggtagagtttaagtcggacagggtagccgatgaagtcgattccgacaatatggcgatagaaacattgtcggattgggttgatatgcttcatatcaattgccacgcacggattgagtcctaagaaggtaatttgtatctattaattaggatattttatataattttcttgtactttgagtcggtaagagtccaccttaaggacttgtttgtttcctaagt

SEQ ID NO: 35474 - DNA, 281 bp, Oryza sativa
ttctttgggttaagtatagtttagtaagcaggtagacttaccagctggctgttgtatgcgtctggcttagcatcatttgtagagactaaatagttaatagtggcaaagacgacaaatgtaaactatgccttttgtttaggccctggtctttttccttataattttggaacctttcctcattaactaaatcaaatggcaaccctgccatttcttaacaaaaaaagggaggagaactggttgtagtggagcctaatgttccatatttatatttttgctacagg

SEQ ID NO: 35475 - DNA, 617 bp, Oryza sativa
cctgcaggtcgactctagaggatccccctagattaatattactcatattttatttttatataattttcttgaatttaattagagttaattcttattcctacacttttcgatttaattgatacaattatagtcctaataatattttactcatttctatcctctctaaatattattttaaattgctctttaattatttacttagtcaatttactttttagggtttactcctaactaattttccattattcgcgatttataaactccgagatcaaaattcattaaaataatcgaacaaaatcggcatgatgcaactttatttaaaaagtttttgaaggtccgtatttttagagtttagatttcgtcgtcgaatttttagggtgttacatgcggcgtggtaacctcaccccagatatagtgaagatattttgctggctggcgcccgtggttttttctctcctactttaggagggttttccacgttaaatctcgtgtcttctgtgattgatctattgttttctttatcgtttgttagcttatcgtttcctaacaaactgaagaggtccggcctctgcacctagatgagcctctgccagtaagcaccgaaaaagcaggcagca

SEQ ID NO: 35476 - DNA, 154 bp, Oryza sativa
ataaatttgttccgcactacccgtgtcatgcgcttggggttccgcccactgtgggctcagtgtccttccatagtaccttcattcaattaagctacacagaataggattcttgtactgtggggaggagtgtctttgggacaatttttgggctagg

SEQ ID NO: 35477 - DNA, 1083 bp, Oryza sativa
cggtggcgccggggaggagacgcccggcggcgaggcggcggcgctatcgagccgcggtcatgcggcgggtgaccgcgtgagattgcgaggtgactggcgtctgctgctgctgctgctggggtggggaatggcgttagggtagggttcgaggaaattgcttctttgccactttcactcaacccaactttaaagttggtttggatttgtctgtggtacaattggtgaaaaaacctttcactacatatactgtatgggagtagtagagtaaaatccctctacttttattacagagtaagtgggctataatatcatttcaaataaaaaataattacttatttcgtttttaaatatatgactatgttgacttttaagcattgggaggttcggcggtgctttcttgtaacattttctacaccggacaacctagctgttcaattggagtgtgttggattgagcaaataataccaattaaaaggaaatgctaccgcgggaaactataccttaccattggcttgctcacacaatccatcgacagcgaacattcctatgttgttatccatatacctagtttcatcaccggctgtttgacttcgactgtatcaatttttacaactgcccagctatattgcgagaaatgatatgcatctcattttatttatgtaagttatcaaacaggttcttaaaaagtttggatatatgataaagtaaagtgtttatatttttatactctccttcccaaaatatttttccggatcctaaatatttgacattttagaacaaaattcgatcaaaaactttgatgataaggatcctaaatatttgacattttagaacaaggacactggcgagttatacaagagtctatacgactacttcctccgtcccaaaataaaccaacggaaccttaagcttcttggtaatcgtgaccgtccacacatgatctgacggccgtgttcttgagctgaatatctgaatagcccaaggatacgtgataattatttaaggtacaaataaacaaataactattataatgttaaaaatagatttagaacagattacaagaaaatcatatgtagaaagatt

SEQ ID NO: 35478 - DNA, 692 bp, Oryza sativa
gggagagagggagagagagagagagagggagagagagagcgccgggagggagggggagatgggccgagagagattcggcccatcgaccctggggaaggcaaaatagacttttgcggagggatttgatttggaaggatttggattcgggattgaactcgacgatagatcggggatttgagatctgagatggcacggacactagacaacaagcaaagaaacaaatttcgcaatagggtttttaagagataatttttccgctaggcgccacgacggaacgggcgctacagattgtctcttcatggtgagtgtgtgtgtcgtcccctcgtgggtgtcccctctcctcctagggggcttgtatttatacctataggtgtctccttgtccaagtagaactaggaaaatcaatatagatacaatccgagtagtcattgtcgtttccatgtagaactctgggtgtctttctttatccgaaggttgcttccgtataggacatggtatgtagtcgatcctgccgagatttagtcaactactattaggtatgtggtatccataaccctgacaatgagcctttagctgagttggtcaggtggctctaacagcactcctcactggattcgattctccatgggagcgaattccaggctagggttaaaaaaaatccccttatctgtcccatgtcaaagtatagctct

SEQ ID NO: 35479 - DNA, 1501 bp, Oryza sativa
tatctaggctatattatttgggttggaccaagttagtgtttggtacattggcattttttctttggaattgtgagatttttttcgaaaaatttccaaccgatttctaatagatagtagtttatgtttatgagaaaaaaattcaaattcatttatgttttaaaaaatttcaaaaaaatatatctccctattcctaaaaataggacaaaagcaaatacttttcaccggtttcacgctaagcatctaatgtctcggagcctcatcggttacccatattcactaataaatcaaaactaataaatcaaaacagcttatcaagaataaaaatcattttagaagtaaaacttttatatatctatccatcaatactaataaaaataggttaaaaatatctaaaaatcaactacgaaatcaaatttaaaaaatttaatttacttattgggtgctctcgattattttccccgtcagttgacaggcagagacagagacaaggaggaggtcgtgcgagaccgcgagaggcgtgtgcgccgtgcgcgtgtcctctgccccttcccttctccccatctcgcctcgctcccttcccttctcttgcccaccgccaccgccccgcacccacccacctctgcctagatccgtctccaccatcgatctccctcccatccccggatgcgcaaggtggaaggcaagatcgaaccctaaccggcgacggaggaggagcggctccaccaccaccacctcgaaggagttgacaggcgggggatggattctgcagcgtgatttcatttgtggttggtacggaagccctaatgcagcatgcttggattgctcgtagggtaatttgttgtttgagcaaccaatctaatttgtcctgtccaatccatcctgctatttgtgggttttgttggattgctctcataccagcttgtttcccaaaattttgggggaaagtacataacctgctttgggtcgggtttccgacgattagtgggagatactctgattgtgtttgattagtagctaggtgccatattgtttggacttggtggtagtatagatggagatttttcgtcataaattgggagaactggataattagagtccccctatgttgcttggatcatttttagtattattattgtttttgctgggagatttatatgtatgatagtgctggaccgtatgcttccattgtagctagataaagatcagttatagaaccaagagaagtgacattcatatcagacaatatatccatatctcatttcaccatatagttaggaatagtcaatgaagactgttctgtttgctggtttgattcttaaaaagttagtatcagtattttttttgtttacttttctaacacctcatgctgatgggattcacttcttgtttgttttttcagctccatttcctgctggttcgatgcaactgctttgtaactgttgattgatgtggtgatacatttcaaaaccagggattagattctgtttatgcctatgcttca

SEQ ID NO: 35480 - DNA, 1501 bp, Oryza sativa
gaagtggagggcaatggaattgtctggtgcacgccagtgtgcatgcaatgcacatatggttcgttgctgattggccactggtgtaacgtagcctaactaatcttacccggtgcacttttccgcgttgttgttgctgttgttgattcctgattgtggctgtcaaatccaacgtgcacggtctggaccgtgctccctctcccggctgcgcgcttggctggtggcctcaaatggctaaactatccaacaagagggtacggttgttcccttttttacgataaagaaaacctgttctgcgatgaagatatttataagtttatttggttttagctactagtacaataagatatgaatggccatgtgtcccatacactatacactgtctgttttaggaatacatcttataatacttattatactagtaaattatatggtgttaaatattgctatgtatattataaaaaggtttcattattgttcaatagacttatactttgactttttttatatggttcactttactttatcctaccaccatgtaataacatatcggaagctctaaagaacgtttagaatattccacctgtagtctttggtttacatgatttgtaaatcacatcactcacttatactttcatagtacattcacgaataaaagtaatatcgcacgagtcatataaccaccttgacaacgtccttcattttataataacaattcacctgacacaactagtacacaacaaatctagcctatgattatatataaagtaacgtcttaaaaaaaaactcaacccaaagcccaactatcatccggattattaatatgctataattaacgtcagaatctgccgactttgaataaactaacacccatgtggtgtcctatttgtcgcatacaaaatcgccccaattgggtacagtagttctttatcgagtataagcgcctagaaaaacccacgcaaatgcaaacccgctcatcatcgtctctctcccaaaggaccagaggttggggacttgggagtggagaccggccatctccggcgagccgatcgccgtgcgacacgttagccaccgccgccgtccctaccaccggaggcgtccgctgcgcgtgtggccgtagcgaaattctaatcccctgtgcgatagtttctcatctcctccctgagataccctcctccgccacttcgacgtcccatccatctctctctatttccttttctcccgctgctccccacctctctctctcctcctcctcttcttcttcatccaaccccccatggcgaccaccacctggtgctgtggttgctgctgctcctgcctcgccaccgctcgaagccggtgagtgagtcgtcgtcagtcgaggcgccaacgatcgagctgagctatagccagggtgaagcagaaggcgaggagagttggtggtgagttgaactcgatcgaagtcggaagagcgagagagggtggaagtgtttggttgggttgccggtgtggtgaggattggaga

SEQ ID NO: 35481 - DNA, 1501 bp, Oryza sativa
cgttcggctcaacgttgttttctcgatatgtgtcagtttaataaaaaaaacgcaccggtggctatttcataggtaccagttaaattgtgtgattgaaaaaacatgcactgaaacttatatttggcggttttttattaaacaacaccaataatgtgttgtaagtgccgattttagtttagactcatatgagagattagaaggatggggagaaagatcacatgtgccggttttatattaatcgacgtctcatatcactttttttatagtgaaaatttctttaaaaattaaataaatctattttattcatttataataaaaaatacttaattaattataccctatccctcgtcttgttttaagtgacggtgaaaagctaaagcaacttgcacattagaactaagctcaagtatttgagtgaagccatggatacaagttgttctaaccgatgacatctacacccttcatctaaaataaatcaaatcttaatgtctagattagaacttgtctagattcataagaaaaactaatttattttgtgatagaaggagtatgccaatataaaaggcatgtgttttatactcctccgtcccattttaagtgcaaacataagttttcacgctcaactttgatcgtccgtcttatttgaaatttttttacaattagtatttttattgttatgagatgataaaacatgaataatattttattcgttacttatgtttttaatttttttcaaaaatttttcaaataagacaggcatttaaagttgtgcacggaaaatcatggctgcatttaaaatgggacatacgaagtattaatttgtcctaattaaactgactgcatatattccaaaacacaagtgaatttgtcaatgtaatcattcgtattttaggacaaatatacaattaaagtttaactaaatttgtagaataacatgatcaacatctataataccttattaggctacgatcttcacttattcctcacaaaaaaaaaactctttccactacaatagcatctagaggaaatccctgttctagccagctctaagcaatatatactactaccagctgtatcatatattaatcatccacataactcccttctgaattttcataccccatcttagtggagtaacatgcatctatgaccttcgcctatataaaaaaaatgtaagtacaaagaaacaaaaacgcttcccaaaaaaaaaagcacaggactacacctttttgtccccattttttttgtaatgatccttccgaacattttctccatagaccatttggaaatagctggcgcagtgatattttctattcgtcgtccaaaccctcctctccgtctcatctctccctgcgtgcggcggtgtgtgtatgtggccaacccaataaatacccgcgaaagggttgaggcgttgagccgcgagctacgactcaggaatccggcgccgcaggccgaggcgatcgagccgggcgtatctatcttgtacacacagtaaagctgc

SEQ ID NO: 35482 - DNA, 229 bp, Oryza sativa
cttttagatttacattttctccctaagaacttgattgtagtttttttaaggttgatattatgttcctaatgataccataggataaaatatgtctgaatgtttgcgcggttattttaagatttatattttatcacaaagaacatgtaacctcggtaaatcactggtttgcaggttaaaatgtaattcatcgtcaatacgctatatttacatattctccccccaatgaaca

SEQ ID NO: 35483 - DNA, 154 bp, Oryza sativa
tagatctgtctaaggtgatggatataacaaatctatttagagcaacattgtgattgtagagatatatcggctaagatagaagatcggacctaaccgagacagtcccaactaaaccgatgtgtctctaaacacaatgcaattaaagatagaattg

SEQ ID NO: 35484 - DNA, 364 bp, Oryza sativa
gggtccggcacggcccgtttcggcacggcccgttaggcatggctcatgaaacgggccgtgccgtcccgacccacgtgccgagccgccggcccaagcacggcccgtgaatggccgggccgtgcccgtgccggcacggcatgcgtgtggcccgccgtgtcagtacgggcccgtgaatgaaaaatggcccgtggacggggcacggttggcccagaaaccgaaatggcgcggagggatgcgatgcgtacttgcgaaggtggctggcgggctgggccatcagctaggaggggtgctcaacggacttgcggaggcggctagcgggctgggccgtcagttgggagggatgagatacggacttgcggaagga

SEQ ID NO: 35485 - DNA, 1064 bp, Oryza sativa
ttcctcttccccttcttctctttctaccacagtacacacaattttttttaaaaaaataaaagttagaaaattttatgtatagaaatactatatataaaaaatttgaattcaaatttgaatcgggtatgtaaacttttgacttataaactttagatgtataggaatactatatatggaaaatatttgaattcaaattcaaatttgaatcagatataattcaaattcaaatttgaatcgggtatgtaaacttttgacttataaactttggatctataaactttaaaactttaggtgtataaactttagatgtatagaaatactatatatagaaaatatttgaattcaaattcaaaattcaaatttgaatcagatataattcaaattcaaatttgaaatgggtatataaacttttgacttataaactttaggtgtataaactttagatgtatagaaatactatatataaaaaaatatttgaattcaaatttaaatcggatatataaacttttgacttataaacttttggtctctaaactttagatgtgtaaacttgaggtgtataaactttaggtgtataaatttactaaaatagaaaagtaatgcggtgccaaaaaagtaaaccaggtggaggggtggagggagggaggggggaggggatcggatcgctgccccatccctaaggcgatcgatcgccgaacagcgtttccgaaccccgttgccagaacggtgatttcatatatggtgaagaaaaaccccaatgacgtggcagtggaggccagcagcccgccacccaccagggttgaccttagattcttatgcttatgtgaatgagcttatacaatactccatccgtcttagaatataaaaaagttttggttagatggcagggacggatctacattataagggcctgtgtcaggcgacaccgatgacttttggcaaaactgtaacatcccggcctagggcttaataggattaatatatcaacaagttacaacttcttttccggaagccaatctccaaagaactccagggttaagcgtgcttggcctggagcaatttgg

SEQ ID NO: 35486 - DNA, 1501 bp, Oryza sativa
atgacctggccgaagatgacggtcatgagcggctgcgacaccccgttggcgagcgccgccaccgtgccgaccgccatcagcagcaggtccgtgccgtcggcgtaccggaacagccccgtgaacgacaccttcttcccggcgtcgccgtcctcctccttcttcttgtcctcgccgtccctgccgttcttcgccttcttctccttgccatccctgccgccgttcgccgccgcgtccattgctggcagctttactgtgtgtacaagatagatacgcccggctcgatcgcctcggcctgcggcgccggattcctgagtcgtagctcgcggctcaacgcctcaaccctttcgcgggtatttattgggttggccacatacacacaccgccgcacgcagggagagatgagacggagaggagggtttggacgacgaatagaaaatatcactgcgccagctatttccaaatggtctatggagaaaatgttcggaaggatcattacaaaaaaaatggggacaaaaaggtgtagtcctgtgcttttttttttgggaagcgtttttgtttctttgtacttacattttttttatataggcgaaggtcatagatgcatgttactccactaagatggggtatgaaaattcagaagggagttatgtggatgattaatatatgatacagctggtagtagtatatattgcttagagctggctagaacagggatttcctctagatgctattgtagtggaaagagttttttttttgtgaggaataagtgaagatcgtagcctaataaggtattatagatgttgatcatgttattctacaaatttagttaaactttaattgtatatttgtcctaaaatacgaatgattacattgacaaattcacttgtgttttggaatatatgcagtcagtttaattaggacaaattaatacttcgtatgtcccattttaaatgcagccatgattttccgtgcacaactttaaatgcctgtcttatttgaaaaatttttgaaaaaaattaaaaacataagtaacgaataaaatattattcatgttttatcatctcataacaataaaaatactaattgtaaaaaaatttcaaataagacggacgatcaaagttgagcgtgaaaacttatgtttgcacttaaaatgggacggaggagtataaaacacatgccttttatattggcatactccttctatcacaaaataaattagtttttcttatgaatctagacaagttctaatctagacattaagatttgatttattttagatgaagggtgtagatgtcatcggttagaacaacttgtatccatggcttcactcaaatacttgagcttagttctaatgtgcaagttgctttagcttttcaccgtcacttaaaacaagacgagggatagggtataattaattaagtattttttattataaatgaataaaatagatttatttaatttttaaagaaattttcactataaaaaaagtgatatgagacgt

SEQ ID NO: 35487 - DNA, 861 bp, Oryza sativa
attactcacctgctcctgcgtcagagtgttcttcacatcactaccagcttgctcttccctgaccaccttggcatcgacggccggagcagccgaagcctccacctcctggatctcctcggcggcggcggcgcggctgctgagcaggtacctggatgagccggcggggctgacgagctcgccgccattcgcggcagccgccttgtgctgatgctgctgccctctcctgcagtcttgcctgtgaaccgttcttggctcaccggggacctggcagagagggctcgcagcaatggcgccgcccttgtgtggccggaccatcggctgccgctccaagctcgggcatatcgccgtggacgccggcgacgagcacgagaggctcttcatgtccttgaacagcaaaggcgccatgctgcaactgcagtgagtggtgagttctagctcagctagtgtgagtggtaaactggctgagcttgtgttgggtggtgtaatactgatggagcaaggaagagtggaagagtatcttagcttatataggagaagacaactttgctatccatggttagcactacggtagggtagaagctgtgctaactgctaaaaaatgctcttattttcggggcttttaaccatttgccactcttacaaataatgcttaacgatttggcactagacccacatgtcacagacacatgagggcccacatatcattgacagggggtggcaaatcgttaattgccatgtcacaagagtggcaaatagttaaatttccccttattttcccatttagcgcttgtttagttactactccctccgtttcacaatgtaaaactttctagcattattcatattcatatatatatgtga

SEQ ID NO: 35488 - DNA, 1501 bp, Oryza sativa
cgcgtgcgcctttccgggcgcggatacacaggcgcccttccgggcgccgcgggtcacggtcgttaatccgcgcgggtttcctactccacacagaagaagaagaaggagaaggtgaagaaaaaggaggaggaaaggctgaaggaggacaggaggtgaaaaggctgcaggaggaaaagaaggaatggaaaaggtgaatgggaagggataaaattggaaaagattttaataaagggaatatttttttcatagtcggtgtaagttagctgccgccagcgaaaatcggccgtcagcgaaaacccaattttttatagtgggtctcttagcgtagccgccagcgaaaatagagttatttttaatggcggacctcttagtgggggcgccaacgaaaagcaaaaaccgattttcgctggctgtccgtaacccttcacccctagttacatttttagtagcggttttcacgtataactgccagcgaaaattatagggtgacgccatgaaaaatcattttttagtagaggtaggatgtgcctccacccgtatatgatggatgtgtgatgtccgtaggatgtgcctccaccgttcttcaagaaacgccacgttagcctttaccgagctgacaagtgattcctgaaacgagacatctagccctgtttggctaatgggatagggaaataatttcccacccaccaaaacatctctaaattctaaccatccattcttcctcttctatttaatcataaccattcattcatttctcattcctaattacattcctcattttccattatacaaacacaccctaggatgtgcgaagatcgaccttcttcttgagtgaacataccaactccagttgaccgtgtcttgggtaaacatacttggcagtttccatgcaaacttgggttgtggggtcctatcttcgaatggtgccacgacatggttcccgggcaattagctagatagccatgtgcacccgtgcagaggacacgtggccaccttcgagcatcttcaaggctatccaccaaagtctcacgttggcctatccttagagcaagtataataaggaggctataatccgactaaatgctgaggtgtagaagagaagagagaagagagaggagaagcgagctgtaaacttatagccggtttggacacaaaaaccaaaaaactctgtgagagagataagtgggtcctatattaatcgtaaagagctaactattatatgggtgggctgagagaaggctacaaagaaccttatagttaacaagtcggctatattattagccttgctcttaattacacaaatggatcgccaacggatacacggacctccccgcaaagtcttgaacttattccatgcgaaggagttattggtccatgtcagaaagatcctagcacactaatcacactactggagaaaccatctttggtcggtcgaccaaattccacaatagtcccggttacaataaaaaccgggactaaagatatctttagactcggttca

SEQ ID NO: 35489 - DNA, 1501 bp, Oryza sativa
tctcagttgaaggcatttaagtctgtaaatcggggaaatagtaccctgccaacatttgtattgttcattggagaataaatgaagtgtgtacttctgagttttggttgagagaaacatatcgggcaagagtaaaaaatagtctgcttgaatgtgattattgtagtttagtatatgtaacatagagctgtttagatgatgggcatgtctctattgaaaaatagatcctgcatggctgcatccctaattcctctggttcttgaatgaattgtgtggttagcatagcatgcgaagctcctgattaattgttaagttcgacggcatattctctcttcgatttcaaacatagatgttttggactttataacttgtctccacacccaagtcgtagaatctttactgattgaatgctatcactcgtcatttccacaagcctaacctgtaggaacaattaattatgtttgacttaatttgtgatatactaaaaggaagcttttgtataaatccaccttataaaatgactaatttccacgtcccaattgctcccaaccatcctaaccatgcttcgtatggaccgtaataaaaaaaaaacagccttccaaagtgaagacactcgccaagaatctcaaggaaaataccagtaccttcttatagcacacaaaacaatactcaactctagccaactactcctccgttccaaaacaaatgtaatttcgcactattcttatctaatgtttgacatttcatcttatttaattttttttatgattagtatttttattgttattagatgataagtcataaatagtattttatgtgtgactaatatttttaaatttttttataaatttttttaaataagacagacggtcaaacgttggatacatataccctcggctatatttattttgggatggatatagtagtaacaataaagtaacagagtccaacgcaaaaatcaacttgatataaaagtggcatgatagctctaatttcacgaacacatgctattgttgtcaaacttgccaccaaacagcacggcagctccgactacacagtgatagcatcatcttggccaaagatatcatcaaaatgaacaaacatcaccgatttctcacagtcgacattagaatcattcttacctgtaaaattctaaacaaaacattgcttgtaaaagtgcaagaaggcttgcaggccagagatagagacaagacatccccgttcaccagcagcacaaaagaacgtagcaacgatcagtggcagcgttgcaattacggaccggtgtggcggtgttgttgcccatcccatcaatttagcagctgcgatgtcaccaccacaactattcattatagccacccagctaacaccatctcgtgcgctcgtggcccttggattcaactacccccgcgccttgatatttgcaactgcaaatttgtctatatacaaaatttgtctccacgttttcttggatagttagttgctcacccgatcctgtatccatggc

SEQ ID NO: 35490 - DNA, 1501 bp, Oryza sativa
ttcccccccggtgaaaaggggtggagaagttgggagaagaatctgatgctgctttgcgcgtgcaggcgatcgatcgcgagaggccggccactgtgtctgtggctgtgcgcgcgcacacacagatactcctcgctttaggccacatttacaatcatacatgcatggtacatacagctgctgaattctttcttattaccagagacaagaaggtactaccatgatttgtgtacatctgtggtagactctagccatgcaaaatgatgattcatggattcaaacgagaacaacaagtacagtaacttgcaaacattgcgctgcaaccgtctcactctccatgtcctcctgatttccgttcgaattattgtgaaaggaaaactgttgactcttcatcattaagaaattcggcatgcctttgttctgtctaccaatacgctggtttcttgacaggttttgatactcctggccatggattgctatcggatagctagctttcgtccaaggctttatttttcttttggacgtgtagacattccttgaattattcggagttgtaccgtttcagccaccttagcaatcctgcctcatcctttgtcgaggaaaagaaatggagaatccttctacacttttagaagctgttcatgaaagagcaaggaggatatatctagaagaaagattggaacaatccatgtttcttcaacttgaaccactagcttaactgaggatcagataacctgtttgatgctacgattagtactataaaatctgaacctgtttgacgattcggtgttctgtccagattcgttatcctagaatgtgtcaaatcccattaaactagattcattaggtagcaacattttaaaacgacggaggaagtaatccattagtgcttgttacatcaatctcaactactatattaatttcttgacagggctttctgtggtggaaacacaagagtcatcatgcagctagagataagcaactgaagaagtgaaccatacgacaacgtggctgaaaccaggaaagcctgaacacgccaggaccatcacggtaatctggcaacttagcagtaaagctaaaaacgagccgtttctctgaagccaacatgtgtaccaactcttctttttttttttcttgtgatataaaaaatcgtacacaccctagctattatgcctaactttttttttaaaccgcattatgcctaactttgcccagaaaccgcattcatgacttcttgtttgttttaacctccatatgtttttgtttctcttggtagcaagggtgtgtttagtttcacaccaacattagaaatttaactaaaattggaagtttgaagaaaaaaaagttgaaagtttatgtgtataggaaagttttgatgtgatggaaaagtttgaagaaaaagttattatttcctccgtttcacaatgtaagactttttagcatcgctcatatttatattaatgttaatgaatctagacacatatatgcgtctatattcattcac

SEQ ID NO: 35491 - DNA, 1501 bp, Oryza sativa
ataaacacacataattgtcgttgtaacatgtaagagcacccgcaatgctaaagtaagatgctctctataaaatatgtacatctcagcaataaactagattaatagtaaaccacctcaatagtatgtttagagcacccgcaatggtaaagtaaggtgttatctataaaacatgtacatctcagcaatagactagattaatagtaaaccatctcaacagtatgtctacatgggtatctatagctctctaatacattgtctcgtttttctctatagactatctccaggttagtagatagctttgctctctctcttcatttaatctcttccaagtaggaaaatatgctgacatggatatcttatagagagcctatagataaccattgtgggtgcccttatatgggtatctataactctttaatccattgcctcgtttttctctatagactatctccatgttagtagatagctttgttctctctcttcatttaatctctttcaagtaggaaaatatgctgacatagatctcttatagagagactatagataaatatctatactaatataaaaaggaggagttgtcccccaccaatgcttcaggccaaatcatcccccaatcatctttgtcctcagccgtccgatctgttgatccaacggcgaaatcaccgattccgccatcccaccaccacacaaatccacgcccgcactactgccaccgcgctatctacgcccccacgctctccccgcgcgatgactccgccgccgcgcctcctcgcgctgctcagatgcgcgctgcgcctcccgacgcttcctcgctccaggccgccgtcgtcatcgcacggtcccgacccctccagtatcccccccatcccgcctcctcctccaccgcgtcgccgatggctccatgtcgtcgtcgtcgtcgcgcggtcccggctggctgtccaccgcgccatcacagatccagccatccctcataccggactcccccatcctgacggccccatcccagcggcgaggaggcgtcgtcgcgcgggagatgactggtggggagagtgaagagggagaggcggatggcaaccctccctctgtcacgctcgctctccaatcccccttcacagtcgagccctgcgtcgtcgccttcccccgccgatgccaccacatcaaggcacctcacgcatggagctctttccccgaagccggacgtaatggccggtccctcgctaaggcgcccagcagatccggccagttgcctcagcaacagagagtccacggacttctccactgctctgtaagaggatctggactcttctgccaacgaggccactgtctgatccaccatcgtaggggattctttccgttccctaaatgcaccacatatcttcccctccggaattttttttttcgaatgaaattgatagaataccaatggctgttgcaacaaggtaatttgccctcaacctttagcttttcaaattagaatcaatttaattacttctttgtttac

SEQ ID NO: 35492 - DNA, 1501 bp, Oryza sativa
taaagctgacagcctggttgtgtcgtggcgcagctctctatcgttcatcagcttaatttgatggttgtggatgatatgactgtttaacgtgcacccgacctggccgcgagcacacagctttcgctgcagtttccgtccgacctggccgagaccggccatcgaccgctcaggcttggataaaaaagggccggacttgagcatcagcggcggcagagcggcaaagcgcccacggaaacgatcagcccgtacgtgcaaattgtgcaaaatataaatcggtcatcgtccactcgtcctatcgagacggccggtccagggtggcgccctggcgggcggtcatgcctccatcaaataagcacagatgcctatcttgacagaccgtattagtatcgcgaaccatatgtgatcctcatactaccgcatatctgtatgcgtgcactggatcagtgagtggctctgtgtttataacttagggttgggaacccatctcatccgcacggaaaacggaacagttcattagggcgtgattaattaagcgttagtttttttaaaataaattaatttgatttttttgagcaacttttgtatataaattttttttaaaaaacatatcgtttagtagtttaaaaagagtgtgcacgaaaaacgagaaatttgagttaggagcaccgaacacacctagtaagttccacgccaaaaccggaggaacattcgtaccacgcgtatgatgctgaatcctcacgagataattttgccgtacgttttactcgcaagtgcagtgcttctagaacaaagtggtggctctcgtcttcccgacagcgacgcgcacagtgataggatcgtcaagcacacaatcaggcggccgcttgtactgaaaaccggacgctttgctgcgttagcatcgccattattcggaccccgcgcgccaaccatgtggtgtcgttcgatcaccggccactgtctccgcccacacggccggagagaatccctcgccgcttgaaaaaaatatctctattccccccggtattgatagctcgcgagccgcgactcgcaagtcgcaactgaccacaggaggagacaaacaagacgcagaccttatggaccttatgggtgatgatcttatctgattcgactagtcgactagtcgcactgattagactccccttctctggtcccatcgtcgcgttgtttggcggcatcagcagttacccgaaactaattattgcgaacacgacattattgtttttctaaaacaaaatcgagatcgcaagttcgcgacgaacgctgatagcttcagttcaggcgcgccggtgcaacgcgcaaggaaggataacccttgccgtcgcggtcgtgtgatcgtgtcgtgcgctgcactgcactgcactgatcaggtcgcgcagccgctgacgtttcgttgtgtcggctccacccgtttgggtggatcccttccgaattccgatcccattggtcattgaccaccgggctggttgcccgcactggtctt

SEQ ID NO: 35493 - DNA, 433 bp, Oryza sativa
ctactcaatagatgatgcaaataattagtactaatatcaggatttgtatgctatgattttctattagatactgtggaacttccacctaaagaaaggcaaatatcatgatgacgaattgacatacatgctaccttcttgatttcagtgagatttgtacgtatattaaaattgctggataactgactcgtaggctcgtaactaagcatgagagattcagaccaatccatagaaaaaagaggagattcagcacgtatcccttaaacaaagagagattcagaacatgacagtattttaagactacaacatgacaacttgctacaaacatgacagcactgcacatctgcatcgtttctgttttaaatttcaaaaagccaacacatagttgctttgaattaattaaccaccggcatttgcattgggtatctttttcagg

SEQ ID NO: 35494 - DNA, 1501 bp, Oryza sativa
tcatttttgaataagtatgaacatttcaatttggacgaaaagtttccttgagctggccggccggcctggccccaagcaattcctggcaacagagcgacacgataacatgtcaaaacttgtgcactctataaaatggtgaagatatagacacgaagcataagatgtatagtaagtagctagcaagaggatcgaaatgtaagagctaaccccagctagtgttttctttttctttttcttttttggaacccttgctcaatcactgttaattagtggacatctaccaaaaagcccaaacttaaattccgggttaccaagttaaccaaaattcttgtgacggcctataaagtttgcattctctggatgtggatggcattgacttgagcaatggagtttgctctggatatatgtgtgacgtctcagcttgaaagctgaattactgtaataaactttggtcggaagctcttgagctaaaggctgggaaacaagttgatcccacaaaacacgatatcatgtggctcttttaatcttctgtacgtgtagcaactaacaataaccaccattataatatacagatgcttgtgcaacccctccgcggactgcggctgttccgcagatcgttgcaagattcttcctctgactttggtatctcgcgtcatctcctcggctttttgctgctaccaaaagtctctgcatagttaaatgtgagatacatttggggtacttatatatttagagcacatccggatccatggtttgtacggaacacagacgatgcaagggattttctgaaatttgaaaacctgacaattagatcattcatgaagatgaaggacatggatgtcaggggcgatcgattcaatatccgggccagtatatgcatcttgtactagtagactactagtttcaacatttcacgctgatatgattaggatttgtgcaagaattgcagataagacggatatcccttcagttacgtttcgtgactagtatacattggactgaaattattggttccggccggacatttcctgcagctcgtatgaacttgctaagcaagatgccaacttgctatcccccaaattgtcaacctcgccgtaggttggcatccaattggcagttactttattgacctgatagggatggccgtgtccttcaactccagcttagcggtgaccccagcaggtgaatgtggcaactcggatatcccagccgcagctagagctcctctcaccaatcactagctctctgttgcatcatcattaagtcatggtgattagttaagataaaaatgacgtattgtgattagtttagcctgcgatctcatgctgtcccagcttgctctgaccaacaaagattcaagataccgtttctgcactattgaactaccagccatcggttgagacgacttagatttgatattattgattcatggcttggcttgagtttacttgggtatccaatgggcgcctctggcttgctggttcctgtaacttcgatatct

SEQ ID NO: 35495 - DNA, 466 bp, Oryza sativa
cccccattgtgaatccgcccctgctggtgagaatggcttctagttcattttccagattcggagaagctgcagttaatggaagctcccccaaataggctcttagaccatggctaaaaaatgcttgaatgttagacttggctaaaaatttcatgactattaaccttgggatatcatgaatatatgttaatcgttcacctgatattccgtgattataaacctttggcctaaatattcatgaatttcgaatttggtacagatcagccacaaggcctgaaaaagcgcctgcatagtattagtatattgtgtccagattttccacaaggcatagtctattgtggtactgttttatactccattggaagtgtgtgctgtattgcctgaagccttcgtcagtggaaagaaaagcccgttaacaacgcacattgaatagcccattaacagctcacctaaagaaatcgtttgctga

SEQ ID NO: 35496 - DNA, 172 bp, Oryza sativa
ataagcaccgatagaccgaacattgcatgcgctgttgcttcattttctttcgataatcatgagctcggtgttactctcagcttctcatggtggtgataatataggtcaagggaagaggcgcagcggtttagatcgccaaagcggactcattgccattgcgcttgcgttgcta

SEQ ID NO: 35497 - DNA, 216 bp, Oryza sativa
agtagcagttactactattgcggatgagtttggatatgtactactcactccgtcttaaaatgtaagtatttttagctatgaatctggatacatatagctaaaaatatttatattttaggacggagagagtattctgtatttgtatcagccggaattttaagggctgggaatgattgtattgatgcgatcgagggcacaatcacttcgctggcacga

SEQ ID NO: 35498 - DNA, 206 bp, Oryza sativa
cctgcagcccctggtcggccaaccaaattttattaagaagaagagagggttacaaggtttacgagttcgacattaggccgtcgagtcaggcaacaattcaattggctgcagccccaaagaaaaaaaaagactaacagctaatcacattgcctaaaagttctagcctccttccatactatgataacctctctgatgtctcaaatagc

SEQ ID NO: 35499 - DNA, 634 bp, Oryza sativa
ctgcgacaaactccaggcagaacgtgctgcaaccatttttccaagaagctaaagaggtagacaaaactctgaaattggggacaaaacctgaaaccaatgacctccctgtagaggcatttcagaattttgttaattcagaagcgcttcaaatatgtctcattcattcccttacagctactctagctacaagtcatcagaaataatgttttttagaactaacaacaccagacggtgcgatgattcattgaatagaacaggaaaaaattacaaggctagcaccctggaaggcggtagcaaggaaaggaaaagaaccaccaccaccacacactacgcatcgacatcacctatacaggatctaggggaaggctagcatcggaccagccaccgctaagcatgaccagtcgctgctaggccaacaaagaaacaacacccgggcaccaaagccaaaccctaacaatgggcactgtgctcaactctatccacgcccttgaggttttaggggagaagatgagagagaagatggaaccactctcccctacaaggctcaccaacatggccagcttgcatttgactatgtcgccatcacaagaggacatatgccagcagagagcacacactaggtttctgagagagg

SEQ ID NO: 35500 - DNA, 1501 bp, Oryza sativa
gtcatgatgattttatcattgccgaaacaaaaggaaggaaataaatagtttctatcattgccattaacaatgtcttttttgggggattacatgatttacgcttcggtatacaaatattagagcatacatagtgcatggatgcacagtagaggtaattatgtgaatctcatgaaaatcatgttgaaaattaaatctaccccgtgcaagaacacatggaacactccatgtgctacccatcaatataatggttgtgaggcgcagaagtaggagctccgggaggccgtcgaacactccatgccgctgccgctgactgacagggtagaggccatggcggcaaggctataggcttgtctgtgcaccgcgtcgccggatctggctccccttcgctagatacggcaaacccccctaatggatcaggcttcttaggcgagggacgccgactcccctgcaatggctccctgtgacagggaggcggtggcatgcggtgaaggggcaggcggtggaggtgccccacggcgatggtgtcacacgcgtgtggatgagagttgacgagttggctagtgaggcccgtcttgatggtagcgagtggtgccggaggcagcgagaagaaggatgcgtggaggtggccgatgatgccatgggtgggctgaggctgactgacgaggggcatccggcggggaacgaagggaggctagcacgacgcaggtggcgtcagtggttcaggaaggctgatgctggttgctccaggaggttggttcgggcgatggcagggaggccgccccggtcgatggcgcggagggccgacgaaagagaggtcggtgaggctatctggtggagggcgtcagtacagtggtgaccatgtaccgatagaggatggtaggtggtggagctttggagctttttcttcaggtcttcatggaccgagcgacatagtaaagcccagcttggtcttgccaggtcgacaacaatggtgttttaggcattgttttccatctttggggcattgtcgagccacccctcttcctcaggtgggctaccaggagaaaacctattgtcttggttctccttgagatctcgacggatggcgatgtcggtgttcatcatcgtttttctcactggagatgtcgtcaaggaagcctcactgcgaaaacctctctcgggggctaggccaaaccctttgcccccgcgtcactcccagggtaggggcgacacgggaggcgacccagccgccaccaccgcaccacccccaccgccctccttccacctcgccgctgcccgagcgggccgccggaaaccacgcggccgcaaggacggcggcggtggggccttctccccccccaaggtcacagtgttcggagcccacgaccccgacctagctctggggcagcgacttcggcggctgcgacgtcgagctcgacggttgcgcatggcgtcggcgaggtggcggtgccgacgacggttgaagaggtgggcggccgggccgacgacgacgaggcggcgg

SEQ ID NO: 35501 - DNA, 186 bp, Oryza sativa
ttgaaggagagaagccgatgcatgaatcttggcataggtccaatggtctaaaaatctgtaagattccattcccaaattttattcgaatgacatatagcaattctggatcacgttcgttttattgtatgttcttattattttccctgatacagtttagtagaagtatatatatagtagtaggttcat

SEQ ID NO: 35502 - DNA, 360 bp, Oryza sativa
  unsure (1)..(360): unsure at all n locations
atgatggtgatgtgcgtaatcgttgttttttttaagctggaaattgttcaccatgtcactgacatttcaaaagatgtctatttcacatgaactaaaagatcttgtgatgtttgctattgtgaaattgttgctgcctgataagatcatctctaagattctgacggtgacttgataatttttgcacgcattanataaacatcttagcctcctagtagctgttgtagttgtaggctgcgtctcaagcttgaagaaaggagatcggttgtttgcaaggcatgcaatttaagcttcttcttaaagtgcatttcagcatgttaaaaccccaaatccatcccagattctccaagaaatagtgaatca

SEQ ID NO: 35503 - DNA, 1501 bp, Oryza sativa
aaatggtggtgctcaccgaaggctgaagagatggatggagagagaaagaggattcaagtcgacatgggtgctcattggagccggaagttagcaggacaccgttggccaccgttgctggccggatggagaggagaggccaaggcaggccaggggaggggagacggacggagaggccgccgtcgcccatgaacgcccttgcccgtgagatctggagcccaccgcccgtgagatccggagcctgccaccaccatcatcgatgcctctcctcccaccgaatctggcggaggggaggccgagagagagagagagagactctcggtcttatccgcttgtcaccgcgcactctcctccccttatccgctcataagctcactgctcagtttttaaaaggtgtcagttttttaaaaggtggtcatgcgcatttaatggatggaaaggtaatgggggatgacgaatagaggatttagggccacaaagcgtgttttttgggtggaaagtttagggattcgatgcaggagagttgcgggaagcaagaatgaccttagataatggcatgacactagagcatggccgctgatttcaccgaagaagggaaatattttggtggaggcggctagggcttttctatgtggacgaggtgggacagagatgtatggactggagggaaactataaaactagcagggacaggcaattttttttaaagaaaatgaggacaggcaaatttttctggagctaaattctttagagttagtcccatataatcccttctttcataaagttaagacccaaagctgagatttggtgaagccacgtcatcatttaattatcgaccgttggattacatctcagtggtcctcattgcgttttggagcatgccctcggtcccttcgctccccaccgcatcgcctcctgtaccgtatcgcctcccccagcaacagcgactacggcggtgacagactctgtcgatggtgacagcgacggtggcggcggtcggggacgagcgcggcggaattggacgcgaacgagggcggctgcggcggacgcggaagagggaggcggcagcggtcgagggcggcagtggacgaggacgaggcggctgtactcgacggtggcggcggcggacacggatgagggcggtggcagcggtcgagggcggcggtagtgacgacgacggcggccacggacaagggcagcagcacctttgcttctgttgctcgtgctgctatcatcggttcctctctcttggaagctcgcccactctactgctgcaggttaattggtgcccttttttttctttcgtttagccaacaagaggaaatcttcctccttggctaattcggttgtgctgctcattatcctcattgtttcttggttgatttttgcagacacacagaattgggggcagacctctgttgttcatcttaggtgagaatgaatttacagactttcctttttctgctgggcaacactagcaatctattctggcattatctctctct

SEQ ID NO: 35504 - DNA, 697 bp, Oryza sativa
ctgtctggtactatacaggaattgggatgttttcgttgattgaacaccgaaatcttatctacaataaaacacggcttcgcattcttaataatatttatctcactactaaaaatccccatgttccctaccgtttaatattttcctactagtgtgtgtggagacaaggaaaataaaaatacccatatcgtaccattctaggaacatagggaaattttttgtttcatacagttttacagtattaagagggaacaaacaactgaaacgttcaccatgctggccggtcatgtttccctgcgatatgattaaaaacaaggtgattccccgcgctttaatgcgagaattactaagtaattattaatttttttgacagcaagttaggagtaaaaagaaaaaaataataatgaaacatcagggtttatcaatcaaataataccatgcttcaatgtgaaacatattgataagtatatgttaaatattgtaaaagtgatagatagatttgttaaaatatcgtgcaaatgatacgaggggtgatgattcaaggtttcaaacatgctgaacatgctgctacccagtcaagtgaaatgtccatgcatgtttggttttcaccttaatattgctatgttgtaggaagcaaacttatttagcaaactgtaagtttttattatactatgcaacaggtaggaaataataagaatac

SEQ ID NO: 35505 - DNA, 177 bp, Oryza sativa
ataagagtagcaactagtatcaattaaggccgagtttagtttcaaactttttcttcaaacttccagtttttctatcacatcaaaacttttctacggctgtgtttagttcagcgcaaagtttagattttggttaaaattgaagatgatgtgactgaaaagttgtgtgtgtatgacagg

SEQ ID NO: 35506 - DNA, 1501 bp, Oryza sativa
gatcgatacacaaacaaaattaaaataagcagaaaaatgtatgcacatcaggagctcgtgaattgattgatcaataaatcaactaaaagatgaaagtacagacagttgtaaaaaatgacaggaggacaatgacatctatcactccaaaaatcattcaaacctgacatatacattgagaagaaaaaagaacagcatacaaatagtatcgacctaagatttttgtgaattgctatatgaatgctgtcaaacttttaaatactttttataactatttcgaacaacaggaacgtctcctaaagaatcaaaacagtttccccctaaaaacacgaggatatatactccctccgtttcacaatgtaagtcattctagcatttcccacattaacatcaatatggatatgggaaatgctagaatgacctataaattgtgaaacggaggaagtaacaactagttgtggcatacgttccttgtcttctcacgtactcccttcgtccaaaaaaacccaacctagtattaaatgggacattttctagtataacgaatcgggacaagcttctgtccagatttattttattagaaagcattccattcaatcttagattggttttttttaaggagggagtactcgcgagtgtgtccgctagcaatcaccatcaccactgcactaaaggcggcatacacatcacatctaaacacatcaataatttaattttattattccctaaaaaaaatgtgggcaaactgtgacacgtagagtaatgtaccaccacaccaccaaagcttccttcctagcttcccaggtgtatatcgtgtattgtattgtgatcaaaagtaaacacttaattaattatgtcagtttcaatttcatttgacactcatataagcagatagctaggtggttattcaagtgatcggcgttaattgtacacgttgatatcgatcttgatcgataatgattgttccacctaatcaattgattaaagtctcgatcgatagttttttttggctttaagtcgacgcgcgcgtcgctatttagcttcgtacatactactgcgtccgtttttggataaataacgacagttgatcttttgaagtatagttggttatttgttttattttttttctaaaaatatgtaattctaataatttgttgtgagttgttttattgaaaacgttaaggctgagttcgcactccctcttcccaacccaactctctcattttccacgcacacgctttccaaattactaaacgacatgtttttttaaaaaaatttctatacaaaagttgctttaaaaatcatattatccattttttaaaaaaattaactaatacttaattaatcacgtgttaaaaaacctctccgttttgcgtgcagaagggatgggttcccgtcctccactcccaaacacaccctaagtatgacttttgtgagcttatgtatttgaaaaaaatgataaaattaacgatgtcatctattacaaaatgcagaatactgcttg

SEQ ID NO: 35507 - DNA, 350 bp, Oryza sativa
cttctcaccacttcatcacttgtacaacatgccttgtcagcatccacaaaaacactgcattaatttgggcatgcaattagctcctgtattcatatataatagattaatagtaaccttgtttagaggtcagtcagtcatcatcaagattaacaaactagccaacttttttccatatgtggcgaaccgtgttgcttatctatgtttaacagagaattagtggcctgatgtggttctggacctaactaactaatgtcaatagcaatcaattgaagcaagaacacatgagtgtgtatgtgaaaaaatggggatttttttggcatgtcaaaatctccttttccacctccccacaa

SEQ ID NO: 35508 - DNA, 527 bp, Oryza sativa
catttattctgcatttgtgggtgtgtcttgttgagtacggtggttgtactcagtcttgctcaattttttcccaagcccagaagaggagctccttgaagatgaaggctttggtgtctagctcgtgcctgccgtcaagcgcctgtggtcgtcgccctagtcttccgctgtttcccgtttgtctttgtgtgtgctgggccttcgctgcccatgtaataagttaactatttacgcttccgcttgttaaactctgaattgtatcaagttttggtgtaccttgcctcctgggacaaggattaatgcacgcacgtcagggacgcccgttgggttatttccggtcgtgacaagtggcatcagagctacccttgaccctaggacgagccgtagatcccaagccttagcaatattttcaaaaataaaaatcctttgttatttgtaaaaactgtctagtctctctctgtcttgctgcttcatttatcgccaaaatctgacctttaaaatgttgttttctttttgtttttgtttgtaga

SEQ ID NO: 35509 - DNA, 253 bp, Oryza sativa
agtggacattctactcatggtaccactagtttaattttaggtagatgcttcgcaatttaattaggtaacattaggtggtttttcaactatagactttgggaaatattcatatcacctggatactttagaatggtttggttcttgtggaattggcttcacaccgctccttctattcaaaatccccaaaatggttttaggctgggctcggggtgcatggttttgatagtagcacctcggccatataaggaccggt

SEQ ID NO: 35510 - DNA, 1501 bp, Oryza sativa
ttggagtagattttttttgtgtaagttagccaaattttaacttagagagccatttggctaggctcttggagatgctctaaggcctataactacaagatcattcagaacgatttgatctccattgtttgcacttaagtttaccagtacgtcgttagaaattgaatttttaagttgctcaaagtatatgtatataaaatttacacattattttttcgctattaagcgttgctgcttatccaaacattagcattgtttagataggtgttgtattcgctcggtcttatctctattctaggtttcggcaataaacctactaaatatactttaattaaacgtatagagaaaacacctctagaactatgtatttacggttaaagacttttgtcctacttgctagcgactcaattacatttataaccttcctagccactttcctcattttcccctttttcaacatttcctcttcctctcccctgagggtgcgccaccctaacccgatcttccctatctccagcgtcacctccatctccctaccctacgatgccactcaagctatcctgttaacatagaaccatctcgaaattgcttcgtagtcatcacgcgacgtgtgattcgttagaatcgctctttgcagatctacctctcagtgtccaaatccgatctgtttattggtgtcaaattttattgtccactgcaacatgcagccttgactggccggtggtgggggcggttgacatcgttcggccacatcgtcgtcataccgagcaatcttcgctgaccataccaccgtttttctcgtgatgtcatatcttcaggttccacttacctattctcatcttctcttttaagactatcctattgtgcttgtctcttggacctcctagtctcttcccgagacaacgttttctctgtaggacatgctgataccgagacacctcatccctttcaccgcggtatcaaacccatgtaaaaataaaaagcctatataggagttatattgccggggaaactttttttcttaaagaactacacgagttgtggaatgtaattattatagggtcacattgctggagatgcgagtttttttttttttacttttagaactttattacgagttgtgaatgtaatttagttcaagtcacatggtcttttcaccattgacacggcacccaagcgaaccggagcgcgtggaagatgggaatcgcccctccgcggcacgagtccacgacggcaagaaaaagcgcccacccggcccacgcaaaaaaaaaaacaaaaaaggtagcactccatctgggcccacctgtcggcaccgggcgcgtagcgcgttcacgcctcatcacagtagtatcagtagagagaaagaaagaaaagaaagaaaaaaaaaaaggaaaaaagccgacgtaatcaatgggggacagcgcgatcggtccaagttaccgtcgttaaacgatcgcgagctccgcctccgcctccgcctccgcgatccgcctccgcctcgagc

SEQ ID NO: 35511 - DNA, 181 bp, Oryza sativa
cctacgattttttatgagtttcaaggaaattaaattgatttctatattttttatgaacaatgtgctaattaataacacaaaaataatataaatgggatataaatcgagcgcgccagttggcgcttattttctgttgagatccattcccggccgattctcatgctgctttgcttattttagc

SEQ ID NO: 35512 - DNA, 1501 bp, Oryza sativa
ggatataaaataatgtgtttgatgttcagcagctaattaccatattttcatggtatcacgtaacacatattccctctatcccaaaatataagcatttttagaatagtgacaagtcaaacatttttaactttgattattaatagaaaaaataaataaaatcaataatgtaaaaatgatgttattagatttatcattaaaaatatatcataatatgcaactctttttatttaaaacatcttacttttatagatattattaattaaaatagtatctttaaaactatgtagaagttaaatattgtttatattttgggacgaaaggagtaggtgtttttatatcttgcagtaaatatcacggactttaagtgtcttcgcaaatttttccaaagacttataaatcaatactcgtaataaatacagagattacgccagggagctaatcgcgtacaaccgcgcacctacagttgtggccagaaaacgtttcgcgcgcccacgaggcacgtgtttcagttgatactgttggacgtaaacccgtcggcccaacaaccagacaagaaccaatcaaaaccactgcaaaataaagccgattttggtatacgtctcacgacagattttttgcctcaaatcacccgaatttgcttccgtcggatctcttgggcatggtttaatttgacggtcatgatttatccccctaccaccgcggcaccacctagcagtatctttaccgggcacacaatgaacaatacaaataaactgatgagtacgggcaaaaatatgaacaccatggtttaatttacagtgtatttttattaaaattacagtgcatctacatgctatatctactatttttacaaatgtaattttagttataaagcactgtaattttagttataaatgcaacatttaacacttcagatacctggacggtttctcaagcagtgcatttgtactaaaacgacaaatattctagttaccaaaatttacagtgcatttgtacttaaaattacggtgcacttacatgccatatttattgtttttacaaatgtaattttagttataaagcaatgtaattttttgttacaaatgtaacatttaacacttcagatacctggacggtttctcaaacagtgcatttgtactaaaacgacaaatattctagttaccaaaatttacagtgcatttgtattaaaattacagtgcacttacatgccatatctactgtttttacaaatgtaatgttagttataaagcactgtaattttagttataaatacaacatttgtgttaatctctactaaatactactctattaaccaatacaatcacaagctatacctggacggtttctctatatttttttaatggttagatgtaaatataaggagagaaaaaatattttttctcgaaaatcacacgacatatgtctagacagtcccaaataaagcagtagaaagcgccaaacgcctccgaatcagtaccccttccactactactgctcgtgc

SEQ ID NO: 35513 - DNA, 1501 bp, Oryza sativa
ggtgacaactttcatgtctaccgaaattccaccgagtgtatttaatggtatcgcgtgatctctctttacatgagaacctagccatagtacattctcattttaccgtcatcaccttttctaccctagtgcgtgttgtgcatctaggggtgggcagaataagaccgaaccgaagagaccgagaccgagatcgaaaaattcggtctcaactattgaaagaccgaaatatattcggtttatttggtcatgggccttaattaaccgaattgaccgaaataaccgaattaggctcaatagatctagttggtccaataaacccactaataagaaatcctaggggcaggtgcgtcacagcctcacaggcatcgacgcatcgtttcatccccatccatcctggagcggcgccgtcccgactcccgtctccatcccatccgcatccttcttcgctccatcgtcgggcgccgcttccgcctccaccgccggcgccgcctccagccggcccggcgccgcctctagccagcgtgccttcacctccaccgcctggcatcgcccccagccggcccggcgctggctccaccgccgggcgccgcctccactaattgttgatttgctttgcttttgctgtttttacaaatagttttgttgatttgctttgtttttgctgtttttacggttagttcggtctatgaccaagaccaaaccaaactaaccgaagaccgatttgctcagtcctgagatttgttggagaccgatcggtcttgagattacaaagaccgaattttaaaaagaccgagaaaccgaaccgaatttttcggttagaccaaatacccacccctacgtgcacccgacactattggttcaatggcacacacttccgttaacaaactctatggacaattgtaggttggacatttgaaatgttgagtaaaaattcaagatcaacatatctttaattcaacccaatggcctactccctcaatcccaaaaaaagccaatctcccctcctagtacaacgaatttggatagccctttgtcacatcccctcctaggttgtttttttttttgggatgaacattatttaaaagtctgaactttttttatttaaaagtgttgtggcaggtttgttctaaacaacccggttacctccggcatttccgtccttggtgcccattgtgagtacaccaagcaaaatgtccatgcaaattgaagaataagatactcatttccacctcttcctctcaagttattacacttgtttccccccatttccctccaaccccggacaccccgcacacgtacgaacaggccacaaatcctcaaatatcggacagcgcagggatcgaacgcagaggaaatccaaaatccaaaatccgatcccctcgaaccaaagaattcgaagcgcgcaggcgggcacacgccccaaatgcgccggcggacgacgcgcgccgccgcagaagcagcacggcgccgatgagtcgcgcccctccggacgccgccggcgacc

SEQ ID NO: 35514 - DNA, 426 bp, Oryza sativa
tagttcattttccagattcggagaagctgcagttaatggaagctcccccaaataggctcttagaccatggctaaaaaatgcttgaatgttagacttggctaaaaatttcatgactattaaccttgggatatcatgaatatatgttaatcgttcacctgatattccgtgattataaacctttggcctaaatattcatgaatttcgaatttggtacagatcagccacaaggcctgaaaaagcgcctgcatagtattagtatattgtgtccagattttccacaaggcatagtctattgtggtactgttttatactccattggaagtgtgtgctgtattgcctgaagccttcgtcagtggaaagaaaagcccgttaacaacgcacattgaatagcccattaacagctcacctaaagaaatcgtttgctga

SEQ ID NO: 35515 - DNA, 454 bp, Oryza sativa
aattccaaatcactgttcatagctgaggctgcatacttaactttttcaggacaatggcagctacatcatgcaaacagtaggggagccaaggcaagaactgttcaatcaagtggtgctcaataattacatgtgctctttccagtagggaggagagggtgagagacaaaaggctaggagaagggaccctacattgacaataggtaatgtagcaaaacgttaagtggaagtccttttgctatcttcagttcaggattgtgtaatctaacatcattatgaaaaaaaaatagtagtaccatgtaagatacacacttagatactcaaatttcataagactgcagcttgagttccaaaattgctcaggtttgtgtaatctaacatcattatgacaaaatcaatgccatgtgaaatacaatgttgggatactcaaatttcacgagactgcatattatttaga

SEQ ID NO: 35516 - DNA, 190 bp, Oryza sativa
atatatatatatatatatatatatatatgtatatatatatatatatatatatgtatatatatatatatatatatatgtatatatacatatatgtatatatacatatatatatatatatatatatacatatatacacacacatacatatatatgtatgtatgtatgtatgtatgtatgtatccatccaagc

SEQ ID NO: 35517 - DNA, 165 bp, Oryza sativa
catcagtgaaacttgagagattaaattagctattcacccaaaaaagtatacttaattctgatgaatcccctaatgatttttatcaaaatcattaagttaaggtagatacacatcttgtcatatgatcaaatggtttcgccaaaaatcaataatcagacaacaaaa

SEQ ID NO: 35518 - DNA, 568 bp, Oryza sativa
aaatcatggtgcaattagacttaaacgattcgtctcacaatttacacattcgatgtgatggttgaaaagtttttgtcttgggacctaaagcagtcctatgtatactaagtgatgttcacttgtttgttagccatcaccaaaagaacatttacggcagttgaaccagcttcagaatctctgcagttaaatatttaattttataaatatttcttcaaactaaatattttaaacattattaatagtcaaggttgtactccctccatttttaataattgatagctataatttgtttccatttaaacttggaccactagatacaatttaacaacgaaatgagcaaaaaatatttttatatttagggtaataacatggctttatatctagtttttgtaaatattagaagaagaagacaagtggtcttagtttgaaagtgaatattccaaaaaaaacaattttataaaaatggatcttttaaccttaatcttattcatattatcccttatatggatcaactatgctgatcatttctttatcttcatttatattaacgacgttattgttgtgttgc

SEQ ID NO: 35519 - DNA, 333 bp, Oryza sativa
caaccagattcaccgtgattagcctcaccctagtctagtgtaatggaattgattagttcaggtggatggtggggcctgttgcaacgtggtgtagcgttggacagtggatggttaatattgagtaattattacaactgatttactgctttcaactaccgtctttaaatgctcgctttatgcaaatgaaccgctcaagctgtccttcaattatatcctgcatcataccctctattccggtatgacttgctgagtacggtggttgtactcagtcttgctctatttttccccaaacccccagagtttgagtgcgtgtcagatggtgggttctccgag

SEQ ID NO: 35520 - DNA, 1293 bp, Oryza sativa
ttcctccaaatctggctttgactctagctttgaacccagcccatggccttaccaaatttggtcgttaacaattatctatgtttttacatgtgtaaacaataattattatctttattaatattattatatttatataaggtacctgactagttttttaataagtggaaagatatttttattaaacataatctagaatgctataaagatttataatattgaacaatatataattatataaaaaattttatggatgaattagagattgacacttgttataaatccaattattataatgttatatatatatttactagttacatgtcaatgcattacaatgcgatctagagataaaaataagatttagtttatttctagtctaatttttatgatatattgggttttttatatttctttagagaaaatattgtacaacaattacataatttattgttttataagtagattagtttatcataccccatttataaaatcctacgtccgccactgcggctcggaatccgaagaggcatcgcgaaatcgtgacgtgattgtgtttacatcaagtgtaaaactttggcatgtcacatcgaatatacggagacatatttaaaatattaaacgtagtctaataacaaaataaattacagaatccacctgtaaaccacgagatgaatttattaagcctaattaatccatcatgaatttattaagcctaactaatatgtcattagcaaatgtttactgtagcaccacattgtcagatcatagcgcaattaggcttacaagattcgtctcataatttacacgtaatatgtgtaattagttatttttttcgtttatatttaatactacatgtatatgtccaaacattcgatgtgttggtgtgtaaaatttataagtattatacacattaattataagtattatacacggacaaaaatcccaagcatccaatcttacataaacacttaacataatcagttttccattgttttacttcacaaggaaacataatcgaatccgttgaataacacaatgcaaacacaaggttgacgctacaaaaattataaaggtggaagcggaaacacataaacaagtaccaaatctataaaaaaaactaatctttcaccttaatttgcagcacctcacgatgtggcaaatccggttgtgatctaatcagccgcggaggcggcgaagacgagctccggccgcgcttcgccaggtggcgcaacggtaggggcacgggtcgtcaaggatgtccatgaacccacgcttccggctgctggcggcagc

SEQ ID NO: 35521 - DNA, 375 bp, Oryza sativa
ttttggtggagctgaaactgtttggctgaactccaacttcaggaggggtggaaccggagctggagctgtgccaaacacgcccgtatgtttaatgacaaattcttaattaccagtactaggatgacaaatcattaaatattctccgaatagaatatattacttggcagcgtagatgaaaaacaaatctcccgtctttttatcttcgcttcctgccctggcaaaaacaatggccgctgaacagaacaagggacaagggcggcgatcttcatctggcgagcaaagcaaagcagattcatctctctctctcccatcgtgactacttttggctggatattgtttgcgttcgttcgttaaccctagcttctcttcgagagc

SEQ ID NO: 35522 - DNA, 588 bp, Oryza sativa
ctttgtttctgctgttatgtggagttatttagtgttaaaggcctttttcttttccgttggtcgtgtagacgctgcagcttcggaagatccgctcttcgttgaagtcgaagccgtcgattgggaaaacgagcaaggcaagacacatcatcttgatcatattgaatcccagtttacaaaattatgttgatttaaattattgcattatcgctttatttaaattcccgcgttatcactgttttatttagccatgcctatttacctttgttatgaccatattattattgttattgttattattactaccttgttcaccctagacaaacaaaacctcaactagtggacactctactcatagtaccactagtataattctaggtagatgcttcgcaagttaattaggcaacattaggtggttttacaactctagacttgggaaattctcatatcacttggacactctggaattgttggattattgtggaattggcttcacaccgccccctctattcaaaattccctaaaatggttttaggctgggctcggggtgcatggtttggatggtagcaccttggccgtttaaggaccggt

SEQ ID NO: 35523 - DNA, 1501 bp, Oryza sativa
ttacttatggttcaagaatgattgaaggcctcaaaattctgaattggaatgtcagagggttgaacaacccggcaaggagagaggctatctgtgaggttgcgaataatgcagatgcgagcatactttgcatccaggaaactaaattagctaacatagaccagtttttagggcgggaaataggtggttcccgactgaggcgttttgaatttctccctgctgatggtgtaagaggtggtgtagcaattttctgggatgacacaaaggtgcaggtcgacaacacacaaattcataccttttccgtttcaattagggcccaagtgataggaggaaatgtcccttttattctcacctccgtatgtgggccttcggaggatgaacataaatcagacttccttgcagaactagaatcgttagtgccgcagccattgctgccctgggttgttttgggagactttaacttgatttgtgaagcaagtgataaaaataatctgaatttagataggagaaggatggggcaatttaggagcactctaaatagatgttgtctcaaggagttcaagctccaaaataggaaattcacatggagcaatgagcaggaagcgcctactctggaaagaattgacaaagttttttgtaatattgatggtgacatcctgttctccaaccacacactgcaagccctctcctcatcctgttcagaccattgccctttgcttcttgctttcactgtaagcccacccaaaagggtagtcttccgctttgaaaatttctgggtctgggtgccgggattcatggaggtagtgcaacaagcctggtcatctcacacttttggtggacatccatttacaaaactcagccacaaattgacagccaccgctaaagctctcaggaagtggagtagaagtctgtttggagagatcaaaatgcaatttcacgtggctcaggaggtgattctccgattggatttggcccaggaagataggatccttactgctgatgaacaccagctcaggaaagacctcaagctaagaattttggggctggcagcagtggcaaagtcgaagaaaaggcagagatcgcgattgacatggctaaaagaaggggatgccaacacaaagtttttccacattcacgcaaactcgaggagaaggaaaaaccacattcaccaactccatacaacaagtgctatcctgacagaacatgaggaaaaaagtgaggcgcttttcaaccatttcaactcaatcctaggcaacaaggaggcgcgaaattgcaccttaaattggaacgcgatcgatctaccacaggttaaccccgatgaactagatgaaccttttacagaggaggaagtttgggccgctttaaagcaaatgcaagcagaaaaggccccaggtccagatggctttaatggtaccttctacaagaaatgctggcaactaattaaataggatatcatggatgttttccagtgtttgtataacctgtcaggaggaaactttggagt

SEQ ID NO: 35524 - DNA, 1137 bp, Oryza sativa
atgccctttgttttaggtgccacaatgcttcttgatctgaatactaatcttctatagcatgatatactatagtccaatcgcaattcacatgctcatctttaaatacgatatcgtccgtaaacaattaacaatctgttccgagcatgtactgcatgtttaaatacaatatcgtccgtaaacaattaataatctgttcaaagcatctactgcatgttataaggtttatgcacaagcgaaattgcatccctttgtacagtttctccctctcttattataaaaccagcaaaagctggcttaggtttcaaaataattgcatccctaagtaaacatggcctttgctgcagggcttgactacttgtctccatatggagtaatatactaatcactcgccattctcctgctcgtttaatatggctggtcgtgtatccagctagcttgtgacatggctagctattcctgaacgaataatgcccaatctcaaagcaaatctagtttgacatcctcacatatttttggatagagcatcccaagctggaacagcagtagagatttattggattgaaggacaccatgagacaagccacccgaaggggaaaaaaaagggccttaaatcagcctttttctcattgactggaaaatggggaaagaaaggaataatgcgagaatgtttagagaaaaggaagctacaaatcatcaaataattattcgtttccaagatgatgagctatgatgctggggtttggccagtgcaaaacacatgggaaaattgttgtcacgaggagtaaggaggattgacgtgcaagcatgttacagttacacatgtacagttttttccttacttttagcgtttggatgtataactaaacttccctctattaatataacgccgtcaatctgattagccgtttgaaaaaaaaactcaattcctgaacaaaatatctgaaagttctgagtttaccggtcgatacccttaatcagctggaaatttgaatttagaaatacaaaaacatttgaattgggcgtcattctgatttcaatttttcttttggcatcttctcaagcttgctttctcattgcaaaattataaagctcggtaccccattgcaaagtttgcaaccactgcaaagctgaaacaga

SEQ ID NO: 35525 - DNA, 771 bp, Oryza sativa
taaataaattgagagagagaatgaaggggtgaggtgatcttttgttgttttgctttgcacactatgatatggttgatcataagaccaaggatagtgcgatcttctcaggtcgcgtgggcttgtcctgtcacggctagaggctttgattagctagggtttgggcagaaaccttaccttttatagggataactcaagactgctgctatacacacccgtgggtatttttcatgtaaatagtagtttgaccctcaagaaggtcattactcttccgttcaggaatataaggtgtattttgactgtccaattttgaagagctttgacgaactattaatccaataatatttaggttttaccataagaaaaggatattattggattcatgtttgaaattactttcttatgactctgattttgacagtgtaaaagtaccttaaaaaacatctttaattttccagctaaatcagatccttcctaagtcctaactgatagatagggtacaaaataaccaatcccatgctttgaaactaataattatttaggcaatagatattcttggaaggtatgtaaacccttcccatattctgttctacaatatgcattactgtccgtgcttcaagcatcaacgctcataacagctgatttatcaacaactttgatccaatctatccctattaccattttttgttttcttaaattcaagcttctggtagttatacttcttgcaatcggcattctctctagctactaattgtatttattatatattacaga

SEQ ID NO: 35526 - DNA, 401 bp, Oryza sativa
ttttgttagacatatccaaggggtatgtaatggtatatttccaatacctgaaaaattataatggcatacctccaaatagttgagtagtaatggtatatttcaaaactgaagaatttacaatggcatgtatccaattaacccaattttttaagcctaattaattcataattatagaatgtttattgtatcatcacataggctaatcatggatttattaggctcaatagattcgtctcgcgaataagtccaagattatggataggttttgttaatagtctatatttaatacttctaattagtgtccaaacatccaatttggaagggactaaaaaattttagtccattccaaacacctccttattatttttatcaaatagccacgtaagcgtcatgtcaatagc

SEQ ID NO: 35527 - DNA, 1080 bp, Oryza sativa
aaagttgagggacatcaggtgaacttattccaactataaggcaacgcatcacggcccatggcccatgggatgcgcattctggcccacaaagcagcacacgctctctcccccaccagtaagccctagcctccaggagctcagccgtataaagccgcagaccttctccttcccctccccgccgccactcgccgcagcgtctcgaccagacaagggagcgcctccgaaaccctagctccccctttcccctccgcggccaccaaaatggtacgcttctccctcctccccgtccgcctctctccgtcgcacgacggcaagatcatgcgcgtgtgtgtcctcgtgccagtccacggcaccctgctctggtcgatttgtagggggattgcattctttattcatgttgatctgctgtagatgggggcgatcttgagccggaggagtagctagcttcttgttgatgcggtttcgggatttagagatttaacacggagattgatagtttctctttagcgatttctttttttcttgttgatataatgatatccacggtgattgtactagttatggtttttttatcttcaatgctttgaattattgtttttgatttgtgggtagagaccagattattgttgttaagatggacggattctttgagctggtcctttgcatgctctgaagcgcagaaaatttgtgtaatgggttatatctggattatgtgtagctattaacttctgtagtaaacattttcatcttcctttgaggacatgggatgaattcctttttttcttctcttgttgtgctaaaattgttcggtaatcttgtctgtggctttgactgatgggctccgatgatggcatgaaatctttgagacctgacattcttgtgatgacaaacataagcatatttcctgaggacccaattgagtttttaaccattggtctgctgaatgtgtctttgctgttgaaaaatatgtatacacatttgcttctgattatgcacatttgattgtgttgtttataggcctgctatgtgctttccaataaccagtatttgttaaatttgtttcatatttcttatgtatat

SEQ ID NO: 35528 - DNA, 515 bp, Oryza sativa
atagagcccatgggccgtggtgccccggctaagccccgcaagatattgtgggcttgtggccgcactttcagcccaagggcagtagtgccccggataagccctgcgcgacattgtggccgtttggttggtaaaaattttactcttgtgacaatagtttctagattttcaatgtacatgtgatttgcactatatatttttttacgcagatatgcattatccttgttcacaaaatcttactactaccagtttatcgcaacttaaaaattcgcttctcgttgattcttgtatagtagtatctcctataagtgcaggcgaatattgaaaccttaaaaatttaatagacgtaaaaatatttaaaatatgaaaagttatattggtatatttttatgagaaactctctttcataaagatatattcgccatgctctttaaatatatagtttagtctttagagactagtggccctgcggcggtcgcggcgacggatctagcctcccccgtcgtcgcggcggcaga

SEQ ID NO: 35529 - DNA, 1501 bp, Oryza sativa
gattttgtagtttcctctctcttttgcgagtaggtgaaactgattcgtttagattgttagttcaattgttagtttcaatccgtatgatctttttgcaagtacctctttatgtttgagattcctttagattgttagtttcgaccatatgatctttttgcgaatacatttttatgtttgagcaggtaagttctccggttgagcacatgagctcccgtttacccccagtctgcatctgttcataaaagagattgtaattaagaagaccaaataatgatgcttatctactaaaggttttgagagtaggaatcagcatccactcaaacactagaccaagcatgtattgtttgcatcataatgcttaatttcttgtttctcctgttgacgcatgtactatattcttaacctttagttgttgcagatgagtctattgcctcaccagagaaacgaaagggctcatgttatcaacaagatgacagtcctcgcagtggcaaaaagatgagatattcaggtccataccttcctgaggtatgacacacagtcctggtagtggaagactaacagagttacagtgcaaatagtgcgtaaaagttggtgtaactattccaactaaaacagaaatttgcgtacatatttcactttgtttatttttgtactcgtcatagactcatagatgtaccaagtatgtcttgttcgactgcggtaattgcagatgacatcatgcttacctgctgataaccttgactaaaacaaatgtcttgtatctggcccattctacctgcagaatctccttccatgggtacttaatgctggaaaataaacctatcattatattgtcaccaaatagtaacttgtttggaataggggtatgaccgtatgatttaaatcagagtcatgggaagcacacaaattcagactgctgtattacactggtttgttttggtatcttaggataactattacactgttgaactttatggaaaaacgtatcagtgcttcctccgcacatgtttacttggttcacactttctattagaacattgatttcatgttatccttcctaattcttatacaagtggtggataggattgatccacatattattttaggaccacaatcatttgtcaagtatgttgcctaagtcatgttgcaacttgcaatcaggggaggaaacagggggaggcgagcagtggcttggcctcccccatgcattcaaatttcacagtattttttactgtagctttagcaaattttgaaaaaaattaacactattggccccctccaacataatgtttttaaggtttttggctgtgtcttgcaataccatccatagcagtaaaatgtatacaagctagtaataactaatagcccttctctacacaatgctcaatttaactaccgcagttacaatccagttgttttagccttcaagtttccaatgtaatggttcactcatgcttgtgcatgcaggaaatgtggcagcatatacattcccttatgccaa

SEQ ID NO: 35530 - DNA, 1501 bp, Oryza sativa
taactaactaattatcaagtatcagtaaaaaaaagggtggcaattcgacttgcatgatactctctccggtaccattgtaccaactatgtagcatagacatgagttcatgatgcctcaaacaaccatgatgcaggatcaaatagattaccactcccgaaacatgaaaactactgcataccatggcacaaagtcgatctgtgtatgtgaaatagcatacgacaggggttaaactttgtataaccaaaactcagttactgcattgctttaaatcaatcacaaatacaaccaagcaaaattggacagcagagcaaaaaagaagaagcacatagctcagaagttccaatcattgataaatatgctaagaacattcaagcagtaaccaaacttcctttcacaaactacctgcaaaaaccactgtaatccaaaccgcacttcacatttcacatttttcacatgctcaattatcatccaaaacctctcgcaactcacagttacaagctaaaacagtcaaaatcaaactgagaaaccagtagcactcacctttcaccgggatgaacacaatccccttcccggagacccctcccatcccggggttgtacctcctgatcagctccatctccgccggcgacgagaacccgtactgcgcggccaccgattcgagcgtctccccgtcccagagcgggtaggtgaggaacagcccgtaccgcggcgagaccctctcgtcgccgcatgagcagttgatggtgacgttgaccctcccatcgccgccggggatcctccccggcgggtacgcgttggtggcctccagccacgcggcggtggtgaggtcggcgtagttggcggcgacggcgtcgtaggtgtcgccgccgccgcgggggagggggagcgggtaggggatggcgcctgcgaggaaggtggaggcgggcgcggcggggagcccgaggcaggagcaggggaagggaacgagcacgcggtcgccggtgacgacgtagtccgggttggtgatggccgggttgtaggggagcagcgcttggtagccgccgccgccgatggcgaagatggtggcgatgaaggtgaggtttgaaccctcggagaagtagtaggcggcgatggccagcgagcagccggcgcggcaaccgtcgccggacgccgcaaccgccgccgccgcgaaggcacaggcgccgatgaggagggcggggagagagaacatgaggcctacaataaataaatttcacatgtaagttgaatattctagttgtttcacttttgaactacccattgattcatgtttgaatcaggaaatcttacattttgttttgtttcactgtagaccacttaactctcttctcaaacatacaaacggttgttgataacattggtttttacctatcgataactagtgcgtatggataaaatagttgagagcgttaaagtgtcccagctgtaaatttatccgattttaaaatgaaaatgtttgttagaagttggcctagagtgaatc

SEQ ID NO: 35531 - DNA, 314 bp, Oryza sativa
atgatcgtttgattggaccacaggaaaaatacaggaaccagatgagagagatagactcaaaagatttttaccaagaggttggagctcttgctaagtttcctccaaaacctatatgcaacaagccattccataggaattttataggatttgaaaaacttcaatccttcgaatcaaagggctacataggaaaatttcctataggatttcaatcctatgaaattccttcataattcctttgattcaaaggggcccttagtattttgataagtgtgattatgataaacgaggaagttgtaacctgtaaaagccaaaca

SEQ ID NO: 35532 - DNA, 1501 bp, Oryza sativa
aaagttcttccaacatagcaaaaactagtgttaggaattattttcataaacttaatccaacatatacttgatcacctaaattgcttatgcggaattggtgattgaccagtggtactgacaggtgcttgacgaagacaaagaaaaacgtcattagtcttattagcaatatatgtagatgtagtgctaacgaaaacggggtagcgaagcaactgtaaggatcagcgtaggcgtcaggctgtgtatgcaatcccatgtttctaagccctctccctcgttttccacgcgcacgcttttcaagctactaaatgatacaatttttaaaaaaagtttatatacaaaagttgcttaaaatattaaattaatctatttttttaaaaaaattagctaatacttaattaatcatgcactaatgaaccgctctgtttttcgtgcaggagggattgttttccatcccttgattaggctgtgcagtaacatgacaccagagagaatcagagttattggagctcgtccttcggtctccctctagcgcctcacttaaaatcggttttggggttttgaggaacatatgtgatgatcaccaccgtacatgagttaggcttctcagttcttgtagcgttagagagtcagctgggacaagtccatcaagaatgaggcgtgtaatcccatcatttcgcgccttgtgatcagctcggtggccaaaaatcaattaacaataagctctgatctgcactttggttttctttctttcagatatgaatgtcgatgctttctgattcctgctagttataaggaattctctccgtttcatattataaatcgcttgacattttttttaagttaaaattctttatgtttgatcaagtctatagaaaaaaaagaacttgtataacagtaaattagtttcattaaatttaacatctaatatatttgttttgtattaaaaatgttactatattgttacaaacttaaagaaatctctactattataaaaattgaagatgtttttgccggtattttggtacgtcatccgtatataagtcggtttttaactttgtttgtttttggaaatgcatatccgtatttgagtcgttttttgagatcatttacttttggtaatacagaaggaatcatataagaaatatgtttaaaaaactcgcattctaatttaagacgatcggactcctaactgcagctcatgattttctaaaaatatatatatatccaagtgaattcccacagtgaattttatcttaactaaaccatataacaataataagattgaaatagactttacccgttacgtacgggcatttttttctagtttaattaaaaaatcaaaccacttataaattataaagcgaagggaatattacttctacttggttaatctatccgaaatcagcgtgtaaaactagccacttaactagtgtccctctgtctgttgccacatgagcagagacagcccgtaaagatgccacctttctggggacggcaatga

SEQ ID NO: 35533 - DNA, 1501 bp, Oryza sativa
tttttagagtgagccccacgttataccctaccatcctgcacaaacaatgtggcgttagtatcctgctactaccgcctggcgtgcggacccacgttactaccgaactcagtcataaacattgggcatgccctaatgtcatgactcatgaccaacgcccgtcatctcaccccttccgagaggactattcgcgctagctttgtcaggatcgtacctttcaaagcgtcgcgaccctcagcagagggtatcatagtttcatcagctttttagtgaggtatggacgagaagccgcgttggggagatgcctcgtcccgagttgtcgcctcgcgccgtggtagaagacggtgaggtggtggaccgaatagaagggtctacccgcgaagctccaccggtgaccgacgacccaatatgccactccgagaatttgtgttgttagttgatgctgttgaggttgagttagttcatgaatcatgccgaactagcgtagtagtagtcgcatgatgttgaggtgaattagtgtccgagtcgtactgttcactggtccagtagctgatgctggcatagtctactcggatgcgtccattcaatgtaaatccatgtgattcactgctcaaaatcatatgatatacgagaaccataaaatgatttctggctaatttgtttcatttgtagctgttgatttgactgtaaacccctttttaagtaagattcactctaggccaacttctaacaaacattttcattttaaaatcggataaatttacagctgggacactttaacgctctcaactattttatccatacgcactagttatcgataggtaaaaaccaatgttatcaacaaccgtttgtatgtttgagaagagagttaagtggtctacagtgaaacaaaacaaaatgtaagatttcctgattcaaacatgaatcaatgggtagttcaaaagtgaaacaactagaatattcaacttacatgtgaaatttatttattgtaggcctcatgttctctctccccgccctcctcatcggcgcctgtgccttcgcggcggcggcggttgcggcgtccggcgacggttgccgcgccggctgctcgctggccatcgccgcctactacttctccgagggttcaaacctcaccttcatcgccaccatcttcgccatcggcggcggcggctaccaagcgctgctcccctacaacccggccatcaccaacccggactacgtcgtcaccggcgaccgcgtgctcgttcccttcccctgctcctgcctcgggctccccgccgcgcccgcctccaccttcctcgcaggcgccatcccctacccgctccccctcccccgcggcggcggcgacacctacgacgccgtcgccgccaactacgccgacctcaccaccgccgcgtggctggaggccaccaacgcgtacccgccggggaggatccccggcggcgatgggagggtcaacgtcaccatcaactgctcatgcggcgacgagagggtctcgccgcgg

SEQ ID NO: 35534 - DNA, 1501 bp, Oryza sativa
taaagtaaaaggaaaaactactgttgaaacgctgctctcctgtaaagagagaaggtggaggctgagcccctaatatgccgcaattaatcgatagcgtagcattcacatgctaataagcctatggaagtgttaatcgtgtagcattgtcacggttctactctctccgttgtaaattacatgtcatttttatcctttttctagagtattatactttttatctttgatctgttggaaatttagtaataataattcgacatgttttaatccaaaaatatagcataataaacatgacatgtgaaaagatgagtgattctaacatagtgataaacataaatatgctatcaagaataatagcatcaaacatgtttaacactgagatgacaaatacatacttggagaacgctctggatccagtggcgatgttgttggtattgtcgccgccgttaccgttctctcctccattgccgttgtttccttccgttgccagtactgatcgacatgatccgagggattgtcaatatagaggaagcagagcgtgatgtagagggcagtgcctagagcagtcacgaatgcgctcccaaaaacttgatcactcacctacccgtgcaggtactcaggtggacggagtttcggagatctgctcgctctgagtacctgtgcgccaaggtactcaaaaccggggagatcaaactgaaactgcgtaggaacagaaagtagagaattgtgccgagaggaagaaccagagggattgaaccgagaaagagacaactctctgtctacccgaaggtggaaaatagtgtcgcacgcaagaggaacgttacagagttgatgacgcattatggtctcatcctttaccggtgtaacatcaccattgataccgtcggttacgcttttgctcatagaaacacaaacggtcggaaaaatgagcagctagccctaccctgtctccgtggcgccacgcacaccatgccacgcctcgccttcgcgcgcgcgcatgtttgacattcccaccacggtgacatatggccaccacctcaatcgctcaacaggtgctctcagttagcagcctatttgagttgaagtcctttcttattggtttccaatgtgataataaaatcttaacattaattgtgggcctctataattactaggattaatttggacctagcctgtgaattactatttcatccggtatattcacatagccagaaatgtaatttctcacgatgaatctaaaaatcataaatccttttaaaactaataatcaaacatagaaataattaacttaattagtactcctactacaagactagaacgtcaaaaacaggatgtgtcatggtatggattttcctttttaattccttttgacagcttctgggctttcacacacatttcctgggtcaaaatacatttctgactccactgtcctgagatcagctccaccgtcactgtacccactaacttttttgcgtatatctcgtgtacagtcagagtatctcat

SEQ ID NO: 35535 - DNA, 717 bp, Oryza sativa
aacggggcccgaactggcactgtatcgtaggactgcgtttttgcagttcaccacccagaagaaagcagcctcctttgactgctatcaggaaatcggttactccaacactccagcatagttaatgtttactgctaggaggattcaatttgcagttaatgattcacaggctttatgtttttgttaggtctgcacatctgaaagctttctccttcacagactgaagatttgcaacatgtacaggaaatgaaggatctctgcatattatatcctagcagaaaatgtatacaaaattctgttgaaagctatgaacttaagtaaagaagtcttgttggatatcttgagctatttttctcctgcaaacaccaggaagtatgatattttcaattaactcaagcaattgcaactgcttaaatagattatttaccagattatatatctacttgattatagagataaattaaatatatttaaaaataaacttaacaaataacttagaataagtgatctaagcaacacagtaaaataaagtttcttgagaaaatgtatttttagagacgtggagcaaataataattcaatgtaccattttataatttatatatggtcaacacacgaaattgaatgtgtgttcttattacataattagctgctgccatttttttttaaaaaaggtgcttacacacacaatgagacaactaattgactagcaaatactcct

SEQ ID NO: 35536 - DNA, 206 bp, Oryza sativa
aaatttttcactagtagaatattctaacgaaatattgtcctgatgaataaatattgagaaactatatgtttagccatcaacaacgatcagatctaaagtcctacatactccacaaccttaaagttcatcgtcataataatgataatgaagttcattacatagttcaaagtccagcgcatgattccctcttactcaacttaaataga

SEQ ID NO: 35537 - DNA, 155 bp, Oryza sativa
agccccgcaactccgaagctctgtttcaccaatccattccatcaaccaccctcgtccgtcgatcgaacaccttgtgcgcgatcgactccacacccctccattcatcctccaccttatataccccttagaacacctatatcctaccatgttttagc

SEQ ID NO: 35538 - DNA, 301 bp, Oryza sativa
ttcagcagcggggagcgtgtagatttcagcacgcatgcaagcttagtgctcgtcagagaactaatcactaatatatccagccgctgatttctcatcgaagacataattaaaattgtttgcacgctgatctgatcacagaagcgattgatgcatgcaaggtgtggcgacgtggagagcccaacacggaaccaccaaggatggggggcgcacgcagagcttgctgtgctgcgtgctgctgctgcgtatgcgtgcctcctgggatacaccgtgtgatagatctggcagccccatccgacctctc

SEQ ID NO: 35539 - DNA, 667 bp, Oryza sativa
cgacatcccgtatgacccgtcaaaggtgacggtcaacacttaggaattgagtggaatcataatttggagttctttcagatgattgctctagcaagactcaagtttgctcaaaggggcttcctggaggttttctttttggcagcctggcacatttagaagaagaggaatggtttaatctttaagagcattcagccctccttccaagcctagagatctctttttgtgaaagaagttcttttgcatatgtgcagaatgaaggatcccttaaagcaaattgtttttaattggttacaagctttatagttttattcagtttcttcttctgtaactttgtaaatatttttcgagttttataaaattacactgctgggcaaagtcctggcagtaattccggtcaaaaaaaaagtgacggtcatcagtgaccaaatcgtttgctcgtcatagatatcccgtcagaggtgtgaggatctggcgtagtcaggggcggatccagcatgggggcggtggggtctcgagcccccactactggcgtgaagactatgagagcccccacaaagatcacactaaaaatttttaccatatgtagataggagagggactataactctatctagtttacttagaccccactgctatttctttctggatccgccactgaggcgtagtg

SEQ ID NO: 35540 - DNA, 844 bp, Oryza sativa
aatcgacgtttgcactatctttgtcttcaacatggttccttttggggaaaggggatccccaagccaacatttttacttttaaacgggctctgcactggtaaataaaccccaatttggtgaccaaatgccaagggattaccctgcatcatagtatattttcttcgtcgttagcttgcccaattttccacttcgtcgaatgtccggctcatctcgcagggagaagttcgatctgtagcaaaacttgcagacactgcatttccgctctagctgttttcagatagtcttggaacaaaatcttctgttattcctcgttgaaaggcatctttgaccgaaacttgacgactagttgcatgggtgtaaaggggcccgaattaaatcgctaaagtctcgttggttatccatcgatcatgcaagaaggaagttcgcaacccatctccaacgtcgacttcagttagggcttgtagatcaggcagcagtttctacattgaggtccagtgaggcccaagtcgaaaagatgttagaagcggagtatctcaggccctatttgggggagcttgtcccagctgcagcttttcccaaaagctgccccaaacagtccacagcttctgagaatctgtagttacatattctgaaaaatgaactaagaagccagaagctggagagctgggtttcagagcttttccagattcttagaagttggctaccaaacagctgcttctcagaatctaaagctccccaaacaggccctgagtgttctttccagatccattttgtccatgagatctttgagttgtacatagggatgaaaacggagcggatagtttccgtccgctccggataaaaa

SEQ ID NO: 35541 - DNA, 353 bp, Oryza sativa
cgaataatgtggtacaaaattaatcgtgacctcgatcgtgtgtgtagtactgtagccgaccgtcgagcgatcgacgatgaagatgatgacgaggatatcgtatatatggatctcctgcagcccaatctcaataatatgcagaagatgagagtacgatggatgcaatgtcaatctcatctcatcaatggtgtcgctattacagcacgtggttttaataataatccacggtacgtacggtgtctagctgctacttgcactgtgcccctcctctacttaaacgcgccatcgtctggatagctagctacgtactgagctcgagcttaattagctctagctagctgcagcaatggcca

SEQ ID NO: 35542 - DNA, 452 bp, Oryza sativa
aagaaatatagaatgttcagagcgtaaggacgacagtactacttatcactgacgtggcgtttagaacacagaagatacatatatatacacacgagcataagtttttagtgccaagcctattaagtcactgaattaagggcacgctgaaggatcggtcaagctgaacacagttgagcaggaaaacagaaatcaggaataggttcacgacaaatggataagtggctcctcttgattaagatgcaaagcaaaatgataacgaatgtaaacaaagggaacggtaacataaactgaaggtacacctgtgttaagttattaacttgaatattgaatttcttgatgagatcaacaacttcctttcttggcacagtggcgcctgcaggaaataaatattagtgacgcgcctccttcattttcataattctttaaattaacatatatatagctcagcagaa

SEQ ID NO: 35543 - DNA, 324 bp, Oryza sativa
gagtgtttagtggcttcacacacctactgaagacatttgtttgtttcgatggagactgcaaaactgatagatgggctatctagtattagttctaatggaatctgaaaagaatttggtgttcttctaattaccctgtggctaatacctaaccagttatgctgcacaataccatggggtacaaataacctgactatatattcgatgttacatagattttgccaattccctcctcctatttactttacaaataaacgaaacagtgttatatacaagtatttgatataagtcgtaatgttttgttactgatattcacaatatgctttt

SEQ ID NO: 35544 - DNA, 1471 bp, Oryza sativa
tttcaccattaaacttatgatattagatccgccaattcataaatcatgaaagtcaaaagaccgacttaaaagcttaaaccaataaatctaaacctagaaaatgagagtgctaagtctataagcaacgacggccggccaggagtgccttatatatagtttaacagtcgatcgagtagccggctagcccgtcgataaatttgtgatcttttgacaaagtagtgagctttgacggaatttgtttaacattattgtgtatatatgtcgctcttttatgcatgccgtaagtttggaaccttggacttctactagatttcttccgatcgagctcacatcacgtttgtttgcagcttttgcgggctttgactaattaatatgtgcatttttgggtcaactgatttgaacaagtagtggcatatgcagcttagccaggaccgaacagatcgctatatacattatgttaacatacagttttaccatgctctagtggtatagataatctaatactaatttattacattaattaaattagagatccagctacagtagttagtctgatcttatctgaaaaaaataaatgccagctgctactactacaaatttcttattctacatatatacaatttgtaacatgcaatcttatagaagccacatgcacagatgacatattatcattaaaaaaaatctgcaaagcgatttttgtgctgatgagatgatatggcactatcaccaccgttacaacagattaaatatgatatagtaaatactcccttcgtttgtaaatatttaacatttaggataatatttttattaaattgtacagagtggccaccaatggtttgtcaagtgtttaattgaaaaagggaaaatggtatatatggcatagatttgttttcaagtactttatatattgtatctactagcaaatatgcgcgtgtgttgcatgggatctagtaagaggggttaaatgttccgttccactctattatactccctccgtcacatgatataagggattttgattttttgcttgcactgtttgaccattcgtcttatttaaaaaattttagaattattatttattttatttgtgacttactttattatccaaagtattttaaccacaacttttcattttttatatttgcacaaatttttttaataagacgagtggtcatacaatacaagcaaaaagtcaaaatctcttatattatgggacggagggagtagtatgttttcagtttttcttagtgtgtttcaacttttttttctatggttgttttctctatttttgtgtacgttcaccggtttttcagaaactttttttttagtagacggattgacaaaactctgcttttgcccttcctgcattataggaattacttggagtgaaaagcttggacaccatacgctgatcccttgtggtggcggtacaacacaataattgagaaatccattcaacatataatggtca

SEQ ID NO: 35545 - DNA, 222 bp, Oryza sativa
atgggaaaggtgaaaggttggaaaaaaaatttgggacttaacttgggctttttaacttttccgtcacattgaactttcgtacacacataaacttctaactcttccgtcacatcgtttcaatttctttgaactttcaattttagtgtggaactaaacacagcctagtagtatgtactgaaccagttcgtcactaagaagtgcataccattatctgtcggcagc

SEQ ID NO: 35546 - DNA, 397 bp, Oryza sativa
ctgcatttttgtaagacttttatgatgtttgtaaaacgtggatctgaatggcaacattgtcgtttgtgtaccccggctggtcctggacggggattttaatgcacattctgcttggaattctattcgggaatttctgggcgtgacagcaggtcaagggtccaagagccttatcctccaagaacgattctccgacgacaaggctggggctagggagagtgtatgactctacaaactgactgatcgaagtcggtaagagagaagacgctcatactcaaaatattggtcggtaaatttaattcattttcaatttaccatacatattataacatgtcacccttagagcgttcgctcgggggctatttctgtctaatattcttttctgagtattgatttcagg

SEQ ID NO: 35547 - DNA, 181 bp, Oryza sativa
tcctccgattctcctcctcgacttcgaacctgaccgcctgcatccgcatccgcctccgcctccgcctccgcctccgccgagaactcgccgccgcgccggccatgtcggtgagtgccccccgccgccccgctccctggccggccgggccgcccgccccacggatcttaattctcccatgcct

SEQ ID NO: 35548 - DNA, 348 bp, Oryza sativa
tactcggtcgcttgaagatgtcaacgatacgcagtctatctaatgaaatacatttaaaccaagtgattggcatagatcggccgatgtgccgagataatataaatcacttaatatctaaatgtgcctcaaagtaaagattgtgtatgctcgcagcatagccgatacagcaaacctagcatgtatcggctagtactccagtacgactctatactaagataacagggtaaatgaaatatataaaacgcagatcaatctagcaagtaagatggactggcagactgataaagagcaagatatgcttcaaataaacgagatcttaatataaagggcagatttagaagatcgaga

SEQ ID NO: 35549 - DNA, 1501 bp, Oryza sativa
gcgcgagcttgtaacccgagcgggggcattaaggtggtgtggacgttgcggtacggctgcgggcctgggtcggcattgctacagatggctcgcccgttccaagttgagtagtgggccggcggggcttgtgcgaaagctctggggccccacggttcctagagtggcaggcatggcgtgaggctggtttcacagagcagcgaatactgcccgcttccaacggtggaaggataacgggccgccgcactgctggcccgcttgggtctcgcatcctactccaacggaccaccacttttttatttttcttagaaaaataaaaacttcgttctgtttttccagctagctagtccgtgcacaaaatctttttttttttggttaaaaaagaaaaacttctttctgtttttgcggatagcaggagaagtgtccagttcgtgacttgaggtctctttggacttggaagtacaagattctcatagaaaaaagaaaatagaggattgcaattccttggaattttttttatacatgccatttgaaaaagggatttgagctcaccaaattcctatacatatgctaatagtattacaagtagaaagcaaatgaattttgtatgaaatgttgtttggaacacatggttgtcctgaacacaaaatttagattctatcctacgccagctagtgaaaaaataatgttgaatgttcagaaatccttccgaatttatatgtttttatggaaatcaaccaaattcctatgtatgattctcatattcttgtgggattcggtagcatatgacattctaggattcctttggaacaaagaaaaaaaatagaggaaatctaaagtgttaaaatcttatggaaaataatcatacttgatcctctgtaacaaaggataagcatacgcaaaatcctttgaaactcccattgaatgactcatttcattcatgggaaatttggaggaaagcttgtaagaagtatagcttcatgttttcccttgtgtcttagattcctctaagtttcaacagagcaagatattctgttagtagttttttttttccaaatcctgtgtttgaaaggagctaatcctacgttgttttctattcccttgaaagaaagggaaaacagaggaatttcaaagaatttgaattcaatgaaaaaatttcctatgataccctttggaatagaggattagatctttaaaatttctttgaaattcgtatggaattgctgcttgtaaattttagaggatttatatcctatggaatagcatgtttcatgtgaattttagaggatttatagtatgggctccaaaacctcctggaatttttcctttgtccacctcttccaaatcctgtgtttgtcatgtgctccatccaaacagcttcctctgtagttttcctatgttcctcgttccttgggatttaataacagttgttacatggctaaaaggattgtgattgtgatgttttagtgcacttgttttttctgtcccaacaatccaacatgca

SEQ ID NO: 35550 - DNA, 1501 bp, Oryza sativa
tttttatttttcttagaaaaataaaaacttcgttctgtttttccagctagctagtccgtgcacaaaatctttttttttttggttaaaaaagaaaaacttctttctgtttttgcggatagcaggagaagtgtccagttcgtgacttgaggtctctttggacttggaagtacaagattctcatagaaaaaagaaaatagaggattgcaattccttggaattttttttatacatgccatttgaaaaagggatttgagctcaccaaattcctatacatatgctaatagtattacaagtagaaagcaaatgaattttgtatgaaatgttgtttggaacacatggttgtcctgaacacaaaatttagattctatcctacgccagctagtgaaaaaataatgttgaatgttcagaaatccttccgaatttatatgtttttatggaaatcaaccaaattcctatgtatgattctcatattcttgtgggattcggtagcatatgacattctaggattcctttggaacaaagaaaaaaaatagaggaaatctaaagtgttaaaatcttatggaaaataatcatacttgatcctctgtaacaaaggataagcatacgcaaaatcctttgaaactcccattgaatgactcatttcattcatgggaaatttggaggaaagcttgtaagaagtatagcttcatgttttcccttgtgtcttagattcctctaagtttcaacagagcaagatattctgttagtagttttttttttccaaatcctgtgtttgaaaggagctaatcctacgttgttttctattcccttgaaagaaagggaaaacagaggaatttcaaagaatttgaattcaatgaaaaaatttcctatgataccctttggaatagaggattagatctttaaaatttctttgaaattcgtatggaattgctgcttgtaaattttagaggatttatatcctatggaatagcatgtttcatgtgaattttagaggatttatagtatgggctccaaaacctcctggaatttttcctttgtccacctcttccaaatcctgtgtttgtcatgtgctccatccaaacagcttcctctgtagttttcctatgttcctcgttccttgggatttaataacagttgttacatggctaaaaggattgtgattgtgatgttttagtgcacttgttttttctgtcccaacaatccaacatgcatgcctgatgcctggttagcatgcatcatcaaagccccatgcagtccagatttaaaacgaggtgatcaccaactgcgttggagacttggagtctttaaagtgaagagaaaaagcacaaaggccatcacaggacactggttagcagataccagcagccatcaggcaaggcaaagttcctcacaaataatggggcggctaccgaatttgttcatggcattaaagcaaggaaaacatcccgtgaaaagatggacaacttcaacatttctgttcaaacgggcaggcttaggatac

SEQ ID NO: 35551 - DNA, 644 bp, Oryza sativa
cacaaaaaaaaacttaagtaagtgtggtgaagaataaggaaacatgcacacttttaactcccccccccccaacaagaaaagagagctttactacctcaaatacctatatgcatgcatgcaaacccaattttcatgcttagatgtagtaactacaccaacattacataataatcaacttgaaatttttgattttagtcaattgatgatcaatatataacggatggaatatttcatattggctggtgcattgtgcggcaaggccgcatctattttctagtaattaattattccaaaattagagatacaataaaacgctttatccaaacggcgtcggtgacgccaacgacactggttggagttggacacgccgaccccacacgcagcgacacacaaacggcggggattacttcgccgttaaggcgtacactaaaccaaaccgcgtggtcgactggtcgtctcctcctcgaatcaaatcaaacggaaccgaatcccatctccccaataataaaaatccccaattcgcgtctcgtctcctcgcaaatacgacgcgttcccaaatcccccaatccgatctgcctttcctcttcctcctcgtcaaaccctagccaaatccacgatcggggctagctcgtcggcggcggcga

SEQ ID NO: 35552 - DNA, 963 bp, Oryza sativa
ttttacatccaaaacatgctgaacattcaagagtaaaaagacaacttttatgtttcagcaggtaaaacaatacaatttacacaaaatgaataggtgttatcatgatatcatctgagcacaccaatgatcactggtctcacttcatacatgctgttaagggtgctcctaagttaaagcagaataatattatccttgttatttgctatcctcctcactttttaggtagtacaagaagagtaaatcattatcaaaatatcaattccgtagtaagtcataatataggactaccgcatgttagctgttaaaaatcctgaaagtcattttatgtcctatcacaattcacaacactacatacctcccaagtaatcagccaacagaagagatgatttgccgcatgtatgatgctatttgatattggaatacacagaaatttccattggtgaaattaaggctgtttggctgcctgggctgcatctgcgccacagacaacagcaacagtgctgcaagcagcaaggaaacagcgggcagcagcagccgcagccacagcccaggtagccgaatggcctgattgttaggtcagtgataacagcatgactcattgttttattggcatccatgttatgcaatgacgatgtcttcagcacagggagcatgacatgaatatgcaacacctcagtaaccctcgccatttgacaggtaagatgtgaggtatggttagtcttatgtttccacaaatcttaaaccatagcagcatagccattatttttcggtgcgcagctgcattcagaaaggccaaagtaggagtataactcaaggaaacagcgtggtcttgtagatactagatacacaccacataaccaccttcacattctccatcaaattgataaaaactaaaacaatatttcacaagtgcaacagaaggtaagtattcatgtatgatgctaggggtggctatgtttatca

SEQ ID NO: 35553 - DNA, 1254 bp, Oryza sativa
aatggttggcttatgttggaattggacacacacctccccctctattcaaaacccccataatggttttaggctgggctcgaggtgcgtggttgggtttggttagtcgtacctcgggtactataaggattaagctcgggcctctgttgcaaagcactaccgtacttccacatgtctagtgggtaaggcttaatttgtggctcagtctggttataaacaaaagtacacggatggagatggatgaagtcgggggtcgatggacattctccagggcaaatgaaggctacacgagctgcggcccggtagtcgagatgtcatggcacagggccggtgtcctgctgctagggggctcaatcctgcctgcctgtcccgggggttccggccgtaggtggggttgggtcggtactcttgtctatggctaggatgggttggaaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagtcagtgtttcaaattcttaaaatttgcttaacaactaaaatgtggaatggttggcctgggttggcttgggacgagctgggacccagggtcgggttgccagttcggtctgaatcatcgtaggccttgggttaaggcaggttcgtgagggttcacggccttgattaataacactgtgtaactctaggatcgtcttataaaatggctttgggcaactaagtgacttttaaatgctgttttctgcaaagcttaacccctatattattaccccttgtacccccttgcattaatcatgcatctgccggtgtggcttgctgagtactgtggttgtactcattcttgctcaatcttttcccccttcagtaagagaagctttggagaagaagtcttaggttgagtcctggcttataccccagttgagcgcctgtgaagatggagccgtaggcccgctagtccgctgctgtttatttttgattgttaggccttaagtgcctttgtaataatgtaaatattatcgatataataaagatgtgtcttttatatcatgtttgtatggtgtaccccggcttttcctgggacggggattaatacactagcgttcgggaaaaggcaattttcccggtcgcgacatcaagtacctcaagaattgctagctcccacaaga

SEQ ID NO: 35554 - DNA, 1070 bp, Oryza sativa
cgaacgaacgcgaacgaacgcgaacgaacgtgactgaaacatgaatgaacgtgagtgttagtgaacgaacacgaacgaacgtgaatgaaacgtgaacgaacgtgattgaaacgttaacgaacgtgaatgcacttgaactaaaagtgtgagaacgaacgcgagcgaaatgtgtacgaacgagataattaaactattgttgaacttaccatatatatatgattatatatacttgaaaacatgaaatacattatatgttcctttgcatttagactaatacattttttttgcatgttgcagagaagacgtcgtcgttgtcgtccctcaagccgaagtggtagctagccctcgaaggaattcacgcaggcaagtgatgtaaagatgtgattgttagagatataatataagattgttagatttctaatataagattattagattattagagttagcatatgtgagtgttaaagattattagattattagacttagcatatttgagtgttagagatagttagagatttaatataagattcttagaggtttaatatacgaaacttaattagacttagcatatgtcagtgttagatatttaatataagattattagagatataatattcgaaacatatttgattgttagagatttaatataagattattagagatgtaatattcgaaacttaattagacttagcatatatgattatctaccgtacaaatacacgacacttagacttagcatatttgagtgttagagatagttagagatttaatataagattattagaggtttaatatacgaaacttaattagacttagcatatgtgagtgttagagatttaatataagattattagagatgtaatattcgaaacatatttgattgttagagatttaatataagattattagagatgtaatatttcaaacttaattagacttagcatatatgattatctaccgtacaaatacacgatacttagacttagcataaatgattatttgagttttaatacaagattagtagagtgttaatattacgcttagcaaatatttcttctatgaacaga

SEQ ID NO: 35555 - DNA, 276 bp, Oryza sativa
gcctgcaggtcgactctagaggatccccccatccttagcatcagctaaccaactccaaatatctagccgtcgtgctgccttactctagcaccgactagaaaaccaaatccaccaaatcaaccacacctatccattttatcctttccttcaattccaacctttagaaaccaaaacccctcttttattttccaaatcaaaatttattttaaaccattatttttccccttgccttgctccaattttatttattccttggttttatcgtttctttgtagc

SEQ ID NO: 35556 - DNA, 472 bp, Oryza sativa
attctatctagctagctggttttaaaaattagtggtggcagtttatccagccaaccgttcatatgtcgtattaatttgattgaaaactcttttcaaaaataaagaaaagaaagattgaaaacataggtccatatgacacggcccatttcagtcgataagttttgaacaaacggtttcgtagtcagcggttgactgaggctttagtttttttttaaaaaaaatggtgataaatccgatgtcattatacgtagccaaagggtatatttagattccaagtctcgtaacaataaaaaaaacactaataccttgttctgttaatctataagaaagagggattgaaggggatttttgagagggaatagttctgcaccacaatagagtgcattaaatcaccctccaaatccctctctattctctcgtgggagggattaaacgaagaagattagctttaatcttttcttgcctaacaagg

SEQ ID NO: 35557 - DNA, 374 bp, Oryza sativa
ttatagtcctgtcgggtttcgccactatccaactctattgaccgtcgatccagcgggatggcaaaggtggaatatgcgaggagaggcagaagagtcggctagaggcaggtacctacttgctactcccctgctgcagcagagatgaaggttagggaccgctagcccatgtagctcgggagaaaaaagcttgggggcaagagccgacggagctccggtggtggaggtcggggaggatgggaagaagcggcaggggatgggcgacaaccagatttgcccttctcggccataatgttcttctcccctcttgatctattcttctttcttttgcctcattaggcggcgtctaacgcagatggatgtgtacctttgagcaa

SEQ ID NO: 35558 - DNA, 1501 bp, Oryza sativa
caagccagcgtgggcaacggctttatcttttgtatagcatggttcattgcggggcaccagactgagaagtggcggagataagcccacgggggtcgctggggagtccatgcctctggtttttgagggggtgattatgatccaggaatggtgcgctgcggtggattgtgttatgcaaggggtactgtcacagcccctttccgaggtaccgtggtggtactgaggcacatggtgacatgatgtggggctgtgtcttgtgggtacagtggtacacctctggccagagtaaaactattcgaatagccgtgcccgtggttatgggcgggttgagcaatgtttttcgtgattagtctcacacctctcacaataattatggatgctataactggtaataatttgcttagctcctggtttggagttagatctgtacagccgggtatggttgttcaggatggttgggcctgtgcagcatgggtatgctgttcagtgttgattaaaatttctgatcaattactccactgttttacttctcttaaatgttttgctaaaatgctgcttttgcaaatgagcctatattatgccatcctttggtatccttgtgcacttgcatatttgctgtgtggcttgctgagtatgtcatatgctcaccttgcaataatcaatcaacctcagttgaagaaaaaggatccagaaggagaagacgtttgtcttatatcccagttgagctgcctgtgggagtggagccggagcttcgctagattttattttccgctgcagttttcttcttagtgaggactaagtgcctcttaagtaagtatttatcgttttagttaatttgatgaatctgtatattaaattgtcagtttgtgtacctcggctgattcctggacgaggattttatgcacaaatatgttcggaaataactagtgaatttccgggcgtgacaagttggtatcagagccatcttgactgtaggataagccaaatggtcaaaccttaaggactaattttccgaaaacatgatttgtgaaaattttcctttcttccttctctagaattctctataaatcattttttcatcctctcccctcctgctttcaactggagtagttctgaaactagttgttgaaacttgaagacgccaatgtggtctacttgtggaggttaagtcaagtggatcgatgaataagaaggtgatggtcgatctgaagtgcccagatgtcaagatggaatgaagtttggatcctaccttagaacctatgccgccaaagtgtccttggagaatagttagtagggtagaacgcttgttgcttgcttgtgtgtaggtatggttgcattcccgtcattggtgtgattcaatgatgagtgtgtaactatactaggttgcttgcttaatcaacttgaacaatataatggtctacacacatcagatcagtgttaacctggttaaggtcttgtctttagtgtaacccctctccttctatcctctctaataagcaacaga

SEQ ID NO: 35559 - DNA, 1501 bp, Oryza sativa
aactaattcatcttaactcagtttaatgtggttcaagttgcaaaagttgtataaaataaagatctacatattaaaattgtccataaattgaattaaatttatttaattctttttaaatgggctttaaatagatttaatcttgtaaaattcataataaattcatttgaagtcagaatgaggccgttcaagtctcataattcatctaaaattatgatctacatgtttgtttactttttatgtattgtttatttggtttttattagtcttttccttgttttgcgtgttagcttgtcgtttccgtcgttgtgaaggttcgcgagtgcgccggaagtattcaagaagattaattgaagaccgattattgcaaggcaagtcacacagatcctaaacacaattcctttgagcatgttgatcctatatttaaattctctatttatttcaactgtgcatttattttcgaatgtcactgggtggtgtgaacctattcctttgttatggcctgtttgcattgattactttattccttgataccttgggttattataattggactagttgagttttatatatattggttcaactagatattagatatgattgcttagccatgcttagaaaccttagcacacaattgggataactaatgtttcactatcacttatggttatatttaatggtagctcacgatggtcaatcgtgattggttaattaattacttgccaactaaaacttgataatggtgggttgtgagcacatggttttgagagtcgtgctcatgacaattaaggaccggttcgcgagctactgttgtgaaacattaaccgtgccaaccacaagccagcgtgggcaacggctttatcttttgtatagcatggttcattgcggggcaccagactgagaagtggcggagataagcccacgggggtcgctggggagtccatgcctctggtttttgagggggtgattatgatccaggaatggtgcgctgcggtggattgtgttatgcaaggggtactgtcacagcccctttccgaggtaccgtggtggtactgaggcacatggtgacatgatgtggggctgtgtcttgtgggtacagtggtacacctctggccagagtaaaactattcgaatagccgtgcccgtggttatgggcgggttgagcaatgtttttcgtgattagtctcacacctctcacaataattatggatgctataactggtaataatttgcttagctcctggtttggagttagatctgtacagccgggtatggttgttcaggatggttgggcctgtgcagcatgggtatgctgttcagtgttgattaaaatttctgatcaattactccactgttttacttctcttaaatgttttgctaaaatgctgcttttgcaaatgagcctatattatgccatcctttggtatccttgtgcacttgcatatttgctgtgtggcttgctgagtatgtcatatgctcaccttgcaataatcaatcaacctca

SEQ ID NO: 35560 - DNA, 573 bp, Oryza sativa
tagttcatcagaatcagtgcaggacgaataattcatattatattcttcttttatttacaaattgcaattatgttaccctgcagtcctgcactcctgtctgctatcatgatttcaagattagttgaacaagagcaaacttagtggcatggaatatatttttatattttccaatgcaaccacaggatagtcctgacatgttgtgatttcagtgcaacatgttagaaattccaatgcaaccacaggaaatataattattttattgaagtctagtatatttagctcacatcatctataaaatagttaaaatgtctcgtaaaatccactggtccgacaatgtgtgaaaactatggatttacttttcattaggtttaccaaaattccatgtttaggagatggacttcaggtaattgttgatatagaatttttttggaactggtcatgtactgaaatttccattagatctcaaagtgagtaagctgtcaaattttatatggacttgctaaggaactcatatttgctacaccatgaatagtaataatccactacttgacaccttccataaaccagccttag

SEQ ID NO: 35561 - DNA, 317 bp, Oryza sativa
atatcccatatctacacggcgatggtatttggactgaatcaggataccaaatatagatagaatatcttatttgtgtctcgggtttgtttctcaacttgtacatcaaggaaataccttgagacttagtcggttacgactgtattttatctgtatctgcatattccgttagggatatagattatcttttgtaacacggactccttcccatatataaggggggtccgggtgcctctaggggcacatgttgattttctccaaatcatacaattaagaagacactcggcggattcatccccggacaggagtagggtattact

SEQ ID NO: 35562 - DNA, 323 bp, Oryza sativa
aacggcgcgtgtggtgggccccgtggtgggatggcgtgaaagcgcgggaagcagccgcgctcgatttttctgtcgctgatcgggcgcccgatcgctggcagggtaacctactctctttccctcgggggaacctactctctctcactatataataagtccgatttggtggtcgaatagtttaaggtttcgattcgtattcgtgcaacatttgtaataaactagatcacgctattacaaatttgctcgagttaaaaatatgtttatttggaatctgtcccaaaaacaatccccaaccctaacctgcctgagcaagaagcacaaga

SEQ ID NO: 35563 - DNA, 774 bp, Oryza sativa
tcagatcaaggtccgagcactcaatcgtgatggcagagcacttgttgtagttattcctcagacctgatgcttctctaaagagaaataagatttcattcatcacccgcgcgtcatgttctctcggccggagaaagggaacaacatcatcagggtagagctaacagccccgcttctttagcacctgaaacatcaaacttaagatgtgcatgacaatgatgaagagaatcagcgacaaagggtcaccttgccgcacaccacggtgcagccacacagccagcggtgggcggcgactggcgagtggcgcggggcgatggggcaggggatggtcggatgtgggcggtgactggcgaatggcacgggaggcgtacgacgcaggtgctggtgagcggcactggcgcctggtggctaggcttagagacacaagtgtgacgccgccgccgtgttaggagactggggagggaggagagtgcggttgatcccctttatccttttcacttttctgctagggttcactgtatttcgattttgggccttatattctatgccacaggcccacggcccaagcaataacaacccatgtgtgacttgctcagaaactgaggattatctactctagcttgttaaggctcacgagcagctcacgagttagctcgagctagctcgttatctctaacgagcttaaaagtcagctcggctcgttacgaaatttaaatgagacgagctgagctgagcttgtcacgagccgagcgagctaacgagtcaagagtttcctgt

SEQ ID NO: 35564 - DNA, 1501 bp, Oryza sativa
ttattcatcgatccacttgacttaacctccacaagtagaccacattggcgtcttcaagtttcaacaactagtttcagaactactccagttgaaagcaggaggggagaggatgaaaaaatgatttatagagaattctagagaaggaagaaaggaaaattttcacaaatcatgttttcggaaaattagtccttaaggtttgaccatttggcttatcctacagtcaagatggctctgataccaacttgtcacgcccggaaattcactagttatttccgaacatatttgtgcataaaatcctcgtccaggaatcagccgaggtacacaaactgacaatttaatatacagattcatcaaattaactaaaacgataaatacttacttaagaggcacttagtcctcactaagaagaaaactgcagcggaaaataaaatctagcgaagctccggctccactcccacaggcagctcaactgggatataagacaaacgtcttctccttctggatcctttttcttcaactgaggttgattgattattgcaaggtgagcatatgacatactcagcaagccacacagcaaatatgcaagtgcacaaggataccaaaggatggcataatataggctcatttgcaaaagcagcattttagcaaaacatttaagagaagtaaaacagtggagtaattgatcagaaattttaatcaacactgaacagcatacccatgctgcacaggcccaaccatcctgaacaaccatacccggctgtacagatctaactccaaaccaggagctaagcaaattattaccagttatagcatccataattattgtgagaggtgtgagactaatcacgaaaaacattgctcaacccgcccataaccacgggcacggctattcgaatagttttactctggccagaggtgtaccactgtacccacaagacacagccccacatcatgtcaccatgtgcctcagtaccaccacggtacctcggaaaggggctgtgacagtaccccttgcataacacaatccaccgcagcgcaccattcctggatcataatcaccccctcaaaaaccagaggcatggactccccagcgacccccgtgggcttatctccgccacttctcagtctggtgccccgcaatgaaccatgctatacaaaagataaagccgttgcccacgctggcttgtggttggcacggttaatgtttcacaacagtagctcgcgaaccggtccttaattgtcatgagcacgactctcaaaaccatgtgctcacaacccaccattatcaagttttagttggcaagtaattaattaaccaatcacgattgaccatcgtgagctaccattaaatataaccataagtgatagtgaaacattagttatcccaattgtgtgctaaggtttctaagcatggctaagcaatcatatctaatatctagttgaaccaatatatataaaactcaactagtccaattataataacccaaggtatcaaggaata

SEQ ID NO: 35565 - DNA, 1501 bp, Oryza sativa
cataaatattggataaaaaaaggaaaaaaaataagagagaaaaaaaatacatcgatcagggtaagtttgcaggatggcgtggggcggttggattgtgctagaagggagaggggttgggctgggataggttgtataatagttatattaaactcacgtcaaattggatacaaacgatatataaccaactaaaaatcaactcaaaacacgcatgatgcaccaaaattccggtgaaaacattttaaatttttataatagtagaaatatttggtatgtttaaaacttcgaattatatgaaaggtgaacatacatacatatatcaagtatacccattgaatacactactctagcctcactaaattatcaatgaaaagttagggggtgtttagatctaggggtgtaaagttttggcgtgtcacatcgggtgttcaactaattacaaaatccgttagtaaaccgcgagacgaatttattaagcctaattaattcgtcattagcaaatgtttactgtaataccacattgtcaaatcatgcagcaattaggcttaaaaaattcgtctcataaattagtcacaatatgtgcaattagttatttttagcctatatttaatacttcgtgcaagtctttaaacgttcgatataatagggtgtacaagttttacgtgggaactaaacatggccttactaaccattgacgtcacgattctacaaggacccggtaggtgcctgtgtagtttcaaaagaaaaaaaatactcacaaacttaaaaaaaaaataaactgggatattttaggcctcttttaaagcgtgttttttttctttttaacaacgaaattgcttctaccctcgatgtatctgacatgtaattgtttttgtcaacaattaacacgaaatttctgcatttcagacccttgaagtggtatgaatgccattttagttatttcgggtgacatttacccagaacccacaaattataaaatacccgatcgattgaagtgtaaaaagttccaagattgaagtgtaaaaaacaaaaacaaatccctcgagccaaagttgtcacaattcacttttgcctcgtctccacctagcccctatatattcctcccaataataaatccaacgacagactgtacggctatactagtattctactcgcaagtcgcaagcctcattcaacatctctctctctctctctctctctctgaacgatggttggtgtgcttgctgctgctgagcactgatgcagccttttcttatgggcatttaatacctgagttattactgcaagggagggagggatcaaatgcaggcagttcaatagaaaaagaaaaaaaaagaaacaacctgagcaccagagttcttggctgctccaagttcgcattgtgatccacggagccggagaagggggcaaaacaaaaccttatggtttcttgattcatttctgctttggtgattgattcttggttccgtttcttgggccccgatttgggaggggttcttggcga

SEQ ID NO: 35566 - DNA, 1501 bp, Oryza sativa
agtctaggcgatccaagcttgatcaaaaccattggcctgaagaatctgaaggattgcctcatgttctactagatcaaaagctttttaaaagtcaacttttagaatggctaattcatttttgcttaggtggcactgatgaacatattcaaagctccaaacaagacagtcttgtatagttctgtttctgatgaagcgattttcatggatgagctcatgtataattgattgaattctattggccatgatcttggtgaagaattgagaagcaatctcatagaagtcattacagatgatgggccaacatttagtaagaaacatcccattaaaaccatgcggcccagggcctctatctgtgggcatattttttatgatattgtccatttcctcttttgatggcattgaactttgaaaatgtaagatatctactggttgaaataggtttgctagagtgagaaccatgtctgagtgaccatcaatccccattctatttttataagttgtgtataaagcatgagccttttcctcatgggaggacacccctctttctgtcttttatcctcaagttttaaatgtgagattttattccttctgtgactgtctggagtagaggcctgaaaaaatttggtgttctcatctccaaatttgcccatctaatcgtacaaacttttttccagaattcatttttgtatttgaacaggcttagaatgtgctcctttaaaatcagtctgaagttccattcctacaaggcaagaggtctttgctctaccaatttgtcgagtagcaacaggatctcattgcagttagaaagcagagagtgtaggttagataatcttttgctcagaaagtcaccaggtatggttagacagtggctagggctctccccttttcagcttctgttaattctcgggtggacattcctaatccccagcctagagccaggaaacacaagtccttagttgtcacgcccggaaattcactagtaatttccgaacttatttgtgcataaaatcctcgtccaggaatcagccgaggtacacaaactgacaatttaatatacaaatccatcataataataacgttacatacttacaaaagaaaagaaaaacagcagcggaattaacggtctagcgatggcttcagctccactcccacaggcagctcaactggggtataagccaaacgtcttctccttctggatcctttatcttcaactgaggtgtgatgattattgcaagaatgagcatatgacatactcaacaagccacacagcaaatatgcaagtgcacaaggattccaaaggatggcataatataggctcatttgcaaaagcagcatttagcaaagatttaagataagtaaaacagtagagtaattaatcatcaattttaatcaacactgaacagcacacccatgctgctcaggcccaaccaaacctgaacaaccaaccccggtcgtacagatcaaacctccaaaccaggaattaagcaaattattaccaggt

SEQ ID NO: 35567 - DNA, 1501 bp, Oryza sativa
taacctttgtccatgatttaggaaagttgtgatggagagcaatcttctttcaactcattcaatcaaaggggcaaaaattaatgattttaggttcagtggttcccattggcaaacctaagtaggtaaaaggcatagttcccaccatgcaaccaaatgtaccaaccagaacttgtatcattttctacattagtactaatgggaatcatgcaagatttgtgataattaattttcaacccagtgcacagggtataggtgttcatcagagttctgtggcaaaataactctctctaatcagccttcatgataagaagggtgtcatctacatattgaataattggaaacttccctctgtcttgagggattggaaatgataatagccccatctcataaggcctgttgataatagattggagaagatccgctgctagaacaaaagaagtggtgataaaggatcaccttgccgaacgcctctcttgcatttgaaatctttacctagaactccatttaacaacacaaaagtggttgcagatgacaggacatttttagtctaggcgatccaagcttgatcaaaaccattggcctgaagaatctgaaggattgcctcatgttctactagatcaaaagctttttaaaagtcaacttttagaatggctaattcatttttgcttaggtggcactgatgaacatattcaaagctccaaacaagacagtcttgtatagttctgtttctgatgaagcgattttcatggatgagctcatgtataattgattgaattctattggccatgatcttggtgaagaattgagaagcaatctcatagaagtcattacagatgatgggccaacatttagtaagaaacatcccattaaaaccatgcggcccagggcctctatctgtgggcatattttttatgatattgtccatttcctcttttgatggcattgaactttgaaaatgtaagatatctactggttgaaataggtttgctagagtgagaaccatgtctgagtgaccatcaatccccattctatttttataagttgtgtataaagcatgagccttttcctcatgggaggacacccctctttctgtcttttatcctcaagttttaaatgtgagattttattccttctgtgactgtctggagtagaggcctgaaaaaatttggtgttctcatctccaaatttgcccatctaatcgtacaaacttttttccagaattcatttttgtatttgaacaggcttagaatgtgctcctttaaaatcagtctgaagttccattcctacaaggcaagaggtctttgctctaccaatttgtcgagtagcaacaggatctcattgcagttagaaagcagagagtgtaggttagataatcttttgctcagaaagtcaccaggtatggttagacagtggctagggctctccccttttcagcttctgttaattctcgggtggacattcctaatccccagcctagagccaggaaacacaagtccttagt

SEQ ID NO: 35568 - DNA, 1501 bp, Oryza sativa
aaaagatttatacaggttcaggccttcttattcaagaagtaataccctactcctgtccggggatgaatccgccgagtgtcttcttaattgtatgatttggagaaaatcaacatgtgcccctagaggcacccggaccccccttatatatgggaaggagtccgtgttacaaaagataatctatatccctaacggaatatgcagatacagataaaatacagtcgtaaccgactaagtctcaaggtatttccttgatgtacaagttgagaaacaaacccgagacacaaataagatattctatctatatttggtatcctgtattcagtccaaataccatcgccgtgtagatatgggatatccataatgtggaggcccatcatgcggcctattccaatgatctgccgccttttcttgcaacatgatttcagacaaccaatcgtgatcaatgtagcctcctgcattctcatcgacttccaccattgaccaggatagggagatagacagtttgttgatacgtgttgacataacatggctacaccacaatataggatgcggtcaccagtccgagtattgcatgtggactgtccaaaatcaagatatacgggtctgtttgacacagcttcaactccagctccatcttttctagagctaaagccccgtcaaacaatttcagctccaccaaaaatgtgagtggagctgggtggagctctctcacaaaataaactagagaggtggagctgggtttgggcagctccacaactgcactccagacccaactccgatcttggagttaaatttaggagttggagctctaccaaacgtacgcacactgatttggaaaacaatcgttcaacaatgcacacaatacatgtttgcacaggataaactatctcctttacattttctcacacttatattatgacctcctggcaactattgttagtaccatgacgaaaatacttcattactgtatgccaacctgactctttatgatgaattatgcctcgtttaggatgaaccttttaatgcaaactgatacttacaaacgggaccaatttactgtggttctataattaccctgcctaccaagttctatgatgaaatactttgtcatagtgtgatagctgcatcttataatgaaaaaaatccctaatgtttgtgattgacatatttttcaccgtgaaagatttttatgatgaatacctccaggcgtcattataatctgtcatggatgtactttacaatgtttttttaaaataattagttatgtagtttgatacaaagaaattaacctatatatataacaagtttgtgattcagtagtcagcaacattgtattactacttttttattataactaaccgtcatcatgtaaattaaaataaataaaaatggccccgttcatcatggactggatttatcatgcaggggcgaaagaatgtcatgaagatgttgaaagaaatactcaatgagaggaagaagatagaaggacgccatgaaagca

SEQ ID NO: 35569 - DNA, 1501 bp, Oryza sativa
ctgcattctcatcgacttccaccattgaccaggatagggatgtcgaaactagatttcggcaataataaaagggggtggctatcaagctggaaaattgtatgggtttggagacaaaagatttatacaggttcaggccttcttattcaagaagtaataccctactcctgtccggggatgaatccgccgagtgtcttcttaattgtatgatttggagaaaatcaacatgtgcccctagaggcacccggaccccccttatatatgggaaggagtccgtgttacaaaagataatctatatccctaacggaatatgcagatacagataaaatacagtcgtaaccgactaagtctcaaggtatttccttgatgtacaagttgagaaacaaacccgagacacaaataagatattctatctatatttggtatcctgtattcagtccaaataccatcgccgtgtagatatgggatatccataatctccacagtagcccccgagacctttgcagtcaaccatcatagccttctcaaagataataatccgagtgcttcaaacctttcatgccaagatctgccgagtagcgaagacaaagactgtaaagggcgaaaagataaagaatatggtgcatcgaatagatgcacctaattaggtgtagcccccaactatgtgattagttaacaaactaaacatatagttgagaacaaaataacagcacaatcgtgcatcgtatgacaaaagcatacgcggcgcctaaagaggcattctagccgactgctttttagccataataaaaggaatccgagtggttagcaccctaaaaggttcacgaatgaacacacttgacaggcatccgaatagaaaactctaaagattacccaccaaatattataaaaattatggtaatgaataagtctaatagcctaggctatgactatttaccataatgaaaacaggcatataacataccaaggaaatgactatggtaaaaacaagtcattctaagttaacccagacagcttttgtagcctaaaaaagcttacaaaaacagcataacacctttctgtcgggcaccttttaatttgcattgcaataattccaaagaattatatgaccgcgtaaaaaggattttatcagcattgggcaacactattgtgcgcataaattgccaaagcaaaaaatgcctaagtccctaaggagcacaatgggccacgctgtcaaaagtactgggctgaggtactgttcaggcctaagcccatttgcacctccgatacccttaacaagaaatcccaagatccaagcgacgcttcgtcttccccgccggaactctcgccattttctccactccctgctacagtacagagctgcgccggcaaactagggttcaccattccactcgaatctaccttcgaaaagttcatcaaaatccttcccgtgatccaccgcctcaatccctcacttctcccaagccatccctcgaatcaaatcagcgcattcgggtaaaatcaa

SEQ ID NO: 35570 - DNA, 569 bp, Oryza sativa
gcatgcttgtattttataattttagatgatgtagtatagttatattttcagttttagtactccctccatcccattttaaacgtagttgtgggtttttttccaacgtttgatcatctatcttatttgaaaattttatgcaaaaattaaaaaaataagccacacataaagtattgttcatgttttatcgtctaataacaataaaaatattaatcataaaatattttaaataagacagacggtcaaatgttggacgcagaaaactacgactacaattaaaatgcgacggaggaagtatatacgaatataattggcataattgcatgattgcatgttattggcttttgatgtttagtgggttgatgcagcatgcttgcatattaactaatactctataagttctattacctaaaaaactaatacttgcgatgactgcatgttgagtgggttgatgtagcgtgcctgcatgtcaactaataattgctatacttgtatgttgagcttagatttttagtgggttgtaactttacataagacaattgaatcttcgtatcactacaatttgttgcaga

SEQ ID NO: 35571 - DNA, 1273 bp, Oryza sativa
atgaaagagaaagaaggtgaggtgcggttcgtgggagtggatggatggaaagcacagcagagaagagaagagaagcgcaggttattaggctcgaattcgaccggtgcctgctctacactgcaactgcaactgcacttgttgatcatgctttcattgccattccatatttctttctgtaccggttgtatgcggttggtgcggcttcgctttctgttgcacatgctgcttgcgactcattgctaccgtttcctctttctccacataatactcgcagcaaccatctactgctgttacttactatactacttctctattcacatcccatctattaatctatagtattattactatatgtgtatgtattatctgcttatatatctcgttgattgatttcatcctgcacttgcagcgattactttggtcgtcaaagtcatcattttgctgattacccggaattaaggacggactcctgtctatatagcatatatactcctgtcacaataggcagcagtaccatcgctcgtctttatttatttatttttacatttattgataacggacacacaatgaatgaatatatataatttcatgctgagctcaactagcaaactaaactagtaaaaaattaaatgcttcttgcatgcctgagcctgactcagctagtgctcacctaatgacactcgatcttcttttcctttctgaacaagctcaaacgcatttgaagagagcactactgctaattgcgtagtaattgcgtgtgctaattagttgctagtaatagagaggagcacagactgttcgatggtgctatctagctagctgcagcagcaggagctcctccctttttgatgcttggacggattagatagagggaactattacaaccaatctcaagcttgtggctctagtaagtgcttgtgtttcatgtctcgctttcagccttttctttctatggccggaccaaaattgcagcgcaacaggatatacagatcaaacaaatttttttttcttttctttacttttgtgcgttgaaaaagaaaaagaagccgatcaaggtcggatacgaaaccaaaagccccaagtatgtgtggaacatatggattgagctatcaagttaagttgtagctggtccaggaggagaagatgaccaaatacaatcgatggagtgacctggatatgctgctgccattcaaaagcagtacctcaatcaataatgcatggacattttcataccagtgcaaaacatagtattcatcatccatatatttttgtc

SEQ ID NO: 35572 - DNA, 1501 bp, Oryza sativa
cgagaagtccgtgggggtcgctggggagtccatgccttgtttataagggggtgactatgatccgggaacggtgcactgttttgagttgtgttgtgcaaagagtattgtcacgatttccccctttgcaatgccgtggtggtatttcggggcatggcaacatgtgtggaatcgtgtcttgtgggtacagtggtacacctctggccagagtaaaactattcgaatagccgtgcccgcggttatgggcgggttgagcaatgtttttcgtgattagtctcacacctctcacaataattatggatgttatacctggtaataatttgcttaattcctggtttggaggtttgatctgtacgaccggggttggttgttcaggtttggttgggcctgagcagcatgggtgtgctgttcagtgttgattaaaattgatgattaattactctactgttttacttatcttaaatctttgctaaatgctgcttttgcaaatgagcctatattatgccatcctttggaatccttgtgcacttgcatatttgctgtgtggcttgttgagtatgtcatatgctcattcttgcaataatcatcacacctcagttgaagataaaggatccagaaggagaagacgtttggcttataccccagttgagctgcctgtgggagtggagctgaagccatcgctagaccgttaattccgctgctgtttttcttttcttttgtaagtatgtaacgttattattatgatggatttgtatattaaattgtcagtttgtgtacctcggctgattcctggacgaggattttatgcacaaataagttcggaaattactagtgaatttccgggcgtgacaactaaggacttgtgtttcctggctctaggctggggattaggaatgtccacccgagaattaacagaagctgaaaaggggagagccctagccactgtctaaccatacctggtgactttctgagcaaaagattatctaacctacactctctgctttctaactgcaatgagatcctgttgctactcgacaaattggtagagcaaagacctcttgccttgtaggaatggaacttcagactgattttaaaggagcacattctaagcctgttcaaatacaaaaatgaattctggaaaaaagtttgtacgattagatgggcaaatttggagatgagaacaccaaattttttcaggcctctactccagacagtcacagaaggaataaaatctcacatttaaaacttgaggataaaagacagaaagaggggtgtcctcccatgaggaaaaggctcatgctttatacacaacttataaaaatagaatggggattgatggtcactcagacatggttctcactctagcaaacctatttcaaccagtagatatcttacattttcaaagttcaatgccatcaaaagaggaaatggacaatatcataaaaaatatgcccacagatagaggccctgggccgcatggttttaatgggatgtttcttactaa

SEQ ID NO: 35573 - DNA, 1501 bp, Oryza sativa
attttaatttacatgatgacggttagttataataaaaaagtagtaatacaatgttgctgactactgaatcacaaacttgttatatatataggttaatttctttgtatcaaactacataactaattattttaaaaaaacattgtaaagtacatccatgacagattataatgacgcctggaggtattcatcataaaaatctttcacggtgaaaaatatgtcaatcacaaacattagggatttttttcattataagatgcagctatcacactatgacaaagtatttcatcatagaacttggtaggcagggtaattatagaaccacagtaaattggtcccgtttgtaagtatcagtttgcattaaaaggttcatcctaaacgaggcataattcatcataaagagtcaggttggcatacagtaatgaagtattttcgtcatggtactaacaatagttgccaggaggtcataatataagtgtgagaaaatgtaaaggagatagtttatcctgtgcaaacatgtattgtgtgcattgttgaacgattgttttccaaatcagtgtgcgtacgtttggtagagctccaactcctaaatttaactccaagatcggagttgggtctggagtgcagttgtggagctgcccaaacccagctccacctctctagtttattttgtgagagagctccacccagctccactcacatttttggtggagctgaaattgtttgacggggctttagctctagaaaagatggagctggagttgaagctgtgtcaaacagacccgtatatcttgattttggacagtccacatgcaatactcggactggtgaccgcatcctatattgtggtgtagccatgttatgtcaacacgtatcaacaaactgtctatctccctatcctggtcaatggtggaagtcgatgagaatgcaggaggctacattgatcacgattggttgtctgaaatcatgttgcaagaaaaggcggcagatcattggaataggccgcatgatgggcctccacattatggatatcccatatctacacggcgatggtatttggactgaatacaggataccaaatatagatagaatatcttatttgtgtctcgggtttgtttctcaacttgtacatcaaggaaataccttgagacttagtcggttacgactgtattttatctgtatctgcatattccgttagggatatagattatcttttgtaacacggactccttcccatatataaggggggtccgggtgcctctaggggcacatgttgattttctccaaatcatacaattaagaagacactcggcggattcatccccggacaggagtagggtattacttcttgaataagaaggcctgaacctgtataaatcttttgtctccaaacccatacacttttccagcttgatagccaccccttttattattgccgaaatctagtttcgacagttggcgcgccaggtaggggttgcgtcaagcttttcgctgatcagtgcaa

SEQ ID NO: 35574 - DNA, 1501 bp, Oryza sativa
ggaagacgaagcgtcgcttggatcttgggatttcttgttaagggtatcggaggtgcaaatgggcttaggcctgaacagtacctcagcccagtacttttgacagcgtggcccattgtgctccttagggacttaggcattttttgctttggcaatttatgcgcacaatagtgttgcccaatgctgataaaatcctttttacgcggtcatataattctttggaattattgcaatgcaaattaaaaggtgcccgacagaaaggtgttatgctgtttttgtaagcttttttaggctacaaaagctgtctgggttaacttagaatgacttgtttttaccatagtcatttccttggtatgttatatgcctgttttcattatggtaaatagtcatagcctaggctattagacttattcattaccataatttttataatatttggtgggtaatctttagagttttctattcggatgcctgtcaagtgtgttcattcgtgaaccttttagggtgctaaccactcggattccttttattatggctaaaaagcagtcggctagaatgcctctttaggcgccgcgtatgcttttgtcatacgatgcacgattgtgctgttattttgttctcaactatatgtttagtttgttaactaatcacatagttgggggctacacctaattaggtgcatctattcgatgcaccatattctttatcttttcgccctttacagtctttgtcttcgctactcggcagatcttggcatgaaaggtttgaagcactcggattattatctttgagaaggctatgatggttgactgcaaaggtctcgggggctactgtggagattatggatatcccatatctacacggcgatggtatttggactgaatacaggataccaaatatagatagaatatcttatttgtgtctcgggtttgtttctcaacttgtacatcaaggaaataccttgagacttagtcggttacgactgtattttatctgtatctgcatattccgttagggatatagattatcttttgtaacacggactccttcccatatataaggggggtccgggtgcctctaggggcacatgttgattttctccaaatcatacaattaagaagacactcggcggattcatccccggacaggagtagggtattacttcttgaataagaaggcctgaacctgtataaatcttttgtctccaaacccatacaattttccagcttgatagccacccccttttattattgccgaaatctagtttcgacatccctatcctggtcaatggtggaagtcgatgagaatgcaggaggctacattgatcacgattggttgtctgaaatcatgttgcaagaaaaggcggcagatcattggaataggccgcatgatgggcctccacattagcacttgccaagtcacaatgtcacgaggcaaatcatcaaaattggccccaagtcgtcaaaatgggctggaaaattggcctccatatcagcacattcct

SEQ ID NO: 35575 - DNA, 1501 bp, Oryza sativa
ctttcccttattctctattgttgttcaatcatccatcgcaaatagaaccacccgactagatctaaacctaggtgatccaatagacaaccctaacaatggtatcagagctgtcctagcgtttagtttggttcggggatagacatccacagagaagaaagaaatccaaagcaaagaaaagcaaacgatccaacggatcgaaaagatcgaaaccctaaccctaatcttacctcgtcgccggccgtcgttgacgccggccacggagagggagaggggcaaagaggcaccgccgaggagccactcgacagccgcgcgcgcacccgcgggtgcacgcgcgcgccggcgagggggcccgcggcggcgccaccatctccgtcgtcgccggtctctcactcttcactcgcgtggaggggtgagacggtgggggggagaagagaaaagaatagagggcgtggcagcgtgagggcgtcggccatggcgccgcggcgcgaaggctgccggtgtcggcgacgccgctcggcacggcgcacgcccgcaagagaaagaaggagggggcgccgcggcacaaccgctcgacggcagcgcactcaccctcgagtgagtgcgcgcaccggcgatggggagtgcgacggcgccgccgtgtcgccgtgccgccgccggcgctgtgctagggtttcggcgacggcgacgccgctccgtgcaaccgcaagagaaagaagagaagaggagctagggtttcggcgccggcggtcgggggcggttttgtttgcccgatccgcccgcgcgaccgtccgatcgaaaccctagcgatcggacggccgacggcggccgggccgaaagcggcccaagtggggagcgcgcggcggcggctttcccggcccaggcccaggttgcggcctgggtgaggggagggggcgctcgcccgcgcgcaaggtggccatgggccaaccggcaaaggccggaaaagttcactttaggtccctccgaaggaagcattttcaatatgtttaatgattgtgtttatttctaagcaatttgaactaacgtgaaaattgtttagagaatagataaatgtgagaaatgcttctgaacatgtattttgtatattttcatgcaaattacaatagagttttgaattgtttttacatgttttacctctgtttaaatttgaaccaacgggagaatttttacagagagtaaacaatagagttttgttattgtttatatgaattgtatatagatcttccgctgcaaatagatgaaattgatgaaaattagtgtttctaaaattaaatttcgaaccaacgggagattttaattttaggagcattaattatgtgctatgatgttgtaatttttctgaccaacgttgataattgcaatgttatagttatggctttatgtgttatgtctattttctgcccaacggtgatgtagacttaatacataataattttaatgttaattttgttctcacaatacatgattatctcaggtggctact

SEQ ID NO: 35576 - DNA, 1501 bp, Oryza sativa
acataaatgcagtggaaatataaaagataactagagctaagtctggacttggatagcagcgggaacaccactccacaggcatcctcgacggcacggacaaagcctactcctcggagaaaccaccattggacgcatactcgaactctgagggttgggagatagagcaagactgaatacttcctactgtactcagcaagtcataccggaacggagggtatgatgcaatatataaccaaaggaaggctaaaaggggatcatttgcacaaagctagcatttataaacagtagttgaaagcagtaaaacagttctaataattaatcaatattaaccatccactgtccaatgctacaccatgttgcaacaggcccaaccatccacctgaactaatcaattccattagactaaactagggtgagactaatcacagtgaatctggttgaccgcccataaccgcgggcacggctattcgaatagttttactctgatcagaggtgtacaactgtacccacaagacatagccccacaacacgtttccgtccgccggcatgccaccacgacataccggaaagagaccgtgacaggaccctttgcataacctcctctaaccaaacacaccacacctcaggtttcacccccactactcgcaaggcagcgggcagtcccctctcgtgcctaggtgaatccggaagcgacaaaggccgtcgcagggcccatcccgctccatcacgcccacccttgcctggatgcgtcagctagaggaaagctacactacaagcccaaccgttgcccaagctggcttgtggtaagtacgataagttcttctagggcatcccgcgaaccggtacttaactgccatgggcgcgaccatcaaaaccatacacccacagccaatcatttagcatattttagttaaccaacaccggagcggtggcactaaaccaacatcaatactagaataggaagtctaagtgttaatgtaaatcccccattgtgtgctagttgagctaagcatggctaagcaatccctagtccaacagctactcatgttataaccccaagctaacaaaggaacaaggtaacaaatagtatggctgagacaataggtaatcatcccatggtatcattataaaacaatgcaatatttaaaggagaacaataaagcatttgcaatgtgggatcaccatgttcaagtgacaagcatgacttgccttgctctgcggctggaggaatctcggcgactatctctaagtacatcggagcgtcgggagagccgaaatctatgcgacatacaaggcaaacaatacaaacaggctataagactactgaaacagagaacaaatatttttaatggattctttgcatttttcttgatttactgagacttgaatgggcttaaacgaagcacggatgaattttctatgaattttagaagattcactgtgtttttactataaaagaaaaaaccttaattggattattgcgcattaaataaccccgaca

SEQ ID NO: 35577 - DNA, 1501 bp, Oryza sativa
acaactaattaatctgctgtgctttgtctcgtactctcgttcggttcaacgtcgtccgtgacccgcattggcacgccatttttgcaagtcagtcttttcatatgtttatggtcgttatccaataatatgttgaacctgtagtgtcaaacatgcaaataataccgtttggtatatcactcctgcatatattatttattgacctcttgtccagcttcttctagctagtctgcttgcgaagaagacaaactacaatattgtggcagactgttaatgaaatcatcatttcctaattgtaattatggtggaggattgaccaagaggagtcgaagaggctggctagtcagcattgacgaagtcagcgtgccaatttttgaggtcctcgtcctacaggcggaacagtagcacggacccagcggcagtcttagaggccacggccatagggttgagcggaagatggcgacggcctagaggagatggacgttagcgccgtggaggtgggggtagacgattgggacgacatggaggcagcaataatggctgctgcaatttctgcaagggaaggaggggatcgcccgtgccgatgacccctcggcatggacactgcttcgacggagaagatgaataggagcaaccaaggaccacgctggcaaagagtggcagtggcggaggtggccatagcagtggcaatttctgcgacgggaggaggggatcgacacgaaagaggtaggctctcataacggatggctagatcgctccttcgctctttgtgcggtggatcagacggacgatagtgatgtgctttagctaggaataggggtgaaaacggtacggaaatttccgagatttcggctatggtttccagtttacaccgatcgtttcagtcagtattgataactatcggtgttggaaatagaaacttaatattattcgaaaatggtagcggaaatggatggaggtttttctcactgttttgtcagtaaccatatttgtctggtaattttcatcaaaatgccgaaagttcccgaatggctcagccatcccaacctattggaaacctatgaatgatgaaaacctggcaagcttttagcccattagaaagcagaagtgaccacgggaaaatgctgttaaacctaggacgtggtacgtggattttgctgaactttggtctcctcaacttatcaatgttgatgtatcgttgaattttgtttatattattcatcgaacttatcatcaatatcattaatcatcatataacggtgtcacgtgtagtgtgatgatgcaagaatgaaattataaagtcatatgcatgcatagttaaatgtgtgctatgccatactccgcttattttgacatgaattttcgacttccgaagattctgttccgacagtcccgtttctgatataccgatataactatcattagtatttatatgactattattagtatttttgtgtctaccattctgataccgttttcgagaaaacagtatgaaaataaaaat

SEQ ID NO: 35578 - DNA, 220 bp, Oryza sativa
ttgccaatactagtacagtgagtgagtcatttgcatctgcataccctaccttacctgctcctactactgctcgcctcgcttacttactaccctcctgctcctaacaacaacaacaacaacaacaacaacaacaaggaagctctatcgggaaagaaataggaggaagaaggattaaggaaggaaagcaaagcaagcattaattaaaggaaattaggaagga

SEQ ID NO: 35579 - DNA, 736 bp, Oryza sativa
attttatttgcaaaaatatatttttcttggaccgatccattattattgcctaaaaaaccaaatgtattgcaattttttagttaaaaaatgggagtgttctagatgcttctctcctggttctggggcggatacacgtcataattatctatctttagaggcttccagaacgacatgggatggccaatactcctcctatactctctctctccaataacggcacgaatcctcaattaacaaatccttctgcctctgcttactggagtactacactacactaggtagcaattctgtttctactactactttttactagtaattatccctccctttgcagcggtaagtggtactagtaactacggagttgttgttgtaaactgtctgcggcaattgcaaattatacgagtacttgtgtatgcttttgctaaagcactgaactttgtgttcctctcctggccatctaggaaaaggattcatccgatttggcaatcaacaaaggcccgtcgctggatcttgtcaaatctcccttgatgatgaatgatgcatctgcaactgtaactgcaatgcagcccaacgaggggatggaggagttccctgtcaaggtacttttgacatctatgcaagccgatccttcttcactagcatgtcttactggcagagaggaacagaaaaaattgtacttctagcttacagcgttgtcactgtacctaacaatctccaacccaatgtttgaagcagg

SEQ ID NO: 35580 - DNA, 1501 bp, Oryza sativa
tcattcataggtttccaataggttgggatggctgagccattcgggaactttcggcattttgatgaaaattaccagacaaatatggttactgacaaaacagtgagaaaaacctccatccatttccgctaccattttcgaataatattaagtttctatttccaacaccgatagttatcaatactgactgaaacgatcggtgtaaactggaaaccatagccgaaatctcggaaatttccgtaccgttttcacccctattcctagctaaagcacatcactatcgtccgtctgatccaccgcacaaagagcgaaggagcgatctagccatccgttatgagagcctacctctttcgtgtcgatcccctcctcccgtcgcagaaattgccactgctatggccacctccgccactgccactctttgccagcgtggtccttggttgctcctattcatcttctccgtcgaagcagtgtccatgccgaggggtcatcggcacgggcgatcccctccttcccttgcagaaattgcagcagccattattgctgcctccatgtcgtcccaatcgtctacccccacctccacggcgctaacgtccatctcctctaggccgtcgccatcttccgctcaaccctatggccgtggcctctaagactgccgctgggtccgtgctactgttccgcctgtaggacgaggacctcaaaaattggcacgctgacttcgtcaatgctgactagccagcctcttcgactcctcttggtcaatcctccaccataattacaattaggaaatgatgatttcattaacagtctgccacaatattgtagtttgtcttcttcgcaagcagactagctagaagaagctggacaagaggtcaataaataatatatgcaggagtgatataccaaacggtattatttgcatgtttgacactacaggttcaacatattattggataacgaccataaacatatgaaaagactgacttgcaaaaatggcgtgccaatgcgggtcacggacgacgttgaaccgaacgagagtacgagacaaagcacagcagattaattagttgtcatccactgctctggtggaatatccgagctagtacagctaatatgacaggaccaagtgaataaccggtcctagtattttttttcttaataatagaatgatttacaaacctactaccttcatctaaaaataaatcaacttttatagttcgtatacaatagttgaaaaggagtacaatgaattctgaaactgaaatgaaatatgtgaggttatctggcaaacctgctgtttgatgaaaacaaaacaatgaacacatagaaaatagggaaaccctgtattttattaatcatgattcattaacatgaatgtttacaaatacatgagggctcccgcaggagttcgccttttgccttcgcgaggaatgcttaatggaaatgtatgctgactggagattgcgtgtagtccgctgattcccggcgcctagcaatgagactaccg

SEQ ID NO: 35581 - DNA, 442 bp, Oryza sativa
caattgcgctgttgctggatttgcgtccgatccagaattcgcacactttcgagggtacggatgaagtggttttctctttggcctaggtggagggatctcaatcgcattattggaaccgggctcacgcaccacctgctaaataaagcccccgcattagaaacgtttgagcatgccatttcaagtttactgttaccaattctgctttacaagcacatgtaatatatatatagagaaaaatatagcatcggcagtgtagtaataaatcaatcagattgatcaattggtacatgaaggattattatatcacctttgagaaaaacttctgggcatggctccgaatttggacagcagtctttgtgccaatgtgctctagagaacagcttggacaaatcagacatactactcactgaacttgtttaaagcctaatgtaaggcaaaaata

SEQ ID NO: 35582 - DNA, 210 bp, Oryza sativa
caattgatagcctgatagtcatgttcatgtaccttaacaaatacttccccaacaacaacaaattttgataacattgaactgaactgtatatgcttaactactttccttgtaataaaaaacaccttgttcttctagctgtatgcatacttcttatgccctgtatatataatacttatagtgatgcttactgacaagtataaccaatacagc

SEQ ID NO: 35583 - DNA, 975 bp, Oryza sativa
agtggattatttttttcctatgtttttccttcaaaaatggaggaatggaaaactttcctatagttttcctatggtgcattcctatgaaacgaatggtagtttaaaacccattcctattcctatgcttttcttttgcaattcctttgaaatgaataagcccttaggcttattcgtttcaaaggatttgtaaaggagaagtacaggaatatccaatcctttggaatgagcattatactatcattcatttcaaaggaatgcatgaaaagaaaaattcatatcccttcacttttagggggaaaacaatggaaaaaaataatccactccaacccaatgttttcaatcatttggattgtttgcaacccaaccataggaaaatttctatgttttccaagcacatgcattcctatattgttcctatgttttccctgttcctacggtttgaaaattctacaaaccgaataagcccttagggggaaatcaaaggaaaaaaaacaatccactccaacccaatgttttcaatcctttggattgtttgcaacctaaccataggaaaatttccaatgtttttcaatccataggtttacacatgtattcccatattatttctatattttttctattcctacggtttgaaaatcctacaaaccgaataagcccttatactttaggatgaagggtttaacgtcggtttctgttatcacatttttcatactaataaatagtgcattttgtacgaaatctctctatataaaagttgtttcaaaatattagataaatttattgttaggtttaaaataattaaaacttaattaattatacatggatggttttatcattttaggtactcgtacctaatcatctccccctaaagaaacttgaatcttcattccagcaagttatacgatgcaatatgagtatacgagtatcttgtactactaggagtatccctacagtacacatgttcgttcttgtaga

SEQ ID NO: 35584 - DNA, 391 bp, Oryza sativa
tgtcccttctcctcctcctcttgccctcttggctccagagggttccagacaataaaaataagagaaagatctgctgcatgctatcacgggcccaccctcaccttaccttggccttttctcatcttccttacaaaaaaaaaattgggttttgctgcccaaaaatccctggccacatgtttttaggaggctggcttggatcctactgtgcttcaattagtataatcccgagcgattaacaaatgattgcttctagttctgtgctcatctaatctgcctgtaatttttaaagatctataagctgcgtatcactatagcttttaccgcccaaaacttgcttatgccctagttcaccaattactagctccaagcaactccaaaattgctctaaaca

SEQ ID NO: 35585 - DNA, 180 bp, Oryza sativa
taatgatgataaagaccatgttaacctaaccagtgaaataaaaaattctgtgttccaaagtacccaaaataaaaactgggagctagtactagctggcttgaatggcgaatggcatggacagcaacatgtgaccgaacagcacagcgagacatgctaatctgatcctgcttcaccaacagc

SEQ ID NO: 35586 - DNA, 205 bp, Oryza sativa
gagtgagctagatgatgagatgtgttatatagagagaaagggggagagggagattaatttgatggttggtattaatcaactgttgttgttgacttgttgtatgaaattatttggaaaattaatcgcaaggaagaagaatcaagttgaaaaaaaaatccaacgcatgcaatagcgagtcaacaaaaaacattgaccaccgtaccca

SEQ ID NO: 35587 - DNA, 1501 bp, Oryza sativa
gggactaaagaggggggttacgaactgggactaaaaacactttcccaccggtgttagctggtactgaaagaaattaatctctttgggggaggccaggcctcccttcacccctccgtggatccgccactgcttcaaatgatagtttcttatgccatctttactaacattaccttttcacatatcgacgtttaggattaataagacagattgacgttcatggtttaccaaatcattttaggtgaggttatcatcgccccacggtttgacgattatcgtggtaaccgcgtggttaccgtgaaaaccgcgcggttatcgcatatactgtgaaaacaaggtaatttgggctaagctaatatcttatttaccatgagttgacatgcttctcaaactgctaaacaaggtttgattggtgttaataatttacatggagaagtttctcttaaaaaaatcagatataatagttaattaataataagctaatgacttacgttgttttatgtgcagctaactagctaaccctaacagccatatattacaaaacgcaccgtagacggtagacacgattacggggacaccagacgaactgcatgccacagtacgtgcccctgcaatttcatcggttcatccgctccttgcacgcatatgcgcgatactgatacacacgctgcgctagagcccggttggtcttacgtgcccgcgcgcgcctgcgcagtgccctgtcgtaccgcgcgcccatgccgttttatctcgccggccgcctgcgttctgccatgccgtgccgtgccacccggcccctgctcgtctcaggtgcctctagaatctctagatctacctggcccgttcgtcaggccatgcatgcatgcacggagggacggcgacggcgctgcagtgcgtgtgtgcctggctgcgcgccggccggtgcgtccaacgtaagcgcgcgcgattattgcttgcacgcttggtgtttcgttgccgtgcgcgcggcgtgcaaggtcgcggcccgggcccctgcgtcgtcgcgccgtccaagcgctgcatgccgcgtctcaactttgatggtaaatccacggaagcaaggagagattcatatatatgcactgcacgcgcgcgagtgtatatatacactggctagtatatgtatgaggccggcggcatcaacttccatctttttcgtggatgtgcacgatggacgtcttttcccacgtatcatttaaatcgtgcatacctgaaatcgaaaccgggttgtattgtaaggccattccaatgcacacatgtggcatttagtcaacccatgatagctaggagatttcccgccaactcagcttgcagcgtgaccaaaccaagttcgtgtagcccagattgggcatgcgttcttcgtgagaaaagaagccgtgcggagcagggagaatggcgcagccgcactgtgaggttgtggcctcgcgcacgtggcttgcgacgcctccacccacaccctggcattggaaatgggttggctgcgagc

SEQ ID NO: 35588 - DNA, 272 bp, Oryza sativa
caaagttgtgtatggattgaagccaaaatagcctaagttcaatattgaaatgacctattttcttaggtatgctaaaatttggcttcaaaccaaatagacataaaattaccaaatattagtaagcctaatttatgcctcataccaaaccagcccataaaatactcctctcaattcaaaacttgcactaaacggccaaaatcttccatcgtatagttacgtcacaccaaacacaaccgtgcaaaaatcacccaaaaaaaaaagagaggaaaacc

SEQ ID NO: 35589 - DNA, 870 bp, Oryza sativa
atattttctttcaaacatatcagtgagtaaattatgagttttgaattatttagattcccctcccaagtatcttatggttgggctgaaaatgtatgaatttctgtgcatatgaagtgactaagaaatgcttatattgtggcataaattttgaatgcgagtaatctttatatttttgaatagagagagtatttggtatgtatgaggcgaagataatattcatttcaattttttcactagtgactaatatctcaactctgcttatatgtatagtgaaatgaggtatcgcagatctatagaatcgtgtattggttcttatgtaaaacatgcttcaaataagatgataaatacgaaaaatactctttttagataataaatacaaagcctgaaaacactctttgttgactattggcatcttattttgaacaaaaattagttttaaatgattcgaatatgatatcatgatgaacgaaaagttgtttggttatatttgtgagcactacacactttggtaatatagacatttgaagtatttatgatttttttttaaaaagaagtggttaaagtttcaaaataaataatactacagtcagttattaagaatggatgcagtaatttaccaacccagaacgactgtcactcgaggagtaatattgtgcattttccctctggatggtcatgctcaactggtagactggtgcaagcaatatgtagtgtgtcgttggaaatttaaacggttgtatttaaatactataaaagattttgagaatgtatatgtattggtaaagtcctttatttttgggacatagtatgtagttgacgttagctgtcccgtccgtagcgcttcggaagtcactctggcgtagtgctgcc

SEQ ID NO: 35590 - DNA, 659 bp, Oryza sativa
agtgttctgctgaatttggcacagatgtgaaagccacttgatataagcaactaatagtggtacatttcataattctggagctggaaaatgcatggaatttaatccacttagcatgcaactgtttagatagaaggtcatatttcattctttagttgtcacgcgtgtaaattttgctgactaattgacatccaactaatgaggaccagggatgtgtattcctctttttgtttcccctgtacattccaaagaaacttcaataatactcgcaaaatgtaaattatgaacagtattgggataaggcaagtattaattagatagccttttcaaatgataacgtgaaaggacatagtagtatgaaattagatgttgaccagtctggacagtggtaataacaagttttcattttaaataagaataagagggctagaacaagaacactgtgtaagatgatcagaaaaagaaaaggaacttaaaatgtgcaacaccctgagtacagatcccgtaaacatagcaaaatgctatttcttataatataactaaaaaaatgagatagcttttccaaaatgcagatgtatgaatcacactcaaagaatattatcaaaagaccatcattacctcctagcaatagcctacagatggactaaaattacgtttatttc

SEQ ID NO: 35591 - DNA, 459 bp, Oryza sativa
taaaactatatgtttacataaaagtatatttaacaatgaatcaaatgataagaaaataattaataattacttaaattatttgaataagatgaacggtcaaacatgtttaaaaaagtcaacggcgttatttagggacggagggagtaacaattaagcgtgtcatcaagcgacgccggccataagctggctgctatatatactctacaaacacatgtatggtcagtatggatagccaattaagcaaggaataaatcgaacgaatgaataccatgggctggactggctaaaggttaggcgatgatctgttagctcgatccttcggtgatctcctttatttttgctaaagctggtacgtgcgtgtggtgcgtactactgaccggtacacctgaccaactcaattgcctttgttcccttggctgagttgcagtgcctgtagctacagagtacagactgggacaa

SEQ ID NO: 35592 - DNA, 1501 bp, Oryza sativa
ctcaaaatacatcacaaactcttaaaaaatagatcatctccaaatacatcacaaatgtcacgaccggaaataacccaacagacgttccttacgtgcgtgtattattccttgtcccaggaggcaaggtacacccaaaagttgatacatttcagagtttatcaagcggaagcgtaattaattaatctattacatgggcggcgaagacccagcacacaagaagacaaacgaaaaacagcggaagactagggcgacgaccacaggcgcttgacggcaggcacgagctagacaccaaagccttcatcttccaggaactcctcttctgagtttgggaaaaattgagcaagactgagtacaaccaccatactcaacaagacacacccacaagtgcagaataaatgcaagggagtacaaggggggttatagtataaagggttagggtttgcagtaaacagcattaaaagacacttagttgctcaaagctattttgtaaatacgatcctagagctatacaaggttattaatcaaggccgtgaatccacacgaacctgccttaacccaaggcctacgatgattcagaccgaactggcaatccgaccctgggtcccagctcatcccaagccaacccaggccaaccattccacattttagttgttaagcaggttttaagaattaaaacactaacttgggtacattgctcggcttgcccataaccgagggcgcgactattcgaatagattatactctgatcagaggtgtacatctttacccacaagacacatcttcctcacgtgtaaccacgtgccacataccatcacggtatacggacggaagacgtgacatagtttccaacccatcctagccatagacaagagtaccgacccaaccccacctacggccggaacccccgggacaggtaggcaggactgagcccctagcagcaggacaccggccctgtgccatgacatctcgactaccgggccgcagctcgtgtagcctttatttgccctagagatgtccatcgacccctgactttgtccatctccatccgtgtacttttgtttataagcagactgagccacaaactaagccttacccactagacatgtggaagtacggtagtgctttgcaacagaggcccgaagaccggtccttatatggccgaggtgctactatcaaaaccatgcaccccgagcccagcctaaaaccattttgaggattttgaatggagggggaggtgtgaatccaattccacaataatccaaccattccgtagtgtccaggtgatatgaatattcccaaagtctagagttgtaaaaccacctaatgttgcctaattaaccagcgaagcatctacctaaaatcatactagtggtaccatgagtagagtgtccactagttggggttttgtttattctagggtaaacaaggaaataataacaataacaataataaggtcataacaaaggtacataggcatggctagataaaacagtgataacgc

SEQ ID NO: 35593 - DNA, 440 bp, Oryza sativa
ccattcctagtgttaccaatttttttgggcaatgacaagatttgtctattgccaaaaattttggcaagaatgagtgggttctaatttgtatgggcataagagtgatgccaaataatttggcaatggcagttctttaggttgcaaaccaaatgggtgacaaatttcttggtgttgccaattatttggcatggttgaattggggtataaatcaaacaggacctaagcgtattctaaatatatacgaaggaaacataatgaggctcaatgaaataacatattatgacttgaagctactgtatcatatgcgtattatattaggtagttcttaatcaaatatagttaccatttgcatgtttctttgaaagctctatgtgttctatgccttttgtactcttgctgaataaattcctcagcttttatgaaatctgaatatgctaagt

SEQ ID NO: 35594 - DNA, 218 bp, Oryza sativa
aataagggaagcaatcacttatagcttcgacgttgatgctgtagacgagcaggcggttttgttcacggcagctggcgcggtaggccatggcgtcgtgtcggcgagcgcgagcgacatgaggaacatggcctgcagccccagcccggctcgtcaggcgccgcgccgaacaccacggccgccttggtgacgacgtagcacaccggacggagcggtggtca

SEQ ID NO: 35595 - DNA, 162 bp, Oryza sativa
ctaatatgcatcatatctaactaaaatttttttatattttaaaatgaatgaataggtaagtgattttgatatttccaatactcataccctactatgagagtatacattaatatggtttttcttagacaaaacgatattgtgtttgatttgtgttataatagg

SEQ ID NO: 35596 - DNA, 766 bp, Oryza sativa
agtgtctctttctataatatatcggtaagttatcaattattatacaatataccatcggactatactattttcaaaaatacctaaaatacaccatatacggttaatatttgatttatcctaccataagtttcaaaagaaaaaaaatgctagtttatgcactagttttaagattttacatttttatatttttttaaaaaaaattatttatccattatatactgcaagaattttttttttgctgtttttaatgtaacttttttcgagaacatacctcatttctaatgtcaattatcttttgcgtaagtaatttctctctcataaaaaactcaaaaatattttttttaaaaaagtgaaaacttgaaatttatatataaactttcatgttgggtaagtaagctacataaacaattcatatttttaaaccgttagatgaatacatcaattgttaaccttatatgtattttgagtattttttaaaactaggacctgagtaaatattttttcttgagttttaggttataagacttcacattcatatatgtctagatctattaacacatatataaatatggacaatgctaaaaaataagaataggaggtggtattattttttttttggtagagaggggagggggccgcataggaggcaggaggtagtaaaatgggctgatgggcatagtattcacgggggcccatgtaatagatgggatgggcttgaacacacatgtaatgtaacaatagcctcggtcgaggtgaggtggaagaa

SEQ ID NO: 35597 - DNA, 375 bp, Oryza sativa
tggttgtatatcaaatgtaattctactttcaaagatctattgtatacaaaatacaaatatctatggaaacaaaatatatgtgtatgccaaatccagctcttactaaaaagaaaaagaaaaaaattggcttcgcctaattttgcgtgggaaatttgctagttgtaatttacttgaaatgctatgaatggtgcacttttgattttgctacatatatatgtggaggaagaaactaagtaatgagtaactctgaaatcaattcctttgagtcacaatattatgccaagaattggaaggaacacacaaatagtagtacaaattaacgagctaaggtgagtagagatgatggatggaggtgcatatatactgctatacata

SEQ ID NO: 35598 - DNA, 1324 bp, Oryza sativa
gaaaaaaattaaaaagacaagtcacgcataaaatattaatcatgttttatcatctaacaacaatgaaaatacaaattataaaaaaaaatcatataagacggacagtcaaagttggacacggaaactcagggtttgccttttttttttttgggacggagggagtatttactaaggccctgtttacatctcaccctaaaattcatcctatcacatcaaacgtttgaacacaaacatgaagtattaaatatatgttaaaaaatagctaattgcacagattgcgactaattgctctatgatttgacaatgtggtgctatagtaaacatttgctaatgatggattaaataagcttaataattcgtctcgtggtttattgatggattctgtaattagtttttttattagtgtccaaacaccccatgcgacatcctatataattcctgatgtgacacgtaaaactttacccctcagttgctctttgtacatcctctggttttggccttatactgggcactgcactaggtagaaagaactagctgatgctacctaagtactacattgcaggcttgcagctgatgaggaaataaccgatgaatttggtggtgtttgaatctcctaaagattaaagattaagtgtttcacgtaaaatgagaggataataacgtgtgattaattaagttttaattattataaacttaaaaatggattaatctgatattttagaacaattttcatataaaaagttttcgcacgaatcacaccgtttagcagtttgaaaagcatgccactttaatccaaaatttaatccaccgttttcaggacattcgaacggggctgttgctagtgttgctgtgacttgacttgcaacaacacagcttaatctgggttaataatactacaatttttaatcaggaaactgggctataataattactagtaaaaaaaataggggagtttatatccaatctttttcttatatgcaattcaagtgatgggactataggcagcaagtactagtgtagtatagtaaacattatggtgggtagatatatatatctccaccgcacattcctcatcgagtggaccttgtggtcagctgcatatccatacttgtatgtagagaagaatgtaatactgctccagtaggcagcatcctctcctctcctatatcatcatcatatccaatccttggttggttggttcgttcacaaggaggaaagcctcgagcatcatcatcagtaggaagaagaagaagaagaagaagaagaagagcaacaggaagaagcaagcaagaagaggaagaagaagaaagcaaggagaagaaga

SEQ ID NO: 35599 - DNA, 659 bp, Oryza sativa
caattgggacacaaataatgtgcctatcatacttggtcaattgcctacgccacgcatatgcttttattagtatttccaaccgaatcctattcaattcaatttttgcaaaccgcgtgttatgaccggatcggactgacagctaactctggttgttcctttcctctcctctatgaaacagggtagggcaacacgaggccggagactaaacaacaatctgattattcacaacaacttctctcctctccatgatggcttcgctccaccgccccctctctgccatggcagttccgcctttgccgccgtctcctcccttgagctgcctgacaggctgtctcaccacaagttgcctgacacaaccgtggatgccgaagctgtcgtctcgattccagccagcaggcccgatgtatcagcagcaccttctgcttctgccatgtctcgcctgcacttcctgccacgcaatctgcagacttcgcacccggctaaggcgcctcctgcatctttgcctgtcatccacacggtttaccactatgcaaagtttgccaaatactactcggaagaggaggcagtgacgactgcgatgccatcctcgtcatcgccggatgttctgtacctctggcatctgccggaccctaaggtctgcggtgactcacatggcaagt

SEQ ID NO: 35600 - DNA, 1501 bp, Oryza sativa
tataactagtaaaaaaaatcacaaactatacaagtacccagacttgcatagaacaccactttgaaaccatataaaataaactaaaaatgcacattatataggggtataattgctacgtgcaattttaggtgactagaaaattgtatgaatttccacatgactaaagtccagcaaatccttatcaaaattgatgttgtgataagaattttcccaaaaaattgtgacctatcgagttgctgtaatatttatggcctatttcaatttgctataaaaacagcaaagaagattatcccaaaattataactttatggacaccttaacattactaacccctggagccaacatgacatagaggtgatatccggcatgacgagacgactacgggatatgttagcatgacatatcaacatgtgcattggagcactatatcaccttagcagacaactaagccacctactttaatccggctgtaacttcacttgtacagtcggtgcagctggatcaaaatgcatcaagcttaaaaagggcaaaaagacaagatgagagggccatttatcctatccggggatgggtttttgacctaggtgcaccaatcaagtgacgtttcaagtagacttgattgcaatagtgtaaccggatcggagtgacgggccgagtagttttctaatgtggcatgccactacaatttatacattactaatgtatcaggctaacatgttccgctgtctcgcccatgctaggtatcatctctataacattccttaatatattatgttagggtattcatagagttgtttttttttttgataattttatttgctacccttgtaacaaactgaaatgtgtctctaaccttgcagcaagcacttttcttgtagctccaaaaaaaaaactccagttttcttgtgcctctagcattttgcagcttctacacgccgcccgccagctcagttcaccggatccccgggaattaaaatcacacgagatcgatcagatcgcacgctgagacgtatagacgacgtgggtcccgccaaagtactgggcccaccagtcattggaccaccgtacgacgacatgtgtgcacctaccgtggacttcgctggaaaaaccaccgaagccgccgccacgtcatgccccggctgcggttttctttaataaagcccagaacacaactgccacacccaccccacttctacccaccctcaatgacgagtgggccccacgccaaaaccgtccccaggacgttagtgtccgtagccgacgcgcgccgcgtcggctgacatgcgggccccacctcctcgcggtcggatcagcatttcgcctttcgtcgtcgtcgtcatcatccacttccacttccaccctcctctgcatttgcaaccacgcgcagacaagaacaagacgcgcagcaaagcgcagcagcagcagcagtattaatcgaggccaaggacaaggagcagtggcaattgttgttgggagaagagcgagttgttgggagggagaa

SEQ ID NO: 35601 - DNA, 1501 bp, Oryza sativa
gcggcgacagcgtggatgtgatgggcggcgaaggcggtggatcggacggcgaaaaatcgggtcacgagagcgggaggagcaatttggcgcggtcaaggtgggagcggcgtgctggcacggttgtggtggaggcatgggcgcggcagagcgacgtcggcgactctgcctcctagcacagggggacaaggggaagagagagggaaagggtggaggagggcggtggaaaggggagcttgcctttgccaatttgggaggaagagggaaggaaagggggggtctctgcctccgagatttggaagcacgcgcgcaggatggcgggaccgggtggcagcgcgggcacaggcggtgctagggcttgacgcatcggcgaccaggcggtcggccacgcgcgagcgcgcgcgggaacgagcgaaggcggtggaggtttggatggtggcggcgggatttcaaaggcggtggcggaaatcaaatcacggtgacggcgcatagcgcggcgagaggagagagagaaaggaaacagagagagagcgaggaaggagagagaaagaagagaggcgctgcctctctctcccgacgcgtgcagcgcgcgggcggggaggaggaggagcggccgagaggagagaaccgggttgagaggagatgggccgaaggagggaatcggcccacaaaaatccgagggacacaaaatagacttttgacagagagattgaatttggagagaattggggcttggaaatggaatttggatatctttggagtcgggcgaatatttggcaaggttttgagatttggaatttgaatttcgaatttgattacttggactcagggaaacagggaggagtcaacaacgggattcaaaaagggaatttgatatttttaggatggggacaattatttggcggggattcaaaggatgcgattcacctttgggatagttgaatcggaattgggatcttgaggtggaggattttgttggcgatgagagagaacaacgatggagatttgaattgagatccacggcacgacttagactctcacacaaagaacgaaattttcacatataggattttgccgaactagtttttaacgcctcacgaaaagcggagcgttacatctcccttcctctcccacttctcccctcctcacattctgaaggtgggcttgggttggcgatggcaggagtgcggtggcgagcacaggagctaagcaggatgctggagtgctggagcggcgcgacacgatgggctcgagtagatgcggcggatcctgcgggagtgcggcaacggcaaaggggagggttggcgacggtgtaggatcaaggaggccgactagaggggggtgaataggcggttttaaaacttaatggcacttaaacaaaactaacctaagttgctaggcaaggtaaggtgcaaggttaactaagcaactaagttaagttttgcaaacctaggtgacatgggctcaaatatgtctctatgaatgtaaatagcacaaatgtaaa

SEQ ID NO: 35602 - DNA, 526 bp, Oryza sativa
  unsure (1)..(526): unsure at all n locations
catggccccatggacatgcaccttctcgatggnacagnagttcatcatttttatataaaatatttgaatccgaatttgaatttgaattgggtatataaacttttgacttataaacattcgctctacaaactttaggtggataaactttagatgtgtaaactttaggtgtataaacttactaaaagaggaaaatataaaatatttgaattcaaatttgaatttgaatcgggtatataaacttttgacttataaacattcgctttacaaactttaggtggataaattttagatgtgtaaactttaggcgtataaacttactttgagagaaaaagaaaaaaaaaccaatcgcctagaacgatcgttcacccattagaaatctcgattaagagccgttgttatgtataacaacgatgtttggctcttcctctttctctttcttccatgtcaacagacaacaggtattcctaattagcaatgcaaagaattaaaccactgttgataaccatcgtacataccctaataaagg

SEQ ID NO: 35603 - DNA, 1057 bp, Oryza sativa
atacatatatacatatatacatatacatatatatgtatatatatatatactatatgtatatgtatgtatgtatgtatatgtatgtgtatatatatatatatatatgtatatatatatatatatatatatatatatatatatatatatatatatatatatatatatatatatatatcacacgagcaatttcgtatctcaataacttaccacaaaatattcgtcttgattaattacttgctgccgatcgagaaacacaagattcctttgactctatgtcacgaagctcacccaacatcgttgatcgagtttgaaacttgatttttagggggtgttttagttacgtgggtgaaaagtttgggcgtgtcatatcggatatacgaacacatatttaaaatattaaacatagactaataacaaaacaaattacagatttcccatgtaaactgcaagacgaatttattaagcctaattaatctgttattagcaaatatttactgtagcaccacattgtcaaatcatggagcaattagattaaaagattcgtctcgcaatttacacacaatctgtgtaattagttattttttcgtttatatttaatactctatgcatgtgtccaaatattctatgcatgccgggagatctaaacaggcccttagtgagggatagaagttactataccctatatttatattatagtgttttaaaaatatttataagcatttaatttgaatttaagaaaaatatatacgagtgaacattcctgtgaggattagaatcaattcaaaaacaaaataacattgtttcgctcctataatttgcaggaatcgctctacgtggagtcgaagcagaagcgtgctctcctcccaaacgccgaggcccgaccacttctcagcacgcccaataattgagcagcggcaacctcacctcctccaacgccaccatggccaacgctatattgaaccgctagggaaagatggcggtggcagccaccacaacatgtagcatgagaggcttaatggagcaaggccccaccgccttgccgtgctaccggatagca

SEQ ID NO: 35604 - DNA, 1501 bp, Oryza sativa
gtttccttaagtcgttctttcaaagtttccagcaaaacaatccctggaaattaaataaaacaatcgacccaacatggatcagcaagcaatgcgagatagataaagaggataaacaagaataagaaataccaagagcacgcagcgtgggaagatcatagtcgtgaccaagcacagcgaggctggcattttccgtgcataccatggccaaatccttcaaggtgatgagcaaatcctgcgattgagcagcccctcaatcggagatgagaaaccggaaaaagaatgaaaggcagtggcaaaagagaggaacatacaagctcggggtcggagagggtccggagccgtcgtgagtcttgttgctgcccgccacgagtaggagatgatggctcttcagcgttggtagacgcaggttttttagcctgagtattcaaagttaattaaattcatatataaagaggttcacagaaacacagatcaaaagcagtggagtaccgataaataaatagttcaatcgtagagataatataaagtaaattgaaaacagaatagaaagaaaataaatccctgcagacatgcaatattgatatctgaattatgcaggttaggttagggagaagaggaagcagcatcggcaatctcatcttgtttctttttggagagaaaatggatgagatagcctgacagacataatatgtttgctgtatttggttggtatgatgtgctagtatttgatttggtgtgagagaatcattcatgtagagtatagaattgagaccctacattcccaatcaataatgagaaacagtactagtatatgggaggggttggagtggagaaatggaggatggggaaacttttcacctgagctgaggttgaggctgagcctgagctgctgtggtcacggtctgctggtgtgccgacgtccctcatgccggttgcccctcgtcgtccttcagtggcggagccaggatctcttcatgcctagggctcaaattgaaggctaaaactatccatgacaattcatacactgaagtacagtgcgagtgctgaaaaaaaaaatgcaagactgaaatacgatttctaatcatacaacgaagtacagtaaaagtacaatacctaacgcaacatatcctcgtaattttcactattcattaacagtactacgtagagaacctgaagttgaatccagaaaataatattacatatgtaagtgattcatccattaatcattcatcttgttctgcagctcagttttaataatgttcatagctgagaaggctctttctaccattgccgtagcaacgggcaaaattaaggctaattcaattaagcgatataacaatggaaaaaccgtgtgtctattacttttaaccatcttcacaggctcacagaaaggttgatcttggtcagagcagcttgagaaatccaaatcagattacttacatcacagataaatgtgtcaagttgatctctgaagactatacaatcatattcaaaatagtct

SEQ ID NO: 35605 - DNA, 296 bp, Oryza sativa
tttaagcaatacttagatactacaactatcctataatataagttattttcaactatttaggagtacaagactaaacagttcttgcattgttttttcaattcccgtctaaactgatcatcaaccgagtaccgacatgttgtaatgcagccgtatgaacaaatcgcttcgactgatcagtcgtgcgtacggcctccgatagttatatatattgtgtactgaatggatatacctcgtctgcagcagcaggactacttgaattacctcattgcctgtactctcctgctgtaccccttagg

SEQ ID NO: 35606 - DNA, 1501 bp, Oryza sativa
aacaccacctaagactattgttgatgtgaaaaacatacactggcctgggagatctgcttagctctagtgcaggtccaaaggttgatgagatgcgggcgtgccagtcagtttgatcctgctactgacaagatatataaacagtagatcaaatagccgatcggctgacaagccaatgtagtagttccagccgatagctgatgccagccgatagcgatagggttttgagttatcggctatatgtccaatgtagagtctgacactcgatgtaaataatgatataaaggcaatcggctgatgatgatgtgataaaatatataacaatataatccagtagaaaccaatcggctaataataatatgacaggataaatactgatccgacggttaaagcattcatcggcaggaggtcccatgtcataaaatccacaagattagataaatcagtgaaaccttttgttgtcatcggctaaatccaacttatagatatatgcaattcttataagccgatgcaacgtccagataacttatcggctagcaccccgataagacactagcatgaacctatcggcttaacaagacttatattatcaacaataatctagtaggtcgaacctaaccgatgcaacacgagattgtatatgataatctaatactcgatgagccgatagatctgtctaatgtgatggatataacaaatctatttataacaacattgtgattgtagagatatttcggctaagacagaagatcagacctaatcgagacagtcccaattaaaccgatacgtctgtaaacacaatgcaattagagatagaattgagatatcaggtaggtaaatatatcaaccaaaccagagcgatccaagagatcaaagcgatgcagccttgaacaacaccaatgtagacaacagattcactagggtcggcgaaacgtaggacttaccccttcaccagagatcgaaagccgatgcagccccacatcaggtgccaagttccgccggatgacaagtaaaaacctcggtaaagagggtggcaatgcgccgagaatagttgtattgatcgagagattgatagattataataaccccgggtgtacatatttatacccatgggtaaatactagtccttgtaggacaagaaagaaactttcctaaagataaaaaaggaaactaacaaactattcataattaataaataacttgccataccgcatcctccttgaactcggactcttctggataaattttctttaattgatccgactccaccaagaacacaactgctgacgatttgacgactcccatcggccgattccaagattctgaagccgatattgactctaaaccgatgatgacttcgggtgtaccaaattttggcattaacaactattctacgaagaagtaaataattcatttaatgtagaataaaaccaatgaacattttaaatggagaagagtgacagaggtggataaacccgctttaccagaagggaggcgtaaagta

SEQ ID NO: 35607 - DNA, 286 bp, Oryza sativa
catcaccatgcctttgcaaaccctttatttcgagctttcactacatgtcaggtcacacattgtggagtaaaacacaaaagttagtgggatggcattgagttagcagtatccctacttgtggtcttcgttgatgaatagacagtgctggatatgcataagctcatcaattagagatgaaaagaatggatcgcatcaaatgcagtatcggagacttagaatgttgcagcagaatacctgtttaaaaaatccatggattaaggcaacagtccacgttgtattcttgaga

SEQ ID NO: 35608 - DNA, 1501 bp, Oryza sativa
cttaactgctggactcttcatctgcttcaaacgaagaaagcaaataaacacaataaaattatttacaaaagataaaagcttgattgacattgattcatatatctgaatcttataaaattaaattcggtatcactaccttctcatccatgtcctcagggacatcaatctcatcgtcattatcagatgaatcgtctccagatgatatctcagtatacctgcataaagagcgagggatctatcaagtatacctttttattctttgccttttttcgggtgggtgggagatgaacatatttgtttttagaaacattagccgttaagccaaataaatgcaggaagtaggcaatctttcagctgctaagcaacaactagagcccgtgtgcttttctgtttatccgagagagcaacagaaaagggtgaaactgacttacttcaaggctttcccagcagttctagcagactgcctaactgaaggtgcttgactagtgctttgtgtgttatcctcgtccttaaggtctgaatcctcggaagaatcaatgtcagattcaatcttaggggaaagggatcctgtggtggtttcctttggcggtttattgatggaaacagcttcatcacaggaagcacctgctccacctttaaaatcagaatctgcaaccgcctcatcctaccagtctgaaatgaagaagcacatgagatgagaggcacagtagcgtcgtagaagaagcgaaaattaagaaaaaggaagtaacatatatggatggaaagcacacgcacattctggaactcttttggaaaatccagtttcagttcttgtgggttttcttcttcttttgttccaatccaccaggcttcagaaaaaacaatctgccaaataaaacagcagcataagtaagtagttagcaataacagcccagagaaaagggacgagcatagcagcaattgtgcggatgcaagttccagttccaagatagatagagggcagggcaggcagagtaaagatgtgaagtttgaagtaaccaggctctcgaagacgtcatctgcagtgtcagatacttgttcttggggtacacatgcgtccccaacagcttcatcctcccctgaaacattcattacccacaataaaacatgcatatcatatcatctcacctacctgacctgacggaatagatagatagatataggatacctgtgggaagtcgaggtagagcagaggatttttggtgccaagatcagcgagctcgccgacgcggccgcccgaggcagcagccgcgggcgcgaggaggccggggaaggagaagaggaagcggctcttgcgctgcccgccgcggcgcacgatgtcgcggccctgcagccgcgacacggcagtggagggcgcgagagccgagcgcggcgccgccggctccccgcgctggagtaagccattagagaaggcgagggagcggaggcggcgccgctcgtcggcctccgcatcgccggccggcttcttcttcaccatccctcc

SEQ ID NO: 35609 - DNA, 323 bp, Oryza sativa
ccggtatctgcttgtggcctgcgtagtgctagaaatatagtaatccctccatttcaaaatgtttgacactgttaactttttagtacgtgtttgactattcgttttattcaaaaaatttaagtaattatttattcttttcatatcatttgcttcattgttaagtatactttcatgtacacatatagttttaaatattttactttttcttttgaataagacgaacggttaaacatatgctaaaaagtcaacggtgtcaaacattttgaaacggagggagtagaataatgattgatttaagttaatactagctatatgtacgtagc

SEQ ID NO: 35610 - DNA, 378 bp, Oryza sativa
ccagtaggactacattcatcttccactttaattccactcactatatcacaaattattttcaaatcatactatgtatgtccatttttatttaccactttttaacactttatatatactattaagaatatctccaacgacttcttcatccaacttgaaagggtctattcttaaaagtaaaaaaaattcaaaaaaattaaaaaaatatatcctccttaataggccaaatttggccaccccattttggttagccaaggatggaccgagcctcacagccaatacactcccccccatctaatacactccccccatctcccccatcggtctctctcccaaccccatctcagcaccggtgcactgctactggagggcgacgagaca

SEQ ID NO: 35611 - DNA, 815 bp, Oryza sativa
attgcattgccgcgaagtaaacgtagctcaactagttaacttccttgtggtggaaccaacccacccaaatccttgacacgggtattcatatttacggttaattattcttagtccttaacacgggtactcatatttatggctaattattctttcaggtgagtgtgcatgtagcctagtggttacagtgacctgagtagtaccccaaggtcctgagttcaaatctcctatggagcgaattttagattgggttatttgtggggctaattccctatttcaattgccgtatatattcggttggatgtagaggccgggtaaaaaatacccttctctaaaaaaaatgtgtgtttaaaaaaaaaggcatggccaacacaggtaaccagggactaattttgggcgtgtttgacggcagttgagcgtactgttagctggagggagacagtcagttcttctcttttttgtttaggttttaaagtgtgcatctgtatctgtatgtttaaatgcattggagcaacaaactactcctaaaaaaatgaaacgatggaatccatatccaatcgagtaaataacaaatcgtccgtcgatttcgcttgtatagagacaggaacagctaggttaatcgattgatcgggcaacaaattacgagaggagtaaatgaaatgatagtctatatccctatccaatgaatgagaagtaaattaaataatcgtggatctcgaccgcttgtaggcagctaggtaaatggattgatgaggcagcaaattaggagagacaattaatcacgtgagctgatgttaattgcattctcctcataaata

SEQ ID NO: 35612 - DNA, 437 bp, Oryza sativa
catcatcataacaaaggtaaataggcatggctagataaaacagtgataacgcgggaatttaaataaagcgataatgcaataatttaaatcaaaataattttataaactgggattcaatatgttataggatgatgtgacttgccttgctcgctttcccaaacgtcggcttcaacttccacgaagagcggatcttccgaagctgcagcgtctacacgaccaacggaaaagaaaaggcttttactctaataaactccatataatcagcagaaacaaagcacaaaaatgggttcttgacttcttaaggaaaaattagagacttgaacggtccaattccgagttcaaatggccaagttatggccatttgaagtttatatgctctttaaatgaatatttgcgaatttcttcatttaaattttaattcaaaaatggatttattg

SEQ ID NO: 35613 - DNA, 411 bp, Oryza sativa
agaatatatacaaggttgaatgattgcacgtgctctggactagctttctggtcagctctttggacggtcacaagctctgaatataacaactggtgcactgcgttttattttcttgctgatcgatcattagtcagggatccaacgttgccaatgatctgtagcacaactaaggagatcatcatcatatatatgatggtgcggtagtaaccgcgtctgcacctaactaaggaaaaagaaacatgtcgttttcggctgtagcagagaaagttgcagggcaacccaaaatatgtatagccaacagaaatactgttccaaatcttatggttatatgcaatgatacccaccaaacattttggagggatgcactcgacataatttgctctccatgaaaaaggaaggagagaaggaaaa

SEQ ID NO: 35614 - DNA, 1501 bp, Oryza sativa
aatcaagctcttgactgacttttagggtggtagatgccttagctaatctaatctagtaaaataatttacccgataccggcaaaaaccataaagcgagaaacaaccgatagagctaaattgagatactaagactagattaattaagacatatgataaataaataggcaaatatatcatccatactagagcaattcaagaggtcgaatgtactgatgcagccttggacgacgccgacgtaaatgagacaattgcctgggccggcagaacgtaggacttaccccttcgccggagatcgaactaaaccgatgcagccccgcgtcaggttccaaattccgccgattgataagtaaaaacctcataaaagagggtgacgatgcgccgagaatagttgtattgatcgagagatattacaatgaccctgggtgtatatatttttactaatggggagatactagtccttgtacgacaagaaagaaatttttctaaagataaaaggaaaacataaagtccttataggacactaaacacactttactaaagataaaaggaaactaacaaactatttctaattaataaataacttgccatgccgcattctcctttaacttggtcacttctggatcagcttcctttaatagattaatttccttaaccgaatatagcaagaattatcacatcggttattggcggtgtgataattctctcaggggcttaccaaatttcactgttaacaagaaaccatctttagcaagaccccttccttccccctctttagcgatgagctcctcggagacatagtaaggcagtgcggtctttcctcccggcgacatgctatccggtagcacggcaaggcggtggggccttgctccattaagcctctcatgctacatgttgtggtggctgccaccgccatctttccctagcggttcaatatagcgttggccatggtggcgttggaggaggtgaggttgccgctgctcaattattgggcgtgctgagaagtggtcgggcctcggcgtttgggaggagagcacgcttctgcttcgactccacgtagagcgattcctgcaaattataggagcgaaacaatgttattttgtttttgaattgattctaatcctcacaggaatgttcactcgtatatatttttcttaaattcaaattaaatgcttataaatatttttaaaacactataatataaatatagggtatagtaacttctatccctcactaagggcctgtttagatctcccggcatgcatagaatatttggacacatgcatagagtattaaatataaacgaaaaaataactaattacacagattgtgtgtaaattgcgagacgaatcttttaatctaattgctccatgatttgacaatgtggtgctacagtaaatatttgctaataacagattaattaggcttaataaattcgtcttgcagtttacatgggaaatctgtaatttgttttgttattagtctatgtttaatattttaaata

SEQ ID NO: 35615 - DNA, 1501 bp, Oryza sativa
acatcaatagagagaaaggagaaattagcaagtaaggactgagctgaccgtaggcgtccgacgtttttcatctgatcggacgttcgaagagaagcatttttgacattagtgtttactaatttaacacctataaaccggaggcaactccggcttggacgtccgatgtttgggggaaatcgggcgctgacgttagcgcccgatttacgtgcaaaaactactttaaactgattttaatcttaaattacttatccaaatcatgattctattgcaccattaaattcgttgcaattaaatcttcaaaacaagaccacacatggatatatttcgatgaaaaatttttttagcttattattgaattatttttaaatgttgcatgatgttccaccaagtatatcggaattgtttcactacatagatcgaaaatttttcactcgtttaaatcgggtgttgtttcaccttatataaaaataatgtttgagcaaatagcgaaagaatgtttcagttcactacaacatttgatccatacatagtgaaatattataagtatactaggtgataaatattttggtggaacaataatagggggtttccaaaatatgtgggttttttgttgcaatggactatttcagttcactgcaacattagatctatacatagtgaaacattgtgagtacactaggtgaaacatttttgatggaacaaaaaataaaccaaattcccttaataggggtttgcaacggcgcgttccataatatcaaaatccactgcaacatttgatccgtacatagtgaaacatcgcaggtacactagctgaaacatcgtaaaactactggttgaaatatcaaaagagatcatatgcaatattaaaaaaaatatcaatagaaaagctaaaatattttttatcaaaatataatcatgtgtggtcttgttgtaaagatttaattgcaacgaatacaacggtgtgatcggatcgtagattggataattagtttaagagaaaaattgttttaaaactagttaaaataggagcggcagaggcgcgggggcccgaggcgtccgatttttccaactgccgtcgggcgcccgcgcggagcattctccctgtaaacctacaaatgttatacacatatggtaagttattaaacaccacatctaaaatgatatatagttaatgccataaaaataaactagtactactagtagcaccctaaacccaaattgatatacgtctcttttcgaaacaatgagcttcacttctttaagagtctccggctatcaaaaactcctcaaacaatttagaattttcacctaaaatctaactaaaagccagaaccagctgttttttagaattttaagtttcacaaacaaacattttaaagccatcagtcgattacaattcagctagccaccatcactccacctgctgaaagcactgcccgagtagcagagcagtaacaactggagtagtaaacaagtaggaatacaaagcaagaagaattaa

SEQ ID NO: 35616 - DNA, 675 bp, Oryza sativa
ccccccccccccccccgagggggtcaggcctcgtgggcgattgctcctgcccaagcctctagtcatgatactcccggtcctatgtcaccgacagtagcccccggcgttatgccagggcgatcgccctcctcgagggaagcggtcgggcgtgacgtcacttcctaaggcctggtgacaggtgggaccggtctcaacagttgggcagaaacccaacggtcgcaaatcacgcacatcggcaatggttactcggctgtcaataatgagcagtctcttcaagactgccacattactcgagtaacacgcgaatcgggacgagccggttcgtttttcctggagatatggtgatggcgcttcggtcggcgagcgtaattaacgcgcgcacgagatgttccatctcgactgccacagccgcatatccacctcatgcaccgcaaacgggcgaatgggattagtggaagcgtgggcgcgagaaacgagggggcaagatagtgggcgcgagaaacgaggagccgggcacagcgttggcaagggtataaagtcgccgaggaagagatttgcttccttcctctcgccattattccccttgtcttcgcctcttgcaccctaactccttgtttcctgtgccctaccttcgccacacgcgctcgctctcaaacatctcttcttccggcgtca

SEQ ID NO: 35617 - DNA, 1501 bp, Oryza sativa
ctggatggactgcgggaggaggtcgaggttggagacggcgaggacgtgcggccggagggactcgtcggaggcctgcacgagtcgccggctcacgacccgaacttgcagctcgccgccattgatgcaggtggccattgttgctttgcataagcttgcagccactatgagtctatgagactatgaccaactctgcagttgcaccgtcttcatatataggcagtgtggggagccaggatctgaggacgaaatggggccttctatataatcgaagcgcactttaattttactaggtattttccctacataattttgtgtaattttatgtaggatagctgatagaaacgtctaggggttttccagctaacttcacaatgtggtggactagccggcctgagttcaaagccataccttttctattaatttaatattaggtcattccctaacatccgtgttttggtatatggagtacctcttagatcctactaatagaaagactcgaatgctccgaatctgccgcaccctcccctgcataatgcctccctgtcctgccgatgtttcctcctaagagcaacgataatagtatagctcacctcctactattagctcatcttaaagccaacatatataatgagattagctataaggttggctacaattttcttcttctctctctatctctcacttatacatttaatgtatttgtcttggagattgtgttaagctagctcttgcatgagagccaaccctcttaattttttgttagagcaggtacaataagctgactaggcaggctccaaaaatatgccatatcatcatattcctatgtggaggggagagaaatgatgagagagaagcgagcgagcgacaaatctatcgcccggcgatagctctctttcccacgcgttatcgcttgcttgcagcctacctgggcgataaaaaacgcgatttgtggacccactcaccgcagccgatcccttccccaccgtagctgatcgagatcccctttcccctccacccagcgcccgcccgatctccgcccttcccacacgatcccgggcgattgcgctcgatctcccgcgcgatcccgggtgatggcgctcgatctcccgtgccgcacgccatctctttccctcccacgcgcgccatctcttcccctctcgcgcgtgaagagctcttcccctcccgacacaaatccactgaaaaaaaaaaatccccatctactattttgccggcctcaaaaatccggtaagatttactgtctccgcctcccactatccgccttccctcttccccctcgctaatctctcccgcccgcacgcaacatatttttaccgaaaaccctagttcctctccaccaatagccatgtctcgccggaggaagagggaggttgcgccaatcctcccggtgttcctaccccgtcggcagtgccatatccttatggaggtccttggttcgccaccccaccgccagcttggtttgcttctccaccatcgcaagcca

SEQ ID NO: 35618 - DNA, 400 bp, Oryza sativa
  unsure (1)..(400): unsure at all n locations
tatttgaccttgtttttacaattttntaattagtgaatgctgtntctnaacactttttattttttgggatcannnanatcttntgtgttgtntntgtgttntnatannnnnnnnnnnnnnnaatggtttgatgacnttttgataacnnctgccngnagccnngcagncnactctagaggatcccctcgagagattgctggctggttgatacccgtgcgtaaccaaaaagtctcttattaaatgtatcctaaatcaaatatcggacgagcagggtctgttataacaaaaaatcgatttaatagacacattaacagcactgtttttatgtgtgcgataatttataatatttcggacggttgcaaaattgttaatgaataactgtcaggtagggagcctgata

SEQ ID NO: 35619 - DNA, 257 bp, Oryza sativa
tgaagtcggcctcgaatctatccaacaggatagctagagaagccaaattctccatagattttgatataaatattcgcgaacctaaagctgctactatcgttgtcttatatagtacttcctccgttttatattataaaactttctagcatttatatatgtcaatgaatccagatatttattaacatttatatgaatgtgagcaatgttaaaaagtcttataatttaaaacggaggtagtaacttttaatctcctttta

SEQ ID NO: 35620 - DNA, 1501 bp, Oryza sativa
attagttttgtaagtagtctatgtttaatacttcaaattagtgtcaaacatccgatgtgatagggactaaagtttagtccctggatccaaacaccccctaataacaaaataaattatagattccgcctgtaaactgcaatgcagcgcaacattgtcaaatcatgtagcaattaggtttaaaagattcgtcccacaaatcaattacaattagttattttttatcctatatttaatactttatgtaggtgtttaaatttccgatgtgatagggtgaaaaaaattacagatcttaaacatgcccttaaaaaattactactactacgagtatacttctacttgtgttgaagtattgaagaagagagatcttgtgtgggtcctactcgaaagggcccactgctcactatatagagcgtagtactccactgtggaccactcgtactgttgtaaactgcactgttgtgttgttgttggctttaataattcctcactcggccttcggggttaagcaaacctatcctcttttctcttgtactagaagtattaccgtacagaccactaaaatcaaaagctttgcctgaaatgaaatggctgggagtagttatagttgtatcccaggcagcatggccatggacacacaaccaaggtccagtttagttaccatcctatgtttgatacatgtataaaatattaaatatagataaaaagctaattacatagattgagtataaattaggaaacgaatcttttaagcctaattacttaatgatttgataatgtggtgctacagtaaacatttactaatgacgaattaattagacttaataaatttgattcgcagtatacatgcggaatttgtaatttatttttttattagtgcctaagcatgctgactctgattgggttacaaagcataatattgtcagtctaaacatctatgtgtgtttatatcccaccataaaattttacaccctgtcacattgaacgtttaaacacctcgatgaagtattaaatacatattaaaaaataactatctgtacagtttgtgactaatttgcaagacgaatcttttaagtctaattgctccatgatttgataatgtgttgctatagtaaacatgttgtaataacggattaattaggtttaataaattcgtctcgcggtttactaatggattctgtaattagtttttatattagtgtctgaacacctcatacgacaccctatataatacccgacgtgacacgataaaactttacaccccaatctaaactcgccctatgcagatattttatgtcaatactgtatgcatatattaacataaaatatctcagcaagcaggcaaccaaccagaaatgaaattactactgtaaataatcttgttaagtaggagtggtagtatattagatagtggtagaagcagaggtaagcagggcagagagtagaaacaggagcactgcattactggtagtgggagcgtaaagctctctcctctcttcttctt

SEQ ID NO: 35621 - DNA, 247 bp, Oryza sativa
  unsure (1)..(247): unsure at all n locations
cgtgtcncatganatgcaacncagcttcgnacccataattaagnttgaaaatttaaaatttagcttttttttctgcttaatgggcaatccgatgggagccttaattaccccgactagacccctattaaggatccaaagaacttttaccaataaaggagctcgagcaccagccgctggtgtcaccattctcctcttgcaatttcaccaccaccgccacggcctctgcctctcgctctctctctctagg

SEQ ID NO: 35622 - DNA, 1501 bp, Oryza sativa
gggactttttttttcacggttttatattgtttaggggtgaagatttctgattttatggataagggactttaaaaaatatcgctattaagttgagggacctccgatgaacttattccttctattttgcttcttttccacctgcaatttcttcccttattttctcaacgcttttatttatgttgaattccataattttcaatattaataagagcaagacaaaaacatgtgtaacgctccgcttttcgtgagtcgttaaaaactaactcggtaaaatcctaattgcgaaaattttcgttctttgtgtgagagtctaagttgtgccaaggatctcaatttaatcccgttgttccctctcatcgaaatcaaaatcctccccctcatccaaattcctcttccgattcgagtctctgaaatcaaaattctgaaattcaaatccttcctttgaatcctcgccaaatacttctacgaatccagaattattcaaatcccgcctcgaatcctttccttgactccaccctatgttcccgagaacaaatacccaagtattccttttgaatcttttccatgactcctccttgagttttccttgatacatccctaaaccctcgagttcgaatatcaaattgaattcgaatccaaaccctaaatctctccaattctatccaaatcagttttctctgtaaaagtctactttacctccctgtatttttggatggaccgattttcctcccccggcccatctcccctccccagcccatctctctcctttgccatctccctcacgtgcgctgcacgagccgtcgccgagagaaggatctctctctctctcgttttctcgctccctctctgtttctctctcgcgccgacaccgcttcccgccgtcgccgcccaaaacctccaccgccttcgcccattcccgcgtgcgcctcgcgaggtggccgaccggccggtcgccgccgacgccatgcgctgccgccttgcccccgctccatgccaaaccgaccgccgccgtcatcgtcgacgtcatccatggccccccgccactccacgccgcacccgtccaagagtgggagaagcagctgccctccctctcctcctcctcctcactctccctctcctcattatggcaagggaccaagcccctttttccccttctttttccctttcccgaccactgccggtgtcactgcctctgcgccgcttgaccgaccacgccaactcgctctccttgaccgcgccagcccgcactcccgcggttcgatttccgccgctcgatccaccgccttcgctgcccaacgcatccacgccgtcgccgctttcgcactgcccacgaaaccgccgctgccgcccgtgaacaccagccgagctcccttgaccgccaatgtcggtttccctcctccaaaccgacctctcctcctcgcctataaagcccgcgccctcccctctcgtttcgtctccgcctcgctcgaaacacccacgcctttgttgccggccgccagct

SEQ ID NO: 35623 - DNA, 1006 bp, Oryza sativa
gtaatagtatttcggtcgaaatcccgagttaattataaaaatatgtttcttgatcagattagattaaaattggtagtaatttagatataattaataactaaacaattagatgaattcttatagattattatagattatttttggtaatcttcataagtcatcggttcacggtagaaattcggatttaattactaggaatcttagccgtgtattatatttaatcgtttagtcatagactaaattaaactgtataatatttctaggatttcgtccgatatttagctcgtaatagaaatttctaacctattatatggatataatgctcgggaagagtaaattaaaaacttatgacaacaaaatatttatacctgcaaaatagtttaagccgaaattgggtttgccgtagttcgcagatagtaaagttaataaaaaggaatcgactttcacattcgactttcatttggatttttatttgaattctaaccgaattcaaatcaatttttgcacgtaactatagagcccgagggagttgcggatccaagcgaaggccaagacccgcaagactctgagcaaggcaagtcatcactattccttgaacatgttgatcccaattgcgaaattgttttgtttacaaataaaattgcatgcaatgatgaacatcctacttgtgattatgccatgccttgattattgtttacccttaaatctttgtaaccatgtttacgtatgagtccctagtcaattatgacaattgcttagaaatgctattctagaatcatgcatactcatatttatcaaatgctatatgcttgggcaattaccttcgggaaggtaattgagatgcggcatgtggagacatgagcgccacattgccatgatgttgatgacatgatttgtgaaaggagaaataaaattaaaacaactgttttcgactggggcagacggaggatttgggtggtatctggaacaggctagtaccgtccccagtcaattaaggaccgagcca

SEQ ID NO: 35624 - DNA, 1501 bp, Oryza sativa
atgcagtggcagaggatgaggagtttggcaggcaaaaggcaaggttggaatgagttggaggaaacaattacctcttatcactctagctagcttgttcttcttctaccagcaccaggaaggaatgaaggaaaggatatgctggtgcttggttgcagctcagcatcgatcatcaagcaatgatgctagtgacaaagtcgagagtctgcgtgtagtgtcgggatgcctggtctggtctgtgtggaaggaaggaaggaaggaaggaagagagggtggatgatgagctatggctataggctctagagagggagggagggagagacgtgaagaagacaagggccaggacaggaggaggatagggttatcgccaactcacatgccctcctgccctctcactggtgacacttggaaatgactcctgctgggtttctcctacgtggcacccaccaaagaaagagcaccgctacagtaccacacacacagaggcaagattgcaactttggaggagaagaatacacaccatacacccgtttggtgacgctgggcccgctcttcatcgattctcgacatagttggaccaaggaggacaggtgatagaaaaccttctatagtggcctaaggaaaagtcttcttttagttgtagcatttttcactagttttctttttttgttttgggtatctctctctctctcttttttttcaaattgcaggttttataataatacatacatcacatttttatttatactaaaatattaatgttagatgcatacaatacatatgcatagatttaccttgaaaagtattatatgttcgttatgtttttacaaacacattttttttggaccaagttctttacaaacatattagtacaatataaattaattattgaagctgtattctatctgaataccataccaatgtcaaaaacgaaaatctgtttataccagtggaatcgaagtagaagtaataaagatcacaagggacatgatacgagaaaaatgattcaggtgttttgttattacttttgttcatacacattaatttgctgtgtttttcaatacaaacaaattcctaagttttgtttcctgtgttattcacatgttttatactctgctccaaacatgccctaaatggatggtagcctgattttactactctgtccttgtttctttttcatctcaagtactgatcccttcagttacatactgttgagtttatcgttgagagagtcagtgctgcttactggtcataactcatactccttccgttccaaaaaaaaaacgaatctattactagatgtgatatattctagtgcaatgaatctggatagaggtatgtctaaatttataatattaggatgtgtcatatttagtattaggttggttttttataggacggagggagtacgtagtttgttttttagggtattttctgaaatactccagagaattatgtataaaattgaagttattttgtgacataagtagtatatatactacct

SEQ ID NO: 35625 - DNA, 1501 bp, Oryza sativa
tttcaaactgctaaacgatgcgtttcgtgtgaaaatttttatatgaaagttgttctaaaatatcagattaatccatttttcaagtttgtaataattactccctccatccaaaaaaagacaacccagtattggaggtggcatttcctttccagattcgttgtactagaaaatgtcacatcaaatacgaggttgccttttttggggacggagggagtaaaactcaattaatcacatgttattaccacattgttttatgtgaaacacttaatttttatcttcagaagattcaagtggtgtttggatccagggactaaactttaagtccctgtcacatcagatatttggacgctaatccaaagtattaaacatagactaaatacaaaactaattgcataaatgagagctaatttgcgagacaaattttttaagcctaattaatctataattagactacgtttactgtagcaatacatgggctaatcatgaattaattaggcttaatacattcgtctcgcgaattagtccagggttatggaatgagttttgtcaataatctacgtttgatagttataattaatatccaaacatccgatatgacatgatatgacatgtactaaaacttcaatccctgatccaaataggaactcaaacaccaccaaaagaacaccaccttagctatagtactagtgctagctttttggcaaatgaagacacggagaagggaatcccgcccaaacccataaagcgcgggaattcatgctacagcttatattgggcccaaactaaaaaaagcccaacttcaacagccatgaactctccgcaccctccagactccactcctgccaccgccgccggcggcggcggcggctggccctcctcttccggtcgtgtgaaggaatggccccaaccccaataatcccctgccggccagtgatgtccaggccacagcgtgcgccgccccacggactccacatggtgaggtgaggtcctcctgcaatctccttcgtcaaccgaccaactgacttgttcgctcatggagtacttgctttgctctctctctctctctctctctctctcaagtttgttactcattctgcattttccctggataatgtatgtatgcttgctttagtagtactgtatcaatcaatcaatcaatcaatccatggatgatgatttttgtttgctcacctctgcggcccatacataggccatagccggttagctactatacaggttgctctttcttcagagtcatacatacatatgtgctgtagcatcaaggaaggatatacatacatgatgtgaaggaaatattcaaccatcacctagcctgcctgcctgcctgcagcattttccctatacatgctatgtatgatacacacaataatataatttcctcaacattaatcggaaggcagatgctgtctgatttttcctatctaagcctaacctgctcatcatcttccctttatctcctcttcccgcctcctacttctgg

SEQ ID NO: 35626 - DNA, 1501 bp, Oryza sativa
ctctccccctcatccgccatgcccatagcctgctcctcccttggttgattttcctcattttgcatcgatggtccaacaacatcccctgcattgataggaccctctacatcttcggtttgcattgaaacatttatatctttctcttgtaccgacacaaatataacgaggggccatgaccattcaaaagccatttcgacataccgtctccaagcatcagtgctgtccatcggcattagttcccaaaaataaccttctgttgcacgactcactacaactgacactgacattgtgtagacttcttggtctattctaaatcctctcaacaaccaactataaattgactgaaatgttctctccgcaggcctatcgatgcccttagatgtcattacaaaatctgacagatcaacaccatctggaccaaatctaatatttccttcaccgtgaactatctgaaatgtgaccttacttgacattgtgcctgatgaaaacaataactgcgttaacctcgcatttctgtactacgccctaagttacattctctacaatattgttctctaaatttctaaaattacgttacattctccagatcaaactaaactacatcttacaattaacactactgtctatgtctcaattcatactattatattctatgctctggatctacacatatgtgctgtgtgctacagatgtgctaaaatatatggaactaaaactaaaacgcaacatatatactcaaacataacatattagtacaaatgcaaaagatgtatgggagcatacctgtgatgaattgagcgaaccagcagggcttcgccgctccccttgctgctgccctcccctctctctcttttgttttttttggatttttagtgaatataatgaaatttcacataggagggactgggctttatagggggagaggcaaaaatcgccctcccccaggacagcaagggggtcacctgcaaaattccatgccccctcgccgcccatttgcaggcggcccccccccacagtacaaaatcgccctagcggaggccggcaagggggccgcctgcaaaattccatgccccccctcgccgcccatttgcaggcggccccccgcacagtataaaatcgccctagcggagggcggcaagggggccgcctgcaaatttcgttgacggccgtcgcccgagagcgaacggccgtctgccacgtcattttcgccgccctctcccagagggcggtaggcgactccttccgttaattttcaaaatggaaaattatttttgtaaaacttttaataaaaaaaattataaataaaaaaaattcgccatctataccctcagcctgaagtggcagggaggcgccgccgcaaaaaaccccacaggatccgccgcttcctccgccgcggtggcgctcgccgctcgccgatagctctcgggtcgccaccgtttaatcctcgcttccccccacccaccacggcggccgccgctttgctgcagaatctcaatcccca

SEQ ID NO: 35627 - DNA, 1501 bp, Oryza sativa
aatctgaaatattagacagaactatgacaaattcgcaactaacttaccattcttcaaaatcgtgttgcaactcgatgttggtcttggcagccatagggagaggacatacagatgaactcggcatggcttgcgatggtggagaagcaaaccaagctggcggtggggtggcgaaccaaggacctccataaggatatggcactgccgacggggtaggaacaccgggaggattggcgcaacctccctcttcctccggcgagacatggctattggtggagaggaactagggttttcggtaaaaatatgttgcgtgcgggcgggagagattagcgagggggaagagggaaggcggatagtgggaggcggagacagtaaatcttaccggatttttgaggccggcaaaatagtagatggggatttttttttttcagtggatttgtgtcgggaggggaagagctcttcacgcgcgagaggggaagagatggcgcgcgtgggagggaaagagatggcgtgcggcacgggagatcgagcgccatcacccgggatcgcgcgggagatcgagcgcaatcgcccgggatcgtgtgggaagggcggagatcgggcgggcgctgggtggaggggaaaggggatctcgatcagctacggtggggaagggatcggctgcggtgagtgggtccacaaatcgcgttttttatcgcccaggtaggctgcaagcaagcgataacgcgtgggaaagagagctatcgccgggcgatagatttgtcgctcgctcgcttctctctcatcatttctctcccctccacataggaatatgatgatatggcatatttttggagcctgcctagtcagcttattgtacctgctctaacaaaaaattaagagggttggctctcatgcaagagctagcttaacacaatctccaagacaaatacattaaatgtataagtgagagatagagagagaagaagaaaattgtagccaaccttatagctaatctcattatatatgttggctttaagatgagctaatagtaggaggtgagctatactattatcgttgctcttaggaggaaacatcggcaggacagggaggcattatgcaggggagggtgcggcagattcggagcattcgagtctttctattagtaggatctaagaggtactccatataccaaaacacggatgttagggaatgacctaatattaaattaatagaaaaggtatggctttgaactcaggccggctagtccaccacattgtgaagttagctggaaaacccctagacgtttctatcagctatcctacataaaattacacaaaattatgtagggaaaatacctagtaaaattaaagtgcgcttcgattatatagaaggccccatttcgtcctcagatcctggctccccacactgcctatatatgaagacggtgcaactgcagagttggtcatagtctcatagactcatagtggctgcaagcttatgcaaagcaacaatggccacctgc

SEQ ID NO: 35628 - DNA, 1501 bp, Oryza sativa
tattaatatggatgttaatgaatctagatatatatgtgtatagatttattcacatctatatgaatatgggtaatgctagaaaatcttataatataaaatagggggagtatcagaaatggtcctttggttttcccaacacaacaaatagctgaaattccatatggagatgaaaaattctgcaaagatgacagatcaacgtgaacacgtgcacacacaagacagcagggcgtcagagcgaatgcatttgttgattcagcaaatccggacggaatttaaaggcaaacggcccaagctttcagcacttcacgtcgacggactagattctagtaatgggctaggccgagcacggtaccagccaagctgatcatatggtgaaaaccacggtagggcagtttcatatgtgtattatatgttttaaatagaaaggattagttattttcattttcttgttaggtgtcttatctattgtccgatcaagacttgtatcaacccaagcgtataaatacgtacacttgtggtctttgtaaatcatctattcatctccacttgtaataccaccactttttattccgacgagttcttagtatcaagtgaggctacatcgtttcgatctccaacaaggaagtagtttcgtcaacttcgcttatatcggtatggctagaactttttcgagttgggctacattatttcgatctccaacaaggaagtagttcctcaacttcgcttgtatcggtatggctagaactttctcagttaggtatgacattctattcaagttgttgcaatcgttgtctatctgatacattggttctattttttaactacatcgttatttagagtcgtatcggtttagttaggactccctcgcagttaggtccgatattctgagtaagttattgtttttccaatcacattgttgttttagattggttcgatatatccatcatggttttgtagatctatcggctaactagatctttttcttattattttcaatattatactgtctcagttaggtccgatctattatattgctactaataagtttgattctactaagagcatctccaatagatgactaaaattaaactcccaaaaatcctgtattggagacagccaagaacatatttagcctaaaatacacccccttctccaagagatgactaaaatttggttcccaaaattttaaaatttttccacatcatcattagtgggcccttcccaactaattttctacctgctcgttaaaatcacaggcgagagcggagggggagatcgcgtcgcgcgtgagaggcgaggaggagatcgcggcgtgcggatgcggaggggaatgggcatggtcgacgcgacgcacgcggacggaaggagatggctgctcatcctagtcgcgcgcgagatcgcaactgataccgttggcgaggctatatatcagacgcagcgatatacgaaattgatcgaaggacacagtgctatagacgcacacagagctcttcctctgtca

SEQ ID NO: 35629 - DNA, 1501 bp, Oryza sativa
tctgattaaccaatgcttgaccagcaattccgccaacgtttcagcacttaatagaaaactgactcaaacatgcagaattgcagattaaccagagtatgtactgacaacaactccaacagacataataagacaactaggcactaggcactagaaataattgacataatagacataattgacttaatagagtaggcactaggcagcgacaactgacatagtaagactgtaatctgcacatggagactgtaaatcatgcaagcaatattccattcacaacagcaaaacataattcaggagttcacagaatgcgtcctgttagaagaagagccactcaactcaagacgtcaagaaactcagattctttctggtatttcagaaaagtgagagcttgagaatacagtttcgacttctgtgattgtaccctcaggcccgttctttctccaacaaaagttagatgaaaatttggatatttatgtcacatttttcaaactgctaaacaatatgcttcatgcaaaaaatttctttataaaagcagttgaatatcataaatatatttttcaagtttataataattacaacttaattaatcatacgttaatatcatctcgttttgcgtaaaacacttaacttaatcttcatcttcatctacggcataaaagaaagcctctccaatctcggcatcatgttcatttgactcgtccaattcaacctgcaaacggagaagaaaatggttgcaaatttcgaatttcactagtagcagcttgtatttcacattcactagtaccagagttgctttcagatctgaaagtggagttccaagtcgattatatggcagtccgggatcatcatccttgactctgctaaaaaacattctcctgcagatgcaaaaccgcgttaagagacagttctgtgattacctatggttatgtttagttcagcgtaaagtttagattttggttgaaattaaagatgatgtgactgaaaagttatgtgtgtatgacaggttgatgtgatgaaaaaagaccaaagtttagatccaaaatccaaactttggatctaaacatagccatagtaaaactagtatctatgaagaattcaaactccaaattcctattctgtctgtgattctgcatataactatgtccattgagatgctttattgcctagattacataagctatacatacgagaaatgcaaaattgtttccaaaggggaaattttttctgggtgagtagaaatagcttgtgtcacattaaggctgtgtttgatacttggggttgggaacccaactccaccgcacggaaaacggagcggtccattagcgtgtgattaattaagtattagttaattttttttgtcaaaaatggattaatttgtttttttaaagcaactttcgtatagaaactttttacaaaaaaacataccatttagcagtttgaaaagcgtgcacgtgaaaaacgagggaaaggggttgggaaacttgtggaaagaacagaggcc

SEQ ID NO: 35630 - DNA, 1501 bp, Oryza sativa
ggtgtgcacagcggtgcgcgggggcggccgcagcagcagctgggaagacggtgtcggtcctgaccagggagaagcggcgcatgccaactgcgtccaggaagtggctgcagccagggagaaggggctgcagccggcgcacgaggccatctctgagccggagctcgtcgcggaaggccgagcactagccataccgttgcaaccccatggcggagctcgacgacaacaatggtcgcggacctcaactccttgtcgtcggaaaacaagagcttcaagttggaccggtcggccaatggcaagtgcttgtcaaacgggaggtacggcgacggcaaggtcgccggcggtggcacacacatcgttgtgtaggaggttgacaggttgttgtgaaggatgagctgatggagtcgagcctgcacaagtacgtcttcgtgcgtgacatccatggcgaggcggagccgcaggaatccggtgggagcaacagctttgccggcaaacgcgtggacgccctcgtgggagcccaattccgtcgattcgaccgaccagacatggacggcgttgcagtccaacaacaacgactaggtggagtagctcagcagcggcgcggtcagcccactggagctgtcgtggcagagcaagcagcacgaggaccgcgacggcggcggcagaggcgaccacgatgatggccttaggcgtgccaccgcctccctcgcgcgcctacgtgtccggcccgctacgcgacgatgacacttttggcggtgatcgtgttcggcggcggcggcggtggctcaaggagcagtgccctgccatcattgtccacgggggtggcaggcgtggaggggtcggccacagggccctggctgccggagtctctaagtgagtcttaagtgacagtgtgagtgaggcagtgagctatactgtttttttacttcttcattgttatttgttacttgttaccatttacatttcctagtattttgatttgttggtagatttgtaatggagaagaaaacgacattgcttaattactatacaagccatttaagtgatacacctataactgatgagagcacaaacagaccaaagaggcacctagtggaatttgatcctaataaaatttttgccgatccagcaaaaacgaataccaatatatgattattgtaaaattatctaccctacagtttaacaaatggttttacttattactcattattttatttctcatggaacggtccagattatctcgctaagatccaacgtctcagatttatcccacctccccacgcatatctccgccaactgattcctcccacctgcgcgtgcatgcctctcccacccacctgcaccgctgcacgcatgccgcggatctctcctaaaatcacgcactcgcggcgatttcagaaaagaaaaaaaaatcatgcactcgctatatattctgccaaaaagaatgcgtctcccagccctaaacgccgccacccaccggatcccctccacctcgcccttaagt

SEQ ID NO: 35631 - DNA, 1501 bp, Oryza sativa
caattaaggaccggttcacgagtttcggttgtgaaacattaatcgtgccaaccacaagccagcgtgggcaacggctttaccttttgtatagcatggttcattgcggagcaccagactgagaagtggcggagataagcccacgggggtcgctggggagtccattacctctggttttgagggggagattatgatccaggaacggtgcactgtagtggattgtgttgtgcgagaggtaatgtcacagctcctttccgaggtaccgtggtggtactaaggcacatggtgacatgatgtggggctgtgtcttgtgggtacagtggtacacctctgatcagagtaaaactattcgaatagccgtacccgcggttatgggcgggtcgagcaatgtctttcgtgattagtcccacacttctcaccatagtaaatgatgctttaattggtaataatttgtttaattcctggtttggagaatagatctgttcagccgggtgtggttgtcagaatggttgggcctatacaacagggtatgttgtatagtgttggtttaatattgtttaatacttaactgttttattaaattctccaatgtttgctaaatgctgcttttgcaaatgagcctatattatgccatcctttggtatccttgtgcacttgcatatttgctgcgtgacttgctgagtatgtcatatactcaccttgcaatcattcatcagaggaagagttcttcaatgaagctgatggtgtggaggattaggtgtagtcttggtcaagctgcctgtggagtggagccgtctgcgccgtttattttactttccgctgcttagatctttattgattgagaggaactatctacctctgtaataatattttattcgctattagagtaataattgtactctattatcaatttgttattgtgtgcctcggttgattcctggacgagggttcacacacatgtaagcgtttggaattttggatagaaattccgggcgtgacaagttggtatcagagcctccttgaccctaggttatgccaaatggttacctatagaagccctctaaaaatattggaaaagtagaactgttctcctccctttctcttttaattaaaccaaactaatggcacatgcacttcttaatctcttttaatggttctcattaaaaatttattccagtgttattagtactgtacatctattactgtactaatggctcattttaccagcaaaagttttacaatattgttttatttaatcttgctgcaataaaataaatttagcatgatgattttataactttcttttatttcttttaaaacctgttgttcaaaagtacaaaacttgtggccttgtttccaactgtttcaacttatcttgcaagtttggtttactttatttaattaccttttaccttgatcttctaaactttattcaaattaatcccaaaacttgtgctattaattggataaatgtcttaactccctcctttcacttgtctttaga

SEQ ID NO: 35632 - DNA, 1501 bp, Oryza sativa
tctcaaccccaactgtggctttcaggtcaagcttcattttacagatgctgcacttagaataattgccaagaaggcaatgtccaaaaatacgggtgcacgtggtttaaggactatccttgagaatattctcatggatgctatgtacgaggtttgttatgtgacaaattttcttcctttatattgactttacagtgtagacataaactcaatgaggctgacaccgttctttttatgttttgctgtgccttgcagattccagatgcaaaatctggtgagaagcgaatcgatgcggtggttgtagatgaagacgcagtcggagcagtggaccaacctggctgcggagctaagatcctttatggcgatggtgcttttgaacgttatctctcccagataaaggtaaggattcttaattctacaaactgatggatgcatatgcatataatctgcaactataatattccttggggaaaatactgcaggtagcaggggatgcagcgggaagcgaagcggatggagaagccgagctttcctcttcaagagccatggggatgtgatttattggttctcacatctcctgtataaccctgtaaaatctaatcccagatgtaataatgtaagtattagccttgtaaaggaatattgtgtgtagtgtctattgctagttaaaaaggctccagcgcaatgttcagcacccccacgctctttacttaatttgcagcagggtttggaaagagtatatagctcaggggatatttatgggtgtcgtacagacaaccctggttgtcatgaaaatgtaatgtccaagaattgtgatgactgctgatggatgtaaaaaaaaaacttagaaacaatgaaacgcattgaaagggggaaggaaatgccaataatgctgttgtcaaaatgttggtgttgttcagtgtttacgtgatagtggagcccattttggaaaggcagaggaaaatctggaattttacaggactgaaatacaaatcttgtggaaatgacttttatattttgcatgtttctcgatccatgttactgagttctttatactgcaatttctcgatccagacagactagtctatgagcaagtttaacagtacagctcactactagctccaatttatctatagctaatttaatagctaattcatacaatggttgcttactatacaattaatacatggtcccacttaccatatacacactgcgtcttggagtccgtgctgcagctgactacagatctgtagttcgctgctcttctctctcatcttttatctcattaaaatatgtttatagctggctaatagtctgctattgtacctgctctaaacaatatgacgcatatggtcatacatatatactccgtagctaacaagttatcattaagatcgtaacacaagaaattgaagagttatcagttatcaccaacgcttaaggtctgcctggtagagctaagccaaacgagataaattccaaagttgcactctggaagaacttg

SEQ ID NO: 35633 - DNA, 1501 bp, Oryza sativa
ctcaacgataaactcaacagtatgtaactgaagggatcagtacttgagatgaaaaagaaacaaggacagagtagtaaaatcaggctaccatccatttagggcatgtttggagcagagtataaaacatgtgaataacacaggaaacaaaacttaggaatttgtttgtattgaaaaacacagcaaattaatgtgtatgaacaaaagtaataacaaaacacctgaatcatttttctcgtatcatgtcccttgtgatctttattacttctacttcgattccactggtataaacagattttcgtttttgacattggtatggtattcagatagaatacagcttcaataattaatttatattgtactaatatgtttgtaaagaacttggtccaaaaaaaatgtgtttgtaaaaacataacgaacatataatacttttcaaggtaaatctatgcatatgtattgtatgcatctaacattaatattttagtataaataaaaatgtgatgtatgtattattataaaacctgcaatttgaaaaaaaagagagagagagagatacccaaaacaaaaaaagaaaactagtgaaaaatgctacaactaaaagaagacttttccttaggccactatagaaggttttctatcacctgtcctccttggtccaactatgtcgagaatcgatgaagagcgggcccagcgtcaccaaacgggtgtatggtgtgtattcttctcctccaaagttgcaatcttgcctctgtgtgtgtggtactgtagcggtgctctttctttggtgggtgccacgtaggagaaacccagcaggagtcatttccaagtgtcaccagtgagagggcaggagggcatgtgagttggcgataaccctatcctcctcctgtcctggcccttgtcttcttcacgtctctccctccctccctctctagagcctatagccatagctcatcatccaccctctcttccttccttccttccttccttccacacagaccagaccaggcatcccgacactacacgcagactctcgactttgtcactagcatcattgcttgatgatcgatgctgagctgcaaccaagcaccagcatatcctttccttcattccttcctggtgctggtagaagaagaacaagctagctagagtgataagaggtaattgtttcctccaactcattccaaccttgccttttgcctgccaaactcctcatcctctgccactgcataccatacgtgtgcgcgcctgaatgcctgcctgcctgcctgatactgatacatacacacagcacacacgccccgctattgtaagtgcggccaccactagctgtgtttctgctctctgtgtttatcaccaaattaaagcaacgacactcacttggtctgtttctttttaaaatattatttctcctcctcacctcacacatacctgcatattatttgcagctagctaccttgcagatcgatctccggccagcgattgatcccatccagtataataatgg

SEQ ID NO: 35634 - DNA, 224 bp, Oryza sativa
tgttgctgccatgcctttttaggttcccttgtagcataacaggacaatattatattttgttttcatgtcatgatcaccctacgtgtaaactaataatcctatgaggaacccatcaatgaagaattactgctcttacattggggaaatcatgttgtttgcttgagctcacccttggtagtctctattccgtattgaatgttttggtgctgttttcctcttccagg

SEQ ID NO: 35635 - DNA, 400 bp, Oryza sativa
ttgggtctataccaacaaatataattgcccaagttaagctatagagtacacagatttgcagcaacagaaatagagaacaaataatgagacacttacaatatgatggctcccatcattcgcagttatttctacccttccagcataaactagtaatgacaaagtatatatgttatgtaccgtctggggaaatgaatttctatccaacactaggttttcaagccttgcagatttttttctacttcagcatattaaacatggctggcatgtttttattggcacatgataaatcatcaagctagttgaagcaagatgcaaactgaaattaataggcagcacacaaaatattgtgtgtaaaaacgactttgttgccctatgtgacttgatcatcatataaaccaca

SEQ ID NO: 35636 - DNA, 458 bp, Oryza sativa
ttatggtgtagtagtttcagaagtagatatctgatatcataatgcactattacagtcagtcttaagcattcatggatgtttaagatgttagtctttcagaaatcagaatcacctggatggagtaccttaatttgcctggcttacaatctagaatagtgtttttgcttgtgaaatggtaggtaattatggagacctaagagatggattccatctgtgtaggagttggaacttggatttcttttttgctataatactgtctatgttgctgctaaaaataatccactgcgtgtaatagctacggagtacaaaagcaagcccaatatttttttcagcttgatcaactaggtacaagatggaaagctagtgcatgtgctgtttgcagctaatgtttaagtaatgtatactccattttacacttgtgaaggtctttttaagtgaaatatctgcggctgtcgtga

SEQ ID NO: 35637 - DNA, 1501 bp, Oryza sativa
agtggcacgttgatggagagtgcgtgcgatccggtgggtgatctatcagtcgaaatggtagtcgcggcggtgtgcgccgcacgtcgatgcagatatggtttgatgcgtggcgcggcgaaccttcaacttacacgcgacgtgggctagatgggccggatggctagagccatgtgggctgtccacggatggcccgtttactcgttcctctctgggctgtcagtttctttttcgcctcccctatatatggatctctccgcctctactccgctgttggattggaacagtcgctctcaggctagtcgccgtcggttccaatccaataaccacgccgttccggtcgcgctgcaccgccgtccgccgcggccgccgccgcccggcgcccgcggttagcctagggtcagtttcggacagcggccagcgcgtccggcactatcatggtgagtgttgtgaaactgaaaggttttttttttctgttccaatttcaagttcggaagccacgatctcacaattgaaaatctcctttattaatctcatcaacaagatcacaacatttgatctcactgattttctcgatttcttccctgccttccccggcgccaatatatgaaatttgatttccgcattttcccctttgaccattttcaactctagacgttgccctacaaagataaattgctgagatacatcatacatgtagattaactctagttctacccagattttgctcccgtttcctccgccgtgccgtacgagaggggcatcctctccgacgagatattgtgttatggactattaattccttgtttgttgctgtgtgataatattcggctaccttgtcccttttagattctttgttcttcattgttcatagccagatactttcgtctagtatttattatggctagtcaattgaatcagttcataagtaacaattaatttgttgatcagtagcacaaataacatatacattttttaagataacgagaaaaaattcattaaaaatgaattacacgtaacctctacatcaaccagggatgcctagaaaagaaaaataataaccctaatacagacatgaacatttcgtgtcttatagtaactcacccaagtacaaccaagacaataacacaaaaaataatatactccctccatctcaaaataagttgattcacagagttcaaaatttgtttggaaagttgtattcctaaactcttcaatacctcttgtctatccaccaaccatctccgattaatgaggaacttagtcattttccctccttactaaaatcttcttgggatgaggaattattttattttgggacactgggagtagacctaagcctagttaattgttttagatatggtatttgatcaggtttataaattacactttcacaatactatatttggcgtcaggacaaacgatctgtctaagctgtatgcttagccgttaaatactgatgctggtaataaatacttgatgtttagaggtcaaaattgtgaaa

SEQ ID NO: 35638 - DNA, 1501 bp, Oryza sativa
cgccctctagtcgtggatctccattttggttcaaaaccattgcgtgttacctcagagtcggagaatgaactgccacccaccactcgatccttcccaatggcgctaccgccatcggtgttcaaggccttccttctccctgcgggacgtttccctctactcccactatttctctcttgccagctttgaccaagatgatattcacttgtgccttctggttccaaagagaagccattgccacgctgatccctaacaccatcgctaccgatggctacagatgttgtagcttcccaccttgccacattatctttccttctatctctcccaaccattgctctttgctcgggtcgcaaatcgacatcccccatgtcctccaagtccgaggtaacaatgtcatcgttccatccaccgtcgctagaatcgtcgtcgtcgccaccatccaagttactcactggctcccacactccacccctttcgatgtactcaaccgcaggctcacgatcaccaccaacaccacgcatttccttcttggccgcattctcacgaacaccttgcaggcggtggcggtgactccggtccgtcgcatcggaagggttaccgcgagcagccagtgtgctctcaaggccaccattgacaagaccgtagggctgaacgctatggacggatcccttggggaagaagcgcgcggaggccctgccggtgtccggggccgcgaagacccgcggcccgtcgcggtcgttccagaggtcgacgccgccggggcggtggaagcggtcggcgagcgccttcatctggtcgtccgccgcgacggagagcaggttgggcgccgccgccgcggcggcggcggagtcggaggcgtcggggtcccaggggcgctcgaggtgcgcggcggcgtcgcggagctcggcgcgcttgcgcatctcgtagagctggcgctcccgggcgaggcgcgccttgagcagctgcttggccttcctcgcctgcatccgcttccactgccacttggagacgccgccggggaacgtgcgcgggccgccgcccatgcggatggcgaggtccccgcgccggagcggcgcgcgcgggcgggcctcgcagggggaggggacccggagtccgcgtgaggagagggagagcgagtggaaggaagacaacggcggcgccaccgccgcggcggcggcgaggagcggcatggtggcgcggcgcgaggcggggatagcggcagcggagaggtggagtcctctcgaccacctgaggctgaggaggagggagagaaatgggaggatttttttttattttttttttgcttgctatctgacgcgcgcgcgtcacgacctcaagcagcaggtgaaagccttccgctcaccaaaaaaaaaaaaaccagcctcttttcccctccattttttttttgccctgtttagtttccaaaaactttttcccaaaaacatcacattgaatctttgaacgttttcccaaaaacatcacattgaatctttgaacgtatgca

SEQ ID NO: 35639 - DNA, 232 bp, Oryza sativa
aggatctttcttttggtcttttgttaaggtttttgatgtttgcgtatagtcgcggttatcggattttcgtcgatcgcgggttttctcaaagattcgtaaagcttcgtgaagaccttgagcaaggcaagtcaccctttgatcaattgctcctataattgaaaagtcattattattttgtttgcaacttgcattataagaatcacacacttaacttgctggccctcggtttgcg

SEQ ID NO: 35640 - DNA, 1501 bp, Oryza sativa; identical to SEQ ID NO: 27398

SEQ ID NO: 35641 - DNA, 187 bp, Oryza sativa
ttcctgcagccccgctgttgttgggcgtccacgtcttcaccgaccggcttgccttcgccgccgccgactggtgtttccgcttgcacggctggcctttatgccgccgttgttgggcgtctacgtcttcaccgaccggcttgccttcgccgctgccactggtgtttccgcctgcacggctggcctatta

SEQ ID NO: 35642 - DNA, 1501 bp, Oryza sativa
acagcttagacagatcgtttgtcctgacgccaaatatagtattgtgaaagtgtaatttataaacctgatcaaataccatatctaaaacaattaactaggcttaggtctactcccagtgtcccaaaataaaataattcctcatcccaagaagattttagtaaggagggaaaatgactaagttcctcattaatcggagatggttggtggatagacaagaggtattgaagagtttaggaatacaactttccaaacaaattttgaactctgtgaatcaacttattttgagatggagggagtatattattttttgtgttattgtcttggttgtacttgggtgagttactataagacacgaaatgttcatgtctgtattagggttattatttttcttttctaggcatccctggttgatgtagaggttacgtgtaattcatttttaatgaattttttctcgttatcttaaaaaatgtatatgttatttgtgctactgatcaacaaattaattgttacttatgaactgattcaattgactagccataataaatactagacgaaagtatctggctatgaacaatgaagaacaaagaatctaaaagggacaaggtagccgaatattatcacacagcaacaaacaaggaattaatagtccataacacaatatctcgtcggagaggatgcccctctcgtacggcacggcggaggaaacgggagcaaaatctgggtagaactagagttaatctacatgtatgatgtatctcagcaatttatctttgtagggcaacgtctagagttgaaaatggtcaaaggggaaaatgcggaaatcaaatttcatatattggcgccggggaaggcagggaagaaatcgagaaaatcagtgagatcaaatgttgtgatcttgttgatgagattaataaaggagattttcaattgtgagatcgtggcttccgaacttgaaattggaacagaaaaaaaaaacctttcagtttcacaacactcaccatgatagtgccggacgcgctggccgctgtccgaaactgaccctaggctaaccgcgggcgccgggcggcggcggccgcggcggacggcggtgcagcgcgaccggaacggcgtggttattggattggaaccgacggcgactagcctgagagcgactgttccaatccaacagcggagtagaggcggagagatccatatataggggaggcgaaaaagaaactgacagcccagagaggaacgagtaaacgggccatccgtggacagcccacatggctctagccatccggcccatctagcccacgtcgcgtgtaagttgaaggttcgccgcgccacgcatcaaaccatatctgcatcgacgtgcggcgcacaccgccgcgactaccatttcgactgatagatcacccaccggatcgcacgcactctccatcaacgtgccactccggattcaactaacctcactgcgatgaaacaagccatatgatattatgattgatcaagcgcaatg

SEQ ID NO: 35643 - DNA, 1501 bp, Oryza sativa; identical to SEQ ID NO: 35629

SEQ ID NO: 35644 - DNA, 442 bp, Oryza sativa
ttatcttaagcaaaccaaccaagcaccggtatttcatggtatggcaaagctggcagcatattagttctgtccaaatttttatttctaacttaattttagagttgtttttttttctcatcatactctactttccagcattagcttttaatgtaggttggagaaagacccagggatttgttatgcccacaaacttgaaacaaaattaggaaaaaaaatccactttaactctcttaaatataggccagatcttacctactaaaatcagatataatgactcttttaactattaaaagtaataaaaatgacttctaaaataatattaaggggatattggttaacattgccgtcagtccaatcatcataggaattgaaaaatagagagggggcatatgccatcccacctctctctctctactttcttccctatcccctcctctctagg

SEQ ID NO: 35645 - DNA, 478 bp, Oryza sativa
gacagttttgcaagcatgtgtgaaacactcgtgaaaactaccccgtcttcgcataatttgatgtgtgggtgttaaacatatagatacccatatctacacttttgcttgtgtgtggatcttctcataaaaaagcatctttctccatctctttctacaagctcagtgggcgtccgagtatcttctctgctaatatcttaacactcccgttctctccccgtgtgtgacaatatagcttttgacatcactattttaataaattagatcttgtggacaacaccctgggcgcttttctgaaaacagaatatatatcgttcaaagttttttgttgaaattttaactcgtaaaaaccatcggggtatagttattctcacccatattatttttttctttacagcacaaaaaaaaaggcatgtagtttgtgcatgcatatatatactgaaattaattataacagcgttcagagatcagcaccatatat

SEQ ID NO: 35646 - DNA, 246 bp, Oryza sativa
  unsure (1)..(246): unsure at all n locations
cgctggttnaatganattgcacttcgtaccccaccgccatcctttccgcgctctcccgccacgggcgcccccgggaggccctctccctcttctccgccgccgcggtcgcccgccccgacgccgagctccttttctgcgtcgtctcctgctgccgccgggcattcgcctccctccccgctcgcgccgggcacgcctacgggtaaagaccgcgccactgctggccttctacgcctcgggcggcccggc

SEQ ID NO: 35647 - DNA, 321 bp, Oryza sativa
gatagcagtaatcatactgaaagagtcaagtgcagtagtgaagcctgcagcagcaagacttctcttccagttattcctgggaggagcagaacaagattaaaggaaatatctagctacagtttgactgcaactaatggagtaataggcactaataagaacaagcatagtggaaaatacagttcaacttctgtgtggcaaaaagtagaaaaacttaatgtggagaacacatctagagcaggatgtatggttgattcagctattcagaacaaggatgtactgaaaacattaacaaggttgcacaacataatctaacaaggtcaa

SEQ ID NO: 35648 - DNA, 1501 bp, Oryza sativa
aggcgaacacacgacgagcttctgcagcggcggcggcgtgtcgtgggtgaccggtgggtcggtgggcatcctggggagcaccatggtgttggccgtggagaacgggctcaccagcgtgtacgcgccgtcgcggcgctggaagacgagccactcgccgcaggagctctgggcgtgcggcagctgctggtggcggtggagatggagcggcagccgccggaaggcggagtttggcaggctgtagaaggtccggtcgggcaacgcgagcatgggaattgccggggcagtgggttccgccgcgcgctgatacgccactggcggcagacggcgccgaagcggacgcggtcgccgtggcacaggatgcgaccgaagatctcaccggcgaggtccgtcgagagctccgaccaagatcgtcgtggcgcgtcctctgtcggcgacatgttcggcgacgccgaagacggcgagatataggtttcccgtttccgtgtgtgtggactgtggatggatcgagcgctgacgagacgcgatacgtgtgccgcgcggatacatcatacaagtcgcagctcatcacgacacgcgaattccgatccgaggtcaaattgggagtgctacgcgggaaagtagtttatacatttaggtactagtcccctcgtctcataaaaaaccaaccagtattggatatgacacgtgctaacacatactacgaatctggatactagtatgtgtcatatccagttctagattcgtttttttcgggacggagggagtacaacactaggccagccataaaaaattgaatattcatgacacgttttttaaactgttaaatgatttgttttcatgcgaaaacattttatatggaagttgtattaaaatatcatataaatatatttttcaattttatagtaattaaaactcaattaatcatatgttaataccaccttattttgcgtaaaacatttaatcttcatctacatgaggttcaaataccatgtatgcatgtgatttaggcagctatataaagatttcataaaatttaaaaagttagattataatgatataatatatatactatacaaatgtataagtctaaattcatatataaagaaataaaaataataaattttacatatattgtataggtactatttattgctttgattttattattttttctctagttcgagactaactttagccttgcatatttgtttatagactcatattatcctaattgatgttattactagtatttcttaattcttttataattatctgaatcgcatataaataacaggttgccatgatatctgggagtgggtgtagaaaaaccttgtccactgctcagcccagcccagcccagccgagatagaaggctagcccaccaacgaaggcctgccactttgagtggagtggtggaaaaggagtttaccgaagggcgaaggggacgaccggaggggggaggcggggagtggggagatcgggatcggcgggggggatggcg

SEQ ID NO: 35649 - DNA, 1501 bp, Oryza sativa
acgtagttaagactatatgttaacaatgctgtcatctgtccttggcttagttccccatatggcttctcttcagaaaacagcattcttattcttcatttcctaggagaagttgatttgtgtatgagtaaagagaggttatgctcatttagttttgtgagactaacaactctgaggatgctgcctgaattgactgtcctttcaccaaatgcaaagccagctcagaagctccgtcggcttagtgaatccccaacaaggcaacaatacgtatcctgttaacctcctgcatatgtaattactctgtaaacattatacatgtgcgcaagtcagagcggttaaatgacttaaaaatctatgtatctcctaaatgctagtagtacatttgaccagagtacaccatgtactgtataaattcagtcctggaaatcatgcaagttgcaactcttgaattgatgtttttgtgagattgtccgtgtttgtttggaaatctggaattgcttatttttcgaaattcttagtccacatcatatggtcccctgtaacacatgtttatcagcaattggaaagcttcagatgttattatgttttgtatttcaaatcatcgtatgtatatacataattttctcaactgtgtgtgtacagtatcacactacgtttttttcccactacagtaattcgtgatttcatatggaaatgtgcatcggagtcacttgaaagtacttctcatgtcgtaaagagtggaaacatggccgtgccctatatatctctttctaggctgtggaacgttccatatgaatcataactcttaagaagttggtggtctctgctatcacttcctttgggtatatcctgtcctcccttgctcagaacgtagatacagaaagaagtgctgcaaagaagattcaagcgaaggtaggtaagactatgttaacaatgctgtcattatcctcggcttagagtccctatatggccttctcttcagaaacaacatttagttttgtgagactaacaacacttagaggttattctcatttagttttgtgatagtgagactaacaacactgaggttattctcatttagttttgtgatagtgagactaacaacactgtggatgctgcctgaattgactgccctgttaccaaatgcaaagccctctcggcagctccttcggcttgttgaatccccaacaaggcaacaatacgtatccagttacgcttttgcatatgtaatgtaagtactctgtaaattatatttgtgcacaagtcagggcagttaaatgacttaaaaaaaactgtgcatgtcctaaatgcttgttcatttcaccaagtcatgccagttgcaactcttgaaatcgatgtttttgtgagattgttcttgtttgttgcaactctggagttgcttatttttcgaaattcctagtccacatgatggtcctctgtaacacaagtttatcagcacttggaaaacttcagacgttactatgttttgcatctgtgctcgtgt

SEQ ID NO: 35650 - DNA, 1501 bp, Oryza sativa; identical to SEQ ID NO: 26433

SEQ ID NO: 35651 - DNA, 1501 bp, Oryza sativa
tgaaatgcacaactgagaaaattgagatgaacatgagaggtttcggtgcagcatgtggaagcgcctcttttcgggattttcttgatgcaatataaagcaaagtgatatatgcagatcatggccttagtacccttgtaactggacgcatgatacgcacacgatgcgccatgatgtccacccattcgtggcacgcacccatgcacaactagctcagaatcgtaggggaggaaccaaaaaacaggaaactcaaaccgaaagatagaacacatgtgtggtagcctcaactattttcttttttgtttgtgggtggaagaattcatgaaggttaatcctatgaagttcgtcccggcattggtcgatggagatgctgtaattggtgattcttacgcgatagcattagtaagcattcagaattttgagatgcagtagtttatagcatcaaaattggccgcttcttgacttgtttctatgtgattgcagtatttggaggacaagtaccctgagcaccctcttttacctcaagaccttaaaatgaaggccttgaatctccaggtaatgatagattctgcactgctatgcgcaggatgatgacctcaattaaacattccatttgatatacaagtgctatttgtaatttgttgaggttgagcagcgttgatgttcagttagtgcctatttgagaaggtaagatcacatcagaacaataacaaaaagaggaaaggatcagcccacacatgtttcaggataataggaatactgagcacaaggatataagataggcttaggcataatccagaaaatatagcttactgtatgcactagattttttttcctcttaccgattgatcatgcctagtgtgacctttcatgacataatctaattttatggcagatagcaagcattgtatgctctggaattcaacctcttcacaatcttaccgtactggtaagaactgatttgcattcaatttcttactgccatgtaaggttctctgcctggtatttgattactcagtgcacctgtgttccatgtctatctggctgcattgtgcaaagatgcatttttgtgcctcagattaactctatattaaacagtttgtgcttctgtagtaaaattaatatagtacagctcaattagggaaaaaaatattgtataacagaataatttgcgggccacttgtttctttgcagaggttcattgagaagaaggttggtacaggggagagcatcccatggactcaacaacagatcgacagaggtttcgcaggttctcctcactgacgtatcctttattttattaatcaaatgactatattttgcagctttacttccaccatcaaatctgcttcaaaaaaaatgtgttatgcataactcagttgttttgcatgttgtgagaagctcactcatattcctccccttttcacattcctgcctatttagatttgcttttatgtcacaccatgctcacttcgttccccaatggtgtagctgctgagaacct

SEQ ID NO: 35652 - DNA, 346 bp, Oryza sativa
tcctgcagcccccacgcgtcaggccgccgtcgtcttcttcctccgcccggccacctctctctctcttcccgtgaaaccctactcccttcctccctcaaatccgtgcgattcgctcatgggattccaaaattaaataggggaaattaaaccccattgaatcctcttcaattcccccttaattcccccttgaacggcgcccccaatcgccgggaacggacgcgccaagtccggccgccttcctttgccgccggccgccattcccgtcgccgttcccgctcctcccgtggccggctctctcccccatcctataaaatgggatcctcatcccccgttctctcgttttagc

SEQ ID NO: 35653 - DNA, 1501 bp, Oryza sativa
caattaaggaccggttcacgagtttcggttgtgaaacattaatcgtgccaaccacaagccagcgtgggcaacggctttaccttttgtatagcatggttcattgcggagcaccagactgagaagtggcggagataagcccacgggggtcgctggggagtccattacctctggttttgagggggagattatgatccaggaacggtgcactgtagtggattgtgttgtgcgagaggtaatgtcacagctcctttccgaggtaccgtggtggtactaaggcacatggtgacatgatgtggggctgtgtcttgtgggtacagtggtacacctctgatcagagtaaaactattcgaatagccgtacccgcggttatgggcgggtcgagcaatgtctttcgtgattagtcccacacttctcaccatagtaaatgatgctttaattggtaataatttgtttaattcctggtttggagaatagatctgttcagccgggtgtggttgtcagaatggttgggcctatacaacagggtatgttgtatagtgttggtttaatattgtttaatacttaactgttttattaaattctccaatgtttgctaaatgctgcttttgcaaatgagcctatattatgccatcctttggtatccttgtgcacttgcatatttgctgcgtgacttgctgagtatgtcatatactcaccttgcaatcattcatcagaggaagagttcttcaatgaagctgatggtgtggaggattaggtgtagtcttggtcaagctgcctgtggagtggagccgtctgcgccgtttattttactttccgctgcttagatctttattgattgagaggaactatctacctctgtaataatattttattcgctattagagtaataattgtactctattatcaatttgttattgtgtgcctcggttgattcctggacgagggttcacacacatgtaagcgtttgaaattttggatagaaattccgggcgtgacaagttggtatcagagcctccttgaccctaggttatgccaaatggttacctatagaagccctctaaaaatattggaaaagtagaactgttctcctccctttctcttttaattaaaccaaactaatggcacatgcacttcttaatctcttttaatggttctcattaaaaatttattccagtgttattagtactgtacatctattactgtactaatggctcattttaccagcaaaagttttacaatattgttttatttaatcttgctgcaataaaataaatttagcatgatgattttataactttcttttatttcttttaaaacctgttgttcaaaagtacaaaacttgtggccttgtttccaactgtttcaacttatcttgcaagtttggtttactttatttaattaccttttaccttgatcttctaaactttattcaaattaatcccaaaacttgtgctattaattggataaatgtcttaactccctcctttcacttgtctttaga

SEQ ID NO: 35654 - DNA, 1501 bp, Oryza sativa
aatatttacacatatcaaagccacatactatggcaataaatgaaaaaaaaattgttgcaatagcacaaaccaatgtaatagtttaaaattcgttgcaatatactattaccatggcacttgttataacggttggcaacacatttttattttgtttgcaattagtgtccgttgcaatgaattttggtttaatgcaacaattttttttgttgtgaaaaatagatttacttctatagtggctttaattttcttcaaacacgaaatgaaacatcgatacacatgtctatgtgcacatgcatgatcgataccacatctttaattaacagctctttatgctagctccatgcattatttgtcaaaaatcttaccatatatatgtacgatatgtagtgataaatcatcactatcgctggaaattgctcttgtaaatatattttatgattcttgtcaagtctacctgtgtcgtcggatttaggcttcaagattttttttttagtaattcagtggttgaattatatttcctatcggttgtatgcttaccaagttcatacaaaggctaaaatttgtttgcactcaatatatagaattgatctataagtagggcgagagaaaatttatggatgtgtacgctccacaaagaaaattaatttttgtttttggctaaacatgatctaatgtatacgccatactaataaaccattaacaatacccctaatgtacaactttaaataatataaatggtttttattttcagcttctatcataaggcacacaatttatccatgcctaatgtacaaaccgaagagaggttaacttcagatggttaagatgttagtgaccataatgtaggtgcggccattacactccttgagggagaatccatcaaattcgatgataaatggaacggagtccattatcataatttggcttccctagtttaagatcagttatatgtaaggagagacttatgataagcaatattattatttttcacttactgtgcttcaataatcttctctattaccccactcctatatgaaaatatcactgatcaaatttaccaaacttatacctttatagtccaccatatacaagaatatcttcctccactacgtgtacaactgtattttttttcgctttcactatatccttctaaaataccactacctccatcttaaaaaaagacttcacttcaatacaaaaatctagacaaagtagttaaaaaaaagtgaggtccatatttatgtccagattcatatataaaagtgaatttctttttacggacgtcatattatctaattttcagcacactttaaaaaaagagagagagaaatcatagctcaaatttgtcctcacactcactctccctctacttaaaccctcctaagccctccttccttcactgagccacacacacaaacaccctctcttccactttccacgtcacaaagcaaagacacgccacactgctgcttgctctgctcgccatgggcggcgccatcga

SEQ ID NO: 35655 - DNA, 1501 bp, Oryza sativa
aaaatcatattccaaacccattttgcaaacacagccaaaaagtgtactatactgagggtgtgtttagttcacgctaaaattaaaagtttggttcaaattggaatgatgtaacaaaaaaagttaaaattttatgtgtgtaggaaagttttgatatgataaaaaaattgaaagtttgaaaaaaaaaactttgtatctaaactcggccttagtcctacggtcctaccaggcctgagaacagaggtcggagtattaatgtaccggattggacttcagtacgctgctatcattttcttttcaaaagaaaaaaaagaaaagatgagtagtactcgtaggacgaaaatgtaaagggctcacacctttaaatacttgtctaccaggccagggtgctacgttgctgccaaaaaccaggaaaaccacgcagagccggagaagaaaaggaccctagaaaaaggttcatcaggaccaccattttgcgcaataataaagctcacgcagacttgctaaatggcgagctgctctttttctgccttgcatgttcttattacatagtagtcctataagattttataacattaatggaaatatatgtgcttgatcgcatctctgcaaaacattagatggaaaacttctgctgtctgcaaaaacattagatgaaaaacttctgccctgatgctgcagtagtacaagcgctattgcaaatcgtcagcgctataaagatgatcagattcccctctcgacgtcaatcagctggtccagccggcatgagcaatggccatgtcaggcgatcaacagttgaattaactcaaacttcacccccccccccccttgtactgttctgtctgcacgctaaacgatagagagtttgtaataaaccatgatgcgttttccaggcaatcactcgactctaaatgaattaagtctgcatcccagctagagccatgcattagaggcaaacattctggtttgcactccactgcatacagacgatcatcatatcgatcctcttcttcaatcaatgccgtgcccatttctcgcgcattgccttttcagagtttcagttcctaggacggagcaattctggacacaggcttggacgtaaaacctctaccagatccgtccgagaaaacgttcgctttcagatgatctggtggcgaggccatatcgtctttccgaaacggtgcaatggcagcggagcggatgggcttaactcaccttcctattgcagactagacacaggttagctcatactacatactactagctacgtactaatggcgtcgatctacttcagtaggcaattgaagttttttgcctactgctactgatgcatggctaattaaacaccggtgccagtgccaaatcaccgcagcacgtactgtgcgttccactgttcaggacttaatttgatcgatactactagcatgcatatctaagtatatacccatcgtagctagccgtagaatagtaacagcagcatctatctgcaacccaacgtaggcca

SEQ ID NO: 35656 - DNA, 403 bp, Oryza sativa
ttttcttttaaccatcgtgtgtgttcttaatttcaggaagcaattgttgggctcatgattctgtcatacagaatgcatgcttccttgaaattattgccattagcttctttttcttagtaaaaagtgtttagtcttgtacagttaattgtttatctgaatttgtcatgcaatcgttcaagaaatgtctgtcatgtcgaaatagtaatataatccgcccatggtgcagtgaagacacataattactctgctcgtggagtataactttaagccatgcaatcaacactactctgatatttttgacatgaatttcactagttcaggccctcttttatctgacgtttgttacaaaatacctgaactctgaaagaataaaatggttgtccttcttttttcttttgacagg

SEQ ID NO: 35657 - DNA, 574 bp, Oryza sativa
ccttaggccgagtttagttccaaactttttcttcaaacttccaacttttacatcacatcaaaacttttctacacatataaacttccaaattttccgtcacatcgttccaatgtcaatcaaacttctaattttggcgtgaactaaaccaacccttaacctatgtttgttttcagttttccattcagtatcagtaatagcaacagctatatctagatcagaaggttgtggaggtggtccaaactgcattttctgcaagccgcaatatttatgtctcgttttattgggtactctctgtactgtaaactacaggctctgtgctgtaaactgtaggctgttcacccatcatcactgaagctctgcaaatgccatgtgaaatgtcaataggagtataccggccgttctttccagcatttatcggtcaaattggtaaggaaaggtaatactcctactattggcctgcaccgggagtggtcctaaactgaatcgaacacatcagcgctgcaattcagaaagtcacatgcatttctcatttcttgcaggctggacgggcctctctctctctctgcctagcagg

SEQ ID NO: 35658 - DNA, 1331 bp, Oryza sativa
aattcctgcagccctcattcttgcatgcaacaatacaaatgaaatgaccattctacccttaccatataaaaaaaagaaaagaaaaaaataaaggaaaaaaaaggaaacaacagggaggaacgaacaaaaaggccggaccattactctatctgttgtttcctttttttcttttctttcttttttatatggtaagggtagaatggtcattgttgtatgcaagaatgacttggcatgtttatgtggcattttttttttcaagtactatgttaacccaaatgattaatttggaggacctatttggacgttttgaaacctcaaggactaaactgagcccgaagcgaaacttcagggaccacattagctattctcccttctttttttttagtaatgtccattttcagttttagaatttatttaatattttgaaacggattatacccttgcacgatatatatgtagtacttattacctgttagagaatgcaggatacatgtataacgcagtagtgcgtgctggcaatgatgctcttcgagtcaagtccatggtgatatattagtactagaagacatctctttgaagtctcgaggatcttgactctccgtttcgctgtcattgacctgtttccgtgaatgatggggcaattgggcatctttgcctccatacgtgaaggcatgcatttgtttctcttcgtccttcaaggctcagatttatatttatttttatgcccgcaagaaataaaaagattcagtttttatcttgtgacaaagataatactcccttcgtttcgaaatgtttgacgccgttgactttttagcatacgtttgaccgttcgtcttattcaaaaaatttaagtaattattaattcttttcctatcatttaattcattgttaaatatatttttatgtaggcatataactttacatatttcacaaaagtttttgaataagacgaacggttaaacatgtgctaaaaagtcaacggtgtcaaacattttgaaacggagggagtagctagcacaaccgattgtctatggttctatatgcactcagattcaaatgtggtctttagaagtgtggagattatgggtaccccatatccacacggcatggttatccgactagtaataggggataacatatatgtatggaatatgtaacagatcatgacttgggtattacgtttccttgtatattatggaacggcctaaagtcctggtttgataatattgtaaagtagatttaggaaaccgataccgtgttggttaaggtttctatcttgtaatcctgccccccatcctatataaggtgggcaggaagccctctagggggca

SEQ ID NO: 35659 - DNA, 1501 bp, Oryza sativa
ctgccgagtggcgaccgtgttgctgcctggtgctcgctttgttcgtaggccttcttcatagcggataccgtgcgcaatccaaccgtgcgcgcaatcagataagcggacggaatcgatttggcgattctgtagcggtggagagcaatccaacgtctctttggagccacaaatttaaaccgggtccttgttactaatgccgagttccagatcttgaattggagttttcaaacgagatacacaggcaactggaaaaattacaaattctcaagtgggtagtcaggcgtggactagccaattgatgatgtggagtcgtttttcatcgtttccgtgaaaatatcacgagggaaaaaaaagatcctggactagcgtcaccttccgcagtaataaaagtcggtcttctcccaaaagaagcccacgtattccatatttccgttcccatagattctctccgaacttcacacacgccataacccatatcttacacagacatgtgggccacacataacttgtaccccacctgtcatcgtcaccgttaagcaaaaacgacttttcactccgatccggttactctatccatgtcgcactctttctcgccgggcccacacaacacggcggcccataaccgacaagcgggccccacgcgaggacggttccgaactcccagacccacacggcagcgaggccacccgcgacttatccgcagagatcccccttcgaatcgaaacccttgagcttttttttttttcgcttaaaccaaattcttttcgcatccccaatcccaccacgcctaccctaaacccacggcgatctcctcctatatttcctccggtcgcaggcgattccaccggcgacgcaccgcgagatcgcattttcgttggttttgttttatttgtggcaatttggggaagtgatgggcggcgggaaccgcatctccggtggcggcggcggcggattcttgaagccgcttgccggcgtgtcgttcgcgtttatgcccggggtgggcgcgttctacttcctggttgggtcggtgctgggttcttggcgatggtgtactcgtccgagtccgacgaggccggcggcgactgggcctccgcggagcgctgggttgcgctggcgaggtcggtgagcgccccccagatgtttgttggaattcccctcctgctcctggcgacgggggtctggcgcctcggcaagcggtgcgaggccgtggaggggctcgtcgggaacgcggacgccacggtgcaggcattgcgcgtcggcggcgtcgtctgcgccgtgtgcgggacgaagatactggccctgaagaagaaaggcggcctgcccccgtccccgaccccgtccccggcccgctccaaggggagctgctccgacaagccggtcgcgaggtcgctggccgccgagctggagcaggaggccaacgcggaggaagacgagtgcgcggcggccggcgacgcgaacggcggctgcggcagcggtgcggaggagggcggcagcgtggagc

SEQ ID NO: 35660 - DNA, 912 bp, Oryza sativa
aggtgataaaatgaagctggctgaagatcctttcacggaagacgagcttgactactacccatttcttgagaacaatcccgttgagtttcagctgagagatgagctaccactcctggagcctggaatgaactgaagaatgctaatctgccccacttgaaaagacctcagaacagtgctattatcatcattatcctctttgcaaactctacttgctcaggagcagtttatttgtagtagtagtagtagtaactagtatcctagatgttctgctgtatgtggttggtgtgataatcattcacactttaggaagaacccaagtagcggaagcaactttagcttcctttatgttctgtgtcttggctgaaatacccatcattaagccattgtgtaaatggtagtagtagtaaactgtagtgtaaggattctgcagaagtacatgcgtgtgccacttcctctattacgaatgcgtgcacatgtgtttgatttcctgtttatattttgttcagagtttcagcttggtcaatacaatgttaggttcatctgaacgcagccatccacttgaccaccttgcatcgattcccagttcggattggatgaatttgccgttccctgttcaaaatttgacgttcgctgttcaaattggatcgtgacgaggaagccttttgccgtcgtgttcttccatcctctgcggctggttctcccgggcccacatgtcatccacccaggggaaggtgggaggaaagaccaaaaaaaataaaaaataaaaaaatgttggatcgtgacgactcaccaaggcctaggattatttatgtattgatcggtcgcaaccgcgagtccgcgacggggcgagacaccggcggccatagctcgagagctcgaggtcaacccgaaagccacgcacgcgccgcgcaa

SEQ ID NO: 35661 - DNA, 222 bp, Oryza sativa
tataaatgtgttgaagcttatgctcaaagattaccctgactagcgtgagaagtgtatataatatgaacacttgcatttaatcttaaaatgcaccttctagatttatttcatcaatatcaattgattcagtgagattgtaccatgtcgactattgtgaagtatgttatgtttccacttcttttttcaggtatgaagcactttcagattgttttttcttatatt

SEQ ID NO: 35662 - DNA, 1501 bp, Oryza sativa
gccaaccaataggtagcacccatgttttatttggctaaattcaagtagtttcttcactacaatatcaaattttggctttatattggtcccaatccaaacatgagctaaataactctactttacccatttattggcagtatcaaagtttgcctagattttagtattattgataaattggtagggtagagatccaaacatgcccgtaaacttggctgctgtctgattaaagtccacgacgaaccatcacggtatgaactatcgcggtcttcttttcttagataatggaatagaatatcccgatctttgctcaacgagctacagccaattattacagagcagcacacaaaataaaaagtttctcacacaaaaaaaagacacctaccaaccgaggataaggagtacacaattattgaattctgtttgtgaatccccatccaaaattggtaaacatttgcataatcgttgcctcaagattacgacatgcaacttttaaacgctcgccctcttcatcacacttttgtagcaatgtccaagacctgagccaatgtgttgccctgaaagttacctgcatatatgaaacagatggtgatttgtcaaaaatcatatcattcctactcaaccatagagcccaacatatagcagaagcttctatgagaataagtttcctatctttcttgtatcgcggtcttcttgaaacagagaaattccatttgcatctctcaactatgggtttttcctactgccgattattgagcttatcatcagggtgcgataatagtaagggcctgataaacttcaccaagcttaaataaatctgaataaaaattttaaatttggtaaaattttgtctggtttttctatcgtttactacggtaccgtggttcaaatgccctaaaaaggggtaatgtagatcctggttgccgtctgataaaagcccattacgaaatacgaactatcttttttagaactcaggaatttgatcttctgaaaaaggaaagaaaaaaaaacccaaatttgatggagtgcagtgcagttcaattctcctgcttccagttgatacaagagccatgggccacagttcaagaggaggtatttgggccacatatattaggtcagcccacgacgaggttaacctacccagcgtgcacacgtgtcacacccccactggccacacatctcccctcatccgctgcgtggtgttccgccgccccggagccgatgcggccggctgattaatttggatgcgatgcgccggcccacgtcggcccatcatctgacgccgacgcgtggacgcatcctgtccatccatcacctccaccgacggctcccagatctcctggtccatgcatccggtccacccaaaagagaagcgacaaaaaggtggaaataaaacgcaataaaataaataaaaccatggagaaaatataaagaaaatcgagagattggtggagagaggaagaacactgggggagaagaacacaagtgtgcagcgtgcgtgtgt

SEQ ID NO: 35663 - DNA, 1501 bp, Oryza sativa
gtcagacctctttctttttttcatgtgaaaataaactaaagggatgcaatccttaggaatgtttcctttcatttcctatgaatcaaaggcatccataggaaataatccataggattgtgaatcctacaaaaaatcctataccgatcatttaaatcaaaggagcccttagattctcatcaaaagcatcatctaagacccctttaaatcacaaaaatgaaaaacacagaggaataggaaaaacatagtattctaataagaatgcaaatgtaaaacagaggattgcaaaacgcaggaaaaacatagggatgactgtttaattgggccgcaggaaaaacacaggaatttgaggagagataaaaactcaatagattcttaccatgaggttctacctcatgttatatttcctccaaaaattgcatgggaagaggcattccataggaatttcataggaccattcctttaattcaaaggactatataggaaaaattcctatagaaataaaatcctctaaaattcctatgaattttctttgaatcaaaggggcctaagaatctggccgataaaaatctagagaaattgaaaaaaatcagcttgtcttttagtttactttttagtttttacaactatagcttctcgtaatctagacaggttgtttataagaactcttaattatgaaaaaaaattgtacatgctagaagctcccacaagaaaatcgcatagcatactagaaaaattcctatacactctagtctatagaattattaggctcgcccaacaccacaaccttttggtgcttgggcgcggggcgcctatgagagtggttgatatgccactatgcattttatgactcctctaaactttagtcctacctatgggcagacgttaagatggtttgactcagttgagctcgttaggagtttagtgactgatgagggaggaggtgaggagccaatgttctggcaccggcacaagacggcaatggtgatgtatggtcgtgtggcgccaatgtagcagtaatgatgagtggagaatagggtttggatcaatatgaactttagtgttctttttagacctagtcaatcggtatagcatggacttatttttgtctagtagagaattgtaccgtatgctgccctagtggactattggttcagctcgttaaactcatgaatactccataactcgtaacctagctcactactagaattcaacgggttccctagagttaaaattgttccctagagttgttaaagccatccaagggaaaccaaaagtatccctagggagcaaattgataactctaagggaaagaagtattcctagggaactttggctgaaatgacacgtagctactccacatcagcatggtggtctgattacttccaatattttttttcaatttttttccttgctgcgaccaaggaacgcgccctcgacatacaaaatttctgcccaataaatgttgggcccaccttatcttctccacagctcaagcaaacca

SEQ ID NO: 35664 - DNA, 209 bp, Oryza sativa
gcaacaatgtagttaatgttataatgtacatcgtaatataggtactacagttcatggaaattaggagccacaaaaactttcctcgacataattaagtatcaaacaagcaagttcaaatgaaatggctaatactgttttagaacatggcagcaaagctctaaaattctctatctagaaccttctataagagaaaaatcaaaatacttcag

SEQ ID NO: 35665 - DNA, 1501 bp, Oryza sativa
cttcgatacggttgcacgcctatatactctataataaaactgtcgtttatcgcacaaaacgacggtggatgtgcacatctaccaccgattcgtaaatcctaaaccgcgttttaggaggatgcagacgacgaagattatcatcggttgttgatcgcactcaacagaatccatttcggttctgcaatacaatatacgcagcggttgaaggagccccaccatgtaaccatgttcatacagaaggtcagcgtctccacggccgtagtgttggcggatgaccaaggtccaaatgacccccaatctttagtcgtttcggattctttttggcagccaatctccggggtctgatctgtattgtatctgtgctttaagccatcctgtattacgcgtcaagaagccagacaaaaagctctcttcctgcccaaaaggtgacacaaaaaatgaaccaactattgtctactgcgggacttccatttgcaagtgaaagttttgatctaaaaaaaagtttggtgcctaggtagtagttagattcacataagggaatatatccagcaatggtgacaacttgtacgtggtgtgtacagctgatcactgcaggagaattgagaccactctgtcgtagctttgcgtttttttgtgcgtgtctgattatcagtcgttgttcccgttggcttaagcgagccttaattctgtggtacagcaaagataggtaagttggtgattcaatattactgataaataaagccttttgcaaccatcgatggttgacacaccgctacgataattacgccatgatggcatctacaggccaccgaatctgtcgacggttacggttccaggacctggtcgtacgtccgttgtttactctgtcgtgtggcatcgcaaaaaagaaaacggaaactctgcatccagctttgtgatgtcaacatgatcctaccttcagctaacctgaattaaagattcttgatcaccgtttacaggtaaggagtagctccagctaacacctgtgttcgtgaaaacgaccggtaatacgcagatggtaaaacacactgttagccttgttgcaaatctaagtcagctacagttctgtgcaaatcttctcaggcactattgttgtacttctggttgttatgctatcaaaatcgcaacatcaacactagtacgtactgtacgtaggagggagggattcaggatcaacgcccggcaaggcaaagctttgtcaacgtgcatctctcgatctgagccgttggaaatgtaatcggacgtacgagatcgcgccgggatctcgtagcgcggttgcgaacttgcgatgtcatttgtggcatcctccgttttttctccttgtccgtaaacaaaagcaatggaaagtctcctttccaaattccaatattctgcttcgcttgtttgtttcttccctcctttcctcttctgcttctcctcctcctcccaccgccgcatggtgtgatcagccaagaaaaaccatccatccacgcagcgatgctgc

SEQ ID NO: 35666 - DNA, 181 bp, Oryza sativa
gcagttaacttctaaactgtgatggctattcactaggtagcttcacaacagtacttatttagttttataatgccatgaggtcgggaacttgggattctgttttgcattgtatgataattcttgtgtcatcaaggcatattttattatttgctgctgacattttggctcactgcatcacagg

SEQ ID NO: 35667 - DNA, 1501 bp, Oryza sativa
ttgcatcttcacttgccataatgagtatattgcatctcaattcaggagcggtagatcaacctttaaactcgccttggaaataaaatcctgaatctgctggtataaattgtggaaccctagcagaaacgtgaaacactctagatgcataaaaagaagtatttggatctccggataaaatctcctggtaaactggcgtgtgggcgattcaccaaatagaaccatagcaagcaatgcacaggacttgatttcccggtagaacttcgtgtgcacgaagcaaaaaccaacgtgaaatttactccctccgtcccaaaataagtgtagttttagcactgttcatgtctaacgtttgaccgttcgtcttatttgaaaaaggattatgattagtatttttattgttattagatgataaaatatgaataatattttatgtgtgactaatttttttaatattttttataaatttttcaaataagacggatggtcaaaacgctgagcacgtatatctatggctgcacttattttttttgacagaggtagtaattcgcatgaacagggcaggaacggtgggcttcctgacctaatcttcctgggaaccgtgcgcgatagatggcctcctgcttttctcctacttttcttgcgctcctccttctgcgatggctgtgcatcggctgctgctttttccttcgtgacgtgcgctgctgctccagcgttttctcacgcggtcgcgcggtcaggaggacggcgatgactcggaaattcggaattgacgagacggcgcgacgaacacgcgcctgctgccgccgatcagatgagatcgatttcttcgatcgtggaatcacgccggtggccgggattgatagatggatctcaaaggctcagatacacttgttatgaaattagatgcacaacagagacacaaattttacatgaaaaatccttcgggaaaaaataggattagatgcacaacggagacataaattttacatgaaaaatccttgcgggaaaaaatacagacgctgatcggcaatgattactataaaggagttgatacaaacgcagaggatacattagaaatctaagagtcctagtggataaagacttagagtcgtagtaggaaactaattcgaatatattgtaagcctaaaatttagatcacatatttaacatagatgacatgcatgaaccgaggggatattccctccaggatgaatatactttcccatcgatatagaatctgagagctcaggcaactgatcatcatatggcaactcggtggtaagttacggtggggactcaattcggattgaagcgtaatattaattaaatatcttaaagcacctagtaatatctaagttacctataggttttgtgtattcttgtgatttgctttgtgttcttgttgacatcgagtggaaccctcacaatattggtattttatttttaacaatactactattaagctatgtttagttccacgttaaaattagaagtttgaaaaaat

SEQ ID NO: 35668 - DNA, 1501 bp, Oryza sativa
ttctaacgcgcaccacgacgcttgcctgctttactcccaaccaaagtgttctcttcaatgcgccgccttcatcttcatgtgcctcccctgatcccctcccctagcaccaccattacccctacagcgtcacgcccaaatcctgaaatctagcgatcaaaaccggacagaaaaatggacataacaatggggccttgtgtggggatgaaagtgtagtagagctgaggcaggcaggctcatagcagagctactattgctgccgaaaggcgtgtctcagctcagtgcacacatggattgcaaatgggttggatggatggatggatgaatcgctgctcgatcgctggccgagctgttttccaaggaccggcggccaataattcacgtcacacattattgttcagagaatagcccactgattatcattccttcgtgctctagtagtgggggcagcggtgcgaagcgaccccggccggctcgagtgatcgatcagcctctccttttataaaaagagcacgatgacaactaatgacaggcagggcgttgcatgatccacaaccatattgatcttcctctcttctcgccctttattttgttcgggcaggttaggattctctcgggctagcttgcccttttaaaaaaaagttgggattctctcggggctaaactagttgtgctcggcaagtacgtacgagcaaggcacgcggcgcattaacgcgttgttttggttggagcagttcgtatcttcgggacaacgcctcttgatgtgctgccaactcgtagccatgttctttgctgttgcttgctcgcacaactcttctataatcctagtcgcacattgcaatatagaaagggggaagcgcaccaaattgacattagttaggggtatttaggctcaatttagatacttcaaaatggcaaaagttttatcattttatagcatttttaccattttggatctatacactagtagcaaaagttggcaatttggcatttgctagtccatagtagcaaattgtgccaaaaagtgctttgggaccactccctctctctttctctctctcactttagcgctagaatggcaaaactttaacatacatctaaacaccaactagtacttttgcaatgtcaaaactttcccactaaaacttttgtcatttgcgattacaaatgtatctaaacatgcccttaaacgacatggtttaccgcgacgcctattggtttggttgttcggaacaagtcgtgtaaaaaagagatcagagctgtactgtgtccctgtagctgtcactgagctcagcatgagcaggatgcgtgcgaaggacgcctttttcagcttttttttttcactgtctccagtgtgtgtgcatggcaatttcatgtagcggcagcggctagatgatgacatcgacacgagtggcccgcacgatccaaacgagatcgactgggacgatgtcgttcaaatcgcgcgggagtcaaaacctcgaagggggagtaatttctcatttgt

SEQ ID NO: 35669 - DNA, 1501 bp, Oryza sativa
atgcactggggtaaggcattctttaaataaactgaatctaatatcagatttctcattttgataggatgtgcaggtctccgagattgaggtaatggtttccagagttctagaaacaggatcataggaacaaactttgtgcttggatgtggcgatgattatcttcgtacctgatctgcaactaccagcggaaccgataactttcactatctgtggctcaagtaaatccctaggcaactgccctgttaaatcaattcgatgatccaaagaccaatcaccagagttatagtccttaagcttccaaatttccaacttgcaaacagcagttgacctatcacgaaggtctcggaccatacacagattaccatcaagctccaccaaatgcactccagatgccacaaagggtggtgatcggatccatctgaaggtttcatcagtgagagaaaatgataaaatagaagctcttggtagtttaacgtgatgcaatgggttgatcaaccagtgcagatatccattgaagaaaagtggctgcagtttgttcatcaccgcattggaaatagcagaacgagcaaaactgtagaaccggaaaggtactccaccagcggcaggcctccaaatatccccttcatcgcccccaagtgtgtatatctcacacttcaaaaattccttctcaagcaagttcccttcaaaaagcctcactaccttgtacttcttcgtccgggcatcgcacccaagaccagcagtggcaaaagccacatctcggaaaggcggcaaccgtgtgactgcccgtgtggttgcattcataacatagtaagctggggcaataccatcatacaggagggagagaccatggcatggtgcgggtgtcacctccacatagtttccgcgaacatcatcaagcgtgagcagcaggtcatcggtgggcttcgatggtgagcacttgtacaccgcggtggagttgaaatttgccgtaggtgagacgaatagcagcttaggagctgacgacatctcctcggctctcgctgcgtagagttgaccaaattcctcggaagacagcattgcgtcccaggagcggcaggcagcccggaagcgaaggatggatttgacgggcaaccgcaggcacacctccgtcagcaactcgtcaggtagcatcgcggccgcatgacgggatggtacagatttcctcctcctcctcttgcttcccggggccaacgtagccgtctccggcagcacggacctcttcctcttgctgtcttgctgcatcatgttgccttcaaacttgacgaccctgggtctgcggcggtcgacggtggtggggcatatatagcaccgggttccccccggctccgatccgaatcggactgttgcgtctatttccgtctcggcttctgcgggagaggggccaaaccgccttggggaggccgtgccccgaagcgaagcaacgctcccctcgccgtcgtcgagccgccgccccgacgaggaggatagatggaggggggtggcg

SEQ ID NO: 35670 - DNA, 268 bp, Oryza sativa
ttatcacgagatgatagctaggatgaagaccctctcttcacagtgcaagtatcgtgtgtgggactcagaaatatctgctagtgggatccataaactcccaagtcccaactccccaccggctcctcctccctcgtcacgcaatccccaaatccactcctccctgccggctctcccctcctcccttcgctgacgccgactcccctcctccctccgccggcgccggctctcctctcctccgggcggtggctcccctcctccctccgccagc

SEQ ID NO: 35671 - DNA, 441 bp, Oryza sativa
cactccccacccggccaaaccccaagagaacccagccggcctccaccacaccacacaccaccaccctcggacacaagaaccgcacgcgcggccggccaccgtcgatgccccctcgccactgccgccgctagccgacgaaccagcatatcttcgccgacctcgacctccatggaccgggcctccgaggagctggagcgccgcagccgctacctcagttcgctcgtccgccgcaccaagctcgccgacccgcccgagccggagccggagcctgagccggagccggagagggagagggagagggaggtggcggcgaaggagagcggtggcggtgaggggaagggcggtaaggtggtggaggagaaggaggtgaaggcggcgaaggagaagaaggagaaggagaaggaggcgaaggtgccgaggggggagggggggaatggggag

SEQ ID NO: 35672 - DNA, 1501 bp, Oryza sativa
ttcaggtttcattcaaactcacccatcagtgtgaactctgaattcatgttatagtaaaattgttgatttaaagaagcttctccttttttttttcttttccagagtcggtattacagatctccggaagtacttcttggttacccgtatcctgtgtgacatctatttttcactaggaaataccttaaagctgcacaaatgtcttatgcttttaatttgtttttctctgttatgtccattttaaatttgtcattatgtggtgcagcttttgtgaattctaacatctggatttgtaaacttaacaagtactagatataccacggccattgatatgtggtcatttggctgtatagtcgctgaactatatataggattgcctttatttcctggagcgtcagaatacgatgtcctatgccgtatgattgagattctcgggttagtacatctgattgaacttttccctcccttttcttcattacaaccaacaatttacagtgaaaataacttatattcaattactttgtaactgtctgagttctttcacttctgttcttaacttttcagaaatgttacaacattgcttttatggaaattcaaaagtgtttttaaacatgtttgcctttttcttatacagtggacaaccaccagatgatctgctacgggaggctaaaaatactgggagattttttaagcaagttggaagtatttatcctggtattgaaatgcagaatggccctatcagtgcgtacagaatattaactgaagaggagattgaaactgtaatatttttattttttttaaggttacatatttgtcctgtcctatacatttacttcattattacttatctataccctgtttacatcctgcaacacagagggagtccaaaaaaccaaaagtaggaagatggtatttccctcgtggaaggcttgacaaactcatatatacatacccttggaagaatttgaatggggaaaacttgccaggtatgttttgtgatacttatttttaaggatggagctaagtaggtttacagctgattttgaaactgtgtttattctagaacaatctcagctagcagtgatcaatatggcagacccagtaattagcgtttcttgcggaatacgtggttcatttggtgtgcattgccttaaggtttattgcctttggtgtacgactatactgtggcataaattataatgggtgcccaggaagttgcagtagttgttatagaactgatagtgttgcatactatagcggtaccttttgggaaatgatcaacctagttaactataccttatttccggttgcagttctttattaaacaggtgtatgaacaataggttagcaatgctggcacataccagaatcatgcaagatactaataatactggtgaacttagaattatttcttagtattagtctcttgaatgataatatcctagtccttatgatgaagttgcaggtttgacattatcttctcacctatttcaattttgattca

SEQ ID NO: 35673 - DNA, 171 bp, Oryza sativa
gattggaacatagggttggtgggggcggcggcgcctccgcgtgctggtggccatgggtttgaggtgggacaaggcggagaggtcaacgagaagggcaaggagcgcaccgacgagggagaagaggccggagaaggggaagtcccgccagaggcgtcgcgtggcaacgacgca

SEQ ID NO: 35674 - DNA, 634 bp, Oryza sativa
tttcccgctactcctacctcgccgccgttcgtcggctcgccgtcgtgcgtcgccggccgtcgatctccccggtggtcaactgctgtcggtccaagatgacatcgctgcacactgacatgtgagtcccaccacgctgagtcagcttgtcaaccgggtcaacaacgtcacgtcggacgaaaccgccagcaaaaccaccgagagaggtgatttgctctggttttcatagatgaaggaggcattatacccggttttccggttggggatgttatttacacaagcgcaagagatgagggaggcaaaatggacttattccgcagttgatggcttcatgccaagcaccacgcccaaactgcgaccgcggatcgagcccgcgggcggacactgttccgttcgtggctgtgcggccatctccacgactccaccacctccacctgtagcatcgctttgatccatggaacaataaagaactcttgcctgcaactgtgcgtggccggtggcgatggcgactctaccctagtgtattctccgctctgccgcctccaccaggaccaccaccaccttcgctacccggcgccgtaccctgcgcagccgcggggcacctcggcggcgtaacgaggcgagggggatcggacgc

SEQ ID NO: 35675 - DNA, 928 bp, Oryza sativa
tttgctccgcccgcgcccggagacgccgctgctccgcttgctccggccatgcaccgcccacgctcggagccgccgctggcccgcagtcgcgcttggccgctgcttgtcgccgccgcagccgcgctcgcccagacactgccgctccgcctgctctagcgtgctgacgccgcccctccacctactccagccgcgcgctcgcccatcgccgctcgccgccggcaaagagagaggagaggaaagagaagaggagagaaaagagaagaaaaataaactgcagctgacatgtgggcctcataattttaatattttttttgctgactaggatgccacgtaagcgaaaccacccacctatactgcgaagggacctcctgtgaacggtttgaatgagtttaggtgcgaacatttctggttttgtggttgagggacctaaaaaaattctcgctgttaagttgagggacctcatgtgaacttattccgcgtctggagtacctcgcttgggcctaggccctcggtctatggatggactgaaagaaagttcagtacatgccacagacggctatttggatttgaaaaaaaaaagagtccatatttcccccctttcgccggagcacttaaccttctatactatttattcgctcattttgcaccacgaactattgaaaatggctcaccttactccctaatgatatttgtcttcttcttttctctatatgtatgtcatattttgcaattaaatttgatgacattgatatacgcattataatttatatctcaacattttttgattttttttaattgttgtagaggttggaaacactcatactaatttaaatttcaagcaaatagttttgaaaaaaaatgaaactattttagaactctgataatggtgtcatttgtggctctgcaaaatataagcttaaaatatgac

SEQ ID NO: 35676 - DNA, 1501 bp, Oryza sativa
atttgatcgaggaaacagctaggaaagaaaacaatgacaaaacattttcagatcaataattaagggcatgtttgggatggaggatttccaaagaaaaatcaatagaactgaggaccatagtatattttttttttcctataaggctgttcggaatggaggaatggaccctagaatttctttggaagcaacttctatgtttctgtattctattagtattctagtacaaaacaaaagaaaggaatggaccctcgaattcctttgaaaacaactcctgtgtttctgtattctattatattctagtaccaaacaaatgaaaggaaaacaaattaaagtaaagggaaaatgaggtcaataagtttataaaaccataaactgaaacttattgtcttgttagtttaaataaaattcttgtattccaaacaactcatctacataaagtttcccatattttctaatcttctgttttatacttgtgcattcatgtgttttgttttcctatggtatatataatatatatgaatcaccaactatggttgggtactatcaaacaatccaaacaacgatctaaaccacgacacaatcaagaacacattttttatctgacggtctgacctaacaagagtaacctcaagaacatgcgctcgcttctgatctttcgtgtcctcgtctttctgcttctgctcattggccttccagtgtccctccactgtacaccatgtcatcgttagccttcacatcgcaggccgaggcttccaccgacccggccatgtttgcacgcccgatcccctgcgtcggcgtcgctgctcacctcgatcaccacccccaacccagtctcggagacgccatgggtacagcctcgaggctcgagctcaaactgttgacgggctgaggcgacggctagtgcggggcgacgcagggctctgagctggagtattccgtccccgaggttcgactcgactcaaacactgccggcatggcggcatggtgaagagcagggaacttcacgaggcacgaccgaccgggccgggctgccgcgatttgctgctggcacactggcgctacggcagctgctgatcaaagcaccggaggggaaagagaagtacgcgctgcgagggtggcacttgagcctggagatgctccaagaatcttgtcccaggaggccgatatatcggaagtggattttttttccctcgaggagggcatcccctcgttgctgtgtctctgttgttcaaaaagttatcaaaaaaaattaaaaaaaatatcaaaatagaacaatatatgatatatcttttttgcaaacatgcgaattaaaattcaacttacacaatttgaaaaaaaaacaaatttgaccgtgaattacgtgttctattcaaagtaaaatttattgtttttgtttctacttatataagtggaatttgaatttgcatgtttgtaaagtgacatatcacatattaatttatcatactaattgttttcaaattgtttttatgattttttaagc

SEQ ID NO: 35677 - DNA, 1501 bp, Oryza sativa
gaagtacaaggtagtgaggctttttgaagggaacttgcttgagaaggaatttttgaagtgtgagatatacacacttgggggcgatgaaggggatatttggaggcctgccgctggtggagtacctttccggttctacagttttgctcgttctgctatttccaatgcggtgatgaacaaactgcagccacttttcttcaatggatatctgcactggttgatcaacccattgcatcacgttaaactaccaagagcttctattttatcattttctctcactgatgaaaccttcagatggatccgatcaccaccctttgtggcatctggagtgcatttggtggagcttgatggtaatctgtgtatggtccgagaccttcgtgataggtcaactgctgtttgcaagttggaaatttggaagcttaaggactataactctggtgattggtctttggatcatcgaattgatttaacagggcagttgcctagggatttacttgagccacagatagtgaaagttatcggttccgctggtagttgcagatcaggtacgaagataatcatcgccacatccaagcacaaagtttgttcctatgatcctgtttctagaactctggaaaccattacctcaatctcggagacctgcacatcctatcaaaatgagaaatctgatattagattcagtttatttaaagaatgccttaccccagtgcataaaacaagggaagagattgccttcgcaactcccttgtctaaggctactaaggagatcctactccgactcccggctgaatcagtcttgaagttcaaaccagtctgtaagcaatggcttgggctgataaagagtgaaagatttatccgtgcatactttgcacacaagaacatggacaagaggccaaaaatcatgcttgtgggtaagggctctggaaaatcacttttcaactttgttcccttaagtaaatggcttcaagaggcatccaatcaaggcacactgtttcttgacacaaaggtggtttgctccaagccttgccgtggattgaatttgatgagcttcgtggaggaggactatctgttcaacccgtgtacaggttaccacagggtctactggaacagagagtggcatcagcaccaaccatggaaaatgcctacgggttgccgtgaacaagaagacaatccttttgcagttggcaataagaatgttggtttggggttcagccaggtgattcaggatcatgttgttgtggggattttctatgaccggaaagactacaactctcgtgagtattctttaacatgttctctatggagctgtggttctggatacttcgagcaactcccgcagccacctctgcctgtgaatgacatgccacctgtctctgtggatggagtgctgtactggatgagcgaaccaaggttgggtcagagttatgaacgagccattgtgtcttttgacattgccgctaagatatttgaagtcatcccttgcccttcaagcattgcaatgtgg

SEQ ID NO: 35678 - DNA, 278 bp, Oryza sativa
tgctaataagtgatttcgaatcaacgtatgaataagcgaaacaatggaatggcctagtaagagatttgttcaaacatccctttcatcctccaacatgaggtcgccacaatgccacttgccatttttctggaccgtaagatagttgtccaaataccaaattagccaaacagtagttgcgtatcgggatttataatgacgaactgttcaaagctttattggacttcacctagatcaatccggttgaggttgacactcactctctccctcgtgcattcaga

SEQ ID NO: 35679 - DNA, 1501 bp, Oryza sativa
acgttgcacctgtctccgccgggagtggaggcaggtatgggctgtcccatcaaagtgtcatttggacggcaaccataccgatctccgtccataaagagaagaaaagtccagtttggaaaggggagggtgcatgtggtatccccttgaagtaaaaaaggaggacctggcccatagagaagggttggttgattcttgagagattcagagcctagaacgagggagagtttagctcataccttgtattcccttcattcacagatccaccaaagaacacaggagtagggtattacgcttcccagcggcccgaacctgtatacatcgtccgtgtctcgtgttttttcctgggacgcgatctttccacacacagcgagagcttgagatctcaccctaagcccccggccgaactggcaaaggggggcctgcgcggcctcccggtgaggagccacgagctccgtcataatatatttgtatagagagcaagggtgagtattttttactccaaaagccaggggaaagatgacatgtttagcttagtcaaggaggctagggcttacgaatcttttaaaagagttgattcacaaaagcactagtttgtcaagttttacctattaaaaagaggctcacacataagcaaggagcggtcacccttactcctagcaacatgggaaatatagaaagagagaaaccaaagagtctttcagcaaacccaactctcaatgatgacgctcgttgcaaaaaaaaaaaaagaagaagaagggaggaagaacttaggctctggtgggagaaaaaaagactagcggagacattgccaaagtcaatcgccaatgtgtagcccttttttcctttatatctgtaaatattgttttttcctactatattcaacggtattgacacgcctcggtgctgatttgttcaaaaaaagaatcacatggctaatcattcatatgtgctaatccaatttagggtatatcaactgcttttggctcataaattagtgttcccagctcttctataggagtgcatgaaacatcaacactctagcggtactcaagccaaagctagataaaccaaaacgcagtaaaaagggttaacaattttggggaaaaaaagagagggaacccataattcaaatttttggaaatatcgggatgaaataagttgtattctaaacaagttttggtcaaatttgaatcttattttgcaaaatttcacaacattttttatgcaaattttgaacaaaatagttttcgtgtgtgtgggaatttcctttagaaacagaatttcaaacccactcaaatttgaacatgcaaaatacggataaaatgtatcttgtattcttattccacttttcatcgagtctagtacgtacttttactttacactaggttatattgaaataagtttcactagtacactaggttgcagcatataattaaagaaaaatcttgtaaaatattggtacaacttgtaaacccttttgatattaaattttatacaattt

SEQ ID NO: 35680 - DNA, 1501 bp, Oryza sativa
atcattttctctcactgatgaaaccttcagatggatccgatcaccaccctttgtggcatctggagtgcatttggtggagcttgatggtaatctgtgtatggtccgagaccttcgtgataggtcaactgctgtttgcaagttggaaatttggaagcttaaggactataactctggtgattggtctttggatcatcgaattgatttaacagggcagttgcctagggatttacttgagccacagatagtgaaagttatcggttccgctggtagttgcagatcaggtacgaagataatcatcgccacatccaagcacaaagtttgttcctatgatcctgtttctagaactctggaaaccattacctcaatctcggagacctgcacatcctatcaaaatgagaaatctgatattagattcagtttatttaaagaatgccttaccccagtgcataaaacaagggaagagattgccttcgcaactcccttgtctaaggctactaaggagatcctactccgactcccggctgaatcagtcttgaagttcaaaccagtctgtaagcaatggcttgggctgataaagagtgaaagatttatccgtgcatactttgcacacaagaacatggacaagaggccaaaaatcatgcttgtgggtaagggctctggaaaatcacttttcaactttgttcccttaagtaaatggcttcaagaggcatccaatcaaggcacactgtttcttgacacaaaggtggtttgctccaagccttgccgtggattgaatttgatgagcttcgtggaggaggactatctgttcaacccgtgtacaggttaccacagggtctactggaacagagagtggcatcagcaccaaccatggaaaatgcctacgggttgccgtgaacaagaagacaatccttttgcagttggcaataagaatgttggtttggggttcagccaggtgattcaggatcatgttgttgtggggattttctatgaccggaaagactacaactctcgtgagtattctttaacatgttctctatggagctgtggttctggatacttcgagcaactcccgcagccacctctgcctgtgaatgacatgccacctgtctctgtggatggagtgctgtactggatgagcgaaccaaggttgggtcagagttatgaacgagccattgtgtcttttgacattgccgctaagatatttgaagtcatcccttgcccttcaagcattgcaatgtgggaccccagaagtcgctgccatgcatttgtggtggagcttctaggaaagttgtgtgctgttctttcaaattcagttgcagatgagttagatatatggaagtgggatcatggtctatggactagagcatacacaatcaatttaaaattctggccagattactcacttgcaacgaatgttgtagtgcctatggcagttgaccttacagatggaaggattctgctgaatactgggaggaagcttggtttatataatccatttgat

SEQ ID NO: 35681 - DNA, 1501 bp, Oryza sativa
tctatttttttaatatactgacgtgtaattcttttgcacgttcgcaaaaaaaatatatcaaatgaccctagtgtaaagtgaaactacgtgctcaacttggtgcaaactgaaacatggtgtattttatccggtgacagaacgaagtgctatttactgttatagtgttatatgatgcaaaatcatctgaataagtaacatcttactaaaaccaaagcctacatatgccagtgtttctggcagccaaagctgaacttgcaaaatacaaaactaaataattataaaataaaaacctgcatgtctgcaccagccttttgtcctcctcgcagcaattttatcctttatgcatctcaacacttctcaacttgcagaactgaactcagcctttatttgccttatccctaaaaaagatgatgctacagacgctgatcacttccgtcccattagcctcatgcatagcttcgccaagattatcaccaaaattctggcaaatagacttgctcctcaactaaatgaaatgatctcacaaaatcaaagtgcttttgttcgtaaaagggcgattcatgacaattttctgtacgtccaaaacatggtgcagatgcttcatagatcaaaaaaacagagtctattcattaagatagacatagcaaaggcgttcgactctgtgaattggccatatctcctggaggtccttcgtcatttcggctttgggcatcgttggttaagttggatctctaatctgttttccacctcctcgtcccaagtgctcctaaatggttccccagggatgagaattaatcatgctaggggactccgtcagggagatcccctgtccccgatgctgtttattttagctatggagccttttcaccggatcattaaagcagcggagagtgccaatgtgttagccccgattggcatgagaagtggcagattcagatgttctctctacgcggatgatgtcgcagtttttgctctcccaaatcccgatgacctgaatgctctttctcgcatcctttcgtgttttgcacaaatttctggtttacattctaacatcaacaaaactgagattttccccatcagttgcaatggaatcgacttgaaacagcttcttgccggctggccagggcagatcaagaatttcccttgccgctacctaggcctcccgctccacttcaggaaattaaggaaaattgatttccttcctcttatagacaagatcggggccagactaccagcttggaaaggtcgcttctttacctctgcaggtcgtcaaaccctagttaactcggttctgagtgctatgccgatgcatcatcttacagtcattcatgcgccaaaatgggtcttcaaaagaatcgaccgtttcagaagatcttttctgtggaagggcgaagaccctgatcattcaaatccaagtgatagtctagtcaattggcagactgtttgcaaaccgaaaagcttgggagggttaggcctaccggatctggacaggttctctaga

SEQ ID NO: 35682 - DNA, 331 bp, Oryza sativa
attttgttcctgccatcttgcctcttgttaatgcacttttgatctggagctctctgcaaatgttgctgctagcttgtcccaaacctttctatagttttatggggtcatcgtttttaaaagtttcagaaaaggaaacataaacagccagccctgcagaaagaaaatttgtgtcctaaaaaactgatgagttggctgtctgatctatacctaaacattagtaactgctgacacattagcacctcttcgttttcttttggaagttatagaagaactgatcagataatatgtcccaggctttttgaagttatataatttgccattgttttggacc

SEQ ID NO: 35683 - DNA, 1501 bp, Oryza sativa
gcaatgcatgaatatgatggcttacattgatctgtaaacccaaaactctgtgtgttatttggttgaaatataggagtatgtgattcatcaattcaaatttactagattttggtagtctgatctctatatattgtatacactttcgtttctttctcctactgggcatgcattggcgaacccgcaatgtctaatgcgcacgtttggaatttcggttcgaaattcaaaccctcccctgacacaaaactatgtccgacttgtgtgtgtgtgtgtgtgaatttagcaaattttatttaaattcgatcaacattggaaatttgagcaatatttatcaaatttgaataaattttgctaacttcacaatagtttgttttgtttgaaatttatgggagggggattgcaaggtacggcgggttcacgtcggcgcaggacgtgtccctcagtccctcacggagaacgcccgtggtcgcggcgctcgactaccggctgatctgccagcgcgcccaaccgcggacgcattcgagacttcacccggtgcagccgaggagaggaagaacggccgacggcgggtgcagctcagctggcgcgcgacgtcgccgacctgtcgctgatcaactacggctgcctggctaccagctgccgtcactactacagatccgggcttcagtgacgggtcatctgtgacgggccaacgcaactcgtcaaagatgagtcatctctgacgggccgaaaaaatatcctcttcaatatatggctaccagggaggacccgtcacagatgtgaagtcatctgtgacggcttgcacttgtaacccgtcacagatcgttgtgacgggtcacaaccatggctcgtcacaaatgacatgtcatctgtgacgggtgtagtattatgaaccatcacaaaagagaccactcatctctgacgggtctttaactaacacacgtcacagataacgttatctctgacgggtggtagttatgacccgtcagtgatgagtgaaaattcaaatttttaaattttgcgaaaaacctcggattgaaacatgtcctatataaaagttgtagctctcaatgatatccacaactttataactaacaacatttctattagagatcgtttacatccccgaagatgcattacaagtgatcagatctacttttaaaaacaaaattttgagttttttttcaaatgacatggatggatacatgccccgtatcaaagtcatagaactcaatcagatctacaacattataattgaaaatattttcatttcacaaaatttacatgttataaagtgagatatattttgaaaaatgaaattttgaattcttcaaacaacatctgatgaagatattttctatgtaaaagttataaaacacgatgagatctataactatttagttgataatattttcatttgaagtcatttagggtgttaaatatatgttaaatgattcagacaagcatagacaaaataataacattggattagtagtcaatatgt

SEQ ID NO: 35684 - DNA, 283 bp, Oryza sativa
cattcgccctcgaattgaagaacttgtctctaaatttagtgttcgagacttggtcgaggagttcatttatcttggtattcgacctctttctgccaactggactttatctcttggtgaaattcctgagggttctagttctttgcttcctcctttcgagatatctgcgaatagtaagtgtttaccttgtatatgtattttttatttcaagcattatatatatatatatatatgtaattcatttttttcttctttttttcttctctttttttcttttttttgcagc

SEQ ID NO: 35685 - DNA, 1080 bp, Oryza sativa
tccactccagactcaactcatggagctaaattcaggagttgaagctgtaccaaacaggttcttagattgtttacggagttagagattctcgaagtaactgtagctatttaaagttccctaaaacagggccagcatgggagctcttgtgaccggcgaacagcagtcaagacatgcaagaggggggaagtgatccatggacgattggtgtgatgcatgcccgccagaatttgctgttggacggtcatcaccggtgcatcaaacgcaaatcatgcgatggcccggatcgaggcagaaaggagagggataaagggcagcatcgatcagagcggccgacaagtcgaaagctagctcaggagcaagcaacataggagtactagtgtagtaccacctccgttataattttttacattataagttattttaattagtctatatatatatataaaaattagcaatatttataatatcaaattagttttgttaaaactaatatttaatatatttggataatatgtttgttttatgttaaaaatgattatatatttttctataagcttaatcaaactttagaaattctaattagaaaaaacaaaacaacttataatatgaatgggtggggtagtatccatctctactctctctcacgcactggaaaggggaggtaagagtagaagttgtactactgccaccacgcaataacacaatacacacaacccttaggtcttgtttagttcctctaaaatggcaaaagttttactgttttggagtactttttgttaaaatggatctaaacactagtagaaaatttagcaatttaacatttgttatttgggtgtctagagtagtaaattttaccaaaaaatatgttgggagccgtgctatctctctttactagtaaaatgataaaactttaccatgcatctaaacaccaactagaaaaacttcaataccaaatcttttaccaccaaaacttttaccaaaataatttttccacaacaaactgatctaaacatgccctcagtatctcacactgacatgcacatgtacactgtgtgtgtgtgtgaatgctccgtatttcac

SEQ ID NO: 35686 - DNA, 1501 bp, Oryza sativa
gagaattaatcatgctaggggactccgtcagggagatcccctgtccccgatgctgtttattttagctatggagccttttcaccggatcattaaagcagcggagagtgccaatgtgttagccccgattggcatgagaagtggcagattcagatgttctctctacgcggatgatgtcgcagtttttgctctcccaaatcccgatgacctgaatgctctttctcgcatcctttcgtgttttgcacaaatttctggtttacattctaacatcaacaaaactgagattttccccatcagttgcaatggaatcgacttgaaacagcttcttgccggctggccagggcagatcaagaatttcccttgccgctacctaggcctcccgctccacttcaggaaattaaggaaaattgatttccttcctcttatagacaagatcggggccagactaccagcttggaaaggtcgcttctttacctctgcaggtcgtcaaaccctagttaactcggttctgagtgctatgccgatgcatcatcttacagtcattcatgcgccaaaatgggtcttcaaaagaatcgaccgtttcagaagatcttttctgtggaagggcgaagaccctgatcattcaaatccaagtgatagtctagtcaattggcagactgtttgcaaaccgaaaagcttgggagggttaggcctaccggatctggacaggttctctagagcactccgactccgctggctctggttcaagtggaaagaagttgataaaccctgggtaggcatgaatgtgccttgcgatgagatggacacaagactctttcaagcggcaacgataataacgattggtgacgaagcaaaaactagcttctggcatgataattggatccaaaaccattgtttaaaagatattgtgcccagttgttttagcctggcaaagagaaagcaaagaacagttcagatggaaatgcgagataatagatggctcacttccttcagacaattctcttccgtggaacaaattcatgatttggtacagcttggtggattactccaattggtttcgctttcccaggatcctgacgacatcacctggaattggaccgagtctggcgtctacacaacaaagagtgcttaccttttccagtttgaatgctcatttgccaccaatgagtttgattctctttggaaatccccgactgaaccaaaaataaaattctttggttggctagttctccataaaaaaattttgactgcccaaaatctgctccgcaggcattggccttgcaattggatatgttgcctttgtggttgtgcctttgaagatacaaatcatttgttcagtgactgtgtgtttgtcagacaagtgtggaccctaatttgtcaattccaaaacttgtcttcggtcggaataaatcctgtcctggatgtgtcaacatggtggtctggaaccaaatttgcaggctctaagaaggatgtgcagctggtcaggggaactcttctaactact

SEQ ID NO: 35687 - DNA, 171 bp, Oryza sativa
tccactccagactcaactcatggagctaaattcaggagttgaagctgtaccaaacaggttcttagattgtttacggagttagagattctcgaagtaactgtagctatttaaagttccctaaaacagggccagcatgggagctcttgtgaccggcgaacagcagtcaagaca

SEQ ID NO: 35688 - DNA, 1501 bp, Oryza sativa
gagaagtggcagattcagatgttctctctacgcggatgatgtcgcagtttttgctctcccaaatcccgatgacctgaatgctctttctcgcatcctttcgtgttttgcacaaatttctggtttacattctaacatcaacaaaactgagattttccccatcagttgcaatggaatcgacttgaaacagcttcttgccggctggccagggcagatcaagaatttcccttgccgctacctaggcctcccgctccacttcaggaaattaaggaaaattgatttccttcctcttatagacaagatcggggccagactaccagcttggaaaggtcgcttctttacctctgcaggtcgtcaaaccctagttaactcggttctgagtgctatgccgatgcatcatcttacagtcattcatgcgccaaaatgggtcttcaaaagaatcgaccgtttcagaagatcttttctgtggaagggcgaagaccctgatcattcaaatccaagtgatagtctagtcaattggcagactgtttgcaaaccgaaaagcttgggagggttaggcctaccggatctggacaggttctctagagcactccgactccgctggctctggttcaagtggaaagaagttgataaaccctgggtaggcatgaatgtgccttgcgatgagatggacacaagactctttcaagcggcaacgataataacgattggtgacgaagcaaaaactagcttctggcatgataattggatccaaaaccattgtttaaaagatattgtgcccagttgttttagcctggcaaagagaaagcaaagaacagttcagatggaaatgcgagataatagatggctcacttccttcagacaattctcttccgtggaacaaattcatgatttggtacagcttggtggattactccaattggtttcgctttcccaggatcctgacgacatcacctggaattggaccgagtctggcgtctacacaacaaagagtgcttaccttttccagtttgaatgctcatttgccaccaatgagtttgattctctttggaaatccccgactgaaccaaaaataaaattctttggttggctagttctccataaaaaaattttgactgcccaaaatctgctccgcaggcattggccttgcaattggatatgttgcctttgtggttgtgcctttgaagatacaaatcatttgttcagtgactgtgtgtttgtcagacaagtgtggaccctaatttgtcaattccaaaacttgtcttcggtcggaataaatcctgtcctggatgtgtcaacatggtggtctggaaccaaatttgcaggctctaagaaggatgtgcagctggtcaggggaactcttctaactacttggtggaatatttggttggaaagaaatagaagaattttccaaaactcttcttgttcagatattgaagtagcttattttatcaagcaagctattgatatgcgctgcttggcctttaaacccccatgaattttt

SEQ ID NO: 35689 - DNA, 233 bp, Oryza sativa
tacagccattgccatccgccgtgatagtgcgggcgttcggtggcgcgtgcacctcgtcgaacgcatcgacgtgttaacggtaaagtaaggcatcaatcagcaggatgatgagtgttaagtcgagtcaccatcacttgcgacgatgccaaaagaaaagaaacaccgaagcttcggtagttaggagcatcaacaaaagcatgacatctcccttagctcttttccaattccaaagt

SEQ ID NO: 35690 - DNA, 1024 bp, Oryza sativa
atggtggcagttttcttggaggagaaggaggtgacgagcaccaacctatggtgatcttcgttgtctccttttattttcgatcttacttatcattcttctccaccttgttcctgttgttgcgtctactgctgcttccgtgtcgctgctgttgcggttcgcatggtctctgttggaggaggtggtaatctgtaattctgtatctgtccgtcttcttgcaactggatagtgttcatcagttcatgagttcatccttcatcgtagcacccgtttctacctacgcattttcttgatgtttcttttcctggcgttatcgatgtaaacatggccgctcgatgatctatatctgctcgtctctatcgtttacttattttggtatgtttttccagattctttctgcgtgtaggtgtgctttcctctctttttttttcccacactgggttttgacgttctgttgattcctcttattcttgttgattcttgatgatgctgtgcatgcggaaactcggtgatcttgatttataacctgtccgttcttgctgttgagtgccagcgagcagtgttactctgtttttcatgaaagtacttttcattcagtagatgtttacatccatagatgtatgagtctcttagttcttacttactatcaagcaatcaagttcaagccatctttatttgcagctcacattaaatggtctaacacttgatgatgtttcacttccccagtatggtgtgaagtgcgattctgttaagtagtttgttacccggcaccaggtgttactgaaatttgagtgggaaatcttagcctgtgattatttgtcccctttcatatcgtgtgcactgcaggctgctgcatttgttcttggcacaaactttggagtttttatttttgttctgaaatgctgaagccatttttcatggtcttcttaagtcttagtgaccctgatcagtattgaacaatgtttggttcaacagatagtacaatagtgtgttcacattagtccttacaggaaagaggcttctgcca

SEQ ID NO: 35691 - DNA, 1501 bp, Oryza sativa
cggatgccggcgatctgcgccgcgcgggtgttccagctgacgcgggagctcgggcacaagaccgacggcgagaccatcgagtggctgctgcagcaggcggagccggcggtgatcgcggcgaccgggacgggcaccatcccggccaacttcacctccctcaacatctccctccgctcctccggctcgtcgctctccatcccttctcacctccgccttgccggcttggctggccctcgcttcggcggcggcgcgcgggcggcggacgcgtgggaccgcgtcgtcggcctcgggttcggcggtgcggccgacgccccgtcctccgccacctcctcctcctcgtcgccgcttctgctgagcttccactccggtagcgtcggccttgacgtgtcgccgccgtcggcgtcgacctccccggccgccgccgacctctcccggaagcggcggtgggagcaagaaatgcagcagcagcagcagtaccagcagcagatggccgggtacacgcagagccaaattcctgcgggcacggtgtggatggtgccgagcagcaacgcgcaggccgccggtggcggcgctccgccgggaggcggcggcgagtcgatttggacgttcccgcagtcagggagcggcggcggcggcggcgcggcgacagtgtaccgtggcgtgccaagcggactacatttcatgaacttcccggcgacaccaatggcgctgctccccggcgggcagcagctcggcctcgccggcgccggcgggggtggcgaggggcacccggggatcctcgccgcgctcaatgcctaccgcgcacaggccgcgcagccggacgccggcgcggcggcgcagaatggagcgcaaggctcaagtcagcatcgtcagcatcagcatcacggcggcggcggcggcggcggcgacgagcggcatgagagcatgagcgccagcgactcgtagggcttccgttccgtccggtgtgtgccccgcattttctctggttttgatctgttcttctttaattttctccgtttttgtttgagttgttgtctactaatgtctatggctttcttcctcgacccatcatatattcatgcaaggatcatacagttgcattccatgccatctgcataaaaatatcttattgtgtgctcttaagaatggatcaccaatttcaccatgataaagctcttgcaagttgcaagtggtagggtttggttagaatgctagagaaccttttttttaaaaaaaatgaaaatgagaatgctagagaacctagaatcattaatcaataaatcattgctttggtatattgatcgatcgatgaggattatccaccaactaatcctcatccaatgcatgcatgcaagctagctagcatccattcgatctgccactctaaataatttcttgttggttatctattgcgtacacatttcatacatcttttctctgtcaccgtatatagcttttgcaagacaaaagtttttcattcgaattgtactaccggcatgca

SEQ ID NO: 35692 - DNA, 482 bp, Oryza sativa
tagttcaccaccatgtgtagttatgaatgtttttacgtggtgaagatttttgaattcttattttgagttaaatgttatgtccttggagaggctgaatctactgaaaagagagacatctgtcattccctgcactagctggggttttatagtattcagacaattatttaatttgatggtttggtatctgacaggcttaataagttggaaatgactgcaacgaccactggtcaccttatatatctgacttatactgcaagatcattcttcaagaaccatctcactaaatgaaacatttacacctgtaggaattgtgctaagatgtatcagtgttaatattgataaatgacagcaatctaccatatattatcacaatctgatatacgtttcccattggcaatgctatgtctcttccttttgtttcttctacagttttattcatattcacatagtaaacttaaatacatttttttttctctttcagg

SEQ ID NO: 35693 - DNA, 1501 bp, Oryza sativa; identical to SEQ ID NO: 26461

SEQ ID NO: 35694 - DNA, 190 bp, Oryza sativa
ttcaaatggagtggatttgatgtggggaggtgagggggagagagagggtggagagctgctgctgctcagctcgggctttttcttgggcgaaaatgggactggtgaggagaaaggtggtgggacccacagggtttaaggggtcggtccacagagaaggggcgcaccagccatgttggcgccgtggtatgtg

SEQ ID NO: 35695 - DNA, 398 bp, Oryza sativa
catttcccattgtgaaggtcagaccatgttacatgaaatcttccattcacatgcaccatcatgtgttcaatgttggtcgtgattgttatcatattgaaactagatttgttgatttattttttgggggtaatgctgactagctgagacaatatgggaaaattatcacctcatgtcatgtttcaatttttaatatgatagccatagttatgagtacaagcatcttctcctttttcatatggttctgtttatattacagtccacatcagcaagcattttctttccatatgtgatttgtctttagccttaagcaaaaaatatgcactggttcagtggtttatccaccttttacgcttttgtgctagcattgaaataatgtctatctttaattaattttcagg

SEQ ID NO: 35696 - DNA, 1501 bp, Oryza sativa
ctttagggggaggaacatgcatgacaggcaaagaagatcgtctttcttcatattgatgtggctgtgtttttccttcatagtggtgcatctcttcaagaggcttctgtggagctggttgaggtacactcacagactcaaatagagctattagcctatggacctgcacaatatcatgtaatacataagataaagtaaatactaacatctatgatttgttcttttaaaactttctgttttgaacaaaattcaaatgacactcacttgtctagagttgagctcgggattgaacttgctctttgcactatagttctctctgattgcatccttaaatctgctctcaggaagtggaaggcaatctttatctatcttaaatttcacctgtggcgagctcaagcacaaaaaatagttttgagtacaacgaaaatatcaaatcttcaacactaactactctagatgaagcccattttcaaacagaaggttgtgtggaatcttgtgcccatgaattcgtgcttgatcattgaaagtagataacagtccaaatatgcaattgtgaggtcttaaaagttgtgcacggaattggcaatggtggtcctaatatacatgctgtacagtcttatgtaagaaccacttgtacaaactttcgtgactttccatcatatggtttcccagatatggtaaattccaactaaccaatggaagtgcagtaaaaacaaatcgaccctcacagagttacagttatatctgaaatgacaacttgaatataaaccaagcatcaaagaactctatggacataaatggtcacaagcaaatcctgttattaagaaacaggggcaatgaatgttctcttagcagtctatcaaatcattcagtcacattacttacagcaccacctgttttcttaattaaagcaaagatgaatatagctagctagtatatctacatctgtttcaacagataaccaatgcaaatgcacaattcaagttacagctgatgatgatgtctaatgcatatgcatcaatcttccgaaaatggaaatgcaatatgtatcgacaacagggttattttgttctcagaaacagtgtgaaccagaaagataccatttctactatcgccaatcataggtttgtgtacaaaaatcattggtgcaccatagtatcaatcaatccccaaaatagtatgtacacccttaagtataaaaacataaaccccaaaaaaccatattcacttcctctttaaaaaaaacattcacagcatatgagtttgtctacagcgatggaataccagaattacctgtgcagggaattttccactgaatgcatctcgaacaagatcaagcccaccctttgatactgccttgtacaccccataaagtagcttcaagtcaaaatcatagaggaacaacctcatccctggtcggatcttctcaactattccgattttccctctgggatacccaaacaagcggctctgaaagcattctggtttagtctgcgcattacac

SEQ ID NO: 35697 - DNA, 456 bp, Oryza sativa
tgcgttgcaataggattttaatcaatgaaaattaccattaacctcgttattaccattattctttgtctacatctcttaaaaagttagggagttggtactggtggaggttgtagattcagctctcaccaccaccactattcctttttaaaggagtatagattttggacccttactgtcctctagctctcctatctatttcttggcatagagctagatataagctgctaatctcctcacaagttagttataagttatcagcaaaccaggacatgttgaagttggagaagaagaatgaggttgaagatgaaacaaacggtaagaaatgatagtctaaagggaaaaatacaggttaagagatagtccaaatgatggtctagaatgaaattcactttttagaaaaggaaaagtacgaattaccccctaaactcttgtgacagtacgaattacccccctgaa

SEQ ID NO: 35698 - DNA, 1501 bp, Oryza sativa
cgaacatacgcgctgaacaaccggccgcttccgttgggtaggaagaaaacttccaagctggccacttggccagtggacagcaccgcatgcactacgccgacttgaccagtttatcaagttattagcaaccgtatgaaaggagcatcttttattcccttgtcccacttactaagacgcgaacgcatcttaagatttaactctttaaagagttaaatcttatttacatatttcatatttcatcaataaatagtttattataaattaaattttatttgatgaaaataatattattaattaccatttaaatttactttcatattattatgattttgttgctataaatattatagtatatgagaaatttaaagtaaaaaaattagtctcgaaggctatattaagtttgaccacgcattagtaagtgggacggagggagtactagattgactggcatccctcgatcagtccaccctccatccgtcataaaatctaacaacatgtattgtttaaatcttgtagcaaaatatatagtaacttctgcacctctatctttcatgtaattttctaacacactttttcatcttgatcaatcatagccatcctcgatcttttccatgtaactttttataaaataatagtgtactttattaattgggaatgaactgcaattgttttccgactcttaaatacttctctggaaagtacaataaaagttgtagtaggagttaagaaaaaacctactccctccatcccaaataaactaatctaggatgtgtttagttcacgccaaaattgaaagtttgactgaaattaaaatgatgtgatggaaaaattgaaaatttgtatgtaggaaatttttgatgtgatagaaaagttgaaagtagtataatgaatctggacaggtagactatgtcccatctaaatagtataggttggacttttttttacggagggagtatataacttaccaacacaacctatatggttgcaatattttcccgagcacacacaatactaaagctcatgtacacactgctataggcccaccgttctcacgcatatatacgaaaatgctcctatcacatgctcaagagctgaagagcaatggcaatcatatagttctcgaaaaagaaaaagcaagtcatatcatccgacctcatcgaaattaatcctatatactccatagatagtagtgagaggaggggaaattaaatgacaaaactaagggcccatttgaatcataggaatgaaaaaattgaggaataagaaaaatataagattctgatagaaatacaagtgtaaaacagatgattgcaaaacacaggaacgactgtttgattgatccataggaaaaacaagggaatttgaggagagataaagactcaaaaggattctttccatgaggttctacctcatgttaaatttcctccaaaacttacatgagaagagatattccatatgaatttcataggattcattcctttgattcaaagcgctatatagg

SEQ ID NO: 35699 - DNA, 332 bp, Oryza sativa
tcagggattaaaagaactgcacaaattaattaagagcagaggccatcggaatggataaccttcggatatataagaacaaaatgattattaggatttccatgtgagattagacagtggaagaaaatgatatttaaggataattcaccaggaaggtttcaatcatgaacaggacacgtgtccccatggagagagaccatacccctctgaccctgtagtccaatcccgggactaattgttcgtagtctaaatatgcttaatacggtcatattccaaagctagtgcagtctaatcgctttctttattctcttatcaattgccgcgttcttcaaaca

SEQ ID NO: 35700 - DNA, 817 bp, Oryza sativa
agcttctcaacatttgagaacccaaaacacatctaaaagtttgtgtcaagaacaaatgcagcagcctgcagtgcacatgatcattagaaggggagaaatattaaattcacaggctaagatccccctctcaaatttcaataatatcttctacggggtttcacaccatacacaggggaagtgaaacatcaataaatgttacacccaacagcaagaaaacggacgtacaggtagcgccattgagtaagagatcaatgggtttcccccgtgcgcagcagcatcgtcaagaattttccgcatgcacagcatcacaaaaattaacgagaacaagagcaatcaaaagagcgtcaaaacccacagttgtagaaaaaagggaagaacacccacatgcagaaagaatctggaacagcaacataccaaaagaagtaagcagagatacacgagacgagcagagatatcacatcatcgagctgccatgtgtacatcaataacgccaggaaaagcagcacgaaaaaggcattgatagaaccgggatgatgaactcacgaactgatgaacactatccagttgcaagaaggggcgcaaatacagatcaccatgggggtcgtagtgctcgttaggatctcctcgaacagagcacagaccaactgaaacagaaacaaacaactaaagcaatctccaagcaaaggagacaacatagatcaccataggtcttggtgctcgtcacctccaagcaatctgccaccaacgtcgaaatcagcaggaacagcaacaacaagcgcaagcaagacagaagaaaagagggggacagagatcacca

SEQ ID NO: 35701 - DNA, 1501 bp, Oryza sativa
tatagggactaaagtggcagcatctcccttggtccacgtgcctttagcaatttttagtccctggatccaaatagtatatgggactaaataatccaaaatatatcacatttcgtactaaatttatttattttaaacgaaaggagtatggatggatgcatgcacatgtattctcgggtgggcttggctgcccttcgtaagtacttggagttttgttctttttttaaaaaaaaagaaaataaagatacatattttttaaaatataattttctatattttgtaattgaggatgtggtgtgcatgggtgtgatgggtaaaattgtgtcttccgtggtgggatctcaaaatgatagtactcaaatccctccttcagtcacgaacaagtggcattttttatgcggttagcacatttaattttgacaataaataccccatcaaagttttccaaattttggtgcccaaggagctctgccaccactgcctagctagcgctgcccgaaggagctccaccgccccgagctctagctagccgaagagggcgttgctcgctaaattcgagcgcacactcgtcgttgactcatccaatgcgtctccaacctaggcttgcctctaccttgttcggctttctcgcaagacaccgcagtagatatgacaacggggaattcctcgccggagaatgcatccccatttttatcgatccacatgagtcaaacctttatgtgtcctcgtctcagcgaaaaataatgggggaaactttattcccatccccacctccgcatgggaattaatctctctgttcctgcttaaaacaatacgtacatatcaaattatatatgcgaacgtaaaacgcatattcacactttatattaatatatcaacatatatctactaattcacatgataaaaaaataatattaatatttgcccccgttcgtttccacttacaaaaatggattaagttttggatattcgtggcacgcttttcaaactggtaaacggcgcatttcatacgaaaactttttatatgaaaattgttctaaaatatcagattaatcctttttcaagtttgcaataattaaaactcaattaatcacacgttattaccatctcattttgcgtgaaacacttaatcttcattttcatcttcaggagattcaaatacccccttaacaaagattgaaacctatgtgggtctccgcaggggacggggaatgatcgaatgggggatcatctttgcccccatgaaacctgacgtgacataatttatctcgttcgacttcttatgcggaaccaattctaacctttcccgtcctaaagagaatttcccgcacataaatgggaaatgaggccccattgccaacatgggatgcggaggaagggcggagacaatgaatttgaccgtcaaggagagataaagaagatggtgttggccatctaatggatagagcctatatgtcatgatgtacagtgaaaataaagtattggggagctgcaaaagtagctt

SEQ ID NO: 35702 - DNA, 251 bp, Oryza sativa
tggcatctgctgagaaaggatcgtgtccgcgtaagttgggtcatcgtgcccacgttctgtaatcgcgtatggataaaagggaaagaaacagaaaatgtcgcaagcaagtaatatgcagcgccaaaaagactttcccaattggtttgttcttctcgcgtccaagcgtgtgtgtgttgcaggtttcactgcagttgccggagtttagctaacatcgtcccccacctcttcatcgacggcggcggggattgaga

SEQ ID NO: 35703 - DNA, 928 bp, Oryza sativa
tcccagactttggaggagtgttggtttccatcagaattcagagaactcctgagtgctcttggactagacactgagcatcacaccctgccttttaaagaggagaagggtggtgcatccatgaactaagcactagcagtgtgcagagctacaaccacaatggctgacacctctcgtgagctgtggtgacagtgagtagatgtccattcctgaaaagaaggggaaaacaaatcaaagaaaaaaaaaggattcgagtggagttgcacagagcagcaaaagcaagtggattaacccaatgtattatttttagtttctgacttaatagatatggttcaaagcatgagagaatcgaagatacgtataccagatgcagggagaggagtagagacgcccatgcaaaatgtgtgcaagcagccatgcgaaaagcagggaaacaagtgaagattttgctggtcatatattcttggtcttgttcagttcaaaacacgtgagaaactaggatatccaaacttttgaagttctgattatttttttcatcgcacttgtttcccttttccttggaaaaggctacagtattctgaaagtttatgcaatccgatcatcttataaaggtaggtgatgagttcattcttttgttcattgcatggcaccaaatgaaagtgatgtctcaatgcaagaagaatactctgaatttcttgccaccatgttgtacagagtatctgtcagtacgattagacccagcaaataatgtgaacaaagacttacaaagccgtagtaaaataggaaatgtgttcacataatctctggcaatactgaaaagaacgagatctgctaacaaatctcgatatctacccacgttttttaattaaagaggtgatggttatggaacatatatcgacacacgagtttctgttaattagatgctgtaaca

SEQ ID NO: 35704 - DNA, 226 bp, Oryza sativa
atgttctttcttttagaacttgttacatcaaacattaaaagcacaacacgtgcacaagggatacatttgttagagtacgcagcctgggccaccgaccatgtcacccagatcacattgggcctgctccaatacaggcccaaccggagccacaactttaggtcctgagcctacacaacccaaaagactagctccggtttggaacccggaacaatttccatgggtcaca

SEQ ID NO: 35705 - DNA, 979 bp, Oryza sativa
actcgtccatttctacattgttttcttggtgctcttcagcagttgctttcgctattggcgtgggatcccatggtatcatggtaatctgttggattggaggaggggctaacgagcacccgcaaccccatggtgatctctgttttgtctccctctctgtacggaatggtgttgttcttcttgagttcatcttccgttgatattcctgggcctttattgatgtgtgcatggcaactctacgtgttcttcatcttctcatctctcactttattctgcttacctcttatggtatgttgttgttccagattctttctgcatgtggtgatttgggtgctttcaccttctttcacaaatgtgggttttgacgttttgttgattcctcttgttcttgttgattcttgatgatgttgtgtgtgcggaaaactcggtgatcgttatctgatgagcgcttattgctgttgagtgctaacaaacggtgcaagagtaattatcggtgtttttttcttcatgaaattacttctgattcttttgatgtcaacatgtatttccaattatagatgtaacttgtaagttgtaggtccccctagtttttactttttactgaccaagcgatctagttgtttcaaggttcgatggtgccttattattgattttttaatttccccattatggtatcaagtgctattctgtaaagtagcttaataccagcagcaggtgttattgaaatttcagagggaaatcttagcctgtgaatagttctcccctttgtaatgatcatgtgccctgctggctactgtgtttagtttcgagacacttttttggatgttcttttgggttctgaaatgtggaagagcttgtcattttggacgctctcttctttttaagacgtagtgacttggatcaatattgaacaacatttggttaaccagattgtacatcgttgtgttcactttagtctttttcaggaaagcaagtcttgcga

SEQ ID NO: 35706 - DNA, 573 bp, Oryza sativa
cttatttatttgttctcgtaattaatgaactttctgagtctcttttagatgcaggcaatcaggttatattaaagggataacgacgacaggaggtacaattcttcattctctgatgtatgcaaataacctaatcactgtgggtcaggcaaatgatggagaagctactagaatttttcaaactgttcaaacttgttgtgctcaatctgttcaaactcctaactgggggaattttctattttctttagctcaagcactcctaatcaacaaaaacatcaaattctcaatatttttcatgtccctctgatagaaaattccactaaacatcttggtcaccctttgattattaacacaagaactagagcttctgcttataagtttattatttccaaattcaaagctcgtcttacctctcttaaagctaacatgctctctcatgctagccacttgtctttaattaaatatgttttcgcttcaatccctatttactgtatgtccacgattttacattctaagagcttattgaacaagttgacagctattattagcgcggttttggtggacaagagtgcataa

SEQ ID NO: 35707 - DNA, 440 bp, Oryza sativa
ttaaaaataactagtattggagttcagggttaaaaatcgaatgacgtaattgttgagggggtaattcgtggaaaaagatcttgtaggcttatcaaacagaccagcttatactcgatgcatgaatattttaggatcggataccaactccactactcgactagagtaatcaacaaattaaaacattttcttgccgaacaagcacagccacgtcgaaagatttccattctaacaccatacacgtgcctcccttatagcattccaatttcaattgcaaaaaccaaatccatttcttaatccgcaagaagatcagcatccgcaagaatatatattcatcgatgaatttatcatccatggacaagtagaagaaactcacagcaactcaccagcacagtagacgaagatcacaagcatggcgatgacgacggcggcggtggcggcgg

SEQ ID NO: 35708 - DNA, 248 bp, Oryza sativa
catttgtctaaaaaacgcatcctctctagaagttcctttcatgcatgcactcttaaattaaatcaatgaaagtttactccagttctgaacacatgtgcatggatctgcttcgttttgttatcaagagattgaaatctaaagtctacatatgaagatcgtaggatgtttttcgctgttcattcatttgttgctagaattgttattatgccctttggcctgtgccttgacgtatgcatgttaaccaacac

SEQ ID NO: 35709 - DNA, 281 bp, Oryza sativa
gggtgtctccaatgacctcaccgtcggccactgggccactgcactgtgagcctgtgagcctaccggtttattaatcggtttctagcacagcgcgtgtggccccagctttggttcgattataaaatctgtgcttataaaatattttgtccaaatcggagttgtgatcgcgtgcaggtaattctttcatacaaagtacaatattttcgatttgaacagtccccgtcaattatatgtttttctgagaagtttgagatgcgttttttgacaaatcaacaatgatt

SEQ ID NO: 35710 - DNA, 1501 bp, Oryza sativa
tgtcgcggaggccgtcggcgagttgcttcagcttggcggtgtactgcgtgatggtcatgtcaccttgattgatcgagcggaactcggtctcaaggtagacagaccgttggacggcgttgtcgcggaagacgccttcgatgtcgctccacacggtgaaggcagaggcgcggggcttgtagacgacgtcgaagatgttcttggcgatggagttgtgcagccaattgaccacgcagtgatccgcacggcgccactcggcagtgcggaggtcgagagcgggcggctcctgaacatgggcctcaaggccgaacttgccgaggaccgattcgaagctgcagcgccactggctgtagttggagacgtcgagatcgagggcgaccgggacgtgggagcggatgttgacggtttgaagaacagaggtggagggcgccggcacaggctcttcgtcagaggtggacgaggcgtcggaagcgccggagctgtgcgacatggctagcaagggagaggtagcggaagactaggatcagagggtcactgataccatgtagaaggagatttggatcaaccgtaactttcattgatcaatggagcttacatttatacatgtacaacaaggcttgggagttgcctgggcctaactaatcccctggtctaacggacgtgcagcggtgcgagcggagcgaggagcgctgcgcgtcgtgcgcggggtgcgcgtcgtgcgcgtggagcgcgccgcgagagtctgacgaagccgttcgccaacagggcgccttcggtgaattgatgaacaggcatcttggacattaggaagatcgcaaatcgaagcggattcgatcggtgcaacggtcttggaccgaaacatataattaatgatgatcgatccgtgtcctctccaactcgatctccaatggatgcgtcgtctgcgggcggcggcagtagcctccggcgcgtggtgaagccgcagcaacgatacatgcccactccacaagaggcgctccacaacaggtcgcgcctcctctccaacatccaagccttgtacacggacacctgcgcccgcctcgccgtcgaccactccgccggcttctgctgcgtcgtcctcctcgatccgagctccaacatcctcgtcaacgccgtcctttctgtctccgacgaggttgcggccgtggtggacgacgccgagctcgcgcggtgatccctcgacggcctcgtcgccttcctgctctacttcttcccctacctcgccgactgggatgccgtgcgctacctgctgcttgctgacgccgacctcctcgtcgccgcgcgcctcgtcgtcgcgtcgcgcggcatgatggccttctccatcacctccgctgcgtcggcgaaggcgttccagccggcgctcaggctcgccgcgcaggtcgccggccaccctcagcccgaacgcctcgtccatgtctggatgtcgctgtcgtcacgtctccatcaggaggtcaccgtgctctcggcggagccgaccaacctccaa

SEQ ID NO: 35711 - DNA, 1501 bp, Oryza sativa
aaagagcataaagatattcaggaaggaggagctaaagcgaattacaaaaacttatagtcatgttcttggaaatggtgcctttggtatggtatataaagggttccttgatgaacagcatcctgttgcggtaaagaagtccatgaaagttgacaagacgcagaaggaccaattcgcaaatgaagttattatccaatctcaagtaatccataagaacatcgtcaggctaataggttgctgccttgaggtagatgtcccgatcttggtctatgaatttgtttcgaatggtagcctgcaagacatccttcacggtgagaacaaagttcctctcactttagacaaacgtttggccattgctgccgaatctgcagaaggcctggcttacatgcattccaagacctcaactagcattcaacacggtgacgttaagcctgccaatatacttttggacgatcaattcaacccaaaaatatctgattttggaatatcaaggttaattgcaagagatgtcaccgagcacactaacgatgttattggcgacaacaactatatggatccagtttatcgtgaaactggtctgctaactaacaagagtgatgtctacagtttcggtcttgtgctctttgaaatcatcaccggtaagaaagctgtttatggtggtgaaagtagctttgtcagaaattaccttgacacatacttaactgagataagagcaaataagatgctgtttggtaaggaggctgaagaaaaggacattgagcatctccataatcttgttgtgatatccaaagagtgtttagacaataatgtggaccaaaggcccgagatgacagatatagcagaacgtctgcaaggcattattagatcccggaagtttcttaattgattcgcgcgcgaatggaggatgtgcttgtatccagataaagtatatcggtctgttagtttatctttatctacactagttctacaataaaatgttgcttgcttctaaatacctaatgtctatttgtcattctatttctaaatgaaatatgcgtgtaatttgctagcatcaattcccaaatgaagttgtatttggccataacctctgatcaaaattcatgtactggtatatttgttgattgtgtttctcataaaacaattctgaattttctctacaaaatgtattttatatgtaataatcaattaaatattttttatgattataaacaaataaatggtaccagtatattatttgctgaagattataaccaaataaacttttgaattctgaagattacctatttatcaactgtaaagatacgtactctctacagttgtcccttcgagactcagaacggtgacgacgcatgtaatacgatcgggggcatgtagtggccggcaacaagtggacatggcacagtggctagccgcagcaaattgatttggggcatcaggcccttcacagtgcaccgaacccctagtccatctttccaactgtcacctaagaaataggagatgaaga

SEQ ID NO: 35712 - DNA, 1501 bp, Oryza sativa
  unsure (1)..(1501): unsure at all n locations
ttcatgcacagatatatgcatgtcaacaagttcttgtacaagcatgtccactccaagcaccacactcttgtagtcccgtatgcctttggagctctctacaaccatccccttgagggcctcatcctggacaccatcggcggcgccctctccttcctcatcgccggcatgactcctaagacggccatattcttcttctcgtttgcgaccatcaagaccgtcgatgaccactgcggcctgtggctcccgggcaacatcctccatgtcttcttcagcaacaacagcgcctaccatgacattcaccaccagctctatggcaacaagtacaacttctcgcagcccttctttgtcatgtgggacaagatcctcggaacatacatgccttacactcttgagaaccgcaagggaggtggattcgaggcgcgcccgattaagctcaatgtggcagagcagagcaagaccgattaagctcaatctagcagagcagagtaaggccaattaagcagtgttcttcctgccagtgcacaaagctcatgtcatgttgtagtattgcctgatttttctaactacatttgtgttggtagtcagtagaagtctttttcatgttcatatacacaaacccttttgtgggggatgccatcttgtaccaaggtatagcaaataaagcattgtgttaaaaagaaatatctagtcagatttagtttcctctgaattgtgcctgttgcttctccatgctgatggacaaagtgagctgaaaacagcattacatgcagcagtgagttggccatcacattctcaaagctttattttttctgtcacgtactctagctaatggtgatgctttggctgtcattgtattctaaaaggagcagtgagctgtgctcatggaccaggctgtcggatgtgcaatgccagcttgactgaagtggctcaaaacagcaatgcccacagaaagcaagtgctccaaactgagtcagagctagcagcacactgaatgatataatcttcagtataaagactttaccttgaagagggatggcatttgtatattgaaatgggcctgtattgttatttctgagttctgacttagactgtcttgcatctgtgtgctcttgctttttttttttcccttctattgcttggtcaggatggcatttggagcctgtctgtgacncaaagaaatccgttttagttaattacacagtgcagatcatgctgttttctcgggaagaatttaaaattacccatcaagttcttccgttgcttgcaagttgccacacatgatgacctcgctctgaataatatggtcagccaatggagttctgaacttctgatggaccaccattttaatcatgatgacatcacactgctagtgccaagtagaagtgataaggttagcaccatttgaaggctacttatcatctggcaactgctctctcatggtacaattatctctgcttaattaatcgagtgataaaggcacaaatcagcttaggaatctgca

SEQ ID NO: 35713 - DNA, 1070 bp, Oryza sativa
tatttgagatattgtagatctttagccattttgtcaagtctgctgaatgtgtaacacatttggtcaccgcgttcgagtggtttgacgggcacatctcaggctgatgttgactggggggctaaagacccagcattgtctccaatattcttctctcgagacgtcggatatttcattatgtctgcctgtgacagtaattagttttttttgtctatatttaatactccatccatatgtccaaacattctatgtgatagggtgaaaagtttttacgtgggaattaaacggggccaaagttgcattcagtattgtgtctacagctgatccggattccatctaatcatagggtgctcagctgagccagcgatggttgtttgccacgtttaattctaaacatcgtcgtacaatcttaagtacataaagatgatcaccaatcagtctcaactcccagttacttcttataattgtcgtatgataatctagtgcgcaactgaacaaaatatattttttcttttttaatatgtgccaaagctattagctatttttaagtacatacagatctctatacatcccatcagcgttgggctaaataaaaatgctactaatatgtttagcattctctcttgcatttgaatccggttaggaatgcatatgctttctactggctagttttgattccaatgtcatggtgtcaggatggcatgcagcagatacaattaatgtgtccgattcaaaaatcacaatgtgtccgattcaaaaatctctctgaactttccaaattgtatgaggacgccgagtcattgtaaatcctatttgaattctattttttttattcgattaatgtgagaatttctagcctccacagcgaacgtggtgccttctttcaagtctgtcttaataatataatagatagatagatagatactccatgcatgtgtccaaacattcgatgtgatagggtgaaaagtttttgcgtgagaactataacagtgccctagtttaactacctaaatcagttgaagagttggctatctgagtatttggagagtctaatttagagatgctgttaaaga

SEQ ID NO: 35714 - DNA, 551 bp, Oryza sativa
tttaaccaataaggaggagggtttgactagccaaatagcttggccagtgagttggtgatattgatggagcatgttttatttgatagaatagccaaaatttaacttgaagagtcaattagagagactgttggagatgctcttcaatcaataacacgttaataacatgttgaaggtagccatattaatggagccggacgtagtactattctgcatagaaccgtcctccggtatgtatatgcgtcatgtgcgtcttccctgtcacgagtgcgtgaactggagaagatgaacgaaatagccagagtcccatgtgccgaccgatgtgcggtgcactcgtgcaaccgcgtcgtcgctggatgctgcagctctgctgctgcgtgacgtgacggatggggggacacactcgcaaaaaccccagctgacctcatcgccgggtggtcccccctctctcccctcctcctaccgctccccatggccgccgccgccacccgcgccgtccgccgcctcctcatcgcctcgcggagtctccacgcaagtacgccacctctcgcgca

SEQ ID NO: 35715 - DNA, 1501 bp, Oryza sativa
gtcgaggatctgcaaatcgacaagctttgttgacttggtcgacaaccacttctgctgtatatgtgtagacaaggtgtgtatgtgcatctaaaatccaaatccttttgctccatttgcttgatttgcaactccaactccacgaatgtgcacacgagcaggagggcagcgtatagctcgcgagctaaacgagctagctcgagctttcaaacgagccgagccgagctagccttttagctcgttaggataacgagccgagccgagctagctcgttatcctaacgagctggagcgagccgagccgagtcgagccgagctggctcgatatccagccctaggtgcacctgtccccggactccccggaccagtggaccgtacaccgtgcgccaccaaccagtgggacctgcctattggcaccggcttccctccccaatgacgtcagtcctcgggctttaatacgcaacaaatcaatattaaggtgttttctgttactagtaaaaacacagagattcttctaaaattcataactaactcatccgatctctgtttatgtccgttcaaattgtagaaaattcataaaattaactagactccattaaaaaatggttttgtttcatgtttcggtagtcttgtatcctattttacttgtgtactttgtatgtcgcgtagaatccagtagttccgacactctggtttactttgaagttgtttagaggttccagcagcaccagagcaaggcaagtcatgcattcctcattgagcatattattcctactttgcaaatatcccgatttctacctaaattgcattattttacaatgttaagtgggatggttcctacgtacttagccatagcttgtttaccctatctaactgataacttgggaattgatatgattaaatgttggtttaggaaatgtttagtcatgcttagatcaactagcttactttttggggaacctcactaatatctcagaccttgattaattatgatgatattggacatgtaccccaaatcaataaaaagtgcatttctcagcatctagaaattcgtagtttattcgtgaaaaaaaaattcatagtttaagtcatgcaccagcagaagatttaggagtggtgggagtagatttgtggtatacgtactataccatatatatcggaagggcttaaatgctagagatttgcttccgtccaacaaaaagtatctcgaggtatcggtatctcacgatactaaatcgtttctcatcgttggatttagctgagcaggatggacattgttagatccaatgatcagaaacgatcataaatctctaaatgttaacttcacgccaccatggtctgagctgcgtcacctgtatatttatatctcaaatgatacattaagccaagataatagctggctcaaagttcacgaacctcgatcatgaaccctatatactccatttagctagcgcttgtccggcgagtttggggaagtgtacacaaaactaatggtatatggctct

SEQ ID NO: 35716 - DNA, 1501 bp, Oryza sativa
gcagtaacctgagtagcacccaatatcctgagttcaaatctccataggagcgaatttcagattgggttatttgagagttagttccctgttcgataggctaagttcctattaaaaaaaagctgcatatatccagttggatatagaggccgagtaaaaaaatacccttctctaaaaaaaataataataataaatagaatattgtgctaattaaattcctatgaaaactaaaaacttagaaaagcctcaaaactacagtttcaattatacatgggaaaaacacatgagcttgaaattatagaaagatgaagacatgattatttttctccacaactcctctatagtagcctagtccactaaaatttcaaagaactttgtagggaatcagttatttgttctaaatattttctacaggaaacttttctatataatttaaatcctagaatgccagatgtatttggaagtaggagttggggacttttccttcccacataaaaaatgagatagcttattaacatataattaattaagtattatcttaaaaaaatttaaaaatagatttaaatgattttttaaagaaacttttctatagacttttttttagaaatatataccgtttagcaactcagaaagcgtgcatgtgaaaaaaagtgcgtagaagatagtaaagtggatttttttttcataccttcctaatttttaattttaaaaataaacccttctaaaacttatttccaaaatccgaacgagctggcgtgtagtaggcttgacagttttattctaccacgccaaccagaccgacatgacagtattattttgcgtggccaaaagattcacatcttggaaaacaacttttacaagagtttacttttaatactaaatattcaaaaatttcaaaaaaaaaaaaaaccccaaaacacaacctaaaccggagaagcagcaaccaaccctttgtccagcttgagaagagccctcctctccttccacacagattccagtgaagtcaagacagcaacagataggaggagtggacggctcgccttctctcctctcctctccgagccggtcttccttccttcctcgagtgcgtctcgcctccgtccaaaaaaagaacaaatctttgtacgagtcgccggtctcgccgcccttctcagaccccgcccgcccgccaccgccaccgccttggccattgccccccctccgcattgcttcgctataagtactcgccggagtggccgccctgcaccatatccactcacctcggagcagcagcacaagaatcaaacaaaggagagccttcttgcgttctttgcttcctcctcctggtaagatccgaatcgattccctgctttttgtttttctttttttggtttctttgagggttttgtgctcggtgcccgccaatgcctgcgtattgcgattcagattgctcattcagatttgcgccttttttcgatggcagtgtgtagaggatttgaaggagatttggagtgtcttgagagga

SEQ ID NO: 35717 - DNA, 170 bp, Oryza sativa
attcctgcagccctgcgcatgcatgtgtggactgctcgaatttatggagaggaaaacaatcacttctttaattaattgtacacttgattaattaattgattgtcatttcatcatatttgcacctgaaaaaagaatctgatatgtccaacatgcgtaattgcgtattacaa

SEQ ID NO: 35718 - DNA, 275 bp, Oryza sativa
agtgtgtgaggaggagaaaccctagccgcgagctcatatccttcgtgtcggattagtggatttatttttttactttttttttctcggaggtgatgaaattaccgtattagccttgagcccagcgactatttgctgagctgggttttgggtgacgttagccacgcgggaggttgaaggggtagtttggggatttccttgggtggggtggtctcgagaggtgtgaaggcgctcgtggatttaggaatctggcaatctggaccgatggggttggggaa

SEQ ID NO: 35719 - DNA, 1501 bp, Oryza sativa
cttaaaaaaatcaatgttatactgctataattaatttgattcagctatgatggactgtttggagttttctcctttttttccacttataattgtggtatttcttcctactagatcattaggaaccattttctggcgccttattgaaaaatgatatagtacatgcacgcacgtctcgaagtgaaggttgtgttatatctgactattagagtttggtgtatatcaaactagcgttaattgtgcctaatttaaacataagtcataacaaacatatttttttaaaacaatgatatttaattatactttcagtagtttattttctgcatctatctcgatcttattcggttaaaagattgagcgctgtgctttcaaagtacactacacaattcctcatatattttattcagcagctttgggtcaacctcagtaggggaaaaaatgctttgggtgtacccactaataaaccttggctggatgagacaatatttagtccctgtcaaattggatgtttgacactaattagaagtattaaacgtagactattgacaaaacatggactaattcgtaagacgaatctattgagcctaattaatctatgattagcctatgtgattctacagtaaacatacgctaattatagattaattaggctaaacatgtgctaattatggattaattagatttaaaaaacttgtcacgcgaattagctttcatttatttaattagttttataagtagtctatgcttaatactccaaattattatccaaacatccgatgtgacatggacacgtatagtccctcgatccaagcaccccaagttcagaaccctcattcccgatacgtaaaacggagcaacgattagtgcatgatttattaagtattagctaaaataaacttaaaaaatagattaatataattttttaaagcaactttcatatataattttttttaaaaaaatatacgccgtttagtagtttgggaagcgtgcgcgtggaaaaccagaggtgagttgggaaaggtgaggaaagaacatggccaagactacttgttgccactgcagtgttagcaacaagccgtgctctttaattgggtggacttgatcacaaatgccgtacacgtgtggtggtggcattgtcatgcgctttcgttttcctctccaacttataacgcctaccactgtgtcttccagaaatatttcctctccgttcgcccagtgtttcaattttgcgagtatatatatgtgtgtgtgatttgtgtcgatcatatataggattgtcagctgataaaagcatgcacgattatattgcatctaggggaggggataagcacgtgcgcgcgagttggacgacggaacaaggttccagtatttttaaattttaatccatgctaatgcgttcaaacgtgcttaaaggcctctcgttctaattttaaaaagtttcactctcttacttaccgatttggttaaaacaagcttcttttcttcacctttgataagtgttcaa

SEQ ID NO: 35720 - DNA, 508 bp, Oryza sativa
ggggcatggaattttgcaggcggcccccttgccgccctgggggagggcgatttttgcctctccctctataaagcccagtccctcctctgtgaaatttcattatattcactaaaaatccaaaaaaaacgaaagagagagaggggagggcagcagaaggggagcggcgaagccctgctggttcgctcaattcatcacaagtatgctcccatacatcttttgcatttgtactaatatgttatgtttgagtatatatgttgcgttttagttttagttccatatattttagcacatctgtagcacacagcacatatgtgtagatccagagcatagaatataatagtatgaattgagacatagacagtagtgttaattgtaagatgtagtttagtttgatctggagaatgtaacgtaattttagaaatttagagaacaatattgtagagaatgtaacttagggcgtagtacagaaatgcgaggttaacgcagttattgttttcatcaggcacaa

SEQ ID NO: 35721 - DNA, 1501 bp, Oryza sativa
gtaaatcaatcaggaaggcaactcaacagtaaaatgcaactctataaacacaaagctagcgagaaggagtaaagagttgtcatgttgctgctgaattgcatgggaaggccgctgtcaaggtgcaatgcacagaacgctttgcacagtgggtcatttattgatggctcagttgatttctgcacaattagccataggtggccaatgaaaaggcttgtaagaggccacgatttgcagaggacgtgtcaaaccttagaattagccaacatctggaaccagcacagcttgaaagcttccattgacagcagtgccgcaatgtaaccatgtcagattctccctccacaccgctgcttgattccagtagtatatatcaatgaggaatatgtaggatatggatctgcttataagatcaccaagaagtgcaggcaaaaaaaatgtcactatggttaactgttgtgaagggaattgtaaaagtggtatttcaggccctattgcaagaactagtgggacctgtgacaattaggcaggttagtcaaatgctatgatgttgatccatggaaatagttggatggcaggctgctatctaaatgcaacaattcttcaaaggcacgtgggtcactgaggactaactgagtgcttgttgatttcagctgttgaataggaacatttggaagagcacaaggcggatttgccatgatcatacataattttaatgaggctttgtcgaagagaacaattcatggcatcaagaatgggaaaggttcatagatgcgtgctatagcactcagtacagttagagagcaacgcatttagggccgcgccaaagcccaaagccaaccctagctattgtatcggcctagtcgatgaaagcattgaaatcacaagaaatccagcacccaatatgcatctatctacccaagatatttaccctaccaatcgcgccgtcgtggaagtcaggcagcgaggattaatccggcgcagcaaaccaggggcagcacgggcggcggtggcgtggatacgcggacgagctcgagcggcgcggccggcgagtttgtgcggcaggaaactctacctgccagaggatggtggaggcgcgccggcggaagatctccccggcggccatcgccggacctgacgccgtcaccatgagcctgtgacgcggccagagaacccaaccgagccttgcaacgggaggcaggaagggaagagcccaagatatatgggccagttttaaggttgggcttttaatcttaagcgggctgaatagtcataccgtccttctgctagtgcttccccctcaaggcctcaaatttccttttttttttctcaaaataagataaagaagctgcacatgttctgaaaacacttcaaaacaaacccatgcaagtatcaagatagttccaaaaggtggggaaccgggctatacacaactttcaatatttttttttagaaaaactttcaaatgtaactatagcataaattcatgaactgtgggatggatgta

SEQ ID NO: 35722 - DNA, 1501 bp, Oryza sativa
catacctcatctcaatgatcttttgtttggctctccaggcctttgcatagcttatggtgtacttgaatttgttctcgatgtgcctaataattgattttggttcaaagccaatgttaccaacaacactgctgtacatctcacttgccacaaaagctgaagtgatgtttcggtgatacttctccaccccttgtaagtagcacttgtgctcggtcacaatgctaactttccaataatcattccatttacccttatatgcatggacacgccacggacaatcttccttcatgcacctcacttcatacacataatttgttgacttgaccaccctaaactctctctgcaaggaaactgcccaatgcttcaccgcctccttcatctcatccttatgagcataccttgcaccctcaattacctcgttctccttatactcccagggtacatgatcaccctctgatataacaagtccagagaagtcctcatttgcccaatcagtggccattacatcaccttcctcatcggatgatgcgtcgtcgtccacttcctcattatccgaatcttccctctccatttcatcaacaattataccgactctctccccctcatccgccatgcccatagcctgctcctcccttggttgattttcctcattttgcatcgatggtccaacaacatcccctgcattgataggaccctctacatcttcggtttgcattgaaacatttatatctttctcttctaccgacacaaatataacgaggggccatgaccgttcaaaagccatttccacataccgtctccaagcatcagtgctgtccatcggcattagttcccaaaaataaccttctgttgcacgactcactacaactgacactgacattgtgtatacttcttggtctattctaaatcctctcaacaaccaactataaattgactgaaatgttctctccgcaggcctatcgatgcccttagatgtcattacaaaatctgacagatcaacaccatctggaccaaatctaatatttccttcaccgtgaactatctgaaatgtgaccttacttgacattgtgcctgatgaaaacaataactgcgttaacctcgcatttctgtactacgccctaagttacattctctacaatattgttctctaaatttctaaaattacgttacattctccagatcaaactaaactacatcttacaattaacactactgtctatgtctcaattcatactattatattctatgctctggatctacacatatgtgctgtgtgctacagatgtgctaaaatatatggaactaaaactaaaacgcaacatatatactcaaacataacatattagtacaaatgcaaaagatgtatgggagcatacttgtgatgaattgagcgaaccagcagggcttcgccgctccccttctgctgccctcccctctctctctttcgttttttttggatttttagtgaatataatgaaatttcacagaggagggactgggcttt

SEQ ID NO: 35723 - DNA, 1501 bp, Oryza sativa
gtcgcaggaaggcgacccaagaggcaattattaaaataaaaatatgggttaatggttaaattgcgactgtaagagattttttgaggagtcagcttggaccatagaatgtgctatatgtggttgacgaggctgatggacatctataaactatactgcatgggcatatgccctatgttcttttttttcatcaaggtgatgagcaaggacaatagaatattggggtctgaaagagcccactaatccacgaaaaaaagatagtggagatcgacataacactctccctatgtgcgatggaaatataatcgatcaagcgtcagaatgccagataatacatgatagttctaagctacaagatggaggcaataactatatttctcgccattactagtttgaaattcaatggttctttgtacttttttatataatagtgttgctttgtacttatagcatgatcattagtctacagctgataagttgtaaaacgacatataagcaactaaataagaatttgtggttaaaaaactatcatatttgtatcatgcactaattaaaacactattatgatgaaaaaagcctcaaaatcaattctaaaattaagttttggcaacaacttataaggtaaaagatcctcaattgtaactctgttctatacctgatgagaatactaggtcctgatattccgataggtattgataactctcgatttggtggaaacttgacacacatgatccagcttccgatcaaccccgattcgaaccctgcaatcgcagcaccacgtttcctctggttatcaaccatgccgaaacccggttgacctcaccgataaggctaatcactgcatgcaaatcaaagaacacaagcaataacaagatagatagcaacacaattgcaaatgaacgattaagcactcgaatttgggcttccacaaaccgatctagcggcgaaactgcaatggcaaaaataatctaagcaaaacccaactctaaatgatgacgacttctgaataaatatgattagagacgtcctagggttgccttagggcgcacacccctttgggcttatcccacgacacaattacaaggctcaagacccaaatcagattcagactggatgaggtacgtggcttatttttcatattcccaacagctcggtaggaatttagatgtggaccaaaaccatctaaaagtatactccataagctttccaacaaatactcatgggctccgaaattcattctagatcagcagttagatccgttcgaagttaatgttgttaggaggcctgaatccgaatccaaaacgtgtaggactttatctcttgttttctatggaccaaaagtgacgtggtgaggtagaagtggatttggagaaggtcttgatttggtccccaatcaacttctttgatcatccatgcattctttatgcttggtctctttttcatcacccaagcatgtaccgctgcaaagaaaacataggaaactcattgtgtagcaacggttgtt

SEQ ID NO: 35724 - DNA, 362 bp, Oryza sativa
gaaattaagatgagaatttgatttttaattctaatatcttgtttggtagaggtgatggaaattgatagggagtttagttggagattaggtcattaataaaaacggatggctgagatttgcttagaaaaagtaaaggaggaattccctcccaattacctgcccctacccaggtattgaaaaggagggagttccttcctcaattccccatccccatcccaccaaaattcctatgtttcccaaccaaacaaaacacttaatagcctcatccctctaaactcccaatccctcctaaaaactccctccaaccaaacgggccgtgaggggttgagccgagaaccaagctaatctgtttgttgaataga

SEQ ID NO: 35725 - DNA, 1501 bp, Oryza sativa
tccacatagatcatcattttaatttgcctgaagatgacgcccgcaggagcatgatcatagtcagttgacttcaaagcacccaccaggatagaacaatctggcgttgaagaacaatctgacttcaaagcagccatcaggatagaacaatctggttgcttctgacctggcgaacaactcctggatctctgacatccgtgccctcactgtcctggtcatgtcccagtttcttcttatttgggatgcggtgcttcacgtacaactctcgccgggtgtcgaggatcgtctcgtttggcgttggacctctaaccagcgctactcagcgcgttcggtgtaccaagcattcttctatggccagcattcctttgcctatgccgatcttctctggcacgaaaaagggtattgctaaatgcaggttcttcctttggtttgcattccagcagcgctgctagacaactgatctcctccagaagcgtggcatcgataatcactcggtctgccccttttgcgctcaggatcttgagacggcgaaccacatgctcctcgactacgtgtttgcttggcaggtttggctctgtgttctgtcgcctcctggctaggctaccctctctcacccctgtggcaatcggttccaggattggtggctgccctccagggcctgcttacctaagcatctccgtgccggcttcaaccccttagtgctcctaatctcttggcaattgtggaaggaacgaaactctagggttttcgactctgcactctcttcaatctcagtggttctggagtctatccactcggaggaccatctgtagtctttaacaggcgttgccgtttttggggacttgtttggagtgtagcgtggctcggccccttcccgctgtttggagttttgttttagccgccgtagttttctaagcttcagccttttattttgctttttctcccttcccttggcataagctggtttggctaattgtgttgtgtaactataaatcttttaatatattgacgtacaattgttttgcgcgttttaaaaaaaagatagaacaatacgttcctatggcgaattggcgatgtgtgagattccatgacttgttgcagtaagcagagcatacaagcaagcttcagcttcgacactctgagcatcatgcacaaattcaattttccctgcacctgctggcacgccatttccgtcatgatcccgaatcacaaatccccagccaccagttttgctagcttcatagaaagcaccatcaatgttcagtctcacctcaccttgaggtggaggtcgccagttttcagtactcgaggatttggctgggttttatcatatctgaccgtatgagtagttggcattacatctcgcttgcccatccaattatgaacatgccctccgtcccatattataagggatttttggtggatatgatatctctatccaaattcatcgtattagaatatgtcacgtccacgaaaaatcccttataatatgggatggagggag

SEQ ID NO: 35726 - DNA, 1501 bp, Oryza sativa
tgacactttcaacatcaaataattataaggtctattatgctattaaatggaaacacacaatcatttatgaaaattaactatcactagttggcatccatatgtacccaccgaccacttattgaagacaaatattccttctcttgagtttctgcgttatccacctcactgataatacctcttttaaatgcactgtttacacatataattaattcacattcatcatatattaaaacacgtcatgctaatatataacttacagatcgataattcttagaaattcctgataggtcttgctatctttatcgagagaatccaagacgttgacttcattgtactttggatagagaagaaagactatcaaatggtcactgcaaacgaaattgttagtcgagccatgattatatgtatatactcttagtgcatattacaacttactcaaaggcatatggggcataaacacactccttgtcctgcgtagattcaagcgccatagctatgtacatagcgacatctagcaccttttcctgatgcctttgtgctatgtaagatttcctctcatcgggagtcatcgccttgatgtgttctggtagcttcttttcgtctagcgtgtatgtgtggttcggcttacttatcctgtgtcacaccccaatccagcaccgccgtacaacggcacctgataggagcgtgtcgtaggaaaaacagcgcgagccgcttcctacgaaaccgcgatctcagtaccagtcccaggatgtagcgctggtacccacggtgacaaatatgaatcattgcaatccttaaaataaatagtggacttatttaccttaacttaggttgcagctcagacagcccgagaatgcaaccgacgacacggacgaggcaaacaccaacaacagcggcagcagcggaaccaacggtctaacacccaacaccacaggcagcagcagggaactaggacaaaccctaatctttacttcacttcaacttcatcttcagagctggcagaactatatttatatagagcaagggtgagtacttacgtactcagcaagccatgggaacttaggtggttaatgcaagcttcaagggaaggctggttaatttagcaatcaattttgttttcaagattttcaacaatttaagtgtgtgctttccacaactagagcgagacaagtctcagctcggtcggggtgagaagtaacaaatttatttatcaagatctttcaaatctggtttattttttccaaaccaaaccaacttttccaaacttcccgataatagtggtccccaaacgaccaatcacttccagggactcccggtcccgctgtcttccggacagctaattgcttcccaagcattaggtttccctaaccttaacaccttttcataaaacagggtaaaacaaaaactacgctaaggaatcacctcacatccgcccatgaccgtgggcacggctgttcgaatagtttgttaacctctgcagagaggttacactttacccaca

SEQ ID NO: 35727 - DNA, 1017 bp, Oryza sativa
tctactccaagtccatttctccgatatgcatcccctctaccgtaggaagaggctggacgccaatttaattgccatctggtgtctgtaagttctagacttgaacatgttaataaatcactacacctatatgcgtagctcatttgatcatccattgttggcaggatgaattacgtggaagctgaagagatgaaaaaacctgtcgcctacctaaacccgtgcaggatgtaacgctccgctttctgcgggacgttaaaagctaatttattgaaaatcctaattgcgaaaattttgttctttgagtgttaagtctaagttgtgccaaagatctcaatttaaatccctccctggtcccgataccctgttatcaaaaatcgtctcctcaaaatttccatcccaatatagtcccgaagctcgattccttctattcggaatcccctcctggaaccccatctgtgaactttgtcgaatgcccgaaccctaactccgtccaaggattcaccttcgcgtcataaactctctccttggttccttcaaaccgattctcaaattcgaattcaacttctcaggttttgattcatctatctttctctctgtattggttcgtcaatctaccctagttctctttctcgaacttctgacccaagtttgaatatgcaaatcgagatcacttccacccttgaactctaaaccccaagagtcaatccctttcgccttgagctcttcccaaaatgatatccgttctgaaataatctcgaagtccgaacccttctattcagacttctcttcaaaatcctcacccgcatatctcgtcaagtagtcaaactcaaactcccaagttacactctctttctctaaattatccatctccctttgactcgtctccgaatattgttctcttccttgactcctttctattctcccaagaccgagtatcgacttcgaaattcaagtccagactccaaccctaaaaccttccaattaaatctctctgtaaaagtctagttaacctcccccata

SEQ ID NO: 35728 - DNA, 1501 bp, Oryza sativa
acgttgagcctccggagaaatttgatgccctggagtggcgatctagcatacctccttactacaactatatttcgcattacgagatacttgcacaaccaccggatatgctgcctaaaaggaagcggtcccggtcgctctcagaaggtttggtttaatctagaatcatatgaggtttaagcaacagacggagttggcaactttgttgattcacttagccagttgttttagcaattagcatggagtttgtccaatgtaatttccctttctgacaatgtaaactaaactaaacttctatgacttttgaagttgatgtgtagtactccctccatctcaccatctcaaaatacaggactgaagcacaaccccttttttttcatgtcttatattggccactactaaaatggtatttttgcatgcatccaaaagctatttttgcatgcggttgaaccgtccgtctgccaggagatgattgcaatcgctattttttcatgcgaatggcgcacccacatggaaaaattgttttttggcaagcgggtgcttgtcgtcgtcgtagtctgccactgctcgtcgtctccgtcgtcgagtcccgccagctcatcgttgttgtcgtcgtcactcctccttgcgcctctaccactatccctccgcaccccgatggattcactggatctgcccatcatggcgccacattcaccactgatcccttgctgcccggtcccactcgagcccgccgtcggtcgctcctactcaaggtccccgttgccgctcgctccgcacgaggatgccaccagatatactcatcaattattttaagtagaaatacaacttaaaataactgaaatttggattaaaataaagaaaataaaaagaaccatattgaacccaacatataatacaagtagaaatacgatttaaagtatctgaaatttgaataacaaataaaaataagaagagtccatgtagaacataatatgaaattaattgaaattcggaataaaaatataataaaatcatcaattggattacagcaccaattccaagttaaaaattattaaaactcaaaatgaataaaataatatgtaacaagtgtccttgccaaatgtggagtatataattggaagaactatagtataactatttttttgtcggcaattttttttgggaatcaacacctaaaccctaactctaaacctttcgaattatgggccattgaatttgctccaagattcatgcaaatgggggcgtcggaaaaaatgcaatggggcagccaggaagaatagaacacgcaacctaagatttgcgtgcgtgcgccttcacaagtgaaccagcacctcgttttgatttcttctgtacaagttatataccggttacaatataactacgtacaagttatatatcggttacaatataactataatcaagttataatgtaattatactagtttataattatagttacatttgaaagtttttctattgaaagttatattggtacttcaat

SEQ ID NO: 35729 - DNA, 1501 bp, Oryza sativa
atactggaaccttgttccgtcgtccaactcgcgcgcacgtgcttatcccctcccctagatgcaatataatcgtgcatgcttttatcagctgacaatcctatatatgatcgacacaaatcacacacacatatatatactcgcaaaattgaaacactgggcgaacggagaggaaatatttctggaagacacagtggtaggcgttataagttggagaggaaaacgaaagcgcatgacaatgccaccaccacacgtgtacggcatttgtgatcaagtccacccaattaaagagcacggcttgttgctaacactgcagtggcaacaagtagtcttggccatgttctttcctcacctttcccaactcacctctggttttccacgcgcacgcttcccaaactactaaacggcgtatatttttttaaaaaaaattatatatgaaagttgctttaaaaaattatattaatctattttttaagtttattttagctaatacttaataaatcatgcactaatcgttgctccgttttacgtatcgggaatgagggttctgaacttggggtgcttggatcgagggactatacgtgtccatgtcacatcggatgtttggataataatttggagtattaagcatagactacttataaaactaattaaataaatgaaagctaattcgcgtgacaagttttttaaatctaattaatccataattagcacatgtttagcctaattaatctataattagcgtatgtttactgtagaatcacataggctaatcatagattaattaggctcaatagattcgtcttacgaattagtccatgttttgtcaatagtctacgtttaatacttctaattagtgtcaaacatccaatttgacagggactaaatattgtctcatccagccaaggtttattagtgggtacacccaaagcattttttcccctactgaggttgacccaaagctgctgaataaaatatatgaggaattgtgtagtgtactttgaaagcacagcgctcaatcttttaaccgaataagatcgagatagatgcagaaaataaactactgaaagtataattaaatatcattgttttaaaaaaatatgtttgttatgacttatgtttaaattaggcacaattaacgctagtttgatatacaccaaactctaatagtcagatataacacaaccttcacttcgagacgtgcgtgcatgtactatatcatttttcaataaggcgccagaaaatggttcctaatgatctagtaggaagaaataccacaattataagtggaaaaaaaggagaaaactccaaacagtccatcatagctgaatcaaattaattatagcagtataacattgatttttttaagtagcaaaaattaacatagttacatctctagcctttgacttcaagcatgcaaccaatgattctatgttaaaagtttaaagaaaacataacgaaattctaacttcctctcacaagccaaaataacgataaaaaatca

SEQ ID NO: 35730 - DNA, 327 bp, Oryza sativa
  unsure (1)..(327): unsure at all n locations
gcgtgccngttaggtctcctatcatatagggcgaattcgagctcggtacccatggttagtaattataactatattgtaaccatataaataattataactacataattaagtaattaactacttagagctcgaacctagactcgttgatagccctactccattgggtctttaacaatttctcaagcgtggatagaagatacatactgaaatgtatccatatatctctataatctctgtggaaagaaagaagagaagagagaagcagtcatttggattattttccgttcacaaactcacacagccacattgctttacgcggaaactagc

SEQ ID NO: 35731 - DNA, 1501 bp, Oryza sativa
tagataccatgaggtggtccttgaaaagtttttgaataagtagagggaattcgtaatcctctggacgtagagcactagagcgcgtggggctttgaaaccaaatacaatctccgttttttaatagatgacgccgttgacttcctgtcacacgtttgaccattcatcttattcaaaaaatttacgtaattataatttatttcgttgtgagttgttttatcactcaaagtattttaagcgtgatttatatcttatacatttgcataagtttttttaataagacgaatgatcaaacatatatttaaaagtcagcggcgtcatctattaaaaaatgaagggagtatattacccaaatggaagagtccctcttcaaaataggtctaatagataagctatataagcgatatattgattttcctttccaacaatgggcttgatgtgatagcataagcctttgtagcaatcaagactagtaagtccattaatccaaacaattgtccatgtaccagtagaagatttggtagctattgtagcctctcctttgggcggaaccccccgtctgaggagttactcggaatgctgtcgatcggtgtcattggtttcgtactctcgtctcgggtgtagtaagtcaatttataattcttgacaccagcttgaaatttaacattttctttagtttctgtttccggtgacatacatccatcccacagttcatgaatttatgctatagttacatttgaaagtttttctaaaaaaaaatattgaaagttgtgtatagcccggttccccaccttttggaactatcttgatacttgcatgggtttgttttgaagtgttttcagaacatgtgcagcttctttatcttattttgagaaaaaaaaaaggaaatttgaggccttgagggggaagcactagcagaaggacggtatgactattcagcccgcttaagattaaaagcccaaccttaaaactggcccatatatcttgggctcttcccttcctgcctcccgttgcaaggctcggttgggttctctggccgcgtcacaggctcatggtgacggcgtcaggtccggcgatggccgccggggagatcttccgccggcgcgcctccaccatcctctggcaggtagagtttcctgccgcacaaactcgccggccgcgccgctcgagctcgtccgcgtatccacgccaccgccgcccgtgctgcccctggtttgctgcgccggattaatcctcgctgcctgacttccacgacggcgcgattggtagggtaaatatcttgggtagatagatgcatattgggtgctggatttcttgtgatttcaatgctttcatcgactaggccgatacaatagctagggttggctttgggctttggcgcggccctaaatgcgttgctctctaactgtactgagtgctatagcacgcatctatgaacctttcccattcttgatgccatgaattgttctcttcgacaaagcctcattaaaattatgtatgatca

SEQ ID NO: 35732 - DNA, 1501 bp, Oryza sativa
agagcaggtggtctttattatgaaaaaacttaaaacatattgtttttgttaattatatatttgaagctattggttctgaggcaattctgttgttttacctttgcaggccattagtttcacttgcttatccattgtaagtattattttgttgtaattcaatattttgccattttgattgtttgattatttctgttattatatatatatatatttacttttcgcacttctgcagatatgcctctgtgagagcaatagaaacaaaatctcctgttgatgatcagcaatggctcacttactgggtgctgtactcgtttatcactttgtttgagcttacttttgctccagtaattgaatggtaatgaccattttcctgggtcaggagattttttttttgtcttactcatttccttttgtttagcatttgatttccctcaaaaagttcagatttagcaacatagcctgtgagtcccttgcagcagggagttcataatatagaagaccaataaaacaggattggccctggtctagtgttttccttgttttttgtggtaatatttgtgattttttttttactattgatgctggagataaacatgttcacacatcaagaggataacaaaggattagatatgcttacttctgacggttgcttgcaggcttcctttttggtcctatgcaaagttgttcttcaactgctggttggtcttaccttgcttccatggtgctgcttatgtttatgatcactttgtgcggccaatgtttgtgaatcgtcaaatagtaaatgtctggtatgttccaagaaaagaaaacctgagtaaacctgatgatgtgctatcagctgcggagagatatattgaacagaatggaccagaagcatttgagaaactcatcagcaaggtattcttgttcaaaactaaaatcatcacaactattagggaaatgcaactctagtatatggatgttcatgctttattccatccctccaaagtgtttgaggtctatgcgaggactttaaaataaatataacatgagatgttgatttgaatttgaaagtttgcatcaacctcaaggaaaacaaatgtacagggatggtgcatatattatcttttatgcagcaatatatttctaaacggtacctctaatcaatgcaaggcagctgtacttctatgtatggtctcattttctagtgcttgctgcttgtcaacattctaatctgatcattggtaacatcaagcaattattatttggtgtaacataggctgtcaattttcctttcttctgagtgctttccttagtattttccaggaatgctttttaggtgttcctccatcactgtataattgctacagatatcatactttttactttcgttaggcatgttggtttatctcatctttacgttgctcctctttcttaacctatgcttattcactcttgttgcagtctacgaggccttcaacctccaaaagaagcacaaagcaatctatcttggaggaggtag

SEQ ID NO: 35733 - DNA, 598 bp, Oryza sativa
ttgtttttcatctactactcttttcgtcccaaaatataaaaatctagaaccagatgagacatatcttatgattattaatatagacatatgtatgtttagattgatagttctgggatatgtctcattcaatcctagatttctgtattttgggacggatgcacttctatacttatcaaggtacaccaaaatacagttttcttccaacaaaaggttattccatgacaataaaaggattgacacgcgaattgttgagcgttgatctagtagtaaaaaagaagtgattggcaaatagatccgaattatatatctatatatagtgatatactcccaccatactcataaagaaaatcgtttagggcaatgtttaagtcaaaccttggtaatataaatcatgaataacactcaagtcgttgagtttgaaaatgtaaaaattatatgagtagatttgtcttgaaaaatactttcataaaggtatacatatatcacttttcaataaatatttttatagaaaaaagaagtcaaagttgtgttttggagaccgtgtcacagtccaaaacaacttcctttacgagtacggagtgtatagtgcagatatata

SEQ ID NO: 35734 - DNA, 1501 bp, Oryza sativa
tctaaaaataatattgagatgcatggcatgatctcaaagcttgaaaagtaattaatcctgatgtatataacaacagggcggaatataattcatattccccaataaaatgccaagcaagaatattgtaagttaaagcaagagcatatggcattcaaatgattgaaaaactagctagcacaacaacttaatgatgcatcagctgttctgatgggaaaaaggtacttagtttgtgcaggatttaaataggtaaatactgcatgccctaatgagtgtgcatgatgacttgtgcccttttcttctggtacggatagggggagatatcttatcaaatctcctaagcacagctgcgactggtgctatgctaatcatcgcagcttgtgactagtgagaagagaggctgtcttcgattagtttactgagagtccatcaagtttcagtaatgatcatcgtctctcgctctttcacgttgttgatagcactaactaagacttccaaattaattaaacttatgacatatatacaatcttcggctcttgttcatcttctcgctcttcacattgtttggtttaatttcctagttcgttcgttgagatttgcggctgaattggctggcctgaggcttctgaattctgaacttattcttgcctattttggtcgtcatcaactttttggacggcaaccagccaagccaatgcattatcggctgtgtttagttcagcgcaaagtttggattttggttgaaattggagatgatgtgactgaaaatttgtgtgtatatgacaggttgatgcgatagaaaaggactgaagtttggatccactttggatctaaacacagccgatatgtagtttctctgaaattcaaaaggggtgtcactgttcacgtctgaaaactcgataaatattcagacttgtagcagattgtcagatacagataacctctgccttggaaggcagtgccgcagccatcaaccaaatgaacaatctgatcgagatgacgacatctgatctagctcgtagaaatcaatattcaaacattcaacaggccgacctaagatatttaacacgaaaaaagggaaaaaaatactcaagcatatagataaaaaattcaagagcgctcatctacctgcgccatggttctccggccgacgccgccgccgccgcttgatcgtccgcgcccgccgtctccgctagtcgccggcttccggtgcttcgccgccaccaccgccacggcgccaccgccgccgccgccacacggagggaagccgaggagcgttgtgctagcatttgcaggtccagcacatcatcgttgggcctttggaccacccgcttcacgtcgcctaaggcccaactagcccacttcttagatgggccgagaaatctggtcccgaagaagaagaagcagcctggaaccttccatggttggcccagcgaatctcactgtcactgacaccaccagcggcagagtagctgacctgaccgaccagccatggccatgaaca

SEQ ID NO: 35735 - DNA, 190 bp, Oryza sativa
tccaccaacgaggtggacgacgccgccgccggcaagggcggcggctccacccgccggaccttcagccaggcctacaagatgaagcaccggacgccactggtaaatacgcagtccatttccgctgatttcatgcgccattcttggtgttcttctcctccttttgtcgatcgattcgatctgcggtttgtgg

SEQ ID NO: 35736 - DNA, 238 bp, Oryza sativa
ttacattggctatagaggatttggagctagtagtgggttaaactattggacttgctccaaggttgtgttctttccttcaagttgccaacctttctcctcgtttttggcgcgcacgtttctcaagctgctaaacggtgatttttttgcaaaaagtttctatacgaaagttgcttaaaaaaatcaaattaatccattttttttaaaaaaaatagctaatatttaattaatcatgcaataa

SEQ ID NO: 35737 - DNA, 700 bp, Oryza sativa
tgtacattcagtaccatattggcatgcatatgtccactcgtaattttactttttgctaattaattgcatatacagggactagccaaggtatccctaccataccccaattgtctgcagattttatcagttaaggagggtttacgtcgttaggcggtcagtctccacttacatctaatttcatatttttattatttcaatttattaattttgcatgtatatgaatcttattgacaatttacttcctgatattaacagggcctactcagtcggttccactgcatgcacctacatatggcaccaacccatggcaaggacaatccatggattacggtggtacgctcagccatcattctccatacacatatatcgatggcactttcatgccatacatgactcccacttcaacttaagacaataactccgtgacattttatatggatgcaaggcacgtcgtttggtggtggagtacagggttatatggacttcttgcaacaaggtgattggctatttggtcaatattcctcgcatcctaatgaaattccatatatgcaagcactgtcaacaggtttggattttttttgtgttattgttgcgtgctacagctttgataatttcattgatatctacattgcttctgtagggtcatttcgccctaaactaatgtcagggtttaggccttacactgcatcataaggcgaca

SEQ ID NO: 35738 - DNA, 173 bp, Oryza sativa
actccactccagactcaactcatggagctaaattcaggagttgaagctgtaccaaacaggttcttagattgtttacggagttagagattctcgaagtaactgtagctatttaaagttccctaaaacagggccagcatgggagctcttgtgaccggcgaacagcagtcaagaca

SEQ ID NO: 35739 - DNA, 568 bp, Oryza sativa
agcggggggggagggagagcggagcgcgccgggaaggggagagggccgggggagagggggagagagagagagagagagagagagagcccgggagagagagggccggggaagagatgggccgagcggaattcggcccatcgaactcgggggaggcaaactagacttttgcggagggattcgatttggaaggaattggattcggaattgaactcgacgatagatcggggattgagatcttgagatggcacggacactagacaacaatcaaagaaacaaatttcgcaattagggtttttaagagataattttcccgttaggcgccacgacggaacgggcgctacagttaatttccgttgtttgcttcgtatctcatagtaggtttgaggtgggtgtagaggtggtgacagtccttaagtacattgaaatcctccctgtccgggtacgttgtagagccatatctagagcagcgagctggccagcgcccgaagtaccgcgttaggattaaattgggctttccgtagacattgtctctcgctagtaaatcctctctaccttaaaataccttagc

SEQ ID NO: 35740 - DNA, 1003 bp, Oryza sativa
gccatctacaattttgaaagagggagaaagatcagtaaccattttagaaacaaactattgaaaataaagaagacaaaacaaaccttaccttttcgcaagtagttttgaacttggtatccttagggttgtcctaagtgtcgggtttcgccctagggccaagcctgtgctctgataccatctcttgtcacgccccgaactagttccgaccggaactagcccgtgacgctccaaattaacctgttaatcgataccagtcccaggaaatagtgctggtatcacagggagacagagtatcacagcaacagaggtctctttattatagagtagaagtacagtcatattgggctgcggacagatcccgagctcacaactgcattacaaaaggaaagcggaagccaggacttggaccaatcatcacaggcgcgacttgggaactaggccgaaaccctataactcatcgtagccgacttgctcctagaagaactcctcgtcagcaggatccacttcatcttcttcagcaactggggggggattatttatatagagcaagggtgagtacgggagtactcagcaagccaggggaaataagtgtttaatgcaggcttcaaggaaaggctgttgttttcgtaattgattttgtttgaactcttttctaaaaagtctaagtgagtgcttctcaaacgacacggatgagacagtgcgtctcgtccggtcggagtatgtgcaatgtatcagtctttagatcttgaaacagggttggcacccggccaacagcttttcaaacggccacccgggccaacaacatttcaaacagccacccgggcctagctgatcccgtcagctgctgatttttcaaacatcgaacccagtttcacaacagcaatttcacaagcagtagtcagacaaaactacgctaggaatcacctcacatccgcccatgaccgtgggcacggctgttcgaacagtttgttaacctctgcagagggggtacactttacccaca

SEQ ID NO: 35741 - DNA, 694 bp, Oryza sativa
aacgccgccgccagccttctcatcgtcagccgtcggccgccgctagcaagcttctccccgcaaggccgcccgcacgcctctccccgcagcctctcacactgggttgagatgggaaaagaggggatataggtggaagaaactgggttactaatatgtgaggtttatgtgggttgcatgctgactcggccaccatgttagctaaaactaggagcagtactacttgggaccacccggttttgtaagattattgcagggattaatttcaaactgtgcgacaaaatgatagaccaacaaaaaacttattccttattaaattgagcgggctccatgcacaccggaatctcatagcagcctgttcaggcccatttcgcatgcaggtgagattccaagtttcggcccattaacacgttggtgcggatttgctatggaataagtccacttgcagtccctcaattttgcgtcaagtttgtttgacatcctatatctccaatacagaaatcttcacccgtaaactatacaaaaccgtgtaatttgggtcccataacagtaagatgtccagtttcactgacattgcatcctagttagcaaaaagaaaataaaaaatgtggggccacgtgtaagtgagcaaaaatgtggggcttgcgcgctctctctttctcccctgctacctgcttccttcccaaacggcgtggca

SEQ ID NO: 35742 - DNA, 1417 bp, Oryza sativa
tgtagatggcagtgaacgccagcttcagttcccacggttttggtgagggtcaccacgtcgctcagcttcgtgacctcgcccgtttccttggcttctcgtgtcccgagtacacggggtactccgtggaccgtgttccccctcactgtgagctctctgtgtacctttacccccgtggaggtatacacggagctggccttcgcccacaccacttcactgtagccaggcccactctccagatcgcgtaccaggacctctcctggactgcgcttcgtcgcctggcccacgactacagccaccgtctcggaggctcctccttccggcagcttccacgccttccttctggccactcagacgccaggtacccttgtccatacagcgagtctcagccagtgctgactcgcatggttgagctttcggaggctcaggccactcagcacgacctactccttgaggcttaccgctcccttgcccgccgctacgccgccttggaggcccgtctggccgaggagggtgtcacctcagttgacactatctcctgggactcaggccgcctctgccacgccagccacctgtcctcccacagctcccgcggctctgcccgcactcccagtggcccgcgctcccccaactcgcgtgcgccgtactcaccagtgtactcgccctacccacacccagttagcccttcctacaccccaggacacaccccagttgcttcctcccgccgtggcccacgctttatccgcactgcgcggaagcgtgttgttggttctgccactgtgttccgtttccactacccagctcccctaccgccagcggcccgtgctgctgccggccctcgacaggttccgccggtcccttcgcgccagccgatcgacgtttcttcgactgaggagccgactacaggaggcagccaggccgacgaggagtagaggaggcagtcttcagcagccgtccgtgtgataggcccttttgttccgccgccaactcttttggagtcgtggcgaggtagtgcgtgcgtgtgtttgttgtgggtgttgtttggtagtctggttctcctaggtggtgtgcgcacagtcaagctcggcgtagctctgtgacttgtccacacccgttgtatcaggtgtttttatgatttgaaaaatccagtttatgcctagtgtgtgctatctgagttgctatttgctttgctccttgccctcctaagtgcttatctgactcttaccccgccctcttctgggagtttagatggctagccgcccccgccgtgcagctcgtgcaccagcccgctttggttttgaggatggtagagttgagccagaagaaaatcatggatcagctaatgagcagtctcaccacagcaaccattcgcatcgtactgtttcccgcaatgcagaggttgagcaaccccgccacagca

SEQ ID NO: 35743 - DNA, 249 bp, Oryza sativa
ttagtggcattttcaattattcagcaatcacaaattcacaataggagccttgctgtttgggaaggggaaaaaaatacaacatttccttcatcgcaagtgttcagtagcaagcattttgcacataaatcaatagggaaatcgttatgatgataacagcacattcatcgagcagacaactagaatacatgaacaaccgaaatacaaggttttcttttactagacaaaactatgatgaatgatttgcacgca

SEQ ID NO: 35744 - DNA, 368 bp, Oryza sativa
taggcctagaggtgccttgggaatgtggagatgcttaagcatccaaagagcatctcttctctcctattgacaagtgtccatgacagtttcttcaggtataatgctcacaaccgtcattgggaggacgttatccactcagcgcaacttgggcttgggccagcggcctccgtcagggttcggctaaacccgagacggcttcgttggctccggttttcggcttagacactcattttgggcccctcattctattgctatggatgtttggcccatttggaggtgtttaattgggtctttgggtccaaacctccataagtttggatataagtttgattctctttttccttcatgtattttcttctcaacttagg

SEQ ID NO: 35745 - DNA, 524 bp, Oryza sativa
aaccaaataacgtggcactcagagaaaaaatgttatattgtctattgtgtatagcagaaacaatagcgttcatctccaccttttttttagctaggttattcttcgttaagaatcaaattttaccatggatgacgatgagaggaagtatatgtttggtgcttagcatagtacactggtctggtaaacgtctgaatcgaaaaagcttaattttctcaaagagtgatgaacagaaaaaaaaaagcatcagctttgtcgtgcaggtccttgtagtacaagacgaaggactattattaactagctgtacaaaatgcacgcactgtttatattccaatttttttcttcaaacttttaattttttcgacacgtcgaactttcctacacacataaactttcaactttttcatcgtatcatttcaatttcttcaaacttttaattttaacgtggaactaaagacaaccatagtgtgatatcgtagaattgaaaaaaaaattaagctgctgtgtcgaattaatgggaggagaaa

SEQ ID NO: 35746 - DNA, 252 bp, Oryza sativa
ttatgtacgtcgtggcttgagtcttgggcatattggtagcccgtgatttccatttttattttcatcccaataagaggaagagaaaactgaaaagctgcaatgcagttcgcagcgccaaatctctctcgctttgtctgcacaccaaatgttcatgtgtgttcatctgttctggcgataacaagtggtattagagcaagcatcgaagatcggtcatggctctatgcctggataggagaaccatttcttgacagg

SEQ ID NO: 35747 - DNA, 469 bp, Oryza sativa
aggctagatagaaatggcggtccatattttgttggatatggcgatccaactttttgtttggttgggtgaatatgatgatacagttttttgtttggttgtagggatgaaggtggatttggtgatccaaatttttgtttggttggagggagtagggtgaatgagtaggtgtggtcacctctcacttagagagggtgagtataccccatcaaatttatatatactacgaatcacaaattccccaacaaatcacaaattatatatatactacaaatccacatagagaaaaaaggaaaaagaaaatgagaaaaaagaaaaaaaagaaaagaaggtctcgcaccccgtcgctgccgagctcgcctctcgctctggttgacctcgccttccaccgccgcgttcgcatctcgcgtcgccgccgacctcgcccctccccaccgccaccgctgacctcaccttccgcttccgctgcagt

SEQ ID NO: 35748 - DNA, 313 bp, Oryza sativa
taacaaaataaattacagattccgtcaggaaactgcgagacgaatttattaagcctaattaatccgatattagtaaatgtttactgtagcatcacattgtcaaatcatcgcgcaaataggcttaaaagattcgtctcgcaatttctatcagaactgtgtaattgtttttttttcatatttaatactccatgtatatgtccaaatatttaatgtgatggatgaaaagttttttttttcgactaaacaagccattagacaattatactataagtttactttactgccattgggcctaaaatacatgaccagccca

SEQ ID NO: 35749 - DNA, 1501 bp, Oryza sativa
ggtgtccagtgacgacgcccccccgactcatcagaaggacgaacaggtggagtaggcgcggtagtgaatacctgatgagacggtgcagagtgcacatgggtaggggacggtggcgccgaagatgaagaagaggccccatccttagtaggcggcttcggaggtggaggaagaagtggaggcggttgcgacggcagaggtggagtcggcggtggagttggtgacgaagaagcagacgtcaccgccttgagagcccgcgcgacctgagcttgctcatgctgaacttgcccgagagaagacatggacaaatccaccttgctttggaccgaatccagccgcttcccttgagtttcaagcttgaggtcgatctgcttaagctgcttgcagagattgtcgaccctctccaccttcgtcaccaacactgcaatcgcttgagtgatgtgttcctccatcgcatccatagccgccacaacttgacgcacctggacgccttgcttcgccggagccgtggtgactacgtcgaagaaccagatcgaaccaagcacgagattaacagagaaatccccgaagataaatcccaaactctgatgcgaggatttaccgagctgaacaacgaagcagaaccccccacgccacgaacgaatccaaatctgataccaagttgtcacaacctcgtcgccggcgagaatctcgccgccgcaatgaggatgaacacaagatggattcgaatttcagagaacagaagagaggcagaggaaagagagtttggggagaggttttgatttcatttcttcagacttgttttccaactacagttcacggggattatatactactccctcgcgtttccgccctcagggccacacaccgaactcacgctacacatttacttaagtcgctttctttacacaaaaacgcctcagcgtgattacgcttccttctcctgttcctcgtccgttgtcatagcctgcgatatgacacgccgccgccgctaggtcgatgtgccgccggcgccggcagggagatcggagatggcgcagcgcggagggcggagggcgacgccggtggggagtgtgacgtgttcgtcgtgttcttgagttgccactatgtttatatgggcttttcatgggccgggcctaaacgaggcccaaaaggaagagcagaatggtcagttacagtcaggtttacaatttcaacaaaaagagaccggtcagttttcacgagatctcgtgatttcgaggaggctggatttcgaatgattttctagaaatataaatttggtcattaaaatgaattgaaattcaaccgatatttcgtcaaattttctaggtttctgtgcaatttttattcgtagctcactgcatattctccatcattgttttattgttttagaacagtactagcagtaacaactatcgagctcaacttaaagccgaatcgtagtgtaattaaaactaattcggatccgaatcgtataagcaaattcatattcgaatcgtacatt

SEQ ID NO: 35750 - DNA, 1028 bp, Oryza sativa
aaccaacaatcaattgccgatgaaaccacaaggcatggtaaccgccaagtaggacgatagcgagcctgttggaaagaagaagagagaggatagagtagtatagttgaaggaagaaataaaggtggtcaattccacatgggtccttgtcaatttccacatgggtcattgtggatgccacatagtatagtagtatggtataaaatcaggttgcaaaattgttgagatccaatttacaatggttttagggcctatttggtagacctctggctctagctccacctcttctgaagctggagcccatccaaacagtttcagctccatccaaaatagaagtggagctagctgaagtgttatcacaaaataaactagggaggtggagctgcgttttggctgcttcacaacacctaacttttgaaattaagagttctactccctctgtcccattttaagtgcaaccataattttccatgcccaactttaatcatccgtcttatttaaaaaaaattaaaaacataagtcacgcataaagtattattcatgttaattagaaaaaaatttaaataagatgaacgattaaaattggatatagaaacttatggttacacttaaaatgggacggatggagtaccaaataaccaaacagccaaacaggctcttactgtcgagggaataaatcagacccggccatagttgagggaatcaaaatatactctctcttttttttctctacaacagattgtaaagacatccaaagagggcagaagtcttcctccggcccaaacccactgactttctgagatgaagcccactcggcccaaataaagcccacaaccagacaatccttcttcgagacggcgttgcgtcccaagcccaagagcggaagaaagaaaaagtcagccgcttttgactcgtttcctccgggtccgccgctactcctccgctccgctgcctgcctagcctagccttcgccgtcgccgccgccgccgccgccctcgccgttgattccgccgcccgccgcgtgatggacg

SEQ ID NO: 35751 - DNA, 1501 bp, Oryza sativa
tgattcactcgttgcaacaatttgtctcaaggacatgaatataagaatgttagatctctatcataccttgggtacgatctggtcagaaatctgcatacttgttaacaaccaaatttcgtaaattctatcattattggcatcggagatgaagatcagatcgaagtggaatccaagatgaagatcgttgcggaaacagagtaagaatcggctgcagtccaaatcggctaaggttaggtcgacagagttcgagtcggacggggctagccgatacagccgattagccgatacagccgattccgataatatgactcggtgtacgtcatcgggttcaagttgatgtgcttcaagatgattgccacgcatggatagagtcctgggaaggcaattgtatctattaattaggatattctatgtaatttctttagagatatgtttgggcaaaagtctgccgtaaagacttatggtatcttagagtttgttagagataatagtcgtgtctgttatggacgtatcttgtaattctcgggtataaatagacccgagccctatgtaaaaaagaacaacacatccaatacaatctcgacgcatcgccacactttatgctttacttttatttcgacgagttcgtgctctcgggttgagctgcatcggtttcaatcttcaacaagaggtaaaacttgtcatgacgacttatgttctcaagattagtgcttccatctttatgacactctaatcttgtctatataattcgtcgagttatcatatatctcacataatctttgataatatcttcgtctaacctataatcggctaacatctgttaatggaaggcagccgattaggttagataatgatgttaacttagactatgtgatatatctaccactctatgaaacttccaacggcttgattgtctagatattgtttttcttttcatacttaatgctgcatcagttgagtttgatctattaagtcgtgcttagaattgcaatctctagcctgctttctggttgcttatcagggtagtatcggagtttcagccaatcttatctgattcaactacttttattctatatgcttgattgacatgttaaatctgccctttatgttaagatcttgtcgcatctaagtatattaagcttatgtttagtatattctacttactgtaaaataaaatcttagtatagagtagtatcggagtattagccgatacatgctagatatacctgatcggctatgctatgaatgtatataatcctactattaatatatatttcgatctaagtgatttatattgtctcggcaaggcgaccgatctatcccaatcatttaatttaagtatatatcgatataaggattatatatcattaatatctacagccgatcgagtagatttagttctggtttgcttattgatatttgtcgatcgatgtacacatgacaccggcttgaaataaatgatatgtcatcggcacctagccgatcggctatcatttatagg

SEQ ID NO: 35752 - DNA, 1501 bp, Oryza sativa
ccccaaccgtgatgctgtaaatattttttcgttagctctaaatttaccctctatattcaatgaataggtaagctttgcctttcgttaaaaaaaaccaatatattcgtatttttttgacataaatatgatgatccttgcagtactataacagttccaggtggaaatgaacgcatgattctcaatacactagggaaggaaataatattggattgaagtgctctaacacctcaaattccatgaattgaaaaaacacaagaaaactgcaagaatggccgtttggatgtagcataggaaaaaatacaggaattatataagatagatagacaccaagattttttttaagaggttggaactcatgttagaattcctttaaaattcctatgttttgagctaatccaaagaaaattcataagattttttgatagctattcctttgattcaggtaaccatataggaagaattttccataggatcgaaatcctctggtgatcctttgttccgaaggagccctaaaatgtcaatttcaacaatcgatgataccccggcccggccatatatggttgcacatgtgtaactatgtgaatatatgaaagtgcaatatattgtgatgcagatgcaaagtatatacatgtggtacccgcaaaaaaaaaagagaaaaaaaactaagctgaaactgaactgaaagtttgaaagttccaagtacttgaagctggacaagctagctaacgtcagccatgagaaagcaaagcagcatacatggggctatcaagctagctagccaacatcacccatgagaaaccaaagaagcacagccaaattgctgtatatattttctttaaaaaatattaagattggctggcttgcaacaaattaccgagttaaatttaggccggcgtaaatgacatcgacgaataaggtaaaacctgtctcacaatactgtcgacatatttgagaaaaccatttggttctatgacatcgaaagatgtttatttgcctgtctggctatatgcacccccttgtcccccagcttagtgtgttgctttcactggcaagtttaatttcaattttaattaccttattaccttgttgatttcaccgtcttagaattgattcttcctccggtgattccaatgcacataatgtagacgccacatagtgatgctacgtactccatccgtcccataaaaaaccaacctaataccgggtatgacacatcctaatattacgaatctagatatatatgtacagattcatcgtactagaatatgttacatctagttgtagatttattttttatgagacggagggagtactactttgcatataatctcgttcttaatctcgcaataatcactacctaattagctttactaatacatccataatcctagtactagtagcttaagctacccatagtttcacatactaattactactactacttgacacacacacacgctcagtgaggcgatcgaggatgcagggcggcggcggcgcggcg

SEQ ID NO: 35753 - DNA, 1501 bp, Oryza sativa
  unsure (1)..(1501): unsure at all n locations
tccaaggttgagcatcagttggtgcaactagaaagtagaaaccacaagggacaacccgtctaaagctctactaattatgttatcacttgaataatactactagtattgttttaaaacacctagatactgatgtaggcaacatggttgttataactaatcttcaatatcttagtatataaagtataaagtatcttaaaatgaatggaaaattaatgcctacttgagagtttgtagtttgtatcattatttcactattataattttgtaccgagtcaaacaattattcagttcgcacaaaaataactccattaaaaaaatataattatcaagacagaggtagagacgtcctcgcaaccatgacacaagcttccgtttgatttagattatcgaacggattattatcatatattatctttattattatatggataaattaaatatttaaaaagtaaacttcaaaacaagctatctaagcaatacaacagaagattttcttaaatgtatttttaattagagagcagaataatacatttcaataattcggtgcataattaaaaagagcattaccttatgccttgttctttttgtcaactccatccttattttttgttagcacatttttcaaatggttaaatgacgtattttttacaaaagctttttatataaagtttctttaaaattcaaataaacccattatttaaggtttgtaataattaacactaatgatttatgtgctaatggtttatcttattttatgtgcccctgaaaatctaaattaagttggagattaaaaatcagaccctaagcagcattgaaatgttccaatatgctaaaacttcaagagccccttgattcgtaggaataaaaaaacaaaaaatagggaaaattaggattatgatagaaatgcaagtgtaaacaaagaattacagaacacatgaaaaacgtttgattggaccgcatgaaaaaaaatataagaatcgtatgagagagttatactcaaaggaagattttcaaaagattgaagctcttgctaatttttctccaaaatctctatagaattttccattccataggaatttcaaaggatataaaatgacccaatcctttgtttcaaaagacattcataaaaaagtttctataaaactagaaatccttcaaaatttatatgtttttttcttcaaatcaaatagccctgatttgtcgtcaaagattagggacaccagtcaaagcaacagttatacagtacataaatataccccctcccaaggaccaaagtgcaaaaccccacctcgaattcgatttctttctcccctttttccacgcccaccttcgctcgctcaccatcctcatccccttttcccttctcctccaccccccccccccaaccacctcaccgccgacgacctcatcctcgtcggcgccgtcggattcaccagcgagggaggttgcggcggcggcggagagcgcgaggaagnaaagcggggaggttgaccgccagcga

SEQ ID NO: 35754 - DNA, 480 bp, Oryza sativa
attttacacccatcaactaacagaagttcaaagcttccaaaatagtacatcgtaagagcagtacaacccggtttaatggtgctttcttagttttgaaattcaaatatgctttttacttgtatgacacctaattaaaaagatatgtaaaagtagttaaatgtaagtgaaacaaacatatttttggatgtcaaaattgtgaaaaccactataaaaaaggctgggttgtactgcacttatttggaccggttttggtaataagagggtgcaaaatgttcggttcccaagatgcttccttttctttatcacctacaacacatgcgcacttgcacatctaaagtttgtgtcagatgacttgtatcttcacttaaaaagatgtaataattcataggttgtttttcctctattcccctaaccatgcctccagaacaaaaaaaaaatgatgaattgacctaattttgtactttggttgtggatggcagt

SEQ ID NO: 35755 - DNA, 1501 bp, Oryza sativa
agcaacaatatgaggcagatccagcacagtgcacttgatgtttgggaatgccgttgctatggctgcagctgcagcgccatggccaccaccaacatcaataagagagctgatgccctggaaaatgccacagctctccttcaagatgatatccatggcgacacggctgtcctcaaccatgccggcgttgaacacgctgccatccttggcatcgttcgctatcatctcccaccgcgtgcaaccatgcgccacctcgaagggtgtcatggtggttgccttctcggtggtgaaccactcgtgaatgctgaaatgagagatcacggcgagtgggttggctaacacacgcgccatttgggacaaggcgtgcgttccctccccatcgctgttgaggagaaggcgagagactcgggtgagtgtgtacatggcctcaccattgcggtcttcgacagcgaatatgccagtgacggtgagcacgcgcatgagccgccggaggtgggagagcttggtcgggtgcagcccgacgttgagcgcgaggtcggataaggtggcggctccgccattgcggtggatgacatccgcaatgcgcaggtcgatggcggcccaaagtgctgtggacttgatgaaggcgaagcagtggtggtagagcttgatctgagcttggatcaagtcatcggtgctcatcatctgctcatcttcttcttggacacgttgtgccatggtgttcttcgtgcagtaaagtactacaagtgcaatcttatggcgaagagctaaggctcttaaataggatcagtagacgtgcaagtttatattcataattaaaattactaatgatctcctcccaccatttacctatactagcttataattaagccgctgccaaaatttaatttgaaaacttagtagttttgaatagtttgttttctaatattcggttttaaatctctaaacacacatgtataaaagttttatctacaaaatatattttttctgataaatcatatggtttataatcagcatatattaggctaaccaaggatgcattattgtagcagtggtgccaaatcaatcataaaaaaaatgtggtcctatccttcgaatcattttgtgtcctttgttgtaatagtatcaatcttcaagatagtggcggatttgcacacaaactccatggaatccgtagccgtccacgtcgactgcccattcacatcacatgcttgaatgccacacggaagacaccgtggcacagtttaaaataattttcagggaatggagcaatggaagaagggatgattttgtcggacgattgtatcggccactgtcgttacagattggcaggagttaaaaaccaccagatttcatcccgatcaagaagtgatcggggacataaattttgtttgtgtggtcggtagaaacagattgagtttaaatataatactccctccgtcctaaaatataagtatttttaagatctcgatacagtcttcgaaatactactttgaccaacaat

SEQ ID NO: 35756 - DNA, 1501 bp, Oryza sativa
caagattaagtacgatccatcccaaaaaggatcgaaataaaaaatataaaaacaaaaaaatacagattggaaaataaaaatcacagctgacatataaaatgaccaatccggtaatctgctcaccactcaagcatgtaaacgcaccatctgttcttttcttttacctaagttgttgagagctaaaacataataaaattttaaaaacaagtaaatttcataaaactgcaaatactttacatgatctatcacaaaactacagatttaagaatttgtttcacaaaactacagattcagtgtcttcgtttatcacaaaaaactacgggtactttgcacaatatatcacaaaactacatatttaagaacttatttcacaaaactacagatttaatatcttcatttatcacaaaattattacatgtttagtatcttcattataacaaaactacaagttttagcattgttaaaacctgtagtttcttaataacggagacactaaatctgtagttttgtgataaatgaagacactaaacgtatagttctgtgataaacaaatacactaaatctatagttttgtaaaataaattcttaaatatgcagttttgtgatagattgtacaaagttgaatggattagatttgatctctagttcaaggggacatgtttgatctgtacgtgcgtacgggacagaaacgaggtgatgcgatctcgcagacggtcgaatcaggagatgaacggaaatttgatacggacgagtaaaaatcccggaaacctaatgaatttttttattaggtatagatttcataaaactaaattatcatagaaccctagatttaacgtgatgtatcacaatagtatatatttaatattaaatttctcatagaactacattttttttatttagatgatagaaatggattaaatctccagcttctgcccattggcacacagccaacaagttttagaagtaataaaaaaaggaaggaattaataatagatgtgattggacaaattcccaactttcgccaataaaaggatcaactgaaataatgtttttaaaatcacatagattctagcatgaaattttgtaggtactacgctatccaaagtataataaaagctcttgactaccaattccaagcatgtagaaccaatgcgcataatatcctgttgttcctatgaaagcatcaaatactaagagtggagctgattggaacacatgatgataacctgcataatgttagacaatttcttatgttaaaaactctatcattacggtaattccaaattgaccaataaagcgcactaactccaaataaaatcaatattttggtgggccaaggcgctccccttagccaattatccaaaatatcttttgcattgcggggagggaggacattaaaggcaaagaagacacatagccaagcaaaacgtgcaacatggtgattagaaaaaaaaatactatacctgagttataacaacttattaggcgtcgttccacaagg

SEQ ID NO: 35757 - DNA, 683 bp, Oryza sativa
cgaatctaacgaggtatattaatccatgatttgctaccgtgatgctacagtaatcagccgctaattatggattaatatacatcattagattcgtctcgcaaaatagcctaggggttatggaatcggttttgtcggtaatatacgtttaataatcctaaatagtaagattcttgagggctatttaatagcccgaaggatccaaacaaggccattgtgttgcgtgtgcagtgacatgtaatcgggaaaaaaaatttaagactaaaattttgaactagtagtatgaagctacagtgccttcttcctgcagctagctactacctccgttccaaaataagtgcagtcatggatatccatgcccagcgtttaaccatccatcttatttcaaaaaattgtgaaaaatttgaaaatatttagtcacatataaagtatcattcatgttttatcatctaatagcaataaaaatactaatcataaaaaaattttaaataagacgaatggtcaaatgttgaatgtgaatagtgtaaaactgcacttattttgggacagagggagtagatgcaatggcagagatgatctcgcattaactaacttcccccctccatggatcgatctcatctaccccctcttcccctcccatttattgcaaccccatgtcgatcgccatggcagcagcagcagcaacg

SEQ ID NO: 35758 - DNA, 404 bp, Oryza sativa
agctatgttttgctcacttttttgtctccaaaattttgttgttagttgatgagagagaaaatttgtgtgggaaagaaagaatatatagaaattttgttaatttgctaaagaaggttttataaaatagttgagaaggaaaatatagtgaaagttaatcttaaataatagaaaacaaactaaattgaaaaccaaaagaagtacaacacattaatattagtttaaaagttcaaaaataataaataagaattatttggtggaatattttataatttttgtatgaataatgatatgtcattattgtatgacctttggaagagtttgtgattattttattattattgtatgactgtcattattgtacgaataattatttgtgtacgattttttttttcatttcatgtaga

SEQ ID NO: 35759 - DNA, 1501 bp, Oryza sativa
taatgctctttttaattatgcaccgaattattgaaatgtattattctgctctctaattaaaaatacatttaagaaaatcttctgttgtattgcttagatagcttgttttgaagtttactttttaaatatttaatttatccatataataataaagataatatatgataataatccgttcgataatctaaatcaaacggaagcttgtgtcatggttgcgaggacgtctctacctctgtcttgataattatatttttttaatggagttatttttgtgcgaactgaataattgtttgactcggtacaaaattataatagtgaaataatgatacaaactacaaactctcaagtaggcattaattttccattcattttaagatactttatactttatatactaagatattgaagattagttataacaaccatgttgcctacatcagtatctaggtgttttaaaacaatactagtagtattattcaagtgataacataattagtagagctttagacgggttgtcccttgtggtttctactttctagttgcaccaactgatgctcaaccttggagggtacctgtttgtgatggagccataattgcagggtgttaggtcccatctggagccaacaaattggattgccggatcatgaagcaagatgatcagaaaaacgagcagatgactcgtcaatttaaatcgcaaaggaattcacacagtgacacagaagggaacacacatcgctggtcggtaccaacttaattaattttttatgggaaaggaaaaagggtataatggaaaaatgagatactggtgttcttttaattctgaacctccgcatactgtgatattgcagatgacaccttgatgatgggattttggggttaatctcgctagctctctctgcgatgattcctacgattcgggaatagaaacgaggcttaaacacgggtgctaaatagtttgataagattggcattggtgccagcaaatttttggtggtgtttgaatctcctaaggatgaagattaagtatttcacgcaaaacgaggtggtaataacaagtgattaattgagttttaattattacaaacttaaaaaatgaattaatctgatattttagaacaactttcatatagaaagttttcgcacgaaacgcaccgtttagcaatttgaaaagcgtgccattttaatccaaaatttaatccactctttccagtggattcgaacggggtacatgtaccgttctcttttttttaaagaattacgcagtacatgtaccgttattgttaaaaattcgtttgaccaagattttaaaattaaaattaaattaaattttgcaaggaaacttcaaattgattgagcttccatgatccatcttgtttgggactacttctagattctctttttgcaatgtaagatactcatctccctccgtttcaccattataagatggtttgatctattcatctatcgtctggatttacttagatcaatataactttggaca

SEQ ID NO: 35760 - DNA, 1501 bp, Oryza sativa
gaatactctatttttgaatcggaatctctacgttagcctctaagaataaaaatatatgagaaacgttgcaacagaaaaatcatcacttgcaagggatacttccaaaggatacatgcaaacaaatggtgcaaataaattgtgaaaaatctgttggattctaatttactttggttggtcttagcctaatataatcacctatgcttaacatggaaattaatctactgagctgcttgtgaagctattgaggccggtttctttgatttatatcctacttgcggtttttcttcttgtctctcttacagttttccttcttatattctctgtttgacatagtgaaaaagcttcttaatgccagctacactaccccaagataaccacataaaagccttccagcgtttaaccgatcgggcgattaaggtttagagttttgacgcaagaattagacatcacctctactctacattttctcctatatataaacccactggtgaggctcaaggcttaattattgcctactccctccgtcccaaaatataagtatttttagcatagtgccaagtcaatcatttttaactttgactattaatagcaaaaaaaataataaaaaatcatgtaaaattgatgttactaaatttatcattaatcaaactatcataatatgcaactctttctatttaaaatattttatttttatagatattgttggtcaaagtagtatttcgaagactgtatcgagatcttaaaaatacttatattttaggacggagggagtattatatttaaactcaatctgtttctaccgaccacacaaacaaaatttatgtccccgatcacttcttgatcgggatgaaatctggtggtttttaactcctgccaatctgtaacgacagtggccgatacaatcgtccgacaaaatcatcccttcttccattgctccattccctgaaaattattttaaactgtgccacggtgtcttccgtgtggcattcaagcatgtgatgtgaatgggcagtcgacgtggacggctacggattccatggagtttgtgtgcaaatccgccactatcttgaagattgatactattacaacaaaggacacaaaatgattcgaaggataggaccacattttttttatgattgatttggcaccactgctacaataatgcatccttggttagcctaatatatgctgattataaaccatatgatttatcagaaaaaatatattttgtagataaaacttttatacatgtgtgtttagagatttaaaaccgaatattagaaaacaaactattcaaaactactaagttttcaaattaaattttggcagcggcttaattataagctagtataggtaaatggtgggaggagatcattagtaattttaattatgaatataaacttgcacgtctactgatcctatttaagagccttagctcttcgccataagattgcacttgtagtactttactgcacgaagaacaccatggcacaacgtgtcc

SEQ ID NO: 35761 - DNA, 1501 bp, Oryza sativa
taaaaaaaaatcggtttcttggactgtaggtttttttaagggaaagactatagggttctatatggtggaaatcagaaatattttttttttgccgggggttggggggggggacattgctgaaatttcggttagaaaaaagttgaaatttgaacaaaattttgtttagttcattttttttagggaagtttaattaaaaaaaattgaagagtggccaatcaattttggactgtacatatgctaattctgaatcttcagctcctgaatccgttcttcttgctagcagaggagggctatctcccctcaatcttaagttgttaactatttcctttgtttcacaatgtaagactttctagcattgcccacattcatatagatgttaatgaatctagaaagttttacattgtgaaacggagggagtagcattaacaaagtccaaaatttcagattgcacccaagcttctcaaacggccgtccctcaaatggctttgtaaaaatttctgaagaacttgcccaaggaggagatgaggggtctgaactctgaacctgataagcacctagtagtttcttaaggcaggtactgcaccaaaacaatctcttcagagttcaaatcaccccccacaagcaccaggaaatcaaccattagttgatctgccatcatcacaacaacttgctcagtcggcgtccgaattttaagctcagtgcaaaactgtagcatccacattcagaatttcagatatcacaaaatccgtttgacagccaaccattaatgaattattaatggttgatttggttgaattgaatgtgcttatgttgcattaattattttaggctcttgtctgattatctccaatgaaggcagtaaaaatacttgattcttttgtttgtgccaaaagtttactctgcatcatttggattgagtgcaggctctaaagtctgaacttcagaggagttaagaacatagaactgtgtcaacgggcggtaacctcatcagtgttcctcaagacaaaagacaaatcaacagacttcgaacttcgtcaacagctggatttgctcaatacgtcaaaaaaaaaaattttgtgatattcaccctgaatctttcttatggctccattcttcagtgtcagcttcaggccttcagcaattggcaatactgcaatagctagtaggctgcaaagatcatttgttcagtgtcaccttcagtaatacgcatgtatagcttgagcagaactgcaaaattcaaaccaatctcacctcgaattttgaagctattttttttctaaataactttcatatcgaatcgcaaagacaagatatttcatcaaactttcccaaaaatgggaaaccacacctgatctttccgcgcgcgagcgcgagctgatcccgcgaagccgccgcctttaaatagcctcctatccgttgctcacatccccatcccctcctcgattcgaatcgcctctcctctcttcccaaccaaaccctcctcccaaaccctagaaattcc

SEQ ID NO: 35762 - DNA, 1501 bp, Oryza sativa
aaccgggtcaatcgatgaggatgagcttcagagttttgtgcctgagttcgtctctctgccacaaggaagctgtgaagctgatgctgaagctgacagcggtggtggcgtagcaccggcgcagtttgctgaatttggaggtccagagagcatggatgacccgttgaactttccagcagaagccagtggcggcggcgaccgtgcagcaccggcatcatcttgggtgtcatcgcaggacaaccaaaatgatgaggcgccaatgttcttcgagcttccagagagcctggatgacatggttggctgctttgactttgccgccatggatggccagagctgcactagcgccgtgtcagagactgctctgatcgaggagctcgttcttcctcctgcagcaatggtgaaccatcacgatgactctgtctctgacatcgccgatcatggctgctccggcgccgttcctcctcctaattcagaagtggtggacctccccaatgactctgtcggcgccgatcagagctgctccggcatggtggacgattctctttccgggtactatgaggctgagctgaaggacgccagcggtggtgcagggtccatgatgtcgtcgccggacaagcagaaggagcactcctcatcgggtgtcatggacgtggaggccactggttttggagttccagacagcatggatggcctgagctgcatcgactttgccgagacgatggacgacctgagctgcatcgacttcaccattgatgatgagttgtttgatctatggagctagagatggattagcagtgacattgtcctttgtagaaagagattcttgtgtagataaagaagcatagatgtgtaggagcttaatcctctgatggctagtatagtggtatttatttagctaagcagatatcattagctgttgataggttgagttaaatgtgcttaagtagtactaattgtactccttattcatggcaataaaatatttacttgattcatttgtttatgccaaaagtgtactttgcatgaattggattcagttcagactctcaagtctgaatttcagaaaagttcagagttgagttggctgtttctgtttcatggtctgtacatgtcaagtaattgtcacaatgtccttgactccttgtagcacaacattgtcctgtttgaattgaatacaagcaagtctagcatggataaaacctttcagaagttcacggattggcaataggctgcaaagagtatttttcagtgtcaacatcagcaatatgtataccttgagaaacactaaaatattctgcccaaactttgaaactagggacagtctagatttcaggcaactgaaatctttgaaaaaatcagttaccttttatatccaaactaaacatcaagacattatgtctcatcaaaccttccaagaaaagacacttcccctggtgaaaagaacaaaattctggacagatacaataggatggcacagaaggaattatcaaggaaaaaagattca

SEQ ID NO: 35763 - DNA, 1501 bp, Oryza sativa
agacactcttttttttattctgaaaacaccttttttttcaaaattttattattcaccaaattttcgtttaagcacaactcatacagggctgaggtaaatttgcatgaacatgctaaaggagcgattagtaatatacgcaccgtgcaccttgataggtgatatctgtctcctttgtatgttagcaattgatttgttcccggctctgacctacctccattgtgaattgaacttgaggactcacccgtcaatttgaaaactttcctgcaggggttagtccacagaagatatatatccaatgtctatgaacatattaactctgaaattcattagtcaaactaaactccatgtccaatttgattaaagtagactattttcacctaagcaccatgcttaatttaaaaatcctatagatgtctcacgaaaacacccaaaccagagcatatgcaaatagacataagaaacataaccatgtatgatcaagccatattcacatagtggtactattaagtaaaggtttggtgaaccttggtttatttttcgcatacctgattgtacttactgccagaatgatggataatttgaaatctctagggcagtggcatggtcacatatcattgtcgttttctcctccatcacaatgcaaattgtagcggaggaaggcaccttgaccatgccaactcaagcaagcaagttggtcatgcacacacctcaggtgcaagaaccttgtgccttgaaggcgtgatccgttggcacaatgctgtagagacgtaggatatctctcttttttgggcaaatgtagaactgccaactggagtggagcagcaaatgcctagaaaagaagagggcaactcctcttgcttgtatgcgcgaaagtgctgcgggagtgagaagttgtgcacagctaggagtggataaagcttgagccaaggcgacacatgagctcgatagagggactaggtgtagcctggcaacatgattgctactagtgagatgtataaccatatttcaaagacacgcacataatgcggtctttgatccaaatgtatctcatcagctctcttgctcttttcttcttctcccatttttttcttttcttctgtctctcttttgtcctctttttgttttcattatcttctttttttttctttttttttcaggcaagctaggactaacaccaacttcaaaccaagatgaccttggttgatggaactcgtcatgaaaagcttgtcgacctcccccacacttcgacttttgtgtcgcaagacatcaaaaaccaagtgtgtgatgtcggattctcctatcgagtgtgttccaataccaaggatcaccaaagcgtacagttgatgtagctaccatgttcttaggcatcgcatgaccctcgttcttaatctcaacctgcaatggttagcgaccaagaatacctgaaggtgcatactatcctaaaaattggttcttgcttttattagaaagaaaacttaccatgataatccggggtatctcc

SEQ ID NO: 35764 - DNA, 1501 bp, Oryza sativa
acccctatttatccatctgatcctcgtgaaatcacattcccctactgcctatctcggctacattgccctttgccaactatagggatggtgcggaataaccgaatataatttcagctacatcgcccagtgggttcccgttgatgcctggttgatttagtacaatgaaatcaacctaaagttccctccgttttaggttataagacgttttgattttggtcaaagtcaagactactctaaatttaactaattttatagaaaaaaacagtagtatttttaacccaagacaaatatattataaaaatctattcaattatagatttaatgaaactatgcttgtgttgtaaatattaatattttttctatatagttagtcaaacttagtagtttgactttgactaaagtcaaaacgtcttataaccttataacctgaaacacttataacctgaaacagatggaagtatattgtatattcagtgtattatgtaacagatgcagtaacctccccacgaaaaaggaaaacctccccacgaaaaatgaaaagcaaaaggcactagcccctgcactatctgtgcgccatggcgtggagactatcagccgaaagtgctgaacttaggggcaggaataggaaaatcgtaaggctgcataagaaaaatggaggattagtaaacaaaggaattttggctgagtttttttctctaagtttccaactcactcatctcgtttttcgcccgcacgctttttaaactgctaaacggtacattctttttttttcaaaaattctctttacgaaagttgctttaaaaaattatattgatccatgtttagaaaagagctaatacttaattaatcacgcgctaatggatcgtttagttttccatgcgtgggaggcgaagttcctaactcacctcccgatcacaaacacaacctttgtaggattagatgttccgaatatagggatagaaaaatgaggatttcatcttatggctgcctatgatgaaaaagaaagaggttggagtggtgttgacgaaaaaatagaacacagcggcctgagagatctgcttaactcctgtgcaggtccaaagattgatgagatgcgggcgtgccagtcagtttgatcctgcaactgacaagatatgcaaataatagacaaaacacccgatcggctgacaagccgatggagtagttccagccgatggccgataatagccgatgccaataccagccgatagcgatagggtttaagcaatcggctatatgtccaatatagataatgatataaaggcaatcggctgatgatgatgtaataaaataacaatataattcagtagaaatcaatcggctaacaatatgatatagtagaacaagtattgatctaaaggttaaagcacatatcggctggtggttcgatgtcattaaatccacaagattagataaaacagtgaaacctttgttgtcatcggctaaatccaacttatatgtatgtgcaatccttacgagccga

SEQ ID NO: 35765 - DNA, 689 bp, Oryza sativa
ccactcgacatcaaggcgcactgtgaacagcctcatgggaagagagatcgacattagtcttattggcgccgagccatttaacctaggggccagcctctaaaaagggctccagaaaaggattcatttctgaaaatagttttttaagatctatttatgaaaatagtctaaaagaaaagctaaattgtaaaaatttcagtgttcctcgagctcctctgctttatggtctttcatgggccagccccaaacacactaatcaaatggaccgttctcctttgtgggtttccatgggccctacccaaacgaaacctccagatgggccgtactctcggctgcccatgggccgggccccaacggaacgcacggataggttgggcttgggctggattggacatgacgccatttgaaggcccatccagacagcgagagcggcgccgcggccgctacttctacccgccgccgcctctccactccactccactcctcatccactccctctcgccgccgcctgcgacctcgccgccgcgcccgcctcacctcacctcgccggagttcccccacggtacgctccctttcccttctctcgcgccgccgtccggatccgccgtgtcgtaatcaccgcgttctataagaggaggatttctcacgatttggtggttttacgtagatcggggggcatccggggtgggcga

SEQ ID NO: 35766 - DNA, 1501 bp, Oryza sativa
  unsure (1)..(1501): unsure at all n locations
gcgaacatgtggaataacatgatgcattgcacattacttatgatcttgatcaatttcactaaccgctgtttatactttatataacagaagatattgtgctcgttgcaagccaactaggtactaccgttgcatgacatcggtggtcatggcatcacttgctggtgacgtcttgagctttagaactgcaggcactaactggatacccacttcagacggtgggtgaagatggaaactcatgtgaagaatgcaaggtcggccagatatattggtcgacatgaattgtgaatttgtggttggaatatatattgttagagatctccatatcttgtattgttgcaatggtattttctttgcaaatgtagagataactgccctaaaaatagagcgtagatgaaaccccctttctccttcaggaaatggggacataaattagtaggttgtaaattatttgcttctgtgccatccgtgcctgcaaagaaattgcggcactgtacagtatgcagcgcgctatcctgtatcaagaaaattattttatgaatcctgtgactaatatgaatctgtgtaaaaaggtttggagaaactcatttgcaacacgttctgcaaagcgatctggcatgtgactcagtgattgcatcttgtacggcgggcacagcattaatgaattctgcgaagaaaacagaattactcgtgtaataaactgaacaannnnnnnnnnnnnnnnnnnnnnnnnnngtcatactgaagatctgaaggtcgcgtgttcgatccacgctcaccgcatgatttaaaatcttcttttttttttggccatttcttgcaagccagatgaattttattccaacttttgccagcaatgtgaaaaacgttaaacctccacccttttccaacttttaccagccagagaaaaatgttacagcaaagctgaaacacaggtgaaatttcttcgaacttttgccagccaggtgaagaatgttaaagctcagctgagacatgtgcattcagatatgcatgtaacaacttccaacagcaataccagattacagaatcccactcgagtttattgcggttaaatgatgatgccacattgacaccatatgttcttgattcgattcatgccatattgacaccaatgtgtcctgattcagtgtaggttacagaatccagtcaaaaacatatcctacaaaaccagccttaaggtgaacacgattctttcaccaaagttcttaatctttcatgaagtatcgaggtgagagtgaaaccagatgttccatcgttcatctcccgccaaaaagcaacaaaaattctcccacctcctcgctacaacaattggcgccaaaacacaaaaacaaaaggtttttttctaccgccaacccctacaaacatttacacccgcagcctttcccgccacctccccattccgacgaccgttcacttcttcccgcgcttcctggtcggcttgtcgtccttggccctcttggaacggggcggcgtctgcggcgcg

SEQ ID NO: 35767 - DNA, 152 bp, Oryza sativa
cctgaatgcgcgtaggtgcattttgtcatatgacggatgtgttttctcctcaaattacctgcatacacatatttcaccaacactagtggaaatgattagtaataatacctaccactaagttggataccatgttttatttcattatatgtagg

SEQ ID NO: 35768 - DNA, 1501 bp, Oryza sativa
aggtgagattggtttgaattttgcagttctgctcaagctatacatgcgtattactgaaggtgacactgaacaaatgatctttgcagcctactagctattgcagtattgccaattgctgaaggcctgaagctgacactgaagaatggagccataagaaagattcagggtgaatatcacaaaatttttttttttgacgtattgagcaaatccagctgttgacgaagttcgaagtctgttgatttgtcttttgtcttgaggaacactgatgaggttaccgcccgttgacacagttctatgttcttaactcctctgaagttcagactttagagcctgcactcaatccaaatgatgcagagtaaacttttggcacaaacaaaagaatcaagtatttttactgccttcattggagataatcagacaagagcctaaaataattaatgcaacataagcacattcaattcaaccaaatcaaccattaataattcattaatggttggctgtcaaacggattttgtgatatctgaaattctgaatgtggatgctacagttttgcactgagcttaaaattcggacgccgactgagcaagttgttgtgatgatggcagatcaactaatggttgatttcctggtgcttgtggggggtgatttgaactctgaagagattgttttggtgcagtacctgccttaagaaactactaggtgcttatcaggttcagagttcagacccctcatctcctccttgggcaagttcttcagaaatttttacaaagccatttgagggacggccgtttgagaagcttgggtgcaatctgaaattttggactttgttaatgctactccctccgtttcacaatgtaaaactttctagattcattaacatctatatgaatgtgggcaatgctagaaagtcttacattgtgaaacaaaggaaatagttaacaacttaagattgaggggagatagccctcctctgctagcaagaagaacggattcaggagctgaagattcagaattagcatatgtacagtccaaaattgattggccactcttcaattttttttaattaaacttccctaaaaaaaatgaactaaacaaaattttgttcaaatttcaacttttttctaaccgaaatttcagcaatgtccccccccccaacccccggcaaaaaaaaaatatttctgatttccaccatatagaaccctatagtctttcccttaaaaaaacctacagtccaagaaaccgatttttttttaggcaaaggtttgaagccaatgatctttcataaataaaagaaaaagaaaaagtctgaactcaatgagataacgtgttggcgtgaaatatacaaaactcatatacatctcttcactctctgctctacagaaggcactcaaatcaattcctacacgcgacaatgtgccaatgtcagtcttgatctcactccaaatcggatccaaattacatcgtgttcggacttcggattcgaactaattaagcgtcccag

SEQ ID NO: 35769 - DNA, 1501 bp, Oryza sativa
tggaaactaatcaaaatggttcagaagaaaagaactctgaggaattataataggtttttacaattgacaagtccatataaaaggctttatgtaagtagtatcagttgcaaattgcaaatctgagccacacgcttgtaatgaatcaaaagagaggaatagacatatcttttcattaaatgcaaatcactgcagaactatggatagtgcaggaggaggttgaggctctgttgaaggcttgagaagatggtttgcagcaaaaatgctctgatcaactaatcaactagcaaaaggtgacatataaatgctttcgcatacagggtcaggttatgccacagagcaaagctaggtagcttttgaattttggcttaggccctgttagttcccacacaaaaacttttcaccctgtcacatcgaatgtttggacacatacatggagtattaaatatagacaaaaaaactaattacacagattgcgtgtaaattgcgagacaaatcttttaagtctattgctccattatttgataatgtggtgctacagtaaacattttctaatggctgattaattaggcttaaaaaaatcgtctcgcagcttacagacataatctgtaatttgttttgttattagtctacgtttaatacttcaaatgtgtgtccgtatatccgatgtgacacgccaaaacttttcacctctggatctaaacacagccttacttttacctgcttagagtagtcttcatagtcccatctttccttgatgaactgatgagtagagctcaagtcttactatttgaaaaaacatgtcacaatatcactgacaacatattctggtattactttgagcagcaactgaaaagaagaatcaccaatactatgagacatgaatttctccttgaaacatacagaacgttaaccttatcatgaaataatcaaaacggcataatgctaactttttttaaacagaggacaagtactgctttcatttttcatcaagaaagaaaattcatacattctgtgataaagctagtagtgcccagcctatttgcagcttcttttcttttctttcagaagctgaactagtgtggtactactcgaaaggcaggaaataaatagctaatgcctatgcgttcaatcaggtcttgccgtgcgagattagctctgagataaaaacaggccacgcacaacttaaggtagcaaatcatgattatctaagagggaaatacttgaaccatccatcactttagaatagggtgttctagatgcaggaagtaatatgaactttaggacaacatgtactgatgtacagtttaaagcatattatcactagaatactagattagggaaattctccacaaaaagcaagcccgggaggaggcgaagaacgtacctaccagcattcccgaatcccagtcccctagttactgatcaaggcaaggaagcattctcggcgaccaaatacctagccctcactcggggtagcagcccccgtcacaggcattgccga

SEQ ID NO: 35770 - DNA, 1501 bp, Oryza sativa
atatcagtacccgccgtcatctttaggtttttgggttttgcttagattattctgtcaagaacagtttcgctgctagatcggtttgtggaaccctaaattcgagtgcttaatccttcatatgcaatttggttgcaatctatcttgttcttgcttgtgttcttcgattcgcatgcagggattagccttctcggcgaggtcaaccgggtttcggcacggctgataaccagaggagacgtggtgctccgattgtggggctcaagagcgtgcgcgttcaagaagccggatcgatttgtgtcgtgactctttgtgtcgtgactccgcccaaatcgttgtttatcataacctttcggaagatcgggaaccctagtgcacatcattacctttgtttgttatgtatcccacggatttgtcagaggcaggcggcaggtggtgacagccctgaatcccgtccgagtaatcctccacgtttggatacatcatagagctatagcagaaaccacgctagcagaccagcaggggtcggtgcccgaagcaacagatatgaaattaccttgcttagcatagaaaattaaaacacatacatatagttgttgtccttggatcgtcttagccttaggtagattacacacgttccctgagtacgatatccttttggggtcacccgaaggtgaagtgctacaacggtattccatgcgcttgcggatttatctgtggtcgtaagaaataccaacaagcatttctggcgccgttgccggggaacggttgctaatttatccgagtctaggtcatcctcgtatctttattcttatttcttcttcttttattccttcccttgatgaagcaacccacaattcaaaatctttctgctcctcgggctgatctttgtgagccgtcctgttcttcaaaaccaatcctttccgatggctacgaaatcggtcctagctttatagccattgttcgagagcaaaccttctatggtggtattggtgaaaatccatacgtccatctttgggactttgagctagtgtgttcatgtttatcgatcgtaggcatgacacatgaggctctaaagtggaagttgtttcttttttctcttagagatgaagcgaagcaatggcacactctgtctgtcaagaaattccacggtgaatgggaagtgcttaagtgcaaattctgccttgctttctttccattaacccgtgtaattaatcttcgattagacatcctctctttccgacagaacgagaaggaatctctcggtgcaacctgggccaggttctcactgttaactaagtctggcccagacttgtctttacccaaccatatgttgcttcaacattttcgatacgggttagacaaggagtctgccgtaaatctcgatatttccgccagaggatcgttcgcacagaagacaaccgacgagggaagagaactcttagatctgatcttagagaacgattcttttggccgaagcggagccatctcggaggtcgagattatc

SEQ ID NO: 35771 - DNA, 158 bp, Oryza sativa
actagtggatcccccaaggaggaccttgcccaccgaagaaagagaggggagatccagaacaagaataggggggacgactctgagaatacctgagctcagggagatccagaacaagaataggggggacgactctgagaatacctgagctcgtagaggac

SEQ ID NO: 35772 - DNA, 1089 bp, Oryza sativa
cggtgtactggtaaattcctgtgttatatatccagcgtcaatgacaaggatgttactctaatatgcaccctaaaaaccctttataattttgctacacatttatcgataaatttaaccgatgttattacagtgcaaccgtagtgtaattatactataacttatatgtaattacattgtaatttatatgtaacttcacatcattttaaattgttagatttgtttcaaaatttatgtatgtgaggaagtaaaaaagtcactcacacacatatgagaagattcgttgacacgatccccgtttcactaaaatagtatgttacggagagatttttgaaagttacagtgtaattttatgacgattgaattataattatatctgttaaattttttatggaaattttgtcagtagatatgtaggtaatcccctcgaaattaatctactcttagagcatccataatatagtctaaaagtggtccataagcaatacaatatttgtttcagccacctatcaatattgtgaaactagacaactagtccatagcaaagaaataacgaaaactacccataaacatatgggctacccatagagaattaaatatattagttttctctgcctcttctctcctcctaataataatgtaagttcatataaatgggtctcatttgtaatatacatttctgttgccccttagaaaatagaaaatacttcaagactcgtctcaccggttcgccgataagtttttcttttaaaacattcttagcgagtctacccgaaaattttacttctctaatttcacgatcgcgttgaagtagttgaactcgcctcatgatcaaaaaaaaaaaaaaaaacagaagttgaacacgcctccccccttggctcgtcgccgacgcctccaccaccctcgcgtttcccacccgattccaccccgaaacccctcaaatcgagcgcgaattcctctccaatagctgcggctccagcctccggtggattctggtctcgccggattcgagctctggtcggcggagagcaccggatccggaggtcacgcgggcaattggtgtgccccggaagaacaagaaccgggagacca

SEQ ID NO: 35773 - DNA, 1501 bp, Oryza sativa
gtatcgaggcattcgtagcgaatatttcgtacgattaaaaaggcatcatactttatttgaaaaggttaaataaaagtttccaagaaaatgaaatctcacgaaaaaaaaggttaattctattggcttaataattagtctactctactctctagcctctaagttttggcatccgtcctttacgccggtggtacagtacgaggcgatgggtgttgggtagagtttacagagtttacaacatcgtacgtaatcttaatctcgtcagtttttaaaaccatggtatacctcatgcttacaaatttaagcattccactgggcattcattacccaaccccatatccatacccacatactccctcctttcctaaatgtttgacactgttgacttttttaaatatgtttgaccgttcgttttattcaaaaacttttgtgatatgtgtaaaactatatgtatacataaaagtatatttaacaataaatcaaatggtagaaaaagaattaacaattacttaaattttttaaataagacgaacggtcaaatatttttaaaaaagtcaacggcgtcaaatattttgggatggaggtagtatttgggtagcgtataggtgaaaaagtttaccatttaaactttagatttggggaaggtattatccattttacccacttcgtccatacccatttgctgcgtgtaaaatttgaacctaaaatttttaaactcgcgttcacattagaaaatcttatcaaatttaactgaaatttggagggatgatttattatatattaagagcaattttgtactccttccgttccctaatataagggattttgacattttacttgcaccgtttgaccattcatcttacttaaaaatagaattatttttttgacttactttattatccaaagtactttaagcacaatttttcgtttttttatatttgcataatttttttgaataagacgagtgatcaaacagtgcaagcaaattgtcaaaatcccttatattatgggacggagggagtataatttttgatccatttctacgggtgaaacccacatatgtctcttctcttatatctattgggttatccaacccattgagcaatacccacttaatttaggtatggataatatttttgtgatggggataagtaaaattggatatggtacgggttatccaatacgatagtcctacgtcaaatcatagggtgatggtaaccctatttatgctgagttcttatgtctaattttccagctcaccctcctagtttttcgcgcgcaagcttttaaaactgacggtgtattttttaaaaaaaattctacgtaaaagttactttaaaagattatattaatctatttttaaaaattattttaactaatatttaattaatcatataaacactgctccgttctacatgctagagaaccggagtactccggaacataggccctgtttggatccggagggctatatattaaatagccctccgaaatcttactattt

SEQ ID NO: 35774 - DNA, 746 bp, Oryza sativa
cagttcagttattagactttctttctcctacaaaagtcaacataatgttttcataaaagaatggtaggaaggggacaattacaatttaggatttccattgttgaaattacccaagttatagcatcagactgcactttaaatgctctgagaacaccagtgtacgcttgttgctcgatctgacgtatttctctgtccacgttgctgtgtaggtttggttgaggaagtgatccatttccattgaaaatcactcttggtcctctaggttggtatgtcggaggaaggtcgtcatcagtgcctgcagtcaagggcatagtcaataccattgaaatactgaatacacacattgtcaagagtttgaggtttcgcaaaatcatatctagatattctctacatatgtggatgctccttttaagtaattaattgacaattctaccaaaatagccacgtcctaattcctgacaagctacaattacttgtatgtaatctccataacagcacatcctcaattcctcacctcatactactctacaacgctacgaatctccccttcttcacaatatatatttaacacaaggcattatacacatttaggtgagttaatacccttcctcaaagattcccctccctgtaaaatccacctccattaatccatcacttatcttccatactcacaacaacttacaacgcacaggaaaagcataataatttttttagaggagcaaaaaataatatttgcaatttctgta

SEQ ID NO: 35775 - DNA, 1501 bp, Oryza sativa
gacgagtggtcaaacattgcaaacaaaaactcaaaatcccttatattatgggatggagggagtaatgaatttgaatatgagactttgcagatatgtgtaatactattaggagtaaatgtccaatttcttatacttcctccgttttacaatgtaagttgttctagcatttcccatattcatattgatgttaatgaatctagatagatatatatgtctagattcattaacatcattatgaatgtaggaaatgctagaatgacttgcattgtgaaacggagggagtagaatttttcgtgacatttgctagttggtgtgcacggagtgtgctgaagcttgtgtgcaaatgatatgttctccattctatatcatattctatcagttgagtaatcatttctcttttttcctgttactaggtaccagaagaaggtttcgaacataattgatgatgttcttgagtggtctccaaagttagctttgtctgggatgatggaaaaacatactgggactaatgcatcagaaactagcaatcacaccagtggaactgggagtagtcctgtccctcccactaatgaagggaataccgcaaaagcagacccagatatggatcgtcagacgaactcagataaagtccaagatggtgatgagtatggtgatgacatgagaacaagatttagtgaagtttagaatcgacttataaactctaaagctctggtaatttggagtacttaccctcggggatttatctgcagaatcatatagataggttactgacaagttcaaattcagggtgctcatgttttgaccatgtttcattcacatattgccagcaatggctgtattacgaggttctcaaagcatattttcgcatggctatgatgtaaacgtgcctcgagtttgcccgagttgagaggttgagaatgcaatgtgtccgtgtccgtgcgtgtgagccgtgtgccaccgacacgtcctgtggcagtgagccaatatgtcttgcctatcgttctgtggctgagcctcagcaggcttgttacattcctcacactgatgacaccttgataagcgcatatgcccattgttcacatcccttgtcccttttttttttatgggaaccgatttcattactatgacggcccggccaggaataagttcatccgaggtctcccttaatgtcaccgaatctgattttcgtccttcaaccggaaaactacatcggatccctcaactattaaaaccggtgcagattaggtctctcggtggtttggaaggcggttttcattgacgtgatgtttatgtggctgatttgactaggtctttatcctatgtggcattgatgtggcgcttacgtggcaattatatatcagaaaaataataaaaatagtggcccacatgttagctacacacaaaaaataacctccctcactcctctcttcttcctttcccctctctcttctctctctcttctttcctggcagcggacggcacgggtgggtggcggagcagc

SEQ ID NO: 35776 - DNA, 1501 bp, Oryza sativa
tgttctgtactttcatagttgttccccttcgcatctatccttgtggtcttccttggtactttctgcgtttggatgttacgtttggtgctgttcttttctctaacaagaattgaatgaagattaaaatttttatggtacatttttcaaaccgctaaatggtgtgtttcgtgcaaaagctttttatatgaaagttgctctaaaatatcatattaatctattttttaagtttgtactaattaaaactcaatcaatcatacgttaataccacctcgttttgcgtaaaaaacttaatcttcatcttcattttcatcttatcttgattgcctgatccgatggctatcaagaccattttagaccttaaccaaaaatctagccatgttgaaggatttttttgtgcgaaagcatgaatgatgtattgttgaatactatatacatgaatacatccaactatcctacaaatgatttcgattttaggcactgaacctttaaaaggtacgggcggttttggggtatgctctaaacccaaaccttcttccgctctcgcacaaaactgacaaaagaaccctcaaaccttctgtcaacgccctgaagtagccttgatttgtttccagtattatgaggggacctgcagtcctgcaggaatgatgcattttggtgttatagttctatgctcacgctttatagctacattaggaggatttctgacgaatggtttttatatgattcaattttatctttcagtttttttatttttaattttctatgtggtgggagaagtatgatgactccacttttacagtagtagaggtagtttttttttataacacaaagttaagattttttttttgacattcaacagagataagaaatgctattgaagcattgagagtttgagactaaggcttaagtatgtctgcaaaaatgccacgccgcctcaccgcccttttgcaggcggtcccaaggggactgcttgcaaaaaaaaatcggtgtcccctgtggccggccgttatgggagggcaacggccgtctgccatatcggcaaaatcgtcttctaggagggcgagggcgatggcgtgactagttttgtaaattttttaaatagaaaattatttttgtaattattttaataataaataaaattaaaaataaaaaaattccacttaactgatcgcttaacgggcaagatgggcctccgctccactggcccaaccacgtagcaagctccccttgaacagagtggaattttttttatttttaatttttttattaaaagttttacaaaaataattttccattttgaaaattgacggaagtagtcgcctaccgccctctgggaaggcgatttttaaaaatcgccctcccagagggcggcgaaaatgacgtggcagacggccgttcgctctcgggcgacggccgtcaacgaaatttgcaggcggcccccttgccgccctccgcgagggcgattttgtactgtgcggggggccgcctgcaaatgggcggc

SEQ ID NO: 35777 - DNA, 279 bp, Oryza sativa
aacacctaaaaaagaatattcctaacttaattataccgctgccaaagtgccaatgggttcatcatcttggttgatactttgacagattataaaatataagaggaccaaaagtagataacttgtcattttataccaaaaaatgtatttgtcagagtagcatgccaataagaaaataacagaaaacaacttgtggacaggttgagagtatattggaaatcaattgtatagaaattccacctccctggagtttcgatttttatttgatgccaaatcaataga

SEQ ID NO: 35778 - DNA, 1501 bp, Oryza sativa
gtattccaaggtatcatatttgtttaatcccgtgggaagattataatagagagaaccgtactaataatttatatattacttgtaataaccaaagtctaagcaggggttaatataattcatagggtagagtgtcactaagcagaagcagtcatcctcttatttatgattatctaagctaagtggaaagaatatagaaagatcatattcctatacttatagtatacatacatattatacatacatcctaattatattattacttagctaataccctctatccgatgccctcctgttgcttgttgacggtcgttagcgatcagtttcgactgtcaatattaccaaaatagagaactagttatggttgcaatgcatattagtgttagaataataatattccacgtattgggtttactaaccttttgcagagaataaccataaagtggaggagaatcaacatcaaattagatgatcaattaatcggacgatgtcgaggatcagatttatgtatgaatgggccaagaacttagaaatgacacgacgaattgggccaaaattcacaagtctgtggaggagagcatgagaggaggccaccaaccaaaatttgggctggttgggccggcccctggttcggccgaaccttcctcaccgccgttcgatctaggtctttgcctggacggtgtagattggctccgaacgggtatttccgaccattccaaccatcacaaccgtcattgggaagctataaaaggagctctcatcctccatttcttgacatacttcaagcaagagctctctcatattctttctagtttagtttagtattcttaagcttgtggagtaaggatagaatagaaatctgagtccagatgtaagagccttaggttcataccaggtatttagaagtgcatttgttgtcctttagatttcatatttactatactgcaatttgattatatgcgataacaaagttaactctaatcggtaaaattgaaaccacttctatttgattaataacttgaacagaagtatacatgtttaataatttattcaaatactagtttatttatcaccaacaaatataaattatgtggaatttttactctctgtttaggcctcctacaaatccaaaccaactttcagcctaaccaatttcatcttttcacaagatttcaaatattaggaatttatgtgtgaaactttgaaaagtggaacctataaaccaacacctatcaccacaccaaattcctgaattgttgaacaaattttacctaatcaaattgaatttaccaagatagggaaagaaaataaatcctggaaatttcaagaacgaatctatactcagtttttcacccacctcgacttgggcccacttgtcactgaccttgggtgcctctttagccccacaacacacccatgggtgtgttcccacatcaggacttaagggggggcagagaaaacccattcttcttactcccctttcatcttcactgcttgctctttc

SEQ ID NO: 35779 - DNA, 1501 bp, Oryza sativa
cctccatactcaagatctctaattctattggatgcatgcattatatttattagagtgatccaaactaggagatgataataattgtttcttggtctttaggttaagggtggttgtgctttatattttggaatggatggagtatctatttagtaattgctttaaccaacacaacaacgcttacctcctcccattcgagtctcctgtgtcactcaacgcgcgtcattgatgtaaaaggtcgttttttaatgagtttgtgacaactgcagctttaattcttcaagcagttgagttttttttatcctgattttgagaagttatagttgtaaaattcagaaaacgaactcaagacatctagattctcagaagctcatataaagtgttgtttagaggagtttctagctgctatatcttctcataaatccccatctccactaaatagttttgattcttagaatctatagttacatagaattcatagaatgaattagaagcttagaaactgaaaaattcatcttctcattctaaaagttgattaccaactatccgtttctcataatcttaggaagtgtttatatgcagggctgtaaagttttagcgtgtcacatcgggtattatatagggtgtcgtatggggcgttcggacactaataaaaaactaacatcagtaaaccacgagatgaatttattaagcctaattaatccgtcactggtatatgtttactgcagcatcacattgtcaaattacggagcaattatgtttaaaagattcgtcttgcaaattaatcataatttgtacaattagttattttttagcctagtagtgcttaataattcatactggtgttcaaacgttcgatgtgacagggtgaaaaattttagagtgggatcaccttaataagctttaaaagcgtgcgtgtggttgtagagctcacaattcacatgtgctgccattgcggagttgcggtgtttggtgttccacccgccgcagctcaccaccgctagcgccagcctcccaacacacaacggtcaggtcccccgatccccgttaagtccaatccccgacaggtattagtaccaccccgcatctccccctcctccactcgaaacggctacttcctccccttcctccccctccaccaccttctagaaccttccacgatgccgccgccgccgcggaagcgcctcggccgcgcggccctgctcctcgccgccgccgcctacctcgccttcctcctcctcttcgagctcccctccctcgacctcttcccctcctccgacgccgcggcgggcgcggcgatgcccacccaccgcccacgccgccgcgagctcgaggcctcgtcgtcgtcttcggcgttcgcttcccccgtcctccgccgccccgccacggcggtgtctcccgcgccggcttctgctgctgccgcggcggctggggcgctcccgatcttctcgtcgctgctcctcctcccccggcccaacgcgacggccaccccgttcgacgggac

SEQ ID NO: 35780 - DNA, 1501 bp, Oryza sativa
aattaaatatatgttaaaaagtcaacgtaaccatcttatgtatggcctgatacttgtgggtacctgggtaccaggcctgatacttgtgggtacctgggtaccaggcgggtaccaggcttgatactgaggtatcgcgattaatacctaatagagaaggccgtggcacggacgcataagatggtgaggtccggccggaagtcggcgacgaccatctccaggaacatgcgcttcagcaacttcatcttgaagttgatggcgaaagagaggaggtagaggttctagagcaggttgtcgccggcgttgcggtgacagaggcatcgagaccaccggcttcttcttcttctgcggtggcggaggaggagccatttgcactcaccggcaaggacgcggcgggagcagcgggcaaggacgatggcgctagtggatcgtgagggcgatggagaccttggcgaggagtgcgagggaggagaggagaggcctcggcgccggcagcaacggggagcgccagtagaagaagcggcgccgcagcgggcggaggacggcgtcgaggaggcgcgacgagatcaccctcgatgccgccccgacctcaccgacgccgtgccatcgtcgtccacctcggccgccggagacgacgacgacgaccccttcctcctagctggcttcatctccatgctcttggacttctcctgactcctgagtgagctagagagagagattgtggagaggaagggatcgaaggagataaggttgatgagaccttatcccgttgtgacgggatactgttgtgtagattttctctaatttgaaagcatattcctccaatcgaaaaagttgtcccctctcttataagtgcagtgagaagcacacggtacaccgtctactatcgagtcacgcacgtactccttccatccataaaaaaactcaattctgggtttgaatcttccagatttaaatatatgattggattttttatgagatggagggaatagagctgagcacaagcatggaatttttacgtagacaaagctagctagcttctcttgtactcatgcaaatttcactacagatttactacctccgtattttaatgtatgacgtcattgactttttaaccaatgtttgaccattcgtcttatttaaaaaatttatgtaattatcatttattttattgtgacttgatttatcatcaaatattctttaagcataacacaaatatttttataatttcacaaaaattttaaataaaacaaatggtcaaatgttgttaaaaagttaacggcgtcacacattaaaatacggagggagtaatttgctagtggccgtgatcgatgtgtgttggtgtatatgttacacacggctcatgcacggctaaggccgcgtgaatttttcccttgtagagaccgtagaatcggagtccgggcgtgcccagttttttcagttttactcagcaaacgagtcacgcacgtaatagcggagccaacacggggttcccacgaagcag

SEQ ID NO: 35781 - DNA, 1501 bp, Oryza sativa
tcaatgatcttttgtttggctctccaggcctttgcatagcttatggtgtacttgaatttgttctcgatgtgcctaataattgattttggttcaaagccaatcttaccaacaacactgctgtacatctcacttgccacaaaagctgaagtgatgtttcggtgatacttctccaccccttgtaagtagcacttgtgctcggtcacaatgctaactttccaataatcattccatttacccttatatgcatggacacgccacggacaatcttccttcatgcacctcacttcatacacataatttgttgacttgaccaccctaaactctctctgcaaggaaactgcccaatgcttcaccgcctccttcatctcatccttatgaacatatcttgcaccctcaattacctcgttctccttatactcccagggtacatgatcaccctctgatataacaagtccagagaagtcctcatttgcccaatcagtggccattacatcaccttcctcatcggatgatgcgtcgtcgtccacttcctcattatccgaatcttccctctccatttcatcaacaattataccgactctctccccctcatccgccatgcccatagcctgctcctcccttggttgattttcctcattttgcatcgatggtccaacaacatcccctgcattgataggaccctctacatcttcggtttgcattgaaacatttatatctttctcttgtaccgacacaaatataacgaggggccatgaccgttcaaaagccatttccacataccgtctccaagcatcagtgctgtccatcggcattagttcccaaaaataaccttctgttgcacgactcactacaactgacactgacattgtgtagacttcttggtctattctaaatcctctcaacaaccaactataaattgactgaaatgttctctccgcaggcctatagatgcccttagatgtcattacaaaatctgacagatcaacaccatctggaccaaatctaatatttccttcaccgtgaactatctgaaatgtgaccttacttgacattgtgcctgatgaaaacaataactgcgttaacctcgcatttctgtactacgccctaagttacattctctacaatattgttctctaaatttctaaaattacgttacattctccagatcaaactaaactacaccttacaattaacactactgtctatgtctcaattcatactattatattctatgctctggatctacacatatgtgctgtgtgctacagatgtgctaaaatatatggaactaaaactaaaacgcaacatatatactcaaacataacatattagtacaaatgcaaaagatgtatgggagcatacctatgatgaattgagcgaaccagcagggcttcgccgctccccttctgctgccctcccctctctctcttttgttttttttggatttttagtgaatataataaaatttcacagaggagggactgggctttatagggggaga

SEQ ID NO: 35782 - DNA, 1501 bp, Oryza sativa
gatcaccctctgatataacaagtccagagaagtcctcatttgcccaatcagtggccattacatcaccttcctcatcggatgatgcgtcgtcgtccacttcctcattatccgaatcttccctctccatttcatcaacaattataccgactctctccccctcatccgccatgcccatagcctgctcctcccttggttgattttcctcattttgcatcgatggtccaacaacatcccctgcattgataggaccctctacatcttcggtttgcattgaaacatttatatctttctcttgtaccgacacaaatataacgaggggccatgaccgttcaaaagccatttccacataccgtctccaagcatcagtgctgtccatcggcattagttcccaaaaataaccttctgttgcacgactcactacaactgacactgacattgtgtagacttcttggtctattctaaatcctctcaacaaccaactataaattgactgaaatgttctctccgcaggcctatagatgcccttagatgtcattacaaaatctgacagatcaacaccatctggaccaaatctaatatttccttcaccgtgaactatctgaaatgtgaccttacttgacattgtgcctgatgaaaacaataactgcgttaacctcgcatttctgtactacgccctaagttacattctctacaatattgttctctaaatttctaaaattacgttacattctccagatcaaactaaactacaccttacaattaacactactgtctatgtctcaattcatactattatattctatgctctggatctacacatatgtgctgtgtgctacagatgtgctaaaatatatggaactaaaactaaaacgcaacatatatactcaaacataacatattagtacaaatgcaaaagatgtatgggagcatacctatgatgaattgagcgaaccagcagggcttcgccgctccccttctgctgccctcccctctctctcttttgttttttttggatttttagtgaatataataaaatttcacagaggagggactgggctttatagggggagaggcaaaaatcgccctcccccagggcggcaagggggccgcctgcaaaattccatgccccctcgccgcccatttgcaggcggcccccccacagtacaaaatcgccctagcggagggcggcaagggggccgcctgcaaaattccatgcccccctcgccgccaatttgcaggcggccccccgcacagtataaaatcgccctagcggagggcggcaagggggccgcctgcaaatttcgttgacggccgtcgcccgagagcgaacggtcgtctgccacgtcattttcgccgccctctgagagggcgatttttcccagagggcggtaggcgactccttccgtcaattttcaaaatggaaaattatttttgtaaaacttttaataaaaaaaattataaataaaaaaaattcaacagagtgtacggaccacacacttac

SEQ ID NO: 35783 - DNA, 1501 bp, Oryza sativa
tgatagctcgcaggcacatcagactactcactatgaaaaagaaaataatgagacgtgtgggttacattcattgattctgctcacttccctgcccggtatgtgtcatcctgtcaaaatcctggcatggcatctatcgtgccattgttttcatggctccacatggtgtttgctatacgaattttatttagtaaaaccggacaatttgttcgttgaacaaaggggacggtccggaatgatagcgtctctgcagcggctacctcctaccggtgcaagaaagctacagccttgtcggcttgaacgtcacgtgcaaaaatgtagtagcagcatgaatatattagtagcatggtgatttcttattcttatacgtgtatttttgtctgaaacatggtactccagtaacatttaatgaaattaacgacgtttccttggaaattctgagcacaaaattgcatgacacgtctgcgctgagtcagtctggtggtcctaattaactcgggggccgtaatttttcattcctccatcctactagattttagcgggtcgtttttaagaggtgacatgacacagcgtgtgaaccagaatatttcgccctaatcatcagttttccagagccgtttgtggccgtgcaagcttactggtcgctggattgtttgatttgcaagagcaagtggcaaccatccaaccatccaaagctctaacagccacgagctgtgtactatagtactccgtacagcgacatggtcgattcgtgttcatggcgacgatcctggtatccagcctttcggtcacccggacgccactgaagattctttatatcatcggaaaacgatagtcctctacgtagtaaaaggactgcagtaactacggtaatttccttgctgacagaaaccctcgcaacgtgcttttcgccagcgagtggtgtaattttgcatttggcgaaattaatcactccgtggaattcagaagaaaaatacagagatcatgagatttactggagacagggattgttcattcttgcagtattaccatatgagtgaaaggagaagagggatattctcaggagcaaactcttaatgattactcaaaaatttaactggtggctgtggcgctttgtgtctctcactgaccgactcgtgctgccctttataatagccacggaattttagcacaaagaggcagacacgagaaaagggaagatacaagtgtcatcccgcatccaacaaccatggactccttgtatgatatctcctgctttgctgctggtcttgcaggtacggaacttcatttcgatctcgcacttacaattcttcttaagttcctatcgcaaaatggtctggatcgaaaagaggcttgctaatcttctgaaaatctggccgcctccttttgttttgtcgctgcaggcaacatctttgcgcttgctctcttcctgtcgccagtgtaagcacacgttcggtttggttttttcttgatcctttgattcgtagccgaagttcataactga

SEQ ID NO: 35784 - DNA, 1501 bp, Oryza sativa
caggggtacagaattagctctgtcctacgattgcgttaactattcaggtgttatatgcctgttatagcatatatcaataccatagaggtcattttttaaaaaattcagatgcatgactatatacgatagtgctgattggaaaatatgctgagactatgccatgtaaaaaaagtgaaacaggcaaacaaaactgaaaataatctatgcatcttatcctaggaaaatagtttatgtccacttccctgagtcccacgtttacgtttacaattcatgttttgtgttgtttcagtgtactattgtgaactgtggtttctaggagctgattgggaagctgttgatttttaattgttcaggtttgcatatcatgaaagatcccatattggagattacttgtatatagcatacggtaaaatcaccaatgaacagaggtaaaattacttgtctatagtaattttccactgtacataatatttctttcaaaagatagaatgcagcctggtaaaaaaacctgggacaacgtgcagcagacaatgatctgtggaaccatggttgtggctgatgctttttgctggagaatggagtgagggttgatgcatcatatattaaaggtaactatttttcagtataccgggctgagggtagcattagtttttagggttatatatgtatggattttatcttaatgtcggagctctattgacgatgggttgagacttgatcccatgtcgttggtttcagaatttcagtcatattcagcattttgacagcatatggacatgttcagagtagcatgtactgtctgaatttacagtggtatacatgctgatagtagcatgtacagatgtaatttctggactttggcgtgctatttcactgctcttgctcatcgaaatctttctgctcatgaactgctcgatttgatatcatgttaagtgatcaggtcccatatttgagatgatgttgttcttttccagtgcattccttacttctatgtacttttcaaataatcttcgatttatcagtacaaataatttgtgctatttcggaatgttttcttttccaattttctatcaaaaaaaatcatgtgcctcatgtttatgtttaacagtgtggtttggcatctattgagctacagtgagtgttatttacaaggtagccaatgacaacagaggtggatgcctacatcatggtcttagcctcgtagggcacatgaaggggctgtcctggtgaagtgctggggaggcgacgacctctggggcggtgaggtcagcttgactgcatggtgtgtactttgactggtattacatgatttggtcaacttatcgttttgaaatatgatacactgatttgcatgattttgtgttgtacctaattggcaggattgtcaatagttgtattattccccacttgatgatcaagcatgattccccttaagatatggtgttgtttaatgttggtgtttatgctgactctttgccatgtaaaacattgagcaagctaa

SEQ ID NO: 35785 - DNA, 1501 bp, Oryza sativa
gaaccggaggagttccaggtctaggcctcctccttgcgagccacacggtccgtgagctgaaaaagctccgcggtggtctggggctccttggaggcgatcttctcgagcatgcggttgtgccgcacgccccccctgaacgcgtagatcaccgcgtgtgcggggatgcatggtatggtgttgcggacttgacagaaccgctgaatgtacgagcgaagagactcatcgtcccttcgctgtaccgcatgcaagtccgcttcttcacctgggcgcggatatatgccctggaagttcatagtgaactgctggcacaaatcctcccaagagtggaccgatgcgggtggcaagttcattagccaaccccgcgcctgacccttcagggccatggggaggaaattcgccatgaccctgtcgtcacccccagcggcctcgatcccggtcgtgtagacctggagaaactcggcggggttgacgcttccgtcgtatttttcggtgatggtgggccggaaccttgggggccaacggacgttccgaaggctcgccacaaaggctcgatagccgacaccgccaaccggggacacggggggtggcccccgtgcccgggccgaagtggcgctccggacgaggaagcgccctccgttgcgtgggcaacacgacgaccattgcgccggcgctcgatattgaggcgggcatccggccccccacgcacatcttcttgggtcggaggcgttgacgagggaatggcggacgaacggcggttgacggccgccgctcgccgcgccctccgcctcgacgacacggagccggcggtagcagcgccagaggccttggtggcggaggaccgcccgccggcgcctaggcgatgctgcgccgtcatgaccaagtcggccacgtcatccagccaacgtcgggctagagtctctggatcggggacgacgggcgggtgacgcaggagcgcgcccgcagcctggagcgcgccctggggcgtgctgccatcgccgtagacgaggaggcgacgctccccgtctcgccgtccttctccatcgcccgtgggtggcgaagtcgcggatctttcgaccccctcgagcgcctcctcccacccaagacttcggcgagaggggggcggtggagtacgagctcgacggcgcgggttctgctccccgacgtcaccgctagcgctcggagagaggttgtgcgccactgcccgttcggccattgggctgagcgggagaagcttggggcacacgaaagaggacgagggcttaaaaagtcacacgcaccccctacctggcgtgccagatgacggagcgtggggctcctcaccgggagaccgcgcaggtccccctttgccggttcggccgggggcgctaagtgaggttcttcaccctcgatctgtggaatgttcgcgagagagccaatgcaaaagacacgggcgatgtagacaggttcgggccgctaagaagcgtaataccctactcctgtgttatggtggatctgtgtgtga

SEQ ID NO: 35786 - DNA, 929 bp, Oryza sativa
caaacacaactgtactctgctcatcttctgtgcctaaactggatgctaatgaaaatgagttttgggaaattcaagtgttcgcaattacttgacatgtacagtccatgaacaaggatcaactaactcaagcctgaacttttctaaacttcagacctgagagtctgaactcaatccaactcgtgcagggttcatttttggaattaaaaaagaatcaagtaagaattttactgcctttattgcagataatcagataataattagtgctacttaagcacattcaattcaacctatcaacaactaatgatcttagcctgctaataaatacagtgaccgttagaggactaagctcctatacatctctatttctacatctacagaagaatctatttctacaaaaggacaatgtcactgctaatccatctctagctccatagatcgaacagctcatcatcaatggtgaagtcgatgcagctcaggtcgtagaagccctgaacttgactgtctaatatgcagcccaatatccacaggatacttcagataccttgaaattcgtttcagagctgtccaatggacatccataggtgaatgtaaacattggcaaatccgtcaacagaaagggaaagagctgagtaatagtcatgtactaaaattctcaccaccaagaaccgctcctctccaggaataggtttcactttcacagagaaactgcctcccaatctgcttcttgttctgaacattgtctgtcagcagcaggctattgttttaacctataaatccttgcttatttcagatgagccattttatcagtaatgatccatttcttcttaatgaatcagtagtgtatccaaagctgatacttgtatctttgatcttccatcaatctattgtcaccatttatatccttgactatgtggatttgtattgctagc

SEQ ID NO: 35787 - DNA, 1501 bp, Oryza sativa
cacatgcctacctcaaagcgaaagcaagtgggaagagagcaaagctagcttacgtacgtacgccggtgcgtgcagtggccggcgcgcggctgctggcgcgcgggtcgctgacgccgcgcgcacacgccatgcacgcaccacgtacggccacaggttgacatgcgcattacgatttacgacccacggcacagggcaccggcaccggtttggttaattggtcacgtcggcgcgcgacaaaccagtcgttttctctttcctttcggagcgacgaccgtggaataatgggaaacccgccgcgtagtagtacgtagtgagaagcacacggctaattcaatgcacaccgtcttctgtcgagtcacgcacgtaacttgagctgagcatgagcatggaatttttcacatactacatacacaagctttgctagctagctagcagtagccgtgatcgatgtgttggtgtggtgtatctgttacacggcccatgcacggtgaaggccgcgtgagttttcccttgtgaaagaccgtagaatcggagtccggcccgtgccgggttttttcagtttaacccacaccaaacgagtcacgcacgtaatagcggagccaacacggagttcccacgaagcaggggaggctatataatatgcatgcagatcgaccacactcgacacctcgtcttgtgcagagagctcgcaggtagctattagctaacgagttagctctgaactcgcctttggcttaactaagcagtgagctgcaaggaagtagatacttgtgcaagctctgagcgagagaaacaccagtgtgcaatcgtagaacttgtgttagacacacacacagagagaggaagagctcatataatggccttggtgaagaggtttgttttgccactaatgatggcggtgcttctggtgttggtcgtgtcaggatcggcgcggcagttgggcggcgacaaacgggttggagtggccacctccggcgatcatctgtcatacagttcctcaaacatctgtacctgcagcagctagcaggtccaggtcactcgtgccaaaccaatgacccaaataacccatcatgtactgcctcggccaaccaccactaaaaaacagggtagacgccaaattaaatatcccaccatgtatatatattgccatcacttgcatgctaacaccaaattctaaagtttggttgtgatatttctctataggagacaatgtagtgtatatatataagatctttcaagaaaagacaatgtactgtatatgatctttgaaaaaaaatgcaatttagtctttttggattgctctgtttcttgttagattgtgataaactgcaagtatatgaattaataaaatggcagttttttgtttgtaacttctgttcttcgtactaccttgcccaagtgttaatgtaaatgttgtccaattaattcgatgaatccatccagtgttatgtgagatatataatggatttgatatatatgggtgaaactggaagctagtctg

SEQ ID NO: 35788 - DNA, 1501 bp, Oryza sativa
ttgaacttacaaccgagggtaaaattcagtcatagataataaaatccgcagaggcaattcttcgctactggcccggcgaaaaaagattaattcagtcctcggtaaatactatgcggcttcctcgtgttggcaactatatagcacatctgaccgacgctatgaacgttttgatttgtactaaagaaaaaaagaaaatgcaaagtttaagaccatgagatgctgccgtaaagtcgtagaccgcaatgcctgaccagaaactgcatatttcacggagcagagctgcaagtcaaatgaaaccgaaaagctccctcgtgccaacatccaggatctgtcttcttttccttctttctgtcccactttgcccaagtacactgctctatctgaacctatcgatcgatcgctgataaaataaagaatacctgattcctgaagaaaatagcacattgtttaccgaaaagaagaagtggcccaaagagcatgaacccttactgatttctccgttaatttctcaatctacaaacagaagcgtactgtagcatgcatgttgaccgcccgcgccggcggcgttgcggcgtgcctgtttcatgacgcgactcgtggcgagaatgaaacgcgtagacacgcatgtgaccggccgttcgatctctcggatgttaggctacgaactccgcggcgcgcgcgcacgattcgcacgggaagatcgatcacatgttgattcgaacacggtggatcgacctctctcgcgcgcgcagaccggcagacgggagcgcgtgtcggggagttgccgaccaacgagaggcaactcggtcaatctcgctttgctagctttgcgccaaacacatctctctgcatgcctacctctagctcaaagcaaaagcaagagctatgtaagccgagcttatacgtacgccggtgcgtgcagttgccggcggcgcgcggccgggtcgctgacgccgcgcgcacacgccatgcacgcacaccaggccccgggtcccagtgtcacctacgtaacaggttgacatgcgcattacgatttacgacccgcggcacagggcaccggcgcgcgcgttggtcacctcggcgcgcgacaaaccggtcgttttctttagctccgcaccctgcaattttttccttccgaagcgatgaccgtggaattggaacccgcgtatcggcgtatgtagtagggagaagcgcacggcacagcgtcttctgtcgagtcacgcacgtaactcgagctgagcatgagcatggaatttttacataggcaaataaaggtaagcttctcttgtgcccatgcagatttcactacagttttgctagtggccgtgatcgatgtgtgtgggtgtatctgtacacggcccatgcacgcgaaggccgcgtgaattttcccttctgaagaccgtagaatcggagttcagcccgtgccgagtttttttcagtttagctcaccgacgagtcacgcacgtaatagcggagccaacacggagttcccacgaagcag

SEQ ID NO: 35789 - DNA, 201 bp, Oryza sativa
tctcttcccctccccccagtcagccgcctctcccgccaccggcgccgcttcccttcccatctccctcccttctcgccggctcggcgcggcaacggcggggttcggcggagacggcgccgtcccaacggcggcgacgacggcgttcgcggtggccgcgctccctcttcccctctcctacccgtctcgccggcttggcgcagc

SEQ ID NO: 35790 - DNA, 507 bp, Oryza sativa
gggcatggaattttgcaggcggcccccttgccgccctgggggagggcgatttttgcctctccccctataaagcccagtccctcctctgtgaaattttattatattcactaaaaatccaaaaaaaacaaaagagagagaggggagggcagcagaaggggagcggcgaagccctgctggttcgctcaattcatcataggtatgctcccatacatcttttgcatttgtactaatatgttatgtttgagtatatatgttgcgttttagttttagttccatatattttagcacatctgtagcacacagcacatatgtgtagatccagagcatagaatataatagtatgaattgagacatagacagtagtgttaattgtaaggtgtagtttagtttgatctggagaatgtaacgtaattttagaaatttagagaacaatattgtagagaatgtaacttagggcgtagtacagaaatgcgaggttaacgcagttattgttttcatcaggcacaa

SEQ ID NO: 35791 - DNA, 1501 bp, Oryza sativa
aaaaattttggtagctccaaatttacactaaaaattttggtagctctaaatatttagtaccatgaagataccaaattttacattagaacttgcatacatgatgtggtatttctcgatacattctcaataataataaatttattcttttagaatgcgtagggcagaaaaaagtgtaaaaaaattgaaatgacatgtttgtttaattctatagaaaaaaagaggaaaatataagataaaccctttaatatagacaagttttggcacgctcaaatctgatgccattaatttgtactatgtgaagaaaaggtagcaaaacaaacatccatatggcactaaagttgccaaaaaaatggtagaattggcttcagtccaaacatggtgaaagcaaattaaagtgttcaaaatattatacctcttgcttattttcctcgttctagtttttctataagtcaaatattagtatctttgacaattaatttcaaaaagaaaaagtttatcatcataagatttatgtttcttgttttaccatggggaatacttttataatatacggtttgcatgttgttaaactatatgaatttaaaaaatggtgaaatatttataataataattgacttaggacaaaattataatgatataatttgaaatagagggagtaggaaagattcgttaggaagttgaatcctacaaaatttatatgccaagccttaattccaaaattatgcctttgggattagaacgggatttctgtaatctatctcaacatagcataggaaaacaaaataaccaatatttcagaatgtggaccatattgagctaggaaaatgtaattctgatcattcttcccacagaatgcagataaacacacaatattgggggcattttcttggaaaatttgcaggactttgacttgaataatatatttgaacaataggaggtctgactgagcaacatctcaggcaagtacactgtcgtagttcacaagaaatcaagttttgaccatacaacaccgagttgtcaaatagagtacatacatacactgcattatcataccaaacacttgccaagttgccatgaggtcctaagtcagggaagacccaacaagctaggtctcgcttacagcaacgcattcagaacacgtaatgcacttatttctgcattagtacattacattcttcttcctgttcaggcagcggatcactgcaaattggccaaattaaaatgtttccttgactgaggaatctctgctaggtttctgttacgcgtgccaggggaaaacgcggtagcgcgaatttcagatttccccagtacgtaccagcagcctaacatgagacattgcatctgatgagttgaaaattcaggagcttagacttggtacctagttcttcattttcagtctgaatttcccactgacggcgtcaatcccttaaattaattccaattactaacgccgattcaagtggccaccgtaccgagcaagcaaccgccgcctgccactcta

SEQ ID NO: 35792 - DNA, 1501 bp, Oryza sativa
aagcactactagttctacttaaccggcaatttcgtgttcttaactagagcagtgatttttcatgcatcccaaaatgcagttcgatatgataagagattaagagctcgaaatgctagtgtttcgagcagttttaccagttcttagatgtaccaaaagataccactatttcacaaaactgtatacacctctacaaaactatatatgtatcgtgaaattaaactatatactaaaccataatattgtaaattcgcttaattagcacaatttctatactccttttaaaagagaacaatggtggtcaccaagtatatagtatttctttaatttatcatctactccggccatcatgttttctatcaattccccatgcatgtgctttaatgttataaaatgatctctctgcatgtatgattctatcatattcacctgtacaatatgacatttataggtacaaaattattcaaaaaacctcactaataatttgttttaatccgtaacaaagcacggttattcggcttttatcatataacaacataagcaatcgtatcgttcataataacatatagtaaaactacatatttatttaagatgttaattagttcaataaccaatcttgatcagggtacattacaatagttaatcaagtagtcatcacaggttagtggactaaatttcttgttattaaacacaacaattctgataggttgataaccacttaggttgttttctttttctaagttccaaacttcctctccttcatttttcgcacgcacagtacgctttccgaacagctaaacgatatgtttttttttaaaaaaatctacaggaatgttacttttaaaaaaacatgttaatctatttttaagttttttaactaatacataattaattatgcactaatctgtcctcttgttttgcgcgttgggaggtgtgggtttggtcataccttcgaacacaaccttaatacataatgatggccaaacattagtatggttagtggacagaatttcagattttctagacacccttatgaaatactaatatgtaatcctttaataaaattggtactaaatctagagttttacaagacatcaaaatataattgttgtcatggttatgataccacatacctaatagtagttgactaaatctcggcaggatccaccacatacaatgtcttatacggaaactgacttcggatatggagagagttccgataaggaaagacaaccagagttctacatggaaacgacaagaactactcggattgtatccatattggtttccctagttctacttggacaaggggacacctatgggtataaatacagggccccctaggaggagaggagagaacaaccatccacgatgagaagatcaacacccaccagaagccacaacatacaagcctacatacgccaagacaagccgccggatatcgacatcagagatacgcttggatcgaccctatccggtaccttcagaggccggccgtagggat

SEQ ID NO: 35793 - DNA, 1501 bp, Oryza sativa
tcattggattcacatagtccattttttatgagcaattttcattttcattggtgaattataaatcttggttgcatgttgttgtatatggcactgtgcccacaccatatttccatgtttgaaaattttaattactagtaatatgcccgtgctaacgctatgataatattttatgtagttcaaatattgcacatccaaatcgccagaaaaatgcttccacattccgttgttcttaatacaaaatgtaatacacataaaccacaataaccacttgatggtttgataactatacatctctgggaatcgcatgggaggggtaacaaatctagttaagtagcaaggaattcgggaggggttacaaatctagttaagtagcaaggaattctctcaataataatctattatacgcatactatgaccactgattcagaaaaatattatccagatccccacaaaacctccacaattctgattgatccaatatgtaggagagtaataaggtatctacagccattgcatgcttcagatttatttaacagcccaatagcccattatgcacttcattgtgttgaacttgaaatgccttgcttgtgctacagagaggtgaaacgaaaggtgtttcaaaacaaagaaaaatgctaggccttgatcagcataaattagttcatttaaattttagcttgctcaatgttttacatggcaaagagtcagcataaacaccaacattaaacaacaccatatcttaaggggaatcatgcttgatcatcaagtggggaataatacaactattgacaatcctgccaattaggtacaacacaaaatcatgcaaatcagtgtatcatatttcaaaacgataagttgaccaaatcatgtaataccagtcaaagtacacaccatgcagtcaagctgacctcaccgccccagaggtcgtcgcctccccagcacttcaccaggacagccccttcatgtgccctacgaggctaagaccatgatgtaggcatccacctctgttgtcattggctaccttgtaaataacactcactgtagctcaatagatgccaaaccacactgttaaacataaacatgaggcacatgattttttttgatagaaaattggaaaagaaaacattccgaaatagcacaaattatttgtactgataaatcgaagattatttgaaaagtacatagaagtaaggaatgcactggaaaagaacaacatcatctcaaatatgggacctgatcacttaacatgatatcaaatcgagcagttcatgagcagaaagatttcgatgagcaagagcagtgaaatagcacgccaaagtccagaaattacatctgtacatgctactatcagcatgtataccactgtaaattcagacagtacatgctactctgaacatgtccatatgctgtcaaaatgctgaatatgactgaaattctgaaaccaacgacatgggatcaagtctcaacccatcgtcaatagagctccgacattaagataaaa

SEQ ID NO: 35794 - DNA, 1501 bp, Oryza sativa
aaatcataactaaataaccatagatccgtttcaggtggttcaagttgctaaatttttctaaaataaagatctacatattaaaattgtccataaattgaattaaatttatttaagtctttttaaatggactttaattagatttaatcttgtaaaattcataataaattcatttgaagtcggaatgaggccgttcaagtctcataattcatctaaaattatgatctacatgtttgtttactttttatgtattgtttatttggtttttattagtctttttcttcgttttgcgtgttagcttgtcgtttccgtcgttgcgaaggttcgtgagtgcgtcggaagtgatcaagaaggttaattgaagatcgattattgcaaggcaagtcacacagatcctaaacacaatcctttgagcatgttgatcctatatttaaattctctatttatttcaactgtgcatttattttcgaatgtcaccgggtggtgtgaacctattcctttgttatggccaatttgcattgaatgccctattccttgataccttgggtaataaattgattagcttgaaccttatgtattggtttggttcagctaaaagttatatatataattgcttagcaatgcttagaaacattagctcactaatgggatgaatcatatatactacattattatttatggttatatttaatggtagctcacgatggttaatcgtgtgatgttaattaattgataattaaaacctggttaaggtgggttgtgagcatatggttttgatggttgtgctcatgacaattaaggaccggttcgcgagctactgttgtgagacattaaccgtaccaaccacaagccagcgtgggcaacggctttatcctttgtatagcatggttcattatagtgcgccagactgagaagtggcgagaagtccacgggggtcgctggggagtccatgccttgtttataagggggtgattatgatccaggaacggtgcactgttttgagttgtgttgtgcaaagggtattgtcacgatttccccctttgcaatgccgtggtggtatttcggggcatggcaacatgtgtggaatcgtgtcttgtgggtacagtggtacacctctggccagagtaaaactattcgaatagccgtgcccgcggttatgggcgggttgagcaatgtttttcgtgattagtctcacacctctcacaataattatggatgttatatctggtaataatttgtttagctcctggtttggagttagatctgtacagccgggtatggttgttcaggatggttgggcctgtgcagcatgggtgtgctgttcagtgttgattaaaatttctgattaattactccactgttttactcctcttaaatgttttgctaaatgctgcttttgcaaatgagcctatattatgccatcctttggtatccttgtgcacttgcatatttgctgtgtggcttgttgagtatgtcatatgctcattcttgcaataatcaatca

SEQ ID NO: 35795 - DNA, 1501 bp, Oryza sativa
atcaccacgaagaacatggccactgcaaccttcctcatcgttggcgtacgtggcgctgcttttttagaaaaaaaaaagagaactctgcagtgttttgagctgtgacacgatgatgaaatgctcgatattacgatcagttagttataagctgggagaagctcgtaagtcgtaacatggcataatgccaagaccaaaccctgaaagttcatggttttttacgtgcatgtgtgattgtctgactgatcaactaatttgacgggtttgtgaatgaaattgcaaaagcaggtacacggttttcttggttacatgcaacgactttgcaaagttatacggagtgaggtcggtctcggtcggtgcattcgttacgagcttgcaaaccaagactgcaataactctcttcttgagatgtagctttctgccactgatctctcttttcgccgtaaccagtatgactgtccggatagaccagcatgcatggaagacgaactgaaagtgtccggaatacgttcttgatgcaatgttccaagtgaacttgttgaaaggaatggcaatatttcaagactagcttttttttttctttagataatggattaaaaatccggttattcacacggatcgatgtacacagccaaagatttgcaaagctaactagtgtttaagatcgattgccttatgaacacgccacgtacagtgatgaaggttgatgtaacattcttcgtattcagggaaaaatgaactcaacaaaaggagaaagtaccgagagtgtatatttgtgttttataaattcaattttttggttaacataatgtaataatctaattgctgaatttttttaccgctaccaaaatttaaatttttgaaacttaattttaagagtaattttacggttcttaaggaggtatcatgaggtaccaaaaatttagtggtacctaggtaccaagaggtgccaaatatataatagaaaaagtggaaccttagagtatcttctcaagtaatataaaattgctctaattttaaagttgattatattttttttctcatcttggtatattttctagaattgggttttaaatcacaaataatgcatacataaaaattatatccataaatcatttctgattttttttgtttattttgtatggcttgtgagctgtaactcaaccaaccagagccgtgcgatcggccacatgtagcttccttgaaaagaaaaaaaatgaagaagttgtagcttctgccccacttatgaggtcagcaagttgatgaaacttttgtgcgtagctagctcagtcaaagttttctgttcaagtcaaagtcattccatttgatacacattaagagatagagacatcgcaaaatagagacaaaaagagaagagatagagacttcattagaggagccataatgctcgatcttgctcctagcgaggatcctttgatgttccatatgtggtattttattttttaaaaaagagtatgtggtatttattcttaccgtctaaaca

SEQ ID NO: 35796 - DNA, 1501 bp, Oryza sativa
tagtatatttttgaattaatccatgagttgtttcgaagagctgtagctgtacaatctgatctatatagtaaaaaaaatgttctactcttgatttagaccatatgctctgatatagatgacctaatatactgcctatatatgcatataagttcagaaacttctgtagattgttctgaaaatctgagactgcagtagtgcttgttctgaactttggttttcaatatagtatagatttggttttcaatttttgacatttcccagaacaatggctgcagtataaattatctgaaatggatattttcaattctctgaaatggctgtagcactgaaatctgaatagtaggatttgttctgggttctctgaaatctgaatatatatagcccgctcaaaaaaatatatagcttgctcgatagggattaacatgcttatatttacttcagtctttcctgtaagcaaaattcataacccaaacaacctaagtctttcctgctgatttcatatgtgttgttgctatgcatgatatcaaggcaaagaagtctttcctgctgatttcatttgtgttgttgctatgcatgatatcaaggcaaagcctctttttaggctggttgcctgattgtaatggtttgataagagtatactggacgtttctttttctttacacttttgtattctttaacagagcacaaaacataattggaacatcatggataaagggtggatgaaagcatcgagatctagtattgaatataatatcggggttaataaatttatagacttcgccttgtccactatattccacggtactagacaattttcctaattcatagtttgttactccaaggttgcaaaaatttagatgctaaatattatttgtacccaattctaggtgttaactgctgttagacacatctcatctgaccaatgagacatatctgcaccaaggagacaaatacatgatctaacatacaaggagaacataggacatgaagatgtacattctaggacaagtagtcttggaaaagccagcgctggtttttaagtgctatcaagttcagtaatagccaagtgctaacaacttcacggttctagcttatgaaagtaagtctcctatcccaagttcgaatgtcttttctcaagaccatggcaacaactctgttgtttcataataagaaatagaactactgatttggatatattatttttttactaggatttaagtggatttgtaattgtaaaatgtagcaactcaattgtagttgtttatattttgcaatgtagaagttttagaaagttgtgaagtcacaagttgcagttaaggtgaatagtcatctatgttatttcttgatctatgattccttttatggcatattggcatattggcatattatgctcatttgtttctttcccttagaacttttatggacaattataatttctgcagatacctcatttgacttgtaaatgtaatacagatgtgcagatctgcacttgtatttgcag

SEQ ID NO: 35797 - DNA, 1501 bp, Oryza sativa
gccatcctcccgtcccccaccatcgccagcggctgcgccaccttctccctgcacaaccacctcacctcctcctccttcttcttcttcctcttcttgcttcgcccgccgcgcttcgcctccgctgccgccgccgggtggctcgtcggttcttcttcccacccgcggaggacgttcttgatcgggagcgagtgaagctttgtccatgtcgtggtgttcggcgttagggaccagaggttgatggtcctgccggggtagtcgtggtggacggcgacgaggcggccgccgagcgcggcgaggctgaggttggggcgctgcccgcggtggcgctggtcggcggggagcgggccgtccatcagcaccggcctccactgctccgtcgcgaggtcgaaccccgcgatggtgtcgcactcgacgccgcggtcgcgcggggcggaggtggtggccggggagaggaagtggaccaccccgccgacggtcgcgctgctccggctgatcccgtgctcgatcctcatcggcgggtggctccgcgtcgccctccactggcagccgccgccggcgccggtggtgatggtgaggacctcgcttgactgggacccgttggcggcggcgtagacgtggagcagcttgtgctcgccggtggcgggcaccttccccagcgtgtacccggaggagacgttcctccccgtcgccgccgagcagcccatcgagaggtcggtcaggtcgccggtggccacgtcgacgacgcggagcagcccgtcgccggggctcacgacgcagatcatgtcgccgccagcgcagaccctgaggcctggcctgctcagcccgtccatccgcctgacgacctcgccggagtacgcgtccatgagggtgatgtcggtgaggtcctcggcgatgtggtacaccgcgccgacgacgaacgcgtccccgccgccgccgccgccgcggtgagggcactgcatgtcccgccacgcgccgcaatacctctgcaacgcctcgtcgtcaacatgggccttctccgtcgtgcggtttctcggcggcgccgccattgatgacgccacagcgagctggtcgagacggcttatgaatctagttccggaggcgcactgattatgtagtacgagttatcgagggcaacggtggcgggcgcgcttaatatggcgcgagcgcttagttcgaatccgaatttaagcccgaacacaatttaatttggatccgatttatatgccgggacgcttagttcgaatccgaatttaagtccgaacacgatttaaattggatccgatttggagtgagatcaagactgacattggcacgttgtcgcgtgtaggaattgatttgagtgccttctgtagagcagagagtgaagagatgtactcctatatgagttttgtatatttcacgccagcacgttatttaattgagttcatactttttcttttgtttttttatgaaagattattggcttcaaatctttgcctaaaaaaattcggcttcatggact

SEQ ID NO: 35798 - DNA, 1501 bp, Oryza sativa
acacagctgcagggttatccactgaaatttctacaccacaaagatcgtttcaacaagaaaatttcaatccctatcgaaacaacaacacgatataatctacttagccggaaaaaatcaccggggaaaaataatatctctagtttacaaccgaataaatctacaaattgaactgttgtatatattagcaaaaagaaaaaaaaagaattgctgtatatatgtctgtgtcacaaattagctagctagcttccaagccatcttcaccatcgatcctatcagcatccgccgttagggctgtaggtcttgcaggagtgacctggaccagcaagcttgtgcagatacagctgccggagaaacctgacgacgacggagtcgtcgccggcggtgtcttctccggcccattcctgtcccgccaatggccgcgccgccgccgtgccagacacgaccaagaacaccatcaccatcacgatcagtgacagaacaagcttcctgatcaacacggccatgatcttttacttccctttcgccgttcttctccctgatctccttctgtcttttctactcactttcactaagaaaaaagctaagaaactttactgaactttactatgttcttctcaaaattctgatatgttcatcactgaattggagcaagactatagagtggcaggcggcggttgcttgctcggtacgatggccacttgaatcggcgttagtatttggaattaatttaagggatttttttttgcggggaattaatttaagggattgacgccgtcagtgggaaatttagactgaaaatgaagaactaggaaccaagtctaagctcctgaattttcaacacatcagatgcaatattgcaatgtctaatgttaggctgctggtacgtactggggaaatctgaaattcgcgctaccgcgttttcccctggcacgcgtaacagaaacctagcaaagattcctcagtcaaggaaacattttaatttggccaatttgccgtgatctcgctgcctgaacaggaagaaggatgtaatgcagaaataagtccattacgtgttctgaatgcgttgctgtaagggagggggtggcggtggtgcggtgccggagccagaggagggagtggcagcggaccggcgttggccgaagctagggaggaagggtcgctggggcggcagtggtcgtcggcatcgatgtcggggtatgtatagtgtgatacttggcaggtatcgcacgatacctttatcacctgatacattgcaagtatcacctagtaggtatcgcgtgatacctgataggtatcacctgatacctcgtaagtgtcatcttctatgtggcaagaatcgcatgatacctgatatgtatcacacctgatacttcgcaggtaccacctatcacctgaaacgtggtagaatcacttgatacctgataggtatcacccgataccggacctgatacctaactggtgtcatcccgttcgaaaacgggattccgttatatagtagccc

SEQ ID NO: 35799 - DNA, 1501 bp, Oryza sativa
ggtttggcagaatttattgaagagaaaatatctttataataagtatataacccagattgataggagacagggtgactctcatttctggttaggtcttatgaaagttaagaatactttcttgaatatggattcttggatagtgaataatgaggaacaaacaagattttgggaagataaatggttaggtaatatggcctttaaagataagtatccttctttatatgctattgtcagaaggaagaattctttaattgctaccgtcatgagttctgttctacttaatgtattttcaggagagctttagttggtcagaatcttatattttggcatgatttgtgtgtttctattgtacatatccagttgaatcaatcttcggattgtttctcatggaattataatcagaatggtcggttctctgtaaggtcaatgtatctagctttgattaataactgctatattgggaggaataagataatttggaagcttaagattaaaggggtggtgttaacgaaagataatttagcaagacgaaactgaaatggtagctcaagatgtcgtttctgtatgaaaaatgagacaattaaccatctttttatcgattgccattacgcaaaattcatatggagagcagttcagttttattttggcttatacattcctactagcatttctcatattttttatgggtggttgttaggagaggacaggaagaaaagtaaacttatattgctgggagcttctacgatatgttgggctctatggttgtgtaggaatgacgtagtttttgataaataatcatatgttcatatatgtaggtaattttaggggaacatattggctccggttttggacacagttacaaaggtttgatgaagacggagagtttttaaagttgcatgcaaaaagcttgagtcgatggttatgcatttttttaccaattatggatggagattcacaaatagacatcattctccatatcttttattggttatttttatctttatgcgatggttgctattatttttagagtacaattgttttgagtgctagattgtaattaataatgggttatagctcttttgagtaaaagccgggatgttatatttcattattaaaaaaaatcaccaatatatgtactgctttaattccacttaatgtagtaaatttgcgcctaacttgactaaatgttcttcaggtggaagctctgaagtcgtatcaggtaatcctaacgatgaattattgactgaaactgacaagatgggagaggaagggaacagcttgcaagttgcaagcgcgaaggcgactacgatcacctcacaccagccgagaggcgtttacatggagcagaagcagatgattgataaacacaagtggccaacaagtcacacagggaatcgcatcaagtatttcaactaatacctggcactacgacatcccaaaaagttgggccccggttaaatcttgaatgttcttcagaggttttatgctggtatgctttctg

SEQ ID NO: 35800 - DNA, 1501 bp, Oryza sativa
ccttgacttggactgcagcgggaacgccacttcacaggcatcctcgacggcacggatgaagcctactcctcggagaagccaccatctgacacgtactcaaactctggggtttgggggaaaatagagcaagactaagtacaaccaccgtactcagcaagtcataccggaatagagggtatgatgcaggatataaccaaaggatagctagagtggttcatttgcataaagcgagcatttaaaggcagtagttaaaagcagtaaaacagttataataattcatcaatattaaccatccactgttcaacgctaccccacgttgcaacaggcctaaccatccacctgaactaatcgattccattagactaagctagggtgagactaatcacggtgaatctggttgaccgcccgtaaccgcgggcacggctattcgaatagttttactctgattagaggtgtacaactgtacccacaagacaaagccccacgacacgttttcgtgcgccgacatgccaccacgacataccggatagaggccgtgacaggacccttcgcataaccccctctaaccaagcacaccacacctcaggtttcacccccactactcgcaaggcagcgggcagtcccctctcgtgcctaagtgaatccggaagccgcataggccatcgcagggcccatccaaactccatcacacccacccttgcctagatgcgtcagctagaggaaagctaccctacaagcccagccgttgcgcacgctggcttgttgtaagtacgataagttcttccagggcataccgcaaaccggtccttatgtgccatgggcgcgaccatcaaaaccatgcacccacagcccaccatttaatatattttaattaaccaacaccggagcggtggcattaaccaacatcattactagaatctgatatctatgcattaatgtaattcccccattgtgtgctagttgaactaagcatggctaagcaatccctagtccaatatctcgtcatgttatatcctaagctaacaaaggagcatggtacaaaaatagcatggctgtaacagtaggtaaatatcacatagtaacattataaaacaatgcagtatttaagggaaaacgatagaacatttgcaatataggatcaacatgttcaagtgacaagcatgacttgccttgctttgctgctggatgaacctcggcgactatttcaaagtacaccggagcgtcgggagagccggaatctaagcgacatacaaagcaaacaatacaaacaggccataagactactgaaacagagaataaaaccatttttaatggattctttgcatttttcttgatttactgagacttgaatgggcttaaacggagctcggatgaattttctatgaattttagaagattcattgtgtttttactataaacagaaaaacccttaaatgatttattgcgcaataattaaaaccctgggagagagagggggcggcaccgacatgcgggccccaca

SEQ ID NO: 35801 - DNA, 1501 bp, Oryza sativa
attttcaggagagctttagttggtcagaatcttatattttggcatgatttgtgtgtttctattgtacatatccagttgaatcaatcttcggattgtttctcatggaattataatcagaatggtcggttctctgtaaggtcaatgtatctagctttgattaataactgctatattgggaggaataagataatttggaagcttaagattaaaggggtggtgttaacgaaagataatttagcaagacgaaactgaaatggtagctcaagatgtcgtttctgtatgaaaaatgagacaattaaccatctttttatcgattgccattacgcaaaattcatatggagagcagttcagttttattttggcttatacattcctactagcatttctcatattttttatgggtggttgttaggagaggacaggaagaaaagtaaacttatattgctgggagcttctacgatatgttgggctctatggttgtgtaggaatgacgtagtttttgataaataatcatatgttcatatatgtaggtaattttaggggaacatattggctccggttttggacacagttacaaaggtttgatgaagacggagagtttttaaagttgcatgcaaaaagcttgagtcgatggttatgcatttttttaccaattatggatggagattcacaaatagacatcattctccatatcttttattggttatttttatctttatgcgatggttgctattatttttagagtacaattgttttgagtgctagattgtaattaataatgggttatagctcttttgagtaaaagccgggatgttatatttcattattaaaaaaaatcaccaatatatgtactgctttaattccacttaatgtagtaaatttgcgcctaacttgactaaatgttcttcaggtggaagctctgaagtcgtatcaggtaatcctaacgatgaattattgactgaaactgacaagatgggagaggaagggaacagcttgcaagttgcaagcgcgaaggcgactacgatcacctcacaccagccgagaggcgtttacatggagcagaagcagatgattgataaacacaagtggccaacaagtcacacagggaatcgcatcaagtatttcaactaatacctggcactacgacatcccaaaaagttgggccccggttaaatcttgaatgttcttcagaggttttatgctggtatgctttctgtgctgctgacccatccagccatctgttagcctgtgatgctcctcctacctatatggtagtctttgaaactcatgaagataaagattaagctggcgcatcacaagactaaacgtttggttagtcttgggaagatctgaagatctgagtgtggtatttcgaaaatccaaaccatgtttaatacttggatgcatgtatgtgcttcatatgtgtccaaatttacatgtatgttagtgaatctagacaatagatataaagaaaaaaagtcttataatgtggaacacaggg

SEQ ID NO: 35802 - DNA, 1501 bp, Oryza sativa
ccattacgcaaaattcatatggagagcagttcagttttattttggcttatacattcctactagcatttctcatattttttatgggtggttgttaggagaggacaggaagaaaagtaaacttatattgctgggagcttctacgatatgttgggctctatggttgtgtaggaatgacgtagtttttgataaataatcatatgttcatatatgtaggtaattttaggggaacatattggctccggttttggacacagttacaaaggtttgatgaagacggagagtttttaaagttgcatgcaaaaagcttgagtcgatggttatgcatttttttaccaattatggatggagattcacaaatagacatcattctccatatcttttattggttatttttatctttatgcgatggttgctattatttttagagtacaattgttttgagtgctagattgtaattaataatgggttatagctcttttgagtaaaagccgggatgttatatttcattattaaaaaaaatcaccaatatatgtactgctttaattccacttaatgtagtaaatttgcgcctaacttgactaaatgttcttcaggtggaagctctgaagtcgtatcaggtaatcctaacgatgaattattgactgaaactgacaagatgggagaggaagggaacagcttgcaagttgcaagcgcgaaggcgactacgatcacctcacaccagccgagaggcgtttacatggagcagaagcagatgattgataaacacaagtggccaacaagtcacacagggaatcgcatcaagtatttcaactaatacctggcactacgacatcccaaaaagttgggccccggttaaatcttgaatgttcttcagaggttttatgctggtatgctttctgtgctgctgacccatccagccatctgttagcctgtgatgctcctcctacctatatggtagtctttgaaactcatgaagataaagattaagctggcgcatcacaagactaaacgtttggttagtcttgggaagatctgaagatctgagtgtggtatttcgaaaatccaaaccatgtttaatacttggatgcatgtatgtgcttcatatgtgtccaaatttacatgtatgttagtgaatctagacaatagatataaagaaaaaaagtcttataatgtggaacacagggagtacggttttaaatatgaaatgaaatataagagagccgccatgttgaatgatgcaagttttgctatgtaacaagtaggttagatgcattagcagataacacgattaaaagggaaactaacaacttcctagatgattcatgcaagtttttttttacatgacaaaatgcttcgggggacggattttgtcatgtaaaaaaaacccctcaaatctcgtattgaaagatgtaacaaaacccaagctagaaaaatgcaagaactacagggtctagcatattgctcagagattcatgagaaacaatcagagaactttgaagac

SEQ ID NO: 35803 - DNA, 566 bp, Oryza sativa
ttgctagatatccatggcactcttctcattcttgtccgcaagctgttattgataatctctttttagagtcattgcattgtgtagctggagtttgtaaagaagaaatgagaactataataaatatataagagcaggcagaatacgttttgcagagtctgtgtgctctcctctgagagaagaaacacaggaaagtcatatttgttccacataatacctgatccctacaaaagtaaatgtcagggtaacagagtgatattcaatgcatgtgatcagctgatcacgtttgtctctcaacagggtggtaccattttaatcaaccgcataacttaccgtgggattccaatgatggctgagatttgagtatggtgcaaaagcctgttgtggaaattttctatccggtgaaaactctacaaagtcagaacagtacattatttttggaattaaaaggcaataaaatacataaaaaaaacaaatccacaaacctagcatgttatcaacgccatttgcctcaactagtacgccagctatcttacgataaagttctggatcattggataccctgcaca

SEQ ID NO: 35804 - DNA, 1501 bp, Oryza sativa
tcttttctctaacaagaattgaatgaagattaaaatttttatggtacatttttcaaaccgctaaatggtgtgtttcgtgcaaaagctttttatatgaaagttgctctaaaatatcatattaatctattttttaagtttgtactaattaaaactcaatcaatcatacgttaataccacctcgttttgcgtaaaaaacttaatcttcatcttcattttcatcttatcttgattgcctgatccgatggctatcaagaccattttagaccttaaccaaaaatctagccatgttgaaggatttttttgtgcgaaagcatgaatgatgtattgttgaatactatatacatgaatacatccaactatcctacaaatgatttcgattttaggcactgaacctttaaaaggtacgggcggttttggggtatgctctaaacccaaaccttcttccgctctcgcacaaaactgacaaaagaaccctcaaaccttctgtcaacgccctgaagtagccttgatttgtttccagtattatgaggggacctgcagtcctgcaggaatgatgcattttggtgttatagttctatgctcacgctttatagctacattaggaggatttctgacgaatggtttttatatgattcaattttatctttcagtttttttatttttaattttctatgtggtgggagaagtatgatgactccacttttacagtagtagaggtagtttttttttataacacaaagttaagattttttttttgacattcaacagagataagaaatgctattgaagcattgagagtttgagactaaggcttaagtatgtctgcaaaaatgccacgccgcctcaccgcccttttgcaggcggtcccaaggggactgcttgcaaaaaaaaatcggtgtcccctgtggccggccgttatgggagggcaacggccgtctgccatatcggcaaaatcgtcttctaggagggcgagggcgatggcgtgactagttttgtaaattttttaaatagaaaattatttttgtaattattttaataataaataaaattaaaaataaaaaaattccacttaactgatcgcttaacgggcaagatgggcctccgctccactggcccaaccacgtagcaagctccccttgaacagagtggaattttttttatttttaatttttttattaaaagttttacaaaaataattttccattttgaaaattgacggaagtagtcgcctaccgccctctgggaaggcgatttttaaaaatcgccctcccagagggcggcgaaaatgacgtggcagacggccgttcgctctcgggcgacggccgtcaacgaaatttgcaggcggcccccttgccgccctccgcgagggcgattttgtactgtgcggggggccgcctgcaaatgggcggcgagggggcatggaattttgcaggcggcccccttgccgccctccgcgagggcgattttgtactgtgcggggggccgcctgcaaatgggcggc

SEQ ID NO: 35805 - DNA, 1501 bp, Oryza sativa; identical to SEQ ID NO: 35781

SEQ ID NO: 35806 - DNA, 1501 bp, Oryza sativa
ttattcacgggataaacgattgtcgtgcggagatagccattcggactgaatttcaaacaggtaaaccatcacgtccacataatcaaatcgattaaccagacacggcgaaatcaatacagtataaatcaacgcatccaaataatcaacaaatcacacaggagttcgagtattcggcacacgaattactaagaagtgctagtcacacactgcataaaacacacacacacacacacacacgtattcgtagacaagcacaaacagcgcctcgatctggttgatccatgtcgaacttaatctcacaaaccggtgaaatcaaattaggctcgtaaagtccatgatctatgcccaataatgctcacaaaggtgtcttcaccttcacaactttaatcagaaaaacctgaccttcttctacctcccgccgtgaatggcgagcagataaaacagctgtgttgccgagagtatgatggtgaaggactccatggttttctgcaaaaatcaagaccagagcagcatgcacacagttaatagcgtgtcttcggttgtcacgacgaactaaaaaaaaaaactgtgtttgatgttgttcgatcttaccaatctggcgttcctgccgtgcaggtcaatctccttgacggccaatctgaaaacgtaacaaatgaatcaaggaaattgatttagtatacccgtatgcatgcatgggacagggtcagatttagttgcgttaatttaccccatggcgagcagggtgagcgtccatgcgatgaacccggaggaggccgccgccggcaagctctcgtggctccacgcgcggacgtggtggaacccagcgagcgccgccgcggcgccgacgactccggcgatcaccgcgaagatgacgaagaacccggtcgccgcgttccccatcgggaagtagatcggggagaagttcgccggcagcgccatcccggaacctacacgtacatgcagtacatacgctcaaacagtcacaaatctagcttcaaaatatatgcactttctattgacaaacataattaggcaccaatctcaatttagagcaagttttggttcgttgtgcccgataacaagacaccatcgagatcgacacggtaaatcaaaatgtgagctagttttaccgatgaagtagccggtgtggatggcgtggttgatggcccagccgccgaccgccgccacgatgacgtacatgcagaagttgagaaccaggagaaggccggccaccggcttcagccccgcgttagccatggatatcaccaccgagagctagcaaaaactctctgcactctttcagaacgtcttcgcaagctatctacgtgctgatctacgttacttgcgtagtagtactatttctacttgattcaggaggcgcaccgattcggcgttagcatccgggccttatatatatacacgcgatcgatagagaacgcgaaataatatgaactattttactgacgggacatagctggttttgttccttgcttccatggga

SEQ ID NO: 35807 - DNA, 1501 bp, Oryza sativa
ttcctcatattttgtttatttctttaacttttcaattttgctcttttttttttcgatcaaactgccacgtaagtgttatgtcaatgccacgtgggacaaagaccaagtcaaatgagccacataggcgccacgtcatccaaaaccggtgacaatactgccgagggatcttatttgcaccggttttataagttggaggatgggttgtatctggtttttgggggttcaaggacgaatgtcagactaggcgacaacttgagggagctagaatgaacttattcctttctgtgaaggcgacggatccaacacggcctggtagtatctgtatatgggccgcagcgtgcaaagattgggtagcctggaatcctatgggcctcctccctctgggcttcaattaacaggacattttagtgtcgcggtgcgatcggatcgagatcatctcggtgtcatccaccagaatttcgggttcccaacaccgattgaattgcagttttgtttcgggacataataatcgttaaatggagcatccgcgaggtgagtggaatacgccttcccaattttcaggggtcaatcgaacactctgcagagctgaaaagatggctcagccgaaaaaggaaaattaaaggtccggcagtgtagacacaaagactcacacctgctgccgttcgagctttgagaaaaagaactgaattggggccaaaaaaagcatctgctgggctttgcgagatagctaaacaaagttaattaccatgtggacctactaaccaaatttcattagcaagcagctgttctgtcgcttccgtttcaacaaggaattattggcagaagaaacgatcgatacgatgcctttcaccctgggttatgcgtatccttatctgaatatttgtttacgtttcggcatctaccagacgtgtcctcgacgcagcatccagcaatcctaacacctcgcagacattcgccgcggttcgttgggcaaagcagcggtctccggctgttaaggaataaagcgctcgttagaactgtgctgaagtgaactgaactgaaaggatacacatgtctctgcatgaaagaaaaggctgtacttttccagctagccgtcatcttaacctccagacgaacagaatctctgaaaactctagatggtctgaaaccaaacccccggaccccagccgggtacgtatgttttcttctttctttcatgccttaagcatcacgtttgtcacaaaaacttaacgtaattcggctgtccatatgcatcccatggaagcaaggaacaaaaccagctatgtcccgtcagtaaaatagttcatattatttcgcgttctctatcgatcgcgtgtatatatataaggcccggatgctaacgccgaatcggtgcgcctcctgaatcaagtagaaatagtactactacgcaagtaacgtagatcagcacgtagatagcttgcgaagacgttctgaaagagtgcagagagtttttgctagctctcggtggtgatatccatgg

SEQ ID NO: 35808 - DNA, 677 bp, Oryza sativa
tagagagagagagagagagagagagagagagagagagagagaggcgggatttgaaattcaaatcccggccatctcggggtgcgggcgagcgggagagggggttgaggggcgcgggaaaagcgggcgcacgcgcgggcgtggcctatgtgacgcgggaaaggcgggcgcgggcagttgcgaggcggcggctgcggacggcgggcggccggaggtgggagacgggcccaacaggtgggccccacctgtcggcgacccgaagggaggagggaggaggcggccggctgctgggccttggccttcggccggcccagcggggagggggaggggaagagaatgggccggcggcccattcgaaaagaaaaaggagggaaaagaaaaagaaaaagaaggaaatgaatttctagggaattaactattgcttgtgctcatttttaattggttaaaattatttctagagttctgaaaattccactaaaaatcttgttagcatatttcgacatgaagaactcaagaaaaatcccacatgccaattccgattattatttgcattaatttattagggtttcactcttgcttttacactgatatttttttgggaccatttataaatttaatttaggcttgagagaagaactttagggtgtgacagtctaccttttaactttctgaccaacaga

SEQ ID NO: 35809 - DNA, 1501 bp, Oryza sativa
agagctatggccgccgtacgatcttaccctgttgatttggccccacgggctatataggtatagcaaccgagtacggaaatcctaaacggcgattgatcacctgggacgcggggggggggggggggggtagcgatcaatcccccttccctccctctctccacctgtttccttttttggcaccgtattacttttctactttagtaaatttatacacataaaatttatacaccttaagttacacatttaaagtttatacaccttaagtttatacatctaaagaccaaaagtttataagtcaaaagtttttatatctaattcaaatttgaatttgaattcaatttttttatatatagtatttctatacatttaaagtttatacacctaaagtttataaacccaaagtttataagtcaaaagtttacatacccgattcaaatttgaatttgaattcaaatattttctatatatagtatttttatgcatctaaagtttatacacctaaagtttatagacctaaagtttataagtcaaaagtttacatagccgattcaattttaaatttgaattcaaatttgaatttgaattcaaatattttctatatatagtatttctatacacctaaaatttataagtctaaagtttacatacccgattcaaatttgaatttgaattcaaattttttatatatagtatttttatacataaatttttctaactttttgtttttttaaaaaaatttgtgtggtgtactatagtaggaagagaagaaagagaggagggagaggggaagggagggaggagtgtatagagtataggggagcggcgatcgcccgcccattagtccctcccagtgtacgagcgctgcacgaggcgtgtgttttttcgctgcctcgcttatagcttcggtcgtgtagctgcaacttgcaagtttcctggagggattaatagtgagattaatagtgatatggctgtaccgtgttcttccctaaccaagtgttgatggaaaaatcttagtcataatctccaactaaccctgctttttttttcctccgtcctttccgtcctgttcccgcggggccctagcttgccgctcgctttcgctcgctggcccagtgtctgcgctcctctcctctcctaatttctctcacgaaccggagatatcttaagctccaatccattgtagcggaagcacgatatcaagccgcacgcaccaggtagtacacacagagaagaggagtactaggtagagagacgcttggctccgtggctcgttggttgattgcttaaaggccacttgatcgctgctcgatctgctgcctccctcgcgcgcgcgcaccgtacgtgtgtgtgtgcagtagttctcggcacgcttccccatatataccccctggatcgggcgcccagccggccgcctcgatcgacagagagatcgatagacagatacacgccggcaagggcaacgaacccagcggcaggtagctgctcgcgtgtcgggcgggaa

SEQ ID NO: 35810 - DNA, 1501 bp, Oryza sativa
tgtttaatgcaggcttcaaggagaggctgttgtttttgcaattgattttatttgaactcttttctaaaaacgactaagtgagtgcttctcaaacgacacggatgagacagtgcgtcttgtccggtcggagtatgtgcaatgtatcagtctttagaattgaaacaaggttggcacccggccaacagcttttcaaacggccacccgggccaacaactttcaaacggccacccgggcctagctgatcccatcagctgcagatttttcaaacatcgaacccctttccacaacagtaatttcacaagcagtagtcaaacaaaactaagctaggaatcacctcacatccgcccatgaccgtgggcatggctgttcgaatagtttgttaacctctgcagagggggtacactttacccacacgacattactaacccggatcacccagcccgtggggatcagccacgtcgggagacctccaagctttcatgacaaggcatttcgaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccatttcacccatgtggtcgtacttgtcttatgtttggatgaaattccaaggaaacggtccttaggtgcaagagcgggaaaccgtacacccggtacgttccccggtccgcggttttggaaattcatttagttcgcaagcaccgacccaggtgtcgggttttccaagtcttttgtaaaacccaagttttacccaagttgttactcagattttaagtttgaaggcgtccgtcgatactcgcacagggtgcacgaatatcgagacgcaactagatagttacaaggggacatggtatatcaatcaacaaaggaaggatcaaatgcaacaaattaggtaggtccgccaatctgccttgcagacgagacaacagattaagtgcaatcctatcaatgcataatatttttcaagcaacataatttagttcaaatataggctcaagatgttcaaaggtggcttgccttgctcgagatctggagcttgatccttgaaatcctcgcactgcgggtcttcgggctccgaaactacacgcgaaacgggacaactcaacaaacggcgaaaataaagctctattaatgacctctaagcgtgccattagatagatctcgagatttgaggaattttggaagttgaacggagtcaaacggatttacgattgggaaaatattgaatttctaagattattggatttttggtctaaaggaaaaggatttaattaaatccttttttgaaaaagaaaagaaaagaaaagaaaagagggagggaaaatagacttttcctcgggcggctagggcacggcccgagagaaacggagcggttcggccgagctaaa

SEQ ID NO: 35811 - DNA, 1501 bp, Oryza sativa
catgaatgtgccactgcaatttgcaaatggcaaggccttcacctagctggatttgattccacattttgactgagcaactttatcgttttcgtgagcacacttcttaaattgttaaaagtatatatttcttttaaaaaaactttatatatagaaggttttaaaaaataaaaaggaatctatttttaaaattgaaaatagttaataattaattaattattcattaataatctatccctttctagtcaagccgaacgcccagttaaactttacatactttgaccaggagagaactggtggacaccataggaggcaggaaggcaggaggcagacctgcttggaagccaagaaaagcacacgttgacgtcgctagcgttttgggattttccgtagcccgattcgaggtctcctagtcctcgcacgtccaccagctgtgcaaatattccacgagagcacctttcaaatttcaatactccagttgattgttcagcggctcgggtgcttcctacacaaggcagcatgactcctgctggcacgtcttgttcatttcgagtcatgcttagctagggtaggataggctcgatcggctgcaacaagttgggccatctcgaacttgttgagcttgaaagggtggtaatgggccataggccatgggatctttcatagtccaactcaatcatttctcttaacctcaaaacataaaaaaaaaaaaaaatcagcccaacctttcaacttttgaaatttatagactaagcccttatttagttcccaactttttattcaaacttccaacttttccatcacatcaaaactttcctacacacataaacttccaacttttttcttcaaactttcaatattagtcaaacttccaattttatcgtggaactaagcacaccttaaaattttgggcgcatcttctccatcacctccgtcctctcctcctccgctgctgtaggctgcggcctcatccactctagctgcccaccgccaccgccgccgcctccttctcgcacatgcttggtgagcttgagctcatcggctcccttctcttctcttccgccactatggaccacgagaaccctctcgacgctgatctctcacagctggggatacaaatatgaggggcgttcatatatagacgtacacgtcaataaccatctaccatgtcataaagaagccctctaggaaatgccctcctaatgcgtgctatagatttgcaaaagtttgaaaaaatattttaaaaatattttaacaaaaaatataaaaacaaaaaagagtaaatttcatatttgggacaaattttattaccgatgtttcgttttggaccaccctttaaaccaatgttttcattttggaccaagtaatcttgcctttccttaactttggactaccccgactctcttctcgagcagatgaacgacctcaagtacgtcggcttctcctcgtcaaaaccccctcaaatgtatgtagattgtttctttgacatatgataattttgatg

SEQ ID NO: 35812 - DNA, 508 bp, Oryza sativa
tctacgtataataattcctcatgaaataaacttatgaatataatagtcacgcaataaattgttatattttcaacaatagatttcacaaatcactacatattccttacacatccatgtgtaaaactaacttttttacacctatttaacggtcaactagtggtcaattgatggcaagggtatggaagcgatcaaaatctaaagttagggggtatacaaggaagcgaagaaaatttagcgacatagaagggatcgactaaagttttaggggcatagagggaattttctcaagattgtatggaaaaccacttatcacctatacttcagattttgttaggtgtaagagaatctccaacagcctctccaaatgactctccaagccaaattttagccattccagtgaaaaaaacaccctccaacagcctctccaaccggatggctaagccatctggctggccaaaaccctccctccactagccaaatttggccagccaaaatgactagccaacta

SEQ ID NO: 35813 - DNA, 1501 bp, Oryza sativa
gatttggatgagatattacaatcttctgccaacaaaagacatagttttcagcatgttgtttttgttgtaaccagaatttctatactgtgaagattgtatgtacaacagaaaatttctcttatgccgcaaagctgcatgccatactcttatttgccacatgatttgttggctttgtaaaaatgccacaaagttcagttgtatactcgtttatctgccacactttaccattttaacccaccaaatgtgcaattttcccttcttctgcaccctctttctctcttctatgagtttgtgaatggagcttggccgcacgggctggtgcccactgtgtttggcccaacagaaaattatatcttaaaaatgtatgtctctctatgggcttttacacccaggcctaggacctaggtccgccactgcggccgggagcagggcgcgtggaactggctttcaggaggaaagccgtgcgcggagtaggtgggctgcacagagccagttgctgagggcaggacgcatattgttgtgctgctggcggccagaggcggaggtaatgctaaggttgaagctggctactggagctagggtgtcatagctcatgccgagctcaggtgcacggagatggcgtgcgcgttggacatgcaggagtggggcgtcggacgtgcaggagtgggctggctgccaggtctggctcaaactttggccggacagagctaggtctgtccttgctggacacagagaagaagggtggggataggacaaaaatggagaaggagaagaaggtgggcattaatttggaatttcacactgtattgtggtaaaagaatgaattggtactcaattttgtggcattttagtaaaggcttcaaacttttgttcaaaatgagagttttcgcatccaactttgtggcataagagcattattctctttgtataatggaataccgttaacttgtctcaggtgcaattgttattaagcagaacccaagggccgtgtaccacatccttgaaattgtgtattgtctgcttctaaccggaaaggcaatacatgcgaaaactttcaatgggtaatgtgtagttgcacattgatatatgggaaaaacatgcagtggatattaaacatgggaaaactatcgcataaatttctaaaatatctcacatacaggaaggttatattagacaaccatataaaatttcaggacatatgaaattgataaacagtgaggaaaaaaagagtattctttatttgtgtttttttctttgctatttgtaaacttaatatctcacaaacaaagttgagttttatcttgaattttgtatgcccatctaatttcatatagctatcattgagttctttttttcaaataaaactctttttgagaacttatattctgtggtttacatgtttccgacctagttaaacatttcaccatgtatttacactggatatctcggaaatctcacatcgtactcctatatccacattgtctcatgtatagttgtcgat

SEQ ID NO: 35814 - DNA, 1501 bp, Oryza sativa
gccggtctagcgaacaacgtgaagatctggttacagcacagtattacatcctctgcttgactgcttcagtaacaaatttcaggactccgtcgatcacacggtccccaggtggaaactgtgtcttaatcaacgagatagatgatcaagctagataagtttgttaggggctaatagatattcatggcgacaaattcatcaacatttatgccaggaagctggaaggctgaagaatgcttgcttgcccggttctctaaaatactccagtgctcggttatattctagcctctaggcaaggtcttacagttttcatctgcacagccttttcttcagagtgtcacgcagagactgatcatcagggacaagatactccagtcaagatccgtcagaaaaagacagctcgaagatacatagatgacacggaaacagggatccccagcttgagaacctttccgtcggcgcagcatttacctccctcaccggcaataagatctcatagccgcaagaaactgacatgttcccatccagaaaaaggcaacccctgttgtagaacagagtcctggagaatatggcattgcctttatgtcaatggatcatcccagagaagggaaggccaacttgcaaaatcagaatgctaacaagccattgttaatcttgatatctgcaacataaaatgtaacatcagatttaattcgggaacacctagtagtgcacgtgcacgaatagtgggtcagtgaaagattatccctgccacaacataggtaactacgacgataatcctttagccaacatactgatgtggatagcatatgtgaaatgaatagtttcaggtgagcgttgacagcatagtaaatctaatttaattaggatatagatctagcaatgctgtttcagatatcgaaagagagaatatacccgtcttttccttccctttcatcaattgcctcttgtatcagctactatgcaatatactggaaactacgtgatataaatgttgcaataaataagaaagatatgttttgagatttgatacactcctttcaacccagaaagagcaggtaagtgtacatccttgattgacgaccatctcgtggttaccaattccatcaccgagatcacagcagaactgccatggatataaattgatgagtacagtcctgagaactgcaagctgtgagctgatgaatccaagatctaacatgtctaccatggaagagcacctgctgcctgtagtccaccgtgatcaagtatactcttcaagacaagacagaagaaaatcctccgatgtcccaaacaggttcgtgacttcctttcacccaagtacaaatagcaaaggtaaccccaatactcccaatcatccgttacatactagcggaaatggcaatatagttaccgcacaaaatttccagcgggtgcattcttctccttctatgttcacatcaatcaaagaaactccctgtgcagatgagttcaatgagcaaagccatgctgcacaacacgtacc

SEQ ID NO: 35815 - DNA, 1501 bp, Oryza sativa
ttgggaactaaataagggcttagtctataaatttcaaaagttgaaaggttgggctgatttttttttttttttatgttttgaggttaagagaaatgattgagttggactatgaaagatcccatggcctatggcccattaccaccctttcaagctcaacaagttcgagatggcccaacttgttgcagccgatcgagcctatcctaccctagctaagcatgactcgaaatgaacaagacgtgccagcaggagtcatgctgccttgtgtaggaagcacccgagccgctgaacaatcaactggagtattgaaatttgaaaggtgctctcgtggaatatttgcacagctggtggacgtgcgaggactaggagacctcgaatcgggctacggaaaatcccaaaacgctagcgacgtcaacgtgtgcttttcttggcttccaagcaggtctgcctcctgccttcctgcctcctatggtgtccaccagttctctcctggtcaaagtatgtaaagtttaactgggcgttcggcttgactagaaagggatagattattaatgaataattaattaattattaactattttcaattttaaaaatagattcctttttattttttaaaaccttctatatataaagtttttttaaaagaaatatatacttttaacaatttaagaagtgtgctcacgaaaacgataaagttgctcagtcaaaatgtggaatcaaatccagctaggtgaaggccttgccatttgcaaattgcagtggcacattcatgagggtgtgtcgctaaggtgacagtgacctgaagaattcctagttctagatgtattgatctgctctaccgtaaaggatactccaggtttatattactctctctatttcaaaatataagaagttttgattggatagaaaatattttttaagtacgaatcagattcataatagtatgatgtgttccatctaatcaagatttttttatattttgaaacggagggagcattagtttgctcaaagctcgtacgaaattgaccgttggtatctgcatcagaaaacatggatcggtattttacacacgtgtatgtgtggcgctaggcattttttgcgatcacgtggaagattcacacgtataacacgcacgtaacgtatgtacgcgcagacgtcctattgcccagctagccagcatcgattgcctgaacgtacatgcatcgggacgccacgacgaagatttcggccccagttgaaaattcagctaatgatcacgcagaaaaggaacagcagtacgtacagctgaagaaaaacaacacgggtcttgggctcgtcgcgctcatacttgtggttgtgtaatctttgcaaaatcctggcgtaatcacatggctagtacatcccgccttccccgtcagttccattttccaagcaccgaaaaaacaggagtgcgcgtaacagtcaaaatcctgcacaggaaatgcctatatatgcaggtacctcctccacccagtgatgtcaccca

SEQ ID NO: 35816 - DNA, 1501 bp, Oryza sativa
ggttattgtctgcagggcacataccctgggaatattactgagcaacttcattggcagtattttaattccagatggtggcaacatttttagtccagatcgatggctattctttcctgcatgccacgcacattaactgtaccacatatttcatcaattattcaccaattattgccaataactaaacataagatttctggtaaagaattggggacgactttgtataaaagatagttgtccagataagcgattcaaatagtgccctgtatggaattacattgtgttggattttcatttaccacagctgatggtccatttacctccattatgcaatgcaagtcatctcccacaaccaaattgctaggtgattgaatatgtttataaaggctgaaatacacacagtcgtaactcttaaggaatatatggaagatggaaaggcaaagtaatgatgcaaaattgtaaagaaaaaagacataaacagacttaagtgagcaagctgttatcaggcctacgtgtaccttgtgcaaactctcgatggagagggtgagagttcagagatgtaatgctggtaggcggcgccggtgagcaaaagcacagaggcgcgatggaggatgactccggctacagtggatctgagaagagagaggcacagtgatggaggccgggctggatgaggctgatgccaggtcgagtagcagggactcatcgtcccaatccttgcttggccgccacttccccctcgacatccagagggccgccagggaggaggggcgcccaaaggagaggtcgccgggctggatgaggctgatgccatgccaaggagcagggactcgtcgtccccccagggcaatccttgctcggccgccactgcccccctcgacgtccagagggctgccggggaggaggggtgcccgaaggagagaccgccgggaggatgcgccagggagtagggagggagcgctggggaggacactcggcggcgggggcggtggttgcgtgtgggcagaggagtaggcgtcggcggatctagagtggactcagaggcaggggcgtcagcggcggttgatggggaggaccggagaaggaggaggacgcgacgacagtagataggacggcgcgatcggtgttgggggcgtggaggagggactgacgataacggtggtcgccgcgggatcgatggatgcacggagagaggggatcgtcgtggcgaaggacgacgcgacaggagatggggaggaggatgcggaggcggtggggagggggatgatgcggcggcggtggggaggaggaggacgcggctgcggtgggtggtgagggtggttcggcggcgcgggagagtgggaggaaggggatcgggagcggtttagcgagaaagaaaactcacagcatcgggcgaatgggcgatggatgatccacgccgttggatctggcgattcgatggttgtgactgcgcgtgtctgtctagtgtctctgctacgtcaggaatcaagaccactactataga

SEQ ID NO: 35817 - DNA, 1501 bp, Oryza sativa
caaagttggatgcgaaaactctcattttgaacaaaagtttgaagcctttactaaaatgccacaaaattgagtaccaattcattcttttaccacaatacagtgtgaaattccaaattaatgcccaccttcttctccttctccatttttgtcctatccccacccttcttctctgtgtccagcaaggacagacctagctctgtccggccaaagtttgagccagacctggcagccagcccactcctgcacgtccgacgccccactcctgcatgtccaacgcgcacgccatctccgtgcacctgagctcggcatgagctatgacaccctagctccagtagccagcttcaaccttagcattacctccgcctctggccgccagcagcacaacaatatgcgtcctgccctcagcaactggctctgtgcagcccacctactccgcgcacggctttcctcctgaaagccagttccacgcgccctgctcccggccgcagtggcggacctaggtcctaggcctgggtgtaaaagcccatagagagacatacatttttaagatataattttctgttgggccaaacacagtgggcaccagcccgtgcggccaagctccattcacaaactcatagaagagagaaagagggtgcagaagaagggaaaattgcacatttggtgggttaaaatggtaaagtgtggcagataaacgagtatacaactgaactttgtggcatttttacaaagccaacaaatcatgtggcaaataagagtatggcatgcagctttgcggcataagagaaattttctgttgtacatacaatcttcacagtatagaaattctggttacaacaaaaacaacatgctgaaaactatgtcttttgttggcagaagattgtaatatctcatccaaatccaagcttaactgaatgtagaaaagatttctcaactagcagtaactatttatgtataggcacaatcttcttgaccaagtaaataatagattctacaaactgcgctcactaaaagttggcagactttgggtgtaatttcaaccaactcccagttaataaactgaccaaatttctcgacaaaagcaaagcagtttgtccacccctttaggataacatctttgaagacaaaatcaagaatacacacaagctagtcccagcccgacaaaaaatctagcccacaagatatcgttgtaaaaggtggagaagcaatgaattcacatcgacttctgcatatgccatacggccaatacgtcaaacagcgagaagatccccaaattgaataggaaatcacgacgaagctcgtcggctcacccatgaattcacctcccaattcgccaaagacagaatctttgacctaaccgggggcatgatggggttcagttgaacccccaaatctattgtttgtggaactaaggcggagagaaaagcttccagatctaggagagaagataagggattaaaaagaggatgacgcgagcagggtgctcaccggcctgcgagga

SEQ ID NO: 35818 - DNA, 739 bp, Oryza sativa
agtggttacagtgacctgagtagtgcaccaaggtcctgagttcaaatcttctatgtagcgaatttcagattagattgtttcagtggctaagttccctagttcaaatcttctatgtagcgaatttcagattagattgtttcagtggctaagttccctatttcaatggctgtatatatccggttggatgtagaggccgggtaaaaaaaatacccttatctaaaaaaaataaaaaaaaaactagtcgtgtgttaggtcacgctaaaattgaaagtttggttgaaattgaaacgatgtgacggaaaagttggaagtttgtgtgtagaaaaattttgatgtgatgaaaaaattaaaagtttggaaaaaaaaagtttagaactaaacaaaggtgcagttttgctccgttgtcatgtttagctggagatgtgtcccgttctcttacattttgattttgcagcccagatatcatcggtgtctggccatcccttttgatatccctcgtttttcaaacgatatgacattttctttttgtgtgtgtgagatcatctcaactgtagtaggcattattacctcagtgaaaatgatacggctgcactgcacctttaataatcctatgacaactttccaatatacgtagcacaccggagattgcacaatattgtaaggacccctttgaatcgtaggaatgtaaaagcataggaatagaaaaaacgcaggattctgacaggaatgtaggtgtaaa

SEQ ID NO: 35819 - DNA, 1501 bp, Oryza sativa
ggttggttccaatgtgctcctaactgtgaaaaaatatcaaaaaaataaaaataaaagttccatctctctcctcagcaccttccgccatttcctgttgtcaccactgtcatcgttcctgtttaggtttgtgtcttgtgatgttctttgtggttaggctcacgtctctacttcggctagcctaggaccagtcaggcccggcccgggggggtcgagctgggcctccacacagggcccacgaagtgaaggggcccaaccccatatatgctgtacataatagcccataggaactaagaagcccactagctcaggagaggaagaagcaaatgtacaggaaaaaaattgcgtcgatttggcttccttccgtgattccgtccgatcgcttcgccttcgctcgcaatcgcctgactcttcgcatgttcggctgttcgccaccctcccaggttccagccatgtttcagctacgtcgacgactgcgcgcggctatgcgtcaacggccggtgtcgtgctcagtgccgtcagcggcaccacgacagccggtagccagatgcaaatctcttatctctctgactctctgttcagttctaggagaccaggaggtaccccattgctctcccctttgatgtatgctaagtttatatgtttaaattttgggatgcaaaatgttactccccaattgctcctcttctgatttctgaaattttgatttaggatttagggatcctcgcggagtcgcggtgcagctgtgcaactagggcagtgaatagttattttctttagttctcaactaggtaatttgccagcactcatttttattataatgttgaattgaatctagtatgacataattttcataaattacttacttttttctaaatttacagtgaaatcatgtaatgtctcaagaaagattaaatggtttggcaactttatgcatcgagaagaaactattagatgaaattgatattgatgccatcgtcgatgacttcgcatcggtacatgttagaagaaaattttaaggtaagatatataacttgttttataagaatgtttttttatgcattaaatttattagaaacatagttatattattatagttgtattaaagggcccatttttctagcttcgctccaggccactgaattgacaggaccgggcctgtgaccagcactgtacaaaccttgaacgattatattattcaacttgatttggctaacttggttgctagttttctcttgagcattactttcagcccattgacaactcaaccacaaacctgactacaacttgataggtcttgttgctacggcaccgatacacctcgttccacggttgcagacttgtgggttgacgtcccctcctatgagtaaggtaagaattggtaagggcttgtaagataggctgagagtgagcatcttgcaaaagctacatcccaatagttgtagggcttatatttcctcatttgttgtttttgttgcctttgttttattagccatggcatgtt

SEQ ID NO: 35820 - DNA, 263 bp, Oryza sativa
agtggttacagtgacctgagtagtgcaccaaggtcctgagttcaaatcttctatgtagcgaatttcagattagattgtttcagtggctaagttccctagttcaaatcttctatgtagcgaatttcagattagattgtttcagtggctaagttccctatttcaatggctgtatatatccggttggatgtagaggccgggtaaaaaaaatacccttatctaaaaaaaataaaaaaaaaactagtcgtgtgttaggtcacgctaaa

SEQ ID NO: 35821 - DNA, 1501 bp, Oryza sativa
taaaatattctttcgctatttgctgaaatattatttttatataaggtgaaacaacacccgatttaaacgattgaaacattttcgatctacttatgaaacaattccgatatacttggtggaacatcatgcaacatttaaaaataatttaataataaactaaaaattgttttcgtcggaatatatccatgtgtggtcttgttttgaaaatttaattgtaatgaatttaatggtgcaatcagattataattttgataaataatttaaaagaaaaaatagtttaaagtggttatgtacgcatgctgtgactgaagtcagtgcccaatcggtagtctcctccccccgagaaagttgcatatctaccattgcaaaagattggattcgctagaataccatcacttaagttggcttcaaaaaaatgccacactcaacaaagacggattcgctgaaatatcatcgtagacgatattgtccctggatcctcttcttcctccttcgagcgcaagaaagctcgccggcgacgatcgcacgccatggcgagcaacaaggtggagccgtggaggtggtacaactgttgtctcccaagatccacaccattcccatccccaaataaagcaagcagccccacaccattcccatccgcaaataaagcagagcactggtggtggctccgacgagctagcgcgtgatgtgagtgcgcgggcggcggcgggggatccttgacgcgatgacgcgagcaccaggcttctgcagcaatggttccttagtatgatgatgtgagtagtaggccccggcggttgctcgacgcgagcaataggcgaaggcgctggtagcggctggtcagcgcgacgagcatcaggtggcggcggtggcgattcctgtatgcaataaaacgagcaacaagcgtaggcggccgttcctcgttggggcatcatagaaggtaaccggaggaaaagttttgcatcatccggctgaattgatttttttgtcatccctgagattgattcctctttcgctggaatcaatttccattgattcatgccatgtaatttgcattcatcactgctgattgagacggtgacaacttggatgattttgccatttttttcattgctggtgcggtggtgcccacgacgtgcagtcgttgccgtcgagcttcttcggcgcacgaaggagaaagaagaggagctaggggcaatattatctagaagggcattccagcgaagttatttgtattgagtgtggtattttttcgaagtccacttaagtgatggtattatagcgaaaccaatcttttgtgatggtagatatgcaattttctccctcgcctggtatcgctgctgctctggttgtctctcgtcctgagtctccgactgagcgcctccaatctcaacagccacctcccacctgttccggctccggctagacctcgccgccggcgatccccagcctcagcgcatccaaccgacggaagaacacaaggcgccgcaccgcaccgcagcga

SEQ ID NO: 35822 - DNA, 290 bp, Oryza sativa
ttcatatcatagcacagtccataattaatgccatagtgaagggactttttaatcctggtattttaatcgacgtagattagcattaataaaattaaaatatattaaaaatcggtccaggagagcaacgagagacggatcggccttagactcgctggctctgcctccctcgtccgacgacatacgtccacgtatgtatatactactcgtactcgtactagtatagcatatatctatgatctctcttattaaatcaatcaatcaagactaacgcgcgtcaaccgtagcggcca

SEQ ID NO: 35823 - DNA, 1501 bp, Oryza sativa
aatctgacagttctaaggttgtaattctgttagaattttatcttttttttactctctacgtagaatgaatttgaatatgtgactttgcacgtagatgcaatactattggaaaaatatatatatatatatgaatttttctatattttttttatgatttttagttggtgtatatggtgtgtacatgcaagggaatgagtacataagatacgctccccattcactttcacataagtaatactccatatagtttgagtattaattatccttagttcttactctaaccgtggcattgcctagacacactgcaaaacaacattgatttgggctgtgtttagttcagcgtaaaatttagattttggttgaaattggagatggtgtgactgaaaagttatgtgtatatgacaggttgatggatggaaaagaactgaagtttggatccaaactttagatctaaagatagccttggcttaattgtcctggaaggatactggaaccccaaggggtaacctagctagtagctagtagtagccattactgctgctactagagtcgtttttgtacattaaacaaagcacctccagatctttgccaatctcttgggattcgggccgccacctcgctccggcacagtcctctctgaattcctccccctccgcggcccagtcccccgacccgccactttcccgtttcctgagacacacgataaaagcgagcaaaagcagcaggcgaacgagcaggagagcagaggcgccagccaaaccctgctgccgctgcccgcgacagaagtgagagaagccgcgcgccgcgccgcgaataaaaagacgatgtcgcatcgcatcgcatgcacggcacgcacgcacgcgcgacgccgccgatattaacccatacccgaggccgagacggggagagaaatcactcgcttccacagggccagccagctagccgatagacgatgcatgcgcatgatgaagcctttcttcaggccagcagcagagcatatattcggcaaggccggcggtgccgcggtaaaactctgaaaagcacggggaggaaaatgtcgatcactgcgagccttgaacggcgatgcagtatcaggtcacacgtagctcgaggaattcccatgccagggtgaaatggaattctcaccatccactcccttgttagctactgttaccagaggatgaaaaagtcactgcgagtaccgtttgaaatgttataactattacggaattttcgtacaaatctttttacgtgaatcagcttgtttccgtttccaaacggggcttaagagcatgcccaatgcagggtgcacctccactatccacatgagcaaaagtgaccaagcatccagttagggatatacctcacatagtgcaagccatacccccatagtatttttgcgttttagcacctatcagtccgttacattttacatttaaacccttagattattattatttgcatatacatccaatatttgcagtatacccactaaaaatca

SEQ ID NO: 35824 - DNA, 1501 bp, Oryza sativa
tggctgggaagtaggaggaacttgaactgaacccttcaaaatcgggcagttcatcagccagccacctttggttgagctgaaggagttattgcctcctgagtcaagtcactgtccggtgtcggccgcaacgagctcgcttgtggcctacaaggctacaactagaccgcggcaactagttgctgcctacagacggtgaggctacgccgttctgccagtggctcactgttctcctttcgagcgttcaaaatcaaaagcagtgcagctagtgccggcctgatcctgatacggtgttcttattccctgtgaggcgaggaaagatttggagttatcagctagggattagtagtagttgaagcctctcacatagataatcaccaaatgtgtagagtcaacatgtaatcttatgttccttcctttccagcaggcattatagcttttctgaaacttgtggtagaaaagggacttcagtttacttgatgacactgataacctccaaaatgctacttgttctgttgaaagattggggaactgggtggtgcttaagtaaaagcaagcttccaattatgcaactcaaagaatcccaatgccctgaaaagagatggtcagagtccaaagcaaactacactggacactcagagaaaacaaacgctagcggaaaagcctatcatattacgggctattagcctgacgattttgctaaaaatctggcgacaaatttttggcacgaaatcactcggatttacttcccttgtggattagtctgtgcatgatttaattagcggctgtgatgcgtttccttcccacgcacgcatgaggccagcaacatctagcttggcacataattgatgagtacatacattgcacgtcgttgcagctaggtgaagagattgaagaaataaaatataaagttacagtcctatataactaaaattacattcgtaaattcagttgatatgacatgtaagtgcactataattttggtaaaaatgttgtgtaagtaaatatgtacttgttatttcctttaaaatataaaattacaatcctatataactaaaattatatttgtaagtttagttgatatgacatgtaagtgcactgtaattacactatagttacactgtaactatagtgaaattacactgtaactatagtgtaattacactgtaacttttagtagatgggttggtgatatatttttttcaatgtaaagatctaacaaataaaatatatgcaatatatataattaatatatgttgatacatgtatagactcttctaatcaagtgatcaaatgagcctaatccaactaatctaaaatctgtgtgatttggacccaaaaatctgtcgtgtgatggatagctagtcccttagcctgatggatatgtggatccagcgccactgtgaaagcttggacccttttttgggatgattaaaacttgggcttgagagacttgtaatcgtctagtagcccaactagtctatgtgcatctgaagcctggagg

SEQ ID NO: 35825 - DNA, 1501 bp, Oryza sativa
ttgcacaaattccgttacatactaatcgaaatggaagtacatcattgtctgaaccagcgcagactttattccgacgctcgattgaacgatcagcggcttggatatcgccaccaattgactgatcgaaagcgtccgcttcattgcttggacagcagccgccgccgacaagcaccacttcagcagctggcaccgtcgccgcgctggacactttgcttggcgcgctacgcgccacatcaatcgattccctggccgcttccgaatcgcaagcctcgcactgctcgccgagcagatcgatccagccttcgtcggagtcccaatccggcaaggccgaaacagggcacgccaatgacttgatcctatcgcagaggctctctgttatctcgtcgacctcctcctcgtcgtcggtctccgactcccagaatgcggcgtccagtgtgctcttcggagagacccacctgggcttcggctgcgcggccttgacttcgtggcaggcgaatgccacgaacggatgctccaagagctgtgccgcggtgctccggtcgccggcgtttctcgcaaaacacatggccaagaagtccttcgcctctgcggacagccaaaccggcacctccggcacggcgtccgtgtacccaatccggtggacggcggcgaggacgtcgtccatgtcgctccacggcgcgcgcccggtggccatctcgatgaccgtgcagccaagagcccaaacgtctgccgctggcccctgctcctccccgcgggcaacctccggcgccatgaacgcaggtgtgccgctgaccggccgctccgaatccatggttttcgcacacccgaagtcggcgagcttggcgagcccgtcgacaccgatcactatgttgtccgccttgacatccccgtgtacgagcgacatcccgtggaggtacgtcagcccgcgcaggacatccgccgcgtacaccctgatcgcgcgctcctcgaggcgtcccccatccctggcaacctcgttggcgagcgatcccccgggggcgaactcaaggaagagattgtatgacccgtcggggccatcgccgccgccgatgcagggcacgacgtgtggcgaggacagcccagacatcatcccccgctccctcctcagcatcgccgcctccgccgcggccgcggtcttgaccgcgaacagctcccccgacgcgccgtcctccgccagcgacaccacggcgcccgacgcgccacggcccagcgtccgcagccgcgtccagcgcccgctcacggcgatcgccattccccgcttcttctcttttcttgtgggtgttgttggacttcggatttctccttgctttgcaatgcgttgttgttgttgttggtggtggtggtggtgagctctgagctggtgatccttttgttcggtctgagttggctttccgagcgcttgtgtgcgtttatatacaaagggtggagaggggaaggcgaaggagaagacgacttggcgttaattgggtgggggtgttaagat

SEQ ID NO: 35826 - DNA, 1501 bp, Oryza sativa
ctgatcagcgaaaaaggcaggagggcgaaacgaatcggccgaagcatcgctcgccgaacgttgaaaccgcaacagcttgtctcggaaaataactagccgaacgacgttacgttcgatcgacataaaagcaaaagcgtttctttcagcacagaatgctacagatcgaaaacaaacgacaaaaagctgaaaagtcagtacacctatttcgctaatatacgcaaaggggccgacatgttccgacctaacaaaagcacgaaatgtgacgatgcgaaagaatagcgaaaaggaaataaaacacatctttattaacttcgaaaaaataatcgaagaatagaaggttcacaacatgatacaattcaccttacaagtaaattacatcttcgcccccataatcactatccctccctaaggaatggtcaggcgaactaggttcgtcttcactactaatatcatacacaaccttaagaggagtagggggcgaaacacagactaaactgtaacgacgctgaaagatcgtttcctgacgtttagtcttctgatggtttcgccaaaagcgagccatatcctccaaacgtcttgaatgaacaagatcgtaatcttctaaggttcgcccggggtgcgcccgcagccagtcggcaaccttgaaaaccttgtagctgcgaccgtttatctccatttcgcgataaacaggccgaaatggacatcgcaccttcggcagacccttcaatgccacaaatttctcgttttgacttcgccagctccctgaagggggccgaatgcacgactttcggtgaaccccctagtagacagtgcagaaaaggcaaaacacagtttacatagtaagaataggcgaaggaaagggaaggtgtggcataatgcgaaatggacaagataataatacgccaaagacttcgaccatccaaaagtggctaagattgtcatacattccaaagtataccaaaggccttcttcggctacaataaggagggttaccgacggcctgccaaatatacatcatttgcctctccaggcaaatgcaaaaaagaggaaggaaaactacaaaaatctaaggaaagggcggagggcctcacacctctgggtgatcctgggcattgcctccaccctcttcgcacgctgcgtcctctccttcgccccggtctgccgcctccgccttcgccagttgctccagaaggcgcgccttggcagcggaccggccgtccttctgccaaaattgtattcgccacgcacgaagagcgggtgaaatgttctgtgcactaatctcccagtcccccttcgcataggtagggaactcggcgacatgctcgcagccgaactgttgcaaaaggcataaggtgaaggccgccgatacacgcgcacaacaatcaccgtacgcggtggcgcagttcgaaaccgatccgccagcctactgggtccactcggagaagtcgaaggctgaggcatccttggaaggaaccccccgcaccttcgtgcccatgtcggt

SEQ ID NO: 35827 - DNA, 1501 bp, Oryza sativa
gtttggctgcaaggcaacgctgtaccttgcagccgaatatgcccagtttatggttttttattgttaattattgatactagatcgtatataatatattactggtcggagcttgataactccgagtaaaaaaactataacatagaataaatccgaggttctttttctcacgtaatttcggagataacaaagcagtctattactcgaacaaggaggtgtttgtgtttgtttcttatggggttgttagttgctcgttacagagttgcccgcataatgtgactggttcattcgttgcaacaaacaagtagcaactggttaaagcagtgactatattatcgtaatttggtttctagttgttactagcggttcgagatagacaaaaatatgcatatatggttttaaaaagctcatgtaaggattacttcaagggcaaattcaagaaaacggcgatatggtattaaagtacactgatcttgttggtatatcacgtcaccttcatggtataaaagagttagatgaccgaaatctacaagcttagagaaaatgtacttctgaatgaccgaaaatctactccacgttacctgcaaaatagtgatacaaactcttactatctttgtcccacaaaaataaacttagaattagatctgccatattccagtacaatgaatatagacaaaggtatgcatatattcatactagaatactccatccgccccaaaatatagcaatctggacacatatgtgtccagattctatatgcttacattttgggacggaggtaggatgttacatatagttataggtttttttttttgagagtagctatatttatggcgccatatttttcatgaaaaaatagtcggtatgtgtttacattataagtccctaaaattgcatatgaaattttagtgtatttacaatgtaagtctcaaaattacatatgtaagtcctaaaattacatatgtaaattctaaaattatatatgtaagtggtgtgtaagtgggatgtaactactatgtaaatttgtataaatatatgagaagtgtctctttttttttcaagaaaagatgtttgctatgctgaactcccggccttagcatactattattttagcactaatcttaacgtcaattcaatgcaccacaaaccgatatatttttaagggaaaaactgtcgtaacttttttagcgtgtctgtttttttatagagacggagggagtacatctctctctaaaatcgactgaacaatccccttttacgagaagaatatgtactaagcgttaagcagacgctgacaggccggctcccacctcccaagtctccagtcttcacctcttctcagtgagcgccgcgccgggttccagcctttcagcccaacccaaggccccaaagccatccgccgcaatataaaccaaaaccctaaaaacccacctcccctcttcggcctctcctttcccccgctccccttccccgaggagccacgccgccgccgccgccgccgcca

SEQ ID NO: 35828 - DNA, 1501 bp, Oryza sativa
gtcagatctgcttaaacatcctttgtgaaggacatcaaagatctgtgcctaatttctgctgtcatggaaattaatgcgcaaatgaatcaactgactctcaacttttttgaggaatgattcggtttcccatgcctaacttcaaatatagaaactgcctttttcaaagatttgtgttccctttgatatagcgtaaaattaatccatatcattacaaaatccgtcctactagaaaaaaaaatcattactattaacgaaaactgtagcgggaaggaggaggatacaactgctgctcaatatcgatagtacaacgagcatgcaacagtggcggccgacgtagaagggggaggatgtgcaacgacagcgagctcgacatggcggtggccaaatctcggagatggcaagtccggcaacggtttttaccacagcacaagcatatttaccggtgccgttgagctcatcaatgtgctaacgaggtctccgaacggtggcaagctcgtcgcagcaccattgatgttttttttttcctctctatagtttggaggagaagatgcctggaaacgtgacaacgataattcaaattttaggagttttcactggcacacaacatgtttagcgaatagtagtgatatttttctaatacagtaaatttatagttcctagaaaaaatatccgtgcgttgcaacggataaatgctattttaattttataattgttataaggtttagttaggtaaaattcacagtgagaattcgcttgaatatttttttaggaaatcgtgagctgcaattagtagtccgtatttcatctaaagttagcatgagtttttttttaaaaaaaatgatttgttatacgactccttttgtatttccaaaaacaaacgagcataaaatccaactcaaacacatacatgtattttcaaaagtgaacgaacttaaaaaccaactcaaatgcggatgacgtaccaaaatactggtaaaagcatctttaatttctataatagtatatatatgaatcaaatttatctttgatattaaatataaacgggaagtttctgtatgaaaaatagacttttagttttggtgttcacttaatcgataccataagaattaataatacacttttaagtttttaaccaaatctttactcttctcgtctagtcaactcatacaacatatccacaggcaacatctgtgtttaataagagttttgtaagaaaaaaaaataatacatatagcattcttcatatcccaaattaaaatggctatcaacactgtgcaataatacgttcaattgctgtaaacgacaaggttgtacccaacccctttaaaaagcgaataggtgataataacctcttcctacaaaatgtagtactactaccaaactttcttcatatttctagtactcatactagaaaaactttggtaactaactaattaattaattaattaaggatattctatgtgcctagcactgttaacccgttttttgttttttcactccc

SEQ ID NO: 35829 - DNA, 1501 bp, Oryza sativa
tccctgtccagatttataattttaggatatatcacatccactaataattctttgtatttaggggcggaaggagtggttcttatcttaaaagagagggcaaattgaaaagtttggcagaactaaacactcctcgagtactacattttctttccttcctttaggctgtgttcggaactttcggttcccatccttactctttcattttccgcgcccacgcttttcaaactattaaacggtgcatttttttaaaaaaaaagtttctatacaaaagttgcttaaaaaaatcaaattaatctatttttaaataaaaaattaactaatacttaattaatcaagcgctaatagactgctctgttttctgtgcgaggagatgagtttccaaccaactagtaacgaacacagccttaatgagtttacgtggaaaaaggaaaaacgagaggaggttgctgcatccaggaacgaaaatccacaggtgggcagaccagatccagcacggcagcagttgtacttgttccccccgcacaaattagctcgtgccgtcgtgtgcaacccaggccatcccacgcaatcggacacagcaccgcaccgcatcgcatcccccgcgatcccttttaggccccttgattcacaggaattctcaaggattttaaattttttctatacagccctttgaatcgaagaaataaattctataaaatcctataaaatttctatgtaatgtctaatgccatgtaagttttggaagaaatctagcatgaggttctacctcatggaaactttcctatgagtcttcatcttttctctaattcctgcgttttttctgtggtacaatcaaacggaaactcctgtgttttttctgtgttttgcaatcctctgttttacacttgtattccagtcagaatcctacatttttcctattcctccgttttcccattcctacgattcaaaggacctttatagcagatataatagcatatcataaaccaactataaacatattttaaagaaataaacgagaagagagaagagtagttggctacagatctgtagccaactgcagcacgaacttcaagacgaaatatgtgtatgacagatggaccagatattaatattatagtaaataactattgtatgaattagctattaaattggctatatatgtttagttggctatactaattaccattcctctcctcccccgtccattcccacgcacgcggcctccaccccccatatcaacccaatccccatccccaaccccagttgctgcttttgcttcggtcacccggtcagtgctgcagacaagccacccccttcctcgcgtagactgctccccccacaaacaaaagcaatcctaatctcggattcgaggcgaacgagcggcggcgagggagggggactagcggcgatcgcgattggagtcgggtggacaccgatcgcggcggcgctctgggggatcggggtgtggaatcgagggggagggaggaggagacggaggcga

SEQ ID NO: 35830 - DNA, 1087 bp, Oryza sativa
gcgcggctcccctcccctcccctcccagatccggccagagggaggccgggggagggcggcggcggtgaggcgaggcgcggggcgacgacgacgacacgcggggcggcggcggcggcggtgcggctcccctcccctcccagattcggccgaagggaggccggggcagggcggcggcagcggcggcgaggcgaggcgcagggtcggcagggcgccaattttttttgttcgtccagtggattttcgtaggcgggtgattgtgctgcctgcgaaaatcatcaattttcacagtcattggtatacaggtgatccttctcccgtctgggaaaactacttttggccgcctacaaaaatgtttttttatagtagtgttactcccaataccattgccccccaatttctaaaaggaaaaggtatgaataacacacaccccatcccgcagagctatcgaggtcgatcgaattactccctaattaaacttgaaagccagacactttggttggaccgaaatttatgaaatttcatgattttcggtactttcagactgaagtttttgaaattttaacatattttgattggatttgaataaactttgactaaatttaacaaacatttgagaacatctgaaaattttggtcaatatattgatttgacagtggggtccgaaattaccgaaattgcaatcattggggtgaggtgaccccacctacaggaatcggaaccagggattagagaaagagagaatagaatcaacaaacacgtacgggtcacatccacttatctatctccattatattaagccttctgcatcttcttctgctgctgcggtggtgtggttgttgttgcgagctagacgctatagccgtcgacgctgcattgcttgtatgtcactgtcagtgactgcctcctcagactgaaactaattaaatatagactactataaaactaattatataaatgaaagttaattcgcgagacaaattttttaagcctaattaatttataattagagaatgtttactatagcatcacatagactaatcatggattaattagactcaatagattcgtctcgtgaattagtccaaga

SEQ ID NO: 35831 - DNA, 1501 bp, Oryza sativa
tccttcctaaaataaacatgattcccgaatcacaaaatcccaaaaaaaacattcacaaattacaaaatcacaagaactattggagcatggaagcgggagagaaccaccgccaacgccacgtcggggaggggaagtaaccgccgcttgggccggtgtcgtggaggataagggtggcgagcgtgcaggcgacctcgcccttttcagagtaggggttggaggcggagacttgcgcccagtgataggaggaagggatgggggattgtaactctggactataggaccgtacatataatatctggactaccatttatccagatttattgtcttaaaagaggtcatatcccctcctaggattagttttttttggatggagggagtagctaatactaaatgacaaacccacctgggaaactgttttaaacactcgggtggatctagacgtcgatccacccgagtcttgcatatcatctaaataattatgaaaaattttcaaaaaaattaacatgataggttaatatgtaatatatcatttcacaaacatgcaagttcaaattctacttctacaagttataaaaaaataacaaatttaactgtgaatatatgtatactagttagagcttaatttgctatttttttacaacttataaaagtcaaatttaaacttgcatgtttatgaagtgatatattacatattaaatctattggcaaaatttgctataggacactcaaaaaatatgtaattagtcatgatacaccacaaaaatatgaattggctataggacaccacaaaagagtggtaattagtcggaggtggcagctcggcacgggcagctacggtggaccaagaaaaggggcagtgtggccaggcgacacgtccacccgagatataaaaatctatcttcaaacctacctagctaattctttagtttgtctacttgcatggttgttgtaaagtcattgtcaatagaaagtaaaataaggtcaaaacccagctatctgccagttaaccttatactatatgcaatcggggaatgatgttgcgcattagttaacttgtctccaattgttttccaaaatcatgcgagttagccgcccttaactaacgatcacgacgttgacttcaatccacatatatatatatatatatatgtatgtatatatatatatatatgtatgtatatatatatatatatatatatgtatgtatatatatatatatatatatatgtatatatatatatatatatgtatatatatgtatgtatatattgtatatatatatatatgtatgtatatatgtatatatgtatgtatatatatatatatatgtatgtatatatgtatatatgtatgtatatatatatatatatatacatgcagtgacacttcatcgaggtatcgtactatcgtagtagtaagtacatattcttctgtttcatgaaacagagggagtacagtgtatcgttattacatcttctccttccaaaggcaaattaaatca

SEQ ID NO: 35832 - DNA, 1501 bp, Oryza sativa
ccttccattatatttgagagatgaagtgaataattcaagtcattaaacaagcataatgaaacatccgacgcctcgagagaggaatattggagacattgctgggcccttagcctgtcagtcaacttcagcctgagatgtgcccgtcaaaccactcgaaggcggtgactagatgtgttacacattcaggagacttgacaaaaatagctaaagatctacaacctctcaaatattcctaactcatactcatatgaatctagttcccaggatgtgccctagatccacactttcatcttaagcatgattatacatagcaaacacaactaagatgaaagaaacttaagacttacaacatcttaataattacataggctgaccggccaaataaacttatcagagaacagcagaagcttgactacccgatcacaagcacaccgactaggggttatatcaacagcaatcggaacccgcatcactcaaagactaaatctaaacctgcagacaaaaggttatatcaacagcaagagtccgtacattaaacaagttaatgtactggcaagcacaagtcaatcctaccatactacatgtaaggcatatattcaaaggaaggcaaatattcaaaggaaggcaatatgtagttcaatttcagcataaagcaagttttgtttcgcaattcttttgtaaaggagttgatgcttcaattaacaaaacaaaattttaagttacaatattaagttcatcataattccatcgtaatcaatctctggttgtcatcctttgacaacaaatcataatatatcacctcacacacacaactcaacacatttatcaatttcaaaccaatgtcacatgatcacattttaaaacataaagtctatactcatgacacatcaccaaagcgttcatgaccgtgagtacggctaatcgattagtttaaagaactctgcagagtttgtacagctttacccacatgatatgaactctctagtttgttttgagtttgcaagactccatcacactcttcatgtcgaatgtgatctagaggtcataacgaagcctttacacaacttagaacctagccttgcaccaacacgatacgtgttcctccatcctaggcatacttggaatatgcctagaaccgttaagtggcgggcccacgccttaaacttaacgccgtggtggcggacacaacgggaacccacccacgtggcacaataccgttgtattggatagacttagtcacctaaactaccacgtcggggcaaatagaaagtttctctgaatcatcgactaattcctcagaattatcgactaactcatacacaccggcctactagaatgcaaggctagtcctaaatagattaattagcttaggccatcccatactagcacatgtggatatacgaataactttaaatgggtgacacaagttcggtccttatggacttgggcaaacactccccctatcggtatgcaactagcaccatatgcacaccacttgccg

SEQ ID NO: 35833 - DNA, 297 bp, Oryza sativa
ccctaataagccgttttggcttattaaaaaaaagcgaaacgatgggtgcctaaaataatagctagtagtttatttttgggctagcaatttgatttgttcaggaaccctcgtttgtaacttttaggaactctgatttgtcagataaccctccttacaaacatctatgaactgttttattgtggtcgtcccgtaagatagggtgagtgattttgcaaaatggattgtggataaaacgaatgaaagtaatttttttctctgtttatctatcaattccttctgacactggcatcttttagg

SEQ ID NO: 35834 - DNA, 262 bp, Oryza sativa
atctttagtcccggttggtaacaccaaccgagaccaaagagaggtagcggcggtgagatggtccttttctttttttttcttttttattttctctcgaatcaagtgggatacatatcccaaatcaaaccccaaatacccaaatcaaacccaaaccaaagtaacatcacaaatcttatacatcacagatccatacaaatgtacaatgaatcacaatattgtccatacaaaagtacatcacagtgaatcacaaataaaaaaacaa

SEQ ID NO: 35835 - DNA, 1501 bp, Oryza sativa
tgatggcaacgtgtacttatggcaggtagttgttggatcatgttatcatttcgcacacgcattagctgctcttttactttctattcatgccactactttttcactgacataggtggatcagcctgaaagaggtcctataattttggaaggccatgaaggtgaagctacttcagttgactggtatgttctacatacaattgtagtttttttttgtgtaaatcttatcaaccatccaatgttcagatttcagtacgattttttcacaattttcaggtgtgcatcagaggtcgggaagatcgcaacgtcatctgacgattccaaggtgagtatgtgattaaccttgcaaattttgttcattcaactttcatgaatcttatgagaatgagatccttttctttttctattacacacctacatgttgcaagcgaatttaaatgcctgttttggtatgtagaaaggggagctgctgatattcagtattttttttaagaaaaccactgataacaacactttatgatgtgtatctatcaggttcgcgtatggaatactgagagaagggtgttcccaaacacaagttccccaacggtcatccgcaagagaataaccgcaccaaacactggaagccggtctgctagccatgagctagctactacctcaagagatgtaggagtagcagcctgcaccagtgcagatggtgaattgccaactggttcacgctctccccttcagcccagagtactggagtttggcacaccggagtcagcgaagaagagagcctttaggttgtttcaggaggactcattggacataaggaaaagcccagaggctcaaatgaacagcccttcttcggttctaagccccccacattcactgaagaggagaacaattcgggactactttgctagtagctcatcttgtgagcacaccaagcatgtccatgaccttgcactcttggctcactcgtcaactgtgaagaacctcaaaaatgctcaatatagctacaggtgcctgaaaaaataactttaaagttttgaacatcgatttcactaaacaacaattattatctccctctgaaatgttgctacctaagatgatagtttagaactctagaatcattgtcggcggagaaagtaaattattttccccaaatttccagctatgaaaaaaccctcaccaaacaccatcaaacaagagttcaccaaaccgcccatgcggccatgctgtcacgcaacgcaccgcattgcctgatggccgctcgatgcatgcatgcttccccgtgcacatatccgacagacgcgccgtgtcagcgagctcctcgaccgacctgtgtagcccatgcaagcatccaccccctccacgtacaccccctcctcctccctacgtgtcaccgctctctccacctatatatgcccacctggcccctctcctcccatctccacttcacccgatcgcttcttcttcttcttcttcgttgcattcatcttgctagctagcttagcaa

SEQ ID NO: 35836 - DNA, 1501 bp, Oryza sativa
cgcgcgatggcggccgaggatatcacggtctccgggggtccgcgagctgctgctgctgcgtttggggttggcacgcacacatgcagcgattggtgccgagcaaaagccgaacctgctcgaaattcggttggcaattgattggggagtttgcctgctcggtttgctttgcttcgctttactatttgcttgtgcgagtgcgacactggcctaccacgagagcgtggcccggccgctggcctgcctatcccagggaagagcggagctgccgtgcgtggcaggcaggcagggccggccgtgctacttgaggagttgaggtcatcatgtcctgcccgcacccagacagcggcactgtgttgacacaaaactctcacaaactgcgggctactgctggctggagtaggagagtactaatattcttcttgatcaggtgcgccagatagccagtggtgttgtatgctgcgaacagtctctctgcctttctgttagattagattagttagagattagcggaagagatgctgatagcgtaggattgagacaataacccaagacccatggcagcgcacgtgtttccgcaacggtatagctaagccagccacaacggggtcatgtgcgcaggctagagatttcggttatcctgagcgaccggtgacacggataattttgtttataatcacagggcaatttgctattgcaactcggctactaatcctagttggatggactaggtagcaaggtgaaaaacaaccccccaccaatgctgctctccaatcagtttctctggcaggtctcttttaatcatcaacatttcagaaacatgcatgccctaccaatgcaagcaaagaccccaagctagtaccatatgaatcatagcctcagggatcttctagcagctacatcttcttccaaaatcaaaagttttctcaattagcctagttttccgtctatatccacaaaataaactaaaacctaaaatctaggaaattcagctattttagattcttagaagttgtctaccaactatcaactcctcggaattttaagctactcaaatagagtgtttctttagagagagataggtattggagttaggcaccacaatcagaagagcaaccaacttggttgtgtggagtaaacatcatatgcccggcaagttcggcaaggacatggtggtcttgcccctcatcgaatcctttccgcttctgacgtgatgtagtacatataactatcattccctagcgcatcatgctgattccagggatttgggctggattggtggcggcccagatcagcttatctgttgtagctaaaagttgaaatttaaaaaatattttataaataattttatcataatttattggtctttaagtcactaaggttgtgttcgttcacgcagatcaactgaccttttaaatagtgcggaaaccagagcaattaattaacttatgattaattaattattataagcttaaaatagatttatttgaacttttaaaaaact

SEQ ID NO: 35837 - DNA, 462 bp, Oryza sativa
tagcttggtctctgaatatggtttctttgtttatttcatgtgtaggtgactcgatgcctcgggagagtatttgcggtgatggaccgggagtcggcttggggataagacgacgtccgtggtggtcaaagatcatgcgggatacttaggctagagttgatgcacgtggttggtgaagattatatatggcatacgatagaggtattgtgtgcgtatgggatgcggagtcgaatttggaaggagtccaaattttggtatgattggttatgtaaagtttgtttcttgtactagagggtttcctaaggcgtttaggactcctagtatgagtttagttcgtggctttaggctgcttacctcgggtataaatagagggggagcgtgaggcttcctggtattgcttttgagagcaattgagttgagttttgagttagggtttcaagtttagtcgaaatttttgtaaggagt

SEQ ID NO: 35838 - DNA, 1501 bp, Oryza sativa
cacttatactgtttgcatggcgatgaacatgcttgcttgtagtatcatcgataagtttccctttaattttcttctttacatctgtttaatttgttcaattttattttattacagctaatattttaagcgtaatggaatcattctttgttcgatggaggtatggttattggtttatcacacaccaaatctttctaacaaaaagtcatgacttgtaatcttatagtctctaaactatctatatgatgttctaaatgtatacggtaagaaattatgcagggaatgatgttttattgatcatttaagtgagtaccacaagcagtatgtttattctacttgtttattttattttatataaaacatgtttactctattaactaacactcccttctcttttaatttcactattctcttctaatttcactaggtcatgagcaaccgttacaacagatacttcaccctatatatgaatttaacaccggcataagtttttgttttatcataattgttgtgttttctagaagttaaaagatttatatattatttgcctatttattttataatataagaaaaaaataaatatatttatgaaatggtttatgtcatttagtttttctatctattatttttagtttctcgaaacatatgatatgtggtaacgatacttgtcccaaataatttgtaaagaattttacaaaaaaaaattcatctttttaatttttcttttctcctttttatgtgtttgcattggtccgatcacgcactgttggattgtggtgccgtgtggcccatctacacacggaggagcttttttctctctctctttttttttacaattcaccatagtaacttgcgtgcttgccatttttatagagagagagtttcttaccatttttatagagagagagagagtttcttacctggtgctctttccaccgattgtatctcgcctctttccaccgattgtatctcgccacgtgtcgctcaactaatggatggtgagggtagccaatcagctgacattaaaccagccaatatgagatagatagatagatgcaaagcgaaaagatattttgggaagtctctagaacatggatggtgtgcattttgtttgcttctcggtttttttatggatattctagatttatatcaaagatgatagataattgggtagtctataggatttatgtttttctttcttttggctatttttcatgtatagtttttctagatttatctcaaaatttatcaccaccatgtggtctaatgagatgctcaagatgagccagctttcgaaagatagatgggtctaagaaaataaataaaaaattttacttacaatttataatcggttgcatgtgaaccgatgagactgcatatagcctgccagaactaaccgatccaaggaaaagcaacgtcaagaagagctgcgtattggaaccaaatagatacagattttggttccaacacctgaaggatgtaacgctcgtataatgtagagaga

SEQ ID NO: 35839 - DNA, 793 bp, Oryza sativa
aaagttgaaggtgaaaaacaaagttaaaggtgaaaatggattttgagcaaagttgtagggcaaaattgaacttaaccctatggatttttagacttctctataattgacttgatgtgaaaaacaactcatgaaattaatgaatttccctgatatcttgtttcgcaagtagtagcgactagcgagtatgacatcactacaacgtgaactacgggagcagggattgttctcaacatgcaagatcctggtgctaccaaggttattccaacttccaaaacccggtttgacttaacaatttaaatttgaattatattatattaacccctaattagctggaaattttcctacacgttagaggatggcccattaaaacttaggtaaatatatgtagcctaatgtgcaatccactcaaataaatattattgaacctaatctaaaagttatctctcgtttcttgcatgatactataaactgaaaaaacaattagcaaaatagattaatatgaaatatatcaccctataaacatgtaacctcaaatccgatttctacgagctgtaacaaaaataacaagtataactgacaatgtacactaactattttcagtttaatttgttatgtttgttgtaagttgtagaagtcgaatttgactttggatatttgtggagcgatatatttcatattaatctatattatagatttttttaaaaaataattattatttaggtgatatgtaaaaatgagacaacgtccggtcgagagataaaaatccatctccaaactaatcaacataccaata

SEQ ID NO: 35840 - DNA, 1501 bp, Oryza sativa
gcttgtctgcagcactgaccgggtgaccgaagcaaaagcagcaactggggttggggatggggattgggttgatatggggggtggaggccgcgtgcgtgggaatggacgggggaggagaggaatggtaattagtatagccaactaaacatatatagccaatttaatagctaattcatacaatagttatttactataatattaatatctggtccatctgtcatacacatatttcgtcttgaagttcgtgctgcagttggctacagatctgtagccaactactcttctctcttctcgtttatttctttaaaatatgtttatagttggtttatgatatgctattatatctgctataaaggtcctttgaatcgtaggaatgggaaaacggaggaataggaaaaatgtaggattctgactggaatacaagtgtaaaacagaggattgcaaaacacagaaaaaacacaggagtttccgtttgattgtaccacagaaaaaacgcaggaattagagaaaagatgaagactcataggaaagtttccatgaggtagaacctcatgctagatttcttccaaaacttacatggcattagacattacatagaaattttataggattttatagaatttatttcttcgattcaaagggctgtatagaaaaaatttaaaatccttgagaattcctgtgaatcaaggggcctaaaagggatcgcgggggatgcgatgcggtgcggtgctgtgtccgattgcgtgggatggcctgggttgcacacgacggcacgagctaatttgtgcggggggaacaagtacaactgctgccgtgctggatctggtctgcccacctgtggattttcgttcctggatgcagcaacctcctctcgtttttcctttttccacgtaaactcattaaggctgtgttcgttactagttggttggaaactcatctcctcgcacagaaaacagagcagtctattagcgcttgattaattaagtattagttaattttttatttaaaaatagattaatttgatttttttaagcaacttttgtatagaaactttttttttaaaaaaatgcaccgtttaatagtttgaaaagcgtgggcgcggaaaatgaaagagtaaggatgggaaccgaaagttccgaacacagcctaaaggaaggaaagaaaatgtagtactcgaggagtgtttagttctgccaaacttttcaatttgccctctcttttaagataagaaccactccttccgcccctaaatacaaagaattattagtggatgtgatatatcctaaaattataaatctggacagggagtatatctagattcatactcgtagaatacggagtagtatcttttatcgaaactatcaactctatacgaaataaatcaaaggccatattacgtatgatatattagagcacgcgataaataattcaccattctatatgcaccaaaactaaagttaagcttatgcatatagagtaataaaaaaaaattagacatata

SEQ ID NO: 35841 - DNA, 1501 bp, Oryza sativa
cgggggagtcgataagggagtacatgcgtcgcttctcgcaagcccggtgccaagttcaagacataactgaggcatcagtcataaacgccgcttcggccggtttactcgagggcgaactcacaagaaaaattgccaacaaggagccgcagacgcttgaacacctacttcgcatcattgacgggttcacaaggggcgaagatgattccaagcgacggcaagcaatacaagctgagtacgataaggcttccgtcaccgctgcttaagcccaacaacaagttcaagttgccgaaccacctcctctcgttgttcgccagccccagccggcgatccaagcacaaccgccaaggcaaggtcaagcccccatgacctggagaaagttcagaaccgaccgtgcaggcaaggctgtgatggctgtcgaagaagtgcaagccctccgcaaggagttcgacgcttagcaagcaagcaaccatcagcagcctttccacaagaaggtccgaaaagacctctactgcgccttccacggacgctcttcgcacaccacggagcaatgccgaaacattcggcaacgtggcaacgcgcaagatccaaggacgcagcagggagcagcggccgaagcaactcgtgaagtagctcaagaacaagcaccccccggccgaacagcgccaagatgcgcaatgccagagtgatccaagtgattacaatggccgacccgccgatccaactgtcgaagcgacagaagaagatgcagctgtgaacggtccacaatatcacttcggcaggcgaaggggctccgcaatatctgaaccagcaaatcttttttgggccagaagatgccgaaggagtaatgttctcgcatcaagatcctctggtgatctcagccgagatagctggttttgaggtccggtgaatcctggtcgacggaggaagttcggccgatgtcatctttgccgaagcgtatgccaagatggggttgactacccaagcccttaccctagcaccgacatcgctccgaggattcggcggagaagcagttcaagttcttggccaagcacagttgatagtagccttcggcacgggggaaaacagacgcgaagagcaagtattgtttgacgttgtcgacatcccacacaactacaatgccatcttcggccatgcaaccttgaataagttcgaagccatttcccatcacaattatctcaagttcaagatgctcggcccggcaggagtgatcgtggtcaaggggcttcagccttcggctgtttcaaaaggcgatttggccataatcaacagagcagtgcacaatgttgaggccgaaccgcatgaccgggcgaagcacgcgccaaagcccgcccctcacggcaagatagtcaagatgcagattgatgatgccgaccccacaaagctcgtatcactaggggcgacatgggcgaagaagaagctaagaacatcctagaggtactaaaaaagaacattgatatctttgcctggggccctgatgaag

SEQ ID NO: 35842 - DNA, 200 bp, Oryza sativa
agaggctcgattgtgcatgtcattatcattcaagtggtgtatctcactttcctcgccgagatatgcacctgttaacggtgaaatttggtaagcccctaagagaattatcacatcgccaatagtcagattcgtgctatattcggttaaggaaattaatctattaagaaaacttatctagaagtgaccgagttcaagaagga

SEQ ID NO: 35843 - DNA, 1501 bp, Oryza sativa
attaaagaatattgaaagataagtttagagtccacatagaaatacaattataaataataaaaaattcagattaaaaaataaataatattgtaagaagagcctagagtctatatagaaatacaatttacagataacgaaaattcggaattagaaaaagaaatattgaaagacgagactagagtccatatagaaatataatttacaaataactaaaatttgatattaaaaataattaacaactaatacatttataaaatacaacatgaatattacatattagtagtttcgtaaagttagtataaaatttaaaattatgttgtcattttaatatatttgaataatacattgaaaaaacatatatgctattatataagagaaaatataatgatgctggccgtgcaatctgcgcgggccaccatgctcgttttttcttaaaattttcaacttttttatcacattgttccaattttaataaaactttaaattttagcgtgaactaaacacatagttccaaaaattttcttcaaacttctaacttttccatcacatcaaggccgtgtttagttataaaatttttcttcaaacttccaacttttccatcacatcaaaactttcctacacataaacttcaaacttttccgtcacaatttcaaccaaaattccaattttagcgtgaactaaggctgtatttgatggtggaaaagttttaaaattggaagaaagttggtagttttgtgtgtagaaaagttttatatgtgatgtgatgtgatggaaagttgggaatttgggggaactaaacacggcttaaacacacctcaaaacttttctacacacataaacttctaatttttccaacatatcgttttaatttcaattaaacttataattttggcgtgacacctaaaatacctgtagccaaaaatgggggttgtgggggttttcccggaaatgggggttgtgtcctttcagtctgtgtctcgtcatcgcggcggtataaatcctgtctccactcaccggtcaccactcaccactggaccactaccactggaccacgggggttggagtagtgactcgtgacgcagcaaccgttcgtcgcgcctctatttacgtgttcgttcgtcgtcgctcccatctccactcgtctcgacgcatccgagattctatacctgctcgagtgctcgatccgtcacggactgatggacgccggcgacgcagccaccacgagggcccggaagccggtcgtgctctacccgtcgccgggcatgggccacctggtctccatgatcgagctcggcaaggtgttcgccgcccgcggcctcgccgtcaccgtcgtcgtcgtcgacccaccgtacggcaacaccggcgcgacggggcctttcctcgccggcgtcaccgcggccaacccggccatgacgttccaccgtctgccgaaggtggaggtgccgccagtggcgtccaagcaccacgagtcgctcaccttcgaggtcacccgcctctccaa

SEQ ID NO: 35844 - DNA, 419 bp, Oryza sativa
caaggacaagattgattaaacaaatggatcgaaagctgtgtttctttagctgtaaagataaaaaagaatggtgtcaggcacgctactcaacgatagattggagaatcaccgaaaaacagaataggccccagatcgcaacaaatgtctatgtgggcatgttcgtcctcgaggtgctacaaccctagtacaaccttgggcacagcaacacgtcagctttcacaactcactactactagtactggtactgtacttgcacaacatttgcaagaatgattaacagaaaacataagcacgtaattgcaaaaccggaataagaaaataaatgaatggcggcaagacacgtagtaaccggcattggagacgagaatcgcgactggaacggatagcgagaggctgagagcactggactgcacgcgaca

SEQ ID NO: 35845 - DNA, 355 bp, Oryza sativa
tgtttgattaataagatgcagctagcacaattgtactggttgatcatacaatttactgcaaaatgacatggcagtgggtatagccagctgctagctatactattgaccttgctctaagtgatttcatcatctaaacaccagcacacatcgcggttggctaggaaagggaggagccaacccaactcgagagtcaggcagtggggcaccaggctgattcacaccggcgcctcgaatcgaagcggcagtggtgcttgggggagcgatgacggctgtccactgccaggcttcggctgaagtgcagttgccaccatatcatgcgccgccacgaggaagaaaaattgacactagggaatca

SEQ ID NO: 35846 - DNA, 1501 bp, Oryza sativa
tatcgcagcaatgcgttgtgtgtgctgtttaagcctttaccacgctatgtttctgcttcaatcggttggctgttgctggtggattttggatgcttaagaattcagactggggaagctgtcctcatcaagtcaagctcgcgctgcactatccgtcttagtgtagtttcgtcgtttgatttggtcgctcatcttgttgtttcgcccgcgcttctgatttttgacatttgagaaatggtgatttctgatgggataatggggaacatctgttcagagatatccaaaccgatcttgtttccatcttgctcgatcgtgtgctatagtccacttgtagtgattcatttgcacgatccagaatttgatcgcagcaatgcgttgtgtgtgctgtttaagccttttaccccgctacgtttctgcttcaatctgttgctggtggattttggatgcttaagaattaagataggggaaactctcttcaccaagtgaagctcgtgctgtttatccgtcgttgacgacgatgacgctggttatcttcctcgttgagtcagcgcatgaccagttgtgtcggcacagtgcaagagtttagtgatgaggcatgatcttgaagccttgggatggtgcgcgatgccgttccgacgtttcatggcgcgtgttttggaggccaccagggctatttcctgttcagtttcgcgaatcgatagaggagaaaggaagcagaaaaaatggctgcgaagtttgcagagcaaaatttctctgttcatttttcgcgtgcgtgagtgttccaggagatgagcgatcccgttcaggaattctggggttgatcagacgcggaggcagcagaggaccttggccacctcgaactcggagtggttgacgaagaagacgaaatggagctgcacgcgttcctcaatctttatcacctcctcgccgacgtctcctcgctcgcgcgattgccgagctccgaacggcgggggatattttggtggacgccacccgcgcactcgggtgacgtcgtcgacgccgctgccggccgccgcggcgctcgtgctcctgcaggatgttatcgagcggaggctggtggtccgtctcgcggcgtggctcgtcctcgtccgggccgtgtcacggtcggcaccagccgcatctggctcctccccgtcctgcgcgccgcgtcgagcggtgcggttgtggttggcggcgtgaacgtacgcgcgcaatcgtgcaattggctttccgctgcacgacgagggattgaagggtacttcatatgatcatatccgtttatgtgtgggaagggaatgtcaaaattttccctgacccattccggaaccaaaaatgttttatagtacaaaatttggaattcacgagagccataatcatggcagttctttctcctaatggactagtatggactagtgttgattgcggattagaagtgtgagctaatctaacctcccaatctcctacccaactggccaaactacccaagccaagctaagctagcttt

SEQ ID NO: 35847 - DNA, 1501 bp, Oryza sativa
aaaataatcattgtgccgaatgttataaaaagcaaaaaaaaattatattaaaaatagataaagtaaaaaataattgcattagaatttgataaagtagggatattatattttttctattagtatgcttgggatgaaaaaaaagtaaacttacttatatttttttgttttctacggcccgttcgattcttctgtaaagagaggattaaattttggatactcgtggcacgttttttaaactgctaaacggtatgtttcatgcgaaagatttctatatgaaagttgatctaaaatatcaggttaatctatttttcaagtttgtaataattaaaactcaattaattacatgttattacaacatcgttttacgtgaaacacttaatcttcatcttcaggatattcaaacaccaccgtaggcgtagtacgtcaaaacactgaattgtacattggactattattggagtgctggttcagtgcaatatacatgtagaagtatctcactcattactccaagatgatttgacattttgtccagctgctattgtaggtgaacccaatgctacagttatgctaggctatcatcgtctgctcgttgatttttgtcagccttaactaaaatttaaagtttaaatacccctatttttaccgcacggttaatttgcacactccaattgcctccaaacattcagttttttttccctattttttgagcagatgttacaagtactagcccatgtaggccgcccttatcttcctcagcccatataggctgcccttctgattctcaaatgaattaggggacaagatgtcaatatctttcagggccccatgattaatgaccatgctataccaacattatggtgcacactattaacattatgggcctaatacagtcatctgtcttggaacaatacccggcctgcaagtagaactgctgtactacttaaacaacttaattattacgataggggctgtctataactagccaaatgcttgtgcgttgcaacggattttcttaaagtatataaaaatattgaacaaaatgggttaatatttctcaacaaaacgtatatattttgtcgttgagcataaaacttcacaaagtagatttgttgaagcaagtatagaagtccgttgccttgtcaacgattatagtggttcaatcatatatacgtgtgtattttgattgcctcaaggtgatgaaaaaatgtgattagtaattattcactccaaaagaaactgatgttgaataggtagttgaatttgagagacatacaggttacaaatcaaacacccataacaagagcccgtgcccataaattagtgatggaggtggtgatgacaaaaccaccacaccactatcaacatttaaaatagtatagatatagtacaagtggattttatatttcttttatgctactaattactcattgtatccattatatgaaaacgcaatgggacccgcatatcaatgaaacatcggttcttctttcgtccttttagc

SEQ ID NO: 35848 - DNA, 1501 bp, Oryza sativa
cacgcaagccaaagctctggataacaatctgattctctgacaactctggcccacaaagccacccatcacggagccccaattctggcctacaaaagcaagcacccccccgccgatagtccgattccccggacacggagccacgcagttagaagttagaaccccacccacaccacagcaatggcggagaaccccctgcttgatgaggtggtcgccatgtacttccacctcgtcgacaaccccgacgacgccagggccctgctggacgacgcgcacttcaacgccgcggagaacgaccacgagatcgccatggtggggattcagctccgccatatccagcaccagacgaacgagctcatgacccagcccatgaccgacgcggagcgggaggcgcagcgcgtccaactcgaggaggactaccgcggcatcaaggtggacgccgatttcctcctggagaaccgcaggcagctgcgccaagtcgtcaagatgctcgtcttcatctggacctacgccatcatcaggcgcgccttgcggcgcttcctccccgccgtggccctcacgttcgtggccggaaccgccgccttggccgtctacgtcgagttgaggcgcggcggcacggtgcccgcgttcgaggccctcgggaggatcttcacctggctgacgtccttcttcctcttgggctatcgggttcgcctctgatcgaccgcgcgacgtgccattcgtgttgtttgcgagcttttcattggtgaggaggcgaggagcgtagatggatcgggtgattagcacaggcgtctcaacgatgtgctagttttgtttcatcgcttttgtgtagattcgtcttttgctttggtcgctcgtcttgttgtttcgtcctctgcttctgatttttgacaattgagaaatggtgattcctgatgggaaaattctgttctgagctatccaagccgatcttgcttccatctttctcctgctgattcatttgcatgatctagtataaatcgttggattgttatagccctttgatgaattttctagaatttgattgcagcaatgcgtttgtatgtgtcgtttaattcttcaccacgctatgtttctgcttcaatctgtttctggtggattttggatgctttagaattaagagaggcgaagctgtcttctccaagtcaagtccaaatggcagagctgttgtaatgcagaacagggtgttcgttgcgttctttggcttttcggctgtgattgttgagcagcgtacaatgtagatggatcgagaaatcaacacatgcatattgcatcttgatgatgaccgtgctaggtgcaattttgtgggttcatttactcgttcctcttgtttccttcctctgcttccgatttggacagacaaggtggtttctgctatgcgtacctgttcaaagatatctgattcgaggaaagcagattatttgtttgagttttttaattgaagtttgctaagttccctagttatttcgagagattgtaaataagc

SEQ ID NO: 35849 - DNA, 1501 bp, Oryza sativa
acgccgaggctgtcacgagccataacctataaaaacatgcaggtagcggctagttctccatcgaaaacgttttctcggctacgtgcaacgatgaggcgacccatggctcgcgattttacggcgacgtttcttctgctgctcagcgtcgcgtcgctgctggtgatctcgccgtgcgcggcccagcagatcaagaccaccgacacgcggtggagctaccacctcccgcttcccgacggcgtcagcggcgccgagagcctcgccttcgacggcaaggacggcctctacaccggcgtctcggacggccgcgtgctcaagtggggaggcagcgccgccggctggaccacgttcgcgtacaatgcgaactaccggaaaatccctctctgctcgtcgtccgaggtgccaccggaggagagggagagcatctgcgggcgcccgctggggatccggttgttcaggaagaccggcgagctctacatcgccgacgcgtacaaggggctgatgaaggtcgggcccgacggcggcgaggcccaggtggtcgcgaccgaggcggacggcgtccccttccacttcctcaatggccttgacgtcgaccaagctacgggtgatgcctacttcaccgacagcagcagcacgtacacccgcaggttcaacggggagatcacgatgaacgccgacgcgacagggcggctgctcaagtacgacgcgcggacgcggcgggtcaccgtgctgaagaccgacctgccgtacccgaacggcgtcgccgtcagccgagacaggacgcacctcgtcgtggcgcacaccgtgccgtgccaggcgttccggtactggctgcggggcaccaaagccggcgagtacgagctcttcgccgacctcccgggctaccccgacaacgtgaggcgcgacacctagggaggctactgggtggcgctcaaccaggagaggatgcggctgggcgcggcgcccgcagccaagcacctggtcggcgtacggctcaaccccgacggcgtggaggtggaggagttgacggctgccaagggcgtcacgctcagcgaggtggcggagcagaagggcaagctgtggttgggctccgtcgaactcgattacattggcatgtttgcttgatagtgctaattaattaggcgtaattgcgtttttaggagaattttagtgtactaggagagtaggagtacatgcctgtttacttaatctgtgtgatattacgtgctttacgtttgctcttcgttttttttgaaacctgtgctttgcatatatttgttcgaacttcgatcgaacggtgcccattagcccaagttcggcgctcggctcatgcaaacggggaggcgaggaaaaacagcgaatacacaataccatacgaataggatccaactcatccaaggccccatgttggatggccttggtaccgagtagtgaaccaatatggccattgcggaacgcagtcgctatcctgtacacagtacacatatttcaaatgagagagata

SEQ ID NO: 35850 - DNA, 1501 bp, Oryza sativa
ctctcccgaagcatgtccgtcaccagactgtccatcagtggaggttttgttgtggagaatacggcgcacaataagcttccggcgcttaccagcacgacgcgtggaggtggtggtgcagattgcgaggtggttgcgtaggtgtgtggtgcctgaccggctagtagctgtgagctgcttcttacagtggttacagacagcaacacagcttccatcagcacgccgttccttagtgaagtcctgccaaactgcagaccgcaatttccgtgcccgtggattgtgcaccacaggcacaggcaccactgcagtgttcactgagctagtaatcggcacttccatagctgttggctccagcatgctatcttgtatctaaatatgatcgcccactgcagcagatccaaacaagcacatcatgcaacgctagtagcaatatagtatatataaagacactacatccatacaaagaaaaggtaatagcatcattttgactctcttttccagacaaactctcacgcgtccaaaacactggaaagcaatgagtgacctttgatgttactatattttctccatgccctcttctacttgtagctacaagctataactatacacgcgcaagtagaaattggcaggaaaagctcatatcctaagcatacactcacactacagaacgcctctgataatccacaaatcccattaaaacatctggagatgcagcaagctgccattccgcccggttgatgaaacacgcacaaaataccttcattaaatcccctcacctcaccggctcaacccgcccgaatccccagtgtcccaaaccaacgacgcaatcagcgtatacaagggagcgatctggaagatacaagctaaatcggagcctccatgggtccaatccccacactcgaatcccatgaaatcgggcacgaagcagctcgtagaccgcgccctcggctagggtttatgactccggttactggacccgataacaccacggaggaggcggaggaggcagcgtggggatggggggaagggcgaggaagggagcggggactgacctcgtcggaggcggccggcggcgagcggtggtgggtcgggggggaggaggggacccgcaacccgatccgagggggcttagcagatcggagccgggggcggaatgcgtgggttgggtcgcgacccatttccgcgtccgtgcggtgaggcctcttttttttggtttgccgtgtggtgggtttcgggtccgcgcctgcgccgatgcggcgatggacggccgcgatgccaatctggttggggcgtgggcggctgggcgcgtgggttgcccgcgaccgcgacgtggcgttcgtggaaggagaggttggcattgggaacttggaacggagccggagcccgcgggggtgaagaaaaccgaatccaagcctgtgtcgtggctccgtttcggttgggtttcgtcttcccgtccatctgcaatactcaatacgtttcgtattacgagtcgtttaacattttc

SEQ ID NO: 35851 - DNA, 1501 bp, Oryza sativa
tttcagatatcaaacatttttttcttgcggaatggatcaggaaaaattctcacatttcactcccacacatcgacagcgcgagcgaaagtagcgacacaccagtacaccggtagcaaaaattaacgtgacataatcccagatgtcactcgctcgcccaaccgaagctgtaacagtgggggatgatctggaatgcgtcagtaactcagtatccaaacagccagaacagcggcggcagtatcgtgatcctcgcgtaggtcaccgcgcgtcatctcgtcgactcgtcctcgtcgtcaaccccttcgagctcggggcggccgaacacctccgactccacgtcattctcaatcgcaacagctttgcagcttcacatccctttgcagctttgcagagataaccatccaaatcaaccagaaacaggttgaagcagaaacacagcgtggcaaaatgcttaaacagcatatacaatgcatcgctgcaaccaaattctaaaagaaaaacatgactggattatgaatgtcctagaacttataatagatcgaccaaatgaattagcacgggaaaaagatggaaacaagatcggcttggatatctctgaacagaacaggttttcccgtcagaaatcaacttgtctcaaatgtcaaaatcagaagtagacggtgaaacggcaagatgagcaaaagaaaaagaaaaagctaatctcgactcatctacatacgatgctcaccaccgaaaaagccaaagaacagcacgaacacggccccatcctcgcgcgcggcgcggtcgatcagaccaggcccacccggtagcactcgaagaagccgcacatcaccacggcgaagatcctcgcgaggctcctgaacgccggcacgccgcgcctcgactcggcgtacacgagcgcggcggcggatccggccgtaaccgaggcgagcacggcggggaggtggcgcgcggcgcgaacgatgaagacggaggcccggagtaactggagcatcaagatgagcaggcgcagctgccggccgcgctccaggaggagaagcgaggacgcgccgaaatcgtcgaggacctcctcgagggcggcgcgcacggcttgctgctgctccacggccatgggcgcggtcgcgacctcgccaaccaggcgccggacatggctgagacgagcctgcgcctcggcgatgtgggcggcgttctcgtcgaggtcggcgcgcgcggcgtcgagcaggatcttgatgtcgtcgacgttgttgaagaggtgaaggccgacgctgtcgagcacctcgtcgaccaggtcgttgtcctccattggtgtgcgtgggttcttgcagttaggcgtgtccgcgtgtggtccgtgttttgcggactgtgggtggggggatgcgtttggactaaagcctgtgagcctgagtttacagagtatcaggtttttgtacgtacaaagctagcttagcttggcttgggtagtttggccagttgggtaggagattgggaggttagattagctcac

SEQ ID NO: 35852 - DNA, 1501 bp, Oryza sativa
cgcacagcaaccattcggcgttcctcagttacgcatcacaaattgtttcagacatttagcgtcaccaccgaagaaggtagaatgataaaaggaaaaacaggaatggaacataacaagtgttcagatccctatgtttctgtaggctattaagcaactagctcatagaagtcatactattctcatccagcactctaccatcatcagttcatcaccacaaaaaaactcatcaaatcttccataggctgtcgcagcagagcaaaacttcctgtgcatcagatcaccagtttacctcttgaggcggaggaagatcaccacggcaacagctgccgcggcggcgccgacggccgcagctccagccatcaccggccacgcgacccgcgctccctgcagggtcccaggtgtcggagcagccaccctctcgtcctccgcagcggcagcggcagcggcagcggcggccctggccctggccctctccttcatggcaatcacctcctcctcgagcctcatcttcaccgcgcgttcggaccccaccttgccggcgagctgattggagtcgcgcttgtccgccttgaattcatctttctctgcttggaggagtttctgcagatcctcgagctcctcgcggagcgcaagcaccttcgcgtcggaagaagaggcgatgtactggaagacgaccgagttctgcttggccttatcggaggtgtccttcaggccgtcgatctccgtggcacgccccttcttctcacggtcggcagcggcgagcttctcctccaggtcgtgattggtggtgcggaggtcctcgatctcggcgttggcggcgacggcggcgtaggacttggcggggttcaccggggcggtgacggtgacctcatcctccgcaacgctgccgtccggcacggtcttctcggcggcgacggtggcgtaggacttggcggggttcacggccgcggtgacggagacctcgtcctcctcgacgttgccgttggggtaggtcttctcggcggcgacgtcggcgtaggacttggcgcggttctcggcggcggtgacggtgacctcgtcctccgcgacgctgccgttggggctggtcttctcagcgacgacggcggcgtaggacttggcggggttctcggcggcggtgacggtgacctcgtcctcctcgacgctgccgttgggcaaggtcttctcggcggcgacggcggcgtaggacttggtggggtgcccgtcggtggtggcggcaacgtcgtcgccggcgaagcatccgatgggcgcggtcttctggccgccggcggcggcggcggggtaggcgagggtttcgtcgcccttctccatggggaacggtgggttttggagtgtggattctctctgcctctctgcgatggggacgggtgggggaaattcgctgtgaaaaaggcgagactactttcgccttcccaatcgcgcagtgccctttttatgccgaagggggggcttgatggattggtggagaagaaaaatctcggac

SEQ ID NO: 35853 - DNA, 505 bp, Oryza sativa
attcctgcagccctgtcccccggccgggctcggtacggctgccacgggcgacggcacggagctgcctaacccatggaacatcgaacaccttcgtcgcttctacccctgaggagggggggtcgggtgtcaggttttggctcaggccaaccccgcacccccctcgggtgtgtagggttggccgggggctaccacacatgcattacattcttatttctcttttttcaacatttcaatagaagcagtttcaatttcctaaaggttgtgtctgtgctgttctttccttttgaagaatcttggcttaaaataaggtcactcgtactcaaccttgccatcgggggttcggtccggtcagctaaaatcgccaaacggggcccagaaccgagccgtgccccggggcgtggtgaactccgggggggaatcgacaaaaacccacaatcgggtcacccatacccctcggtcaccacgttcccggcctggccagtctcgacatgtggatctccccagg

SEQ ID NO: 35854 - DNA, 1501 bp, Oryza sativa
aacagaagggaatgatcataatcgttttattttattttttccgaatctacacaggagaacatcatatcccttctgtttctgtacgagtggccgtgaccatctcgcgcacatgaattaaagggcaatcgactttaaacactttaaattccaccagtagttaagaaactgccgccccccaccatacctccagaaaatattttctacaacactaggtactattacaatatacgagcaatgctacacgtaaattttttttactaaacttttactaacaatcatctcaaccgtttgatttaagtagatggaagttacaaaaaaaatctagatgcactcataatatgacacattagtgttattagtaagaaaaagttagtacgtatagccttttccacaatatacctaggtgtaggtgtatatatgcggtttaaatattatataaatttttttataaactttgataagatagattatgataatataagacaccacacaaagatacatgtctaaatttgatctattacattaagaagaaaataacaaattttatttacgttgtacaatgtactatgcattttctgatttttaccctcaagtcaaaagtcgaattttgcctgacatgtttctttacatacttatataatccaattaatataactattttttaaatttttttataaacgcttaattcacaagcaaataacgggtgccaatttgtgtggttgtatctaggcccttgttccactgtacgtctgtaccagtgtatcactgcatgcggagggactcagaggctgtgtttagttccatgtcagaattgaaaatttaaagaaattggaacgatgtgacggaaaagttgaaagtttatgtgtgtagaaaaattcgatgtgacggaaaagttaaaagtttaaagaaaaaagttgaaatctaaagagggccagagcacacaggcaaactcaggcctttgtttagttccaagagaattttgctcaaaatcgtcccatcgaatctttggacacattcatagaaattaaatatagataaaaaaactaattgcacaatttgcatggaaattgcgagacgaattttttgagcctaattagtccataattagctataagtgctacaataacccacatgtactaatgacggatcaattagtcttaataaattcgtttcacggtttccagacgagttatgaaattaattttttcattcgtgtctgaaaatcccttcttatatctggacaaacgtttgatataacaccctataatcctaaaattttctttttcgcgaactaaacatcccctcacagcacaggcaaccgatggatcggagagggcatatggtgccgatttatttattcgcttttgatatccatcacgcagccgctccggttgcgtctttgtcggccactcaccacgagagcgcgcgaagagacccgacaaatttataaaacggagacgggcagagatcgagtagcctctcacttaaccagagattcaga

SEQ ID NO: 35855 - DNA, 557 bp, Oryza sativa
gaaggtacagatatcttaagctagttattgttttcaatttgttcccttattaatactacacttttcatatatgtaggatctgctgttgaattaggatgtgttgattaacctgcaattttgttcatagatttaatcggatgcagctattcctttgcttttatgtgtgtaatagtttttttttacattggcttttgaagttctgatactccatattcttgaacaatacatttctgatggataaaataaggtgtgtgtgtatatatatatatatatatatatatatatatatatctttgttacactgaaaaaggttatgtggccttgaccagttttgaactttacttgattcgaattattcaggagaatgatatcatatgacttgacattgctattttgaaactcttcactaggaagatgtttatggaagtaaggtgttgcctactgtaggagtaagatgtattagtgattagtggatggtatctatgtaaagtagataacacatgtaccaaccatttcaagtttttaatacttcccgtcagtccttttatttttccagg

SEQ ID NO: 35856 - DNA, 1501 bp, Oryza sativa
cggagagaagatttgcgaccgtcctgccgccgccggcgagcgccggcgatggccgcatgaggagatgggcagatggcggccggggacgggtcacgtaaagtcaaagtacgccttcatgaagcgttggcggagaacatggagtgttggtacgtgagacattacggtcctgattgggtgttgttcggagtagcaactactaattgataaccagtttacgagaatttggagaagctaaaaaataactcttagtttcttttttaaaaaaattctgtaaatatatttctcaagatctggatgaaggttttgattataagaagctcgctaaatatgtctgatatattggtatctcaggtctcacgatacaccatattttttttcttttcggtgagtggataaactagaaaatttggaaaccattctcttagacatacaactacaagtctacaaaccatggagctaactagggatgaaaacggttggaaaaaccctataccgttttcattttctttttttttcttgaaaacgaaatcggaacggtagacccggaaatggtaacgatatcggtaatattggtatatcggaaacgggatcatcggaacggaatataccgatattggtcgaaactcgaaagtcaaaaattcatgtcgaaattagcggagtgtggcatagcacacatttaactatgcacgtagatattttttaactttattcttgcatcatcacactccacataacaccgttatatgataattaatgatatgataataagtttgacaaacaatataaacaaagttcaacaatgcttcaacatcgataagttgagaagaccaaagttcagcaaaatccacatgcaacgtcatagggttaacaatattttccctagtcacttccacttttttataggctgcaagcctaccaagctttcttcattcataggcttccgatgggttgggctggctgagccgctggggaactttcggattcttttcggaattttaacggaaattaccatacaaatatggttaccgataaaacggtcggaaaaagcccgtcccatttccgctaccatttccagaagatattaccgtttccatttccgccaccgtcggttactgaaaccgactaaaacggttggtgcaaactggaaacggtagccggaagtttccatactgttttcacccctagagctaacccataacttctacagcaataccaacagtaaatagtctcattatactttggtcctaacatgcactacatttcacgacaatatttgatttgccattaagacctttttttctaaagatctatagggaataattccaaattaagatcaatataacctatgcaaatcgaacgttaacgtgcataccaaatgaactttgttaggacttagggtacgtttgaatctccaacttaatttagcttttcattagcacgcaaagtgagataaattattagcacataaataattgagtattagttattacaatttaaaaaa

SEQ ID NO: 35857 - DNA, 267 bp, Oryza sativa
ccatctgtttcttccagcctccaaccattttaggaacattttggtgtgaaccgagaagcatcgaatcagcaaaacaaaacttcatcaacactgcacaattcagtacttttcatctgaacggaacatattcaaacaccaaataattcaacgaaataaactaaaaaactattcaatccatcaaacacaaaaaacatactgtaggaaacaagaaaccaaaagatgaaatcgaaacaaagaagattaaaaaaaaaacatgcacatgaaaga

SEQ ID NO: 35858 - DNA, 1501 bp, Oryza sativa
ttggggagtagtaccatgttgtcgagatgatttcgacgtggcgagacacgatagagtgtcgtatatcagcacatgagtacacgaggcagcgcgcattagcgccgtctggaacgaaaggcatattttctctctgctgcatcacaacacaggaaaatttctttattcgagcgcttcgattctgcaccatttcacatactccctccatcctattttagccacggtcgtggattttgtgttcaatgtttcatcgtccgtcttatttaaaatatttttataattatatttttattatattaatgataaaatatgaatagcacttatgtgttatttatttttaaacttttttctaaaatttttaaataagatggagagtgaaatattagacacgaaaacttatatccgtacttagaattgagagggagggagtatagggcctgtttagttcgcgaaataaaaatttttgagtgtcacatcggacgtttgattggatgtcggaaagagttttcggacacgaatgagaaaactaatttcataactcgtctggaaaccgcgagacgaatcttttgagcctaattaatccgccattagcaaatatggattactgtggcacttatggctaatcatggactaattagacttaaaagatttgtctcatgatttactccctaactgtgtaattagtttttcttttaatttatatttaatacttcatacatgtgtcaaagatttgatgtgatgtttttgagaaaaaatttttgggaactaaacattgcctaaagatttctgcagaaatactcctgtgattcggccgctttgaatctgcgcgggacccgaatgaagccaagcgcaccacctcatctcaggcaaaacgacgaaaagaaaaaaaaaatctgatctgctcggatctcgcggtcgatctgatcgcgcgctcagccgctcctcccctggatccttcttctccccctctcccctctcccgcctataagagtccctccctcctccccttcgctgcgcactcacctctcatcgtcgcacgcacgcccgcacctcctcccctcccccctcaaaacctccgccgtgatccggtggtggatgcagcctcgtgggcgatccttcaaccgccgctcccggagcttctcccgcgcccgcctcgccatcgaggggtcttaatctcgccggcctcctcccttctctcagactctcagtcgctaaaccctcccctctaaaatcgcactgaacgaacggtcgaacgatcccgccgagatggacgccgcggccgccaccgctgttaatggtaagcagaaggacgtctcctcccccccacggatcggatcgggcctgatctgttctgttttgccctgcgttttgttctcgttctgcttgatctggtttggggatggatgggggcgtgggggtgttggtgttggtgtgttggattttgcggatctcgttcgtgcggagggcgttgtttttgcggggtgatgttctgacgcgtctgcgt

SEQ ID NO: 35859 - DNA, 321 bp, Oryza sativa
attatagacaaacgtattactaatgaatgatttttacagtttttagaaggtaccaaaagataccacattttatagcgtaaaatttagtatctcttattatctttggtattaaaaaataccaaaatttgcactacagatattaatacttcttggtagtacctctcaagcaaccgtaatgtatcctactaaactaataataatgtgggccaagggtttaggtggtaacagttattacaaagctcacaatgtgctatgcctattagagcaggtacaatagcaaattattagctggctacaaatatattttaatgagataaaaga

SEQ ID NO: 35860 - DNA, 191 bp, Oryza sativa
attgtgaaacggagggagtaaatcggcttggtcccaaacaagtttttctgatttatggttttcgtgccaccacttcaacagcagatcagcaatacttcagacactcttcagtgttctgttctatttgcaagtattcgctggtccacatctggagccaattaatgtaacattcatttcatgcactatgtagg

SEQ ID NO: 35861 - DNA, 445 bp, Oryza sativa
tagtccatggcaattagaatagcatacagattaaatttagtgaagagcaaatggctaattcaaagaccctgtcagaaagaaaattgtagcctgtaaaactaccaagagagcaccttcaaagaccctattgatgagtcagtaatcagtacatatatgagaaaggaaacaatagaacttctatgttgtaaaaaagcacaaatgcattaaggatctgatttgcaactagtagagatactgccttcggagttagtaaatctgaaagatgttttaggctacaagcattggttatcctttctaacaaaacaataccaattgttcagcttataaagtgcacactaactattgggtatatatcatgatgatggatatagatgcaaggcatggcaaattaagtcagagaggcaatatatacacaaaaacatgttgcatcatgtacaaattaagt

SEQ ID NO: 35862 - DNA, 606 bp, Oryza sativa
agtgggagaaacgctacatcgctggtcgaggaccaggcagtagtcgtaactcgaccacttaacgtggaagtagtgggagaaacgctacatcgttggtcgaggaccaggcagtagtcgtaactcgaccacttaaagtgaggcgagagagatcactgcgtcttactggttcgagaaccaggagtaggagtctcttaatcacctataggggcgctaaagttggtttattacatgtgcatatcatgtggccagcatgactctcacacacaacttgtagcatatccggatgtccgttcgcaatcatgtcgggtgatcaagccgacggcgttcgcgaggaattatccgttaacaaccttttctcgagtaatccagcgatggccggtgctatgagataggttgtcggtcttcgttggtaggttgggcgcgacgattctgcatttgtcgagatcgttctcgataatgcggtgtactcgaccacgacctactcgagtgctcaattattcctgaaaaatattttctagaaggcaggatatatagcagagaatatcgagtatgtattcgaaaaactgcatggatcttctagaattatcaggatataatgagcagatg

SEQ ID NO: 35863 - DNA, 1337 bp, Oryza sativa
cgagcgaggagcagattgatgagtggagagcagcggaggagtcgagactcaagagtggggactgcggactgggaaggacaataataaaaaaaagccaggcctctttgcaatcttttattcaggatagaatgaactagcaaatgagattactgtgttcgaatctgacgaagatttagattaaatgcggacatgcaaaacgagataactattagcatataattaattaagttttaattattacaaacttgaaaaattgatatatttgatattttaaagcaacttccacatagattttttattacatgaaacacaccgatgtttgaaaagtgtactaacgaaaattaaggtaaaattttgggaaaagaatgctaccgacatcttttgctcccgcttgatgcaaacgttatgctccttgagtaccaaattttcaaacaaataatcaattcattagtttcctttactgtgtaacttgaactttttaatgttatgcacttagaacgttatatttaaggaataagaagataaaattattttttttgaaaaaaggatttcctcgattcttatacacatgtggaacatgtggagggaaaataagtagtttcattacattggttggttggaatttagaatttgtacgcacatattcgtcttccaacttatgtccatcatctcaatgtcttgctgctttcaattaatatatgaataaaagggtaaatttccataatttcaagcattaaatagatagagaaaatagatgtacttataagaccactagcaaaagtgcccgtgcgttgcaccgggtgattacggagtgtgtatattgaccaaaagtgttgtttggtctagcaaaagtgcctgtgtgttacaatgtgaagcgtacagattagaaaaatatgcaattaattaaaatacaaattcgttgaaatatttggtatttttaagtaggtatgtgtataattaaataaatttacaagtaaagcaagtgtgagaaataaaatgacatggttaaatttaattttttttaaattctccatgattagttacgctctttgaaattatatttgaatttttcagagcttaattgttaattttattaatacaaacgtcatttaacaattatttacttggaaaaagaaagaaaatccttccttttaggtttgcttcgaaataaacacattcaataacttataattgtaatgcttctgaaaaaatgagcactaaaaatgaacttattctctttttttgggcctgagggacctaaaatagacttatttccggcccttgccggtcggtccacggccttttgtgcacgcgcaagtgcacttcccctccccagg

SEQ ID NO: 35864 - DNA, 314 bp, Oryza sativa
acgtgcaagagcaacgtcagaggcgtgcagttcctcgcagggttttaaatctcccgctatagctgccgctatctcccgctatagttgtttgaaaagggttctaactattcgctctcatgtacaatttaacagctatagctccatttagcccgctatagctgtttaagaagctaaccgctaaatggcttagcccgctatttaaaacattggttcctgcacatccaccgtccaatctcatctagcggctcacaatcgttcccccaataatcttcttcctcctctgtccactgaagcgtgttacactgcctccgcca

SEQ ID NO: 35865 - DNA, 1501 bp, Oryza sativa
tggttttaatttgttagtgtgtggaaacatgagaggatgtcgtctgctagctagctagaggaacggatcaatctgctaacgatagattgatgttcgtattgctgtgttttttttttaatttgtttcaatgtttcagcttaattgcatgcttcctcttcttgattgtgtggtgtgatcaataagacagcaactgttcagaaattgtttccgtcaagatcgtatcctatcaagaaattaattaataatgcctgcagcctgacttaagcgtgtaatcctacatacttccatgtgcggacagtgcatgcaatctgatgtaataatgtgtcggatctaagcataatatgtctgagattaatttaattaacctgttttcttcagacagatttatttgtggttgattttggcactgatattgggagagaacacacgtactccctccgtcccattttaaacgtaactatagatttccgtatctaactttaatcgtcggtcttatttgagaaaatctaaaatctttaaaaaaattaaaaaaaacataagtcacttatagagtactattcatgttttatcatctaataacaacaaaaaatactaattataaaaaaaattttaaataagatggacgatcaaaattgaactcgaaaacttacggttgtgtttaaaatgaaacggacgagtatcactcatagaatagttgtcggagctactccctccgtaaaaaaaacaatcatgagtttaaacctgaacacaatgagttgggttcaggtttaaactcaagattaggttgtgtccagttttaaatttaaaattggggttttttttttctttggaacggaaggagtagctaggagagctagctagcccttggatcgaaaaaatctcacatgcatgacattgtgagctgtgacatattactagcaaggagatctagtatagtcaagtacggtcggatagcgagagaaaactatactgtagagaatactttgacgactgcataggagccggaatgctcgatcgatattctgcattctctggagggtaaccgagaggcatgattggtgcaaaagtgagggcaaagcatgtgcagactccgttggcagtatgccgcccgtgagcgaatactgagcagtaactgagttgatgtgatggacatgtaaccccgtgtcattcttgtcttctgtttgtagtagctctgggctgtgcatgaaacacggcaaatgggcaatggccatatgtgatcttaccttggattttatactgaacagactttgaaaaggctgctcgtgagtgtactggccaatatataaagatagccaactgtgtaaatacaagtggcttgaaatattttgcaactaaatttccatataaaatggtacttggttcttctcacatgatcactagtactcactagtgtgctgcttgcagaaaggcaaggatggaactgcacagttatgagtgcagacatgacacaagtgactaattgagttaaatctatggatta

SEQ ID NO: 35866 - DNA, 488 bp, Oryza sativa
ggggggagaagaagaggagctagaagtgtttgtgcgatcgatctagggtttatggcggtgtggttatatagagtggcgagctcgccgttgtggcccgtgaactctagggtttgcagctgctagagtgctagtagctcggaaattatgcatgtgtgtgtggcaacgtgagtgaccgtcactcacagtgcaggatcttcatttgagccttggagtactgtacgtctgtaccacgaagtctagctagggtcataagtctaaaattattctttttataatgtaagtggctctaggaatggcattgttttttttatttcagaccttgctactatctattctagctctcatatttatttcaatttgtgtggaagtacacaatttaacaatgaataccagaatctagaaaaaaaataaaatcccctctttcccctcttccgtcactctctcgattctctcctcgactcctcccacggcagtgaccgcatctcagc

SEQ ID NO: 35867 - DNA, 1501 bp, Oryza sativa
gtccttctcatgcctttagttcttgctattagaatctttagaatttgcgttcgaatactgatttttcttggggcctttttttttttgttcagatttggcaaggtgctgaacggtgaaattgcattatgccgccagattgcgcagcaaactggtatcctgttggatccaatgtacaccttagctggttgggagcaagctgtggatctatgtgttggagacagtagaaccaaagtggtgatgatccatacgggaggaacgcttggcttctgcggattggcgcagcggtactcatcgcacttcacctcggatgagcaaacttaggccctgtttcttttagcttaggattattataatccagattattaggagtaagctaaaagatagcttattataatctgataagctcatttaggtgagctttttctagattattgggtgaaaaattacccatcatgccaccccactccctctttagacttgcaaacccaataatctaggctctaataatctaggaaagaaacaactaaccacttattctactacagattataacaatctagattatagtaatctgactcaataatctagattataataatcccaagctaaaagaaacagggccttaaccaggccaaccttactgcaagagtgcaattgcatttttacctctatttatcctccttttttaagtccttttgccacttcccagggctagagaggtactacttttgtatacgagtcagaattgcttgaatagtcagaactctgaaactctgaattgaattgcctaagccacactccagaacagacaatttcatcctgctgatctattgtgattacccatcaaattcatggtctttggctgaatctgcttcccattttcatctgaagattgaaacatacgcacgctgaaacgccgtaactctgatggtagtgcagtgcaggtatagttctgaagtctgaaatccttgcggtccttcaccgcctctggatcccgcgcagggaaagtagtggtggagacgcgggcgatttttcccgccggggtcgagacagacagtcctttcaggcggggacagaccacgtcgccgtctgatcgcgaggcgtcgagaacgacgacgccgccaacgacgtcgtcgacgaccccacgagagcgcggccgccggtgtcgctcgctccagtccacccacgcacgcacgcacggcacgttggcgcgcgcacggcgtgacgaatcggagaaaccgcagcaaatttctcgacgcaacgcgacacgacgtatacgtcacgacccccaccgcgcgagatcgattgggccgcgcgcgcgcgcgccacgcacgcacaccggacgcaacgcaacggaagccgcctgccccgtctcgtcgtcgccatcgggacggctgggccgcacgctgctcctcggtccttcgccgctcgtctgctctgcctgccgcacgcggacgcgggtcggcgcggcggagtgggggtctggggtctatggccgccg

SEQ ID NO: 35868 - DNA, 1501 bp, Oryza sativa
aactcgctttagttatcattgagcgaaggatagtattacatatgaaaagttgtttatacctacggtaaagaaatggtgtcacttaagaattggaagacaaagtcaatgattgttattatacatgatattagccaatgtatgttaaaatgatcctctcttcaaactagactgaaaaggaatccaaattaaactaaacacttacataattaggcttctgtccaagcaaagccttagttactaccatctgcaacaatcaggtcaaattcaatagaatcgttagtgctacatatagaagaatatgtaggattaatggaccaaaataaatacgaacagttgtcttaattcagcataagaacaatttaactccattcatttttttttcagttttacacaacttttagaagttggattaatctaatgagaacataatcagttcgcattgtgcataaggacaattctacaaggaacaaacaattggctaagataaatatatatattcttatcatgcagtaattatgtagctggatgatataggctatcagaaaaagtattgctgataaaatgtaaatgtatagcacaaaacccccattctgaacatatatagatttttttttttgactgaactgaacatatatagatttgatggaacttttctcagacaattatgctgcaacttggttggcatttttttcccctaaaaaatagcatatatatacagacaaagcattgccatcgaggcagcagagcactaggatactatcgttcttaattgattagatagtatcatttgattatttaacactgtaaggcatcaaatatctacaaacaagggaacagaaaactagtctcacattcacatcccatataagcaagccacatacctactaacatgtttgctaaacaagttgaagttcaagtcacaaaggttctaacatttacagcagaaatttgagggaaattgaaaaggatacttggaacagactagtaacctggttaataactaattttcttgaaatgggttaacatgtgaaggattgaaaaggactaaatcaagctaagcaagtactccaatgtcgaaaagaataaactcaaaaggcaatataccttgcaatgccttctgaatacttgcaagacaagtttgtcgccaacgactacttctgcatgtcttctggtcaatgctacccactgaaatgagaggatagatggttcagtgtaaaactctgaataaaaatgaaatactgattacaagaacaagaatggcaagaaattacagaaacctgtgatcctttcctccatttgtcctttaggataacaggagacatgcttggattgtaacgcttctcggtcttgtcaacaaaactggaaaatatcaacatactaattttgagaaataaaaattgaaatatggcatgtagcctataggaacaaacatgaacttgcaagatttcagatgatctttttactcttacctgtctacaaaacttttagtcgaagccatcaa

SEQ ID NO: 35869 - DNA, 274 bp, Oryza sativa
tacagcagctagctgaaagactgaatcactgaaacaagaggctttacctaacattgaaagacaccagtcaatgcactgttcattgaatcgttgactgactagaaggtggggccgtctcaattaaagacagaaagaaaaaggaaaggatgagaagaagaagccaataaagataagtattggtgcatctcccctcctatagtcctagggagtctatgttgctagttggatcctacaataacatgcatttctgatcatttcaaagatcaactcagaa

SEQ ID NO: 35870 - DNA, 1501 bp, Oryza sativa
tggcctcagaccggccggacttggaatggcgaggggggcgcgacggaatctcgctgaaagcggaagaaaaaccagaagacaaaaggaaacgggtaagtgaaaactcgccttgggagaatgaatacggccgcagtgggcgcggggacgaacctgcgaggaggtcggctaaacgaccaccttgggggggagatgaggtttccccggcatggttcggtcccccccatcttgcggagccgcttcttttttcgctccctctcgggctgcgacgtcggcacagcaccctccgggcgcctgctgctggcacgcaccgccccgccccctcggggaggagatggagagggggtatcctcctgtttcctcttcccccgggcgtcggcagggcggctgccccccgggcccccgtcacggggcccagaagcatgaccccctcccggggtagattgttcccccctgcggctcccgcccgtgccatcgtggcctcgaggagcccactcccctgacgccccgaccgcctgcatgatggtcaggatgttggcgcgctctggatcgctgcagagggggaggacaccttgggggatgagggatgcctccacggagctgagattcagcacccgttggaccaccatcttgaagtcctcaggggcccagtcccatctgcccccctggtgggtcctcatgtagtccttagacccggtgtactcccaggcgccccgggcgcgccgctggagtggcgcgatccggcgatgaaggtagtcaccgaacaccatggcccccgtgagcccctgggatcgcagacccgccaggcagtcaagaacggcgtcgtagccatctcccagatctaccggcgcccgccagctggaggcctgcgctgggggctggctcggaagtcggaggcgcgcttcgtcggcgagaggggtgtagaaccagtcgctcttccagtcgtcccacttcttgcgaaggacgcagggaatgtagcagttcagcaccggcccccgcggctggaagtagcagccaccgactaccgacggtggcgacaccggctgtacggtgaagaaccaccggaacagccggagagatgggcgcaccccgatgaacatctcgcataggtgcgcgaagatggccaacgtcattaccgcgttgggggtgaggtgcgccatctggagatcataaagctccagaacatccatgaagaaagaagagaatggcgggaccagccctgccattgcgaaagagaggaagaagacggaccgccccgggtaatgcggcgccgggcgtccctcgcccagcgcgaccacctcccggccggtggcagattccggcatgaatcggcgcggcagcccggcctgcctctcgctcacgatgcgggaaggcggcagcacgctaccctcgagcggtgcggagccccgtgccatgacgccggcggaggaggagcttgagagcgagcgagtatggcaagggtagggcgccggaaacggagagtcagagcacaagtggcaaaggc

SEQ ID NO: 35871 - DNA, 1501 bp, Oryza sativa
tcttctcttttgtttggaccgatttttgatggttttggattgcttcaagattcgtgtagcgactgtaacctacttcctccgtattagaatataaggctaggattggatgtgacatttttcaatactacgaatttggacagagagttcctaattttacgaatctgaataaggagcatgtctggattcatagtattatattgtttctatatggagtctatccagattcgaagtactgagcttgtttaaatttgtagtactaagaaatattccatctaatcgtaggtacgatggtaataactctttgctgtcagatagcaaggcaacacaggagcaacggcataggcgagccacaaggattgagatagtctgcaattaaatgcgcggtacctatgtcactgatatatgggtctagtggtcattaggtccacatgtcagtgataaagtcacgtgacttcaactgcagaggatcctgatatgagccgtaggggtgtacattgggcattagacagacacggataaccaggttttttttttcctctctctccgttttttgtttttcttttttacgttggttagttgaggtgaaaaatagattcacgttatatcgagtaccccgcatgtaagttacaatggcactcgacctaaagagatacataaagtttctggatatttatattttagccttttttaaaaatagtttacaaatagaccctagaaaaatttattctaagaatgcaatctttttctcagatcagggtcaaggcgacgaggtttaatgtctcagcgacaaagacactgacgctaatacccttgtcctctatggtagctacgggcatgtttggatcctgggcaagtgtcatcctagcctcgccaagcaaagctacgcgtttgcaaccggtaaaataatctggctttgtggggtaagaaaaatctagctagccaaggagagccaaatcggctctcctttgatggcaaactctgcttgcgcgaaaatgttagaacgagggcaacacatacttctccaaaattagcgattttttcaatgactcgcacaatcttaccagcctcttcttccatttctttgttgcgaactctcgcttaggctttgttgaaaattgttctctccatcaactcataaatacagcgaacaatcagtctggatctaaaaggaaaaatgattcacggaagaactcagcaacaataattcatctgcatcagctagccactaatacttatacatgaagcaaaaccatccaaacatagaagccactgcaaggttagcaagctggcaaagagatggtttagtgctgccgagcttggctagctgggctagagagccaaacacacattaagtcgctgaggtgaaggggatcgactagtaccgagaacctatttataaaataatttccaaaagaacaaaacaaacatatttttctttacaaataggtcatcggtagctttttggcgctgagtatttacatttaaccattttaaaaaatat

SEQ ID NO: 35872 - DNA, 1501 bp, Oryza sativa
gccctgcatgtaatatgttagaattgctttaggcttggcagtacattatttctaatgatgtactgactcttgttatactagagtatccatttttgtaggttgtatgcttagtgtttattgagtgatgcgggtttcaaccgtttcttctaggaattagattctaattggggtcaaccccctagtcggtttgcttgttgtttgggtaggcaagcttgcgcgaatctctgattatttggctagttggcctatgtataactaaagtagttgtaattgaattttgtttgtcttgtattttcttctgtgtatcattgcttaagatgaaagtgtgaagctagtggatatcctaggaactagttccacatgagtaagggtttaggatatttgggatgtcgtagagctttagctattttcgtcaagtttcctgaatgtgtaacacatctagtcactgccttcgtgtggtttgacggacacatctcaggctgaagttaactggcaagctaaagtcccagcaatgtctcctatatcctttacttgaggcttcggattttacattatgcctgctacttgatttgaattgttcacttcaattggcagatataatgtaaagttcaggtgtcctccacaggcatggtaccagagctaataccaactataggaaccccttaagttggtcgtttagaatggtttcttaaaattattttgagggttttgctctcagctacaaattattttgcgaaaatcatattcaaccttatatatcatccctctctagagattactttcctctaggtctctattttgattttgaaaactcttatcttgctctataggaccgagaccttttgaaagcttgtactaaagtgaaaatgagtttgaaaacacttattaatcataaaaaatcagttccaaagtgttttgaaaagttttgaaatccatttgcaatcacctatgtactagtacggatttgcaaaatatcgggttaaaaatagcctctagttataggatttgaaaatggatggataaaatttaaatcttgaaagacatgatatggtttccatctccttatgttatctctgcaccaaaaaaaatgaatttggtagattttgaactcctctcttccgacatttcaaattttactgacatggtctagaatgggtagtttgtgaaggataaaattgttgtgcttaaacctgtagattgttgcttagatggaccacccaaaattcacatagcctctgtaccaccctaacctaatgtaaacaaaagatgaggaatttaggtaacttaaaacatgaatgaagtttctttctgtgtcggttgatcgtgttttggaatttcgagtcagtctgttaattttgcctaggctaaaccgtagacgatagacctgagaatttttacaaggaacatgtagaataggcatcatgaattttggtgtgatttttggacctttgtatcatagggtaaaaactcaattagtgtgcataaccgtgttctgaaatct

SEQ ID NO: 35873 - DNA, 1501 bp, Oryza sativa
gctctgaaccaatgttgggagaccaaaaaagactcgactggatttttgatgggaggatcggatccgtcatcgtacggggcacaaaaggatttttcttccgaaggtttaagacgctgctaaatggggcggttgtgctagctgggtctaaggttccacttgtggaccgaaccggacggaagagagacagtccgagcggagagaggtaggagacatcagaccgtgcttggggtgaaaaggaaaaaaaaagtaatgggcttttggctcaaaaccaagaaattttttttattaaccttttcaattatagtgtaaagcaatcatgatgtttcaaattattgatcatttcataatagatgttgtatcactaggaaaatgtatttacccgttgcaacgcacgagcatttttttagcagagaatatataagaaaattatgacgtacgaaaacaaggagatgtagaaaagtttttataacacaaccgagcaagacagaacgtacatcaatgattaaactgattctaatttggtactgttgtccaaatgaagtttatcacgcctcaggggcaacctggaaaaaaatgtcaaattcttttagataagctattagttatataaataaattacgaagaggacactacaagtctcgattttgcatatgtacggcaggcgagcgctgcagcgtgtgtgcgacattattgatgccggctgcggctgcagtagacctagcagccaaacatgccgttcaagtttttcatggttgtcgcttgcgcgatccctgtagaggatccttgtaatgagattttggttcagtgcatgtgatcttctgtgttttgctactccttcgttctcagtatccaaatttaaattttcaaacttaacttgtaagttgattttaatatatttccaatgtagcattttttttaatattgagttttaagtcgctacgaatacatatataaaaatttcacctataaattaattttattttctaataaatcgttttagcttacgaagaaatatgggcaaacgctcaggagtcaggacctcagtccatcagaaagtagccaagttgggccagactacacccaacccaattgctctctaatatcctggtcgacaatgggcccaacgaccccgcccagctacgactgggcctgcacagtccgtctccgacccgcgtggcctctcccgagccagagttgcaaccgcaccgcttccgagttccgaccgagccggactcgaactcgaacccgacccgtaccccccttgtattcttcctcccccaatataagcggccaccacccgatagggcttcttccccaatctcgctgccgccgccggatttgctccccctcgcgattcctcttgcgccgccgccggattcgctcccctcgcgtgctcgtcgccgttgcgctgcgccgggttgtggttgttcttggcggctaggtcgtggggttttcttgtttcggaggtagggagaggtttcgttagggtttcgggcgggga

SEQ ID NO: 35874 - DNA, 1260 bp, Oryza sativa
taggggtattttggtcatttcgacaaatttgtacagtactaacggagactaaccggacggcgatggtaaattgtagaagttaagcaaaagtcgatggcatattgtagaacatgacaaagtcagtggcaaatcgtagacgtgcgacaaagtcagtggcatataatggattatctctaaaaaaattttatggtgagttggaactgaatcaaaatccaatatataaaacttcagtgtaccaccttatactctgtttggataatgggttaagaggggtgagattgtgatagggatataagtggagggttgagagaaatgagatatgaagaataaacggctaggattaaaagttatccttttagaaggtaggataagatttccccattccattatccaaatatagtattagggttaaaaaaaagaacaatgcatacaaatgaccatttaataccgtagaaaaacaaaagtcacatgtgtcaacgtttatttttaggattggatttattttgggatagagagtaccaaatatgttgatattctttaataatattaaataatataatgatcatttgagaatggagggagtactaattaattaccagttgggatatctgttcgtttaatagtttaggtgcacgattaatccagatctgttgtctgcctaaccaaccacacatctctcagctatactgcatcaacttcacctggcttatcaacggcagaatcgtccgtattagtattccgtgtagaatggtcatgttgatgagttatcccttcgttctaaattaatctacatatagttgttttgaggttatttctaaatgatctacatttttatgtttatttgttaagtgtattcgttatttgcgcattagagtaaatggacattgatacatgcatccatgtacataagtatttataacccacgtgcaatatcttgatttgctattggctaggaaatagtggaaatagtgcatgcatcaagtttgttgttagagtaaatataatatgatagagttattagatttttttttttgtcttggtgtatctagtatatcaatttggaatggatgagtactttggtgtttactccgtacctatcaacagcaactggacaattaatccttaaaaaaacagcaacttgacattttcttatctgcttcctttcacgagagttcggaaaatgtgtgggcccagttgcacgaatagatgacaaatggacggtagatcttggttgttgtctctagtttaatcatgcttaga

SEQ ID NO: 35875 - DNA, 280 bp, Oryza sativa
ttccccataggaattcgatggacatattttttttagaaaatcatgagctgcaattaggaatccgatcgtctcaagctagcatgtaatttttttaaatagatttcttatacgactccttctatattttaaaaaataaacgaactttaaaaactgactcaaatacggatatgtattttcaaaagagaacgaacttaaaaccgactcatatacggatgacgtacctgtcatagttacgaataaggcatacttactatcctatgacatatgaaatatacagata

SEQ ID NO: 35876 - DNA, 727 bp, Oryza sativa
tcgtctcttttccatacggttctaatggtttgggactcttttcgagtgcacttatatttttcatacggttgtaatgtttcgaaaaactatctaatacatacaacaaatcaatctacatatgcaattcataattatacttccttctaattaatgtggtagtttctatcgccttgtgtgtaatttgcggagcccaaatagctagctgatacatgcaggggatcatgtagttcggttgagctgctaaccacagatcttagatctgtctaaacgttccgttcgaacttgcgatgaatgaacattaagtacgagcatacaaaacgataaatgcattagctcatgattaattgagctttttatttaaaacctaaaaatagatttatctgatattttaaaaaaaaatttatatagaaagtttttgtatgaaatatattgttttatcagtttaaaaagagtgataaaaaatcaagataaaatttgtatcttaacgcgtaaaaaaaagacataagtccgctaaactttgtcgcgaagtttgaaggaactctgaactctggagtcccctaaactttggttagtgaatggaatggcagaaatggagggattgctagtggatggtagatggagcatcaagaaattacttgaagcgttcaggtttgcatattttaatggtagaatgtaattgatcatgcatacatccacagtcaaatggactgagaacccaaacaacggt

SEQ ID NO: 35877 - DNA, 479 bp, Oryza sativa
agcaaaagctatctagacatctagacatgtccgcaatttccaaaaaaaattgatactaaatataaaaaatcgtcaatatgtacgtttcatgggtgatagttattgatattataaatattaagttctaatcatattttaaatatattgattaatatttttatttataagttgcttaaattaatagggaattcactagtaaaagacgatttttgcatatggccaaaaaccgatttccgtagtcagctgggtggctcgatgcaccttggtgtctgcgaaaatcaaaatttatatatgagcaaaacaaccgcatgcaaaaataagattttcatgcgaaaataattttagccaaaaaacaaaaattccaaaaatcaaatttgaaacccctagctcctcgattcatccctgagccctagcctgccaccggcagaaaccatagcccgccgctagcccaatccctagctctttgtcgccgccaccaa

SEQ ID NO: 35878 - DNA, 1229 bp, Oryza sativa
tttagcactatttcgatccgcccctgctggtttcatgctgaattatagaaaacatctgcactgcccatctgtcagtaaaataaaataaaggtctcgtttccaccacaaagagtggataaagttttgaatattcgtggcacgcttttcaaactgttaaacgatgtgtttcgtgcgaaaactttctatgcgaaagttgttctaaaataatagattaatctatttttttaagtttataataattaaaactcaattaatcatacgttattatcaccttattttacctgaaacactttatctttatcttaatcttcaggagatacaaacaccaccaaaatatgagtgccacctgttagcaccactctctttctttccccaacttctctctgcctcacagtcaccctgcgacaagcacgagctaaagctccaccatagggactttaggggcgccatcgtttcgctttttttctaataagccaaaacggcttattagaaaataaaaattgaatttgtaggtaaaacttttatatatgtgttctttgtgatttaaaagccaatgctaaaaaaatctacgttgaaaatatctcaaagtcattctcaaaattaagtttgaaaatttaaaatttggttttttttcttattaggccatccgatgggagcctagggaggcagttgtgtagccagaggttgccattgcaatgaattttctcaagctagctaaagaactgttgctactgtgtttgcacatgatgctagtctacgtgggcaagtattttctacacccaggtgccataacatttaagtgtatgcatgtagttcaaatagttatataaaaaattcataaaatttgataagataaactatgacgatataagactctatataaatatgaagtctaaatttgatctacacatgaagaaaaaataataaattttatctgcgttatacaggttctatttactatcagtttctattatttttacactactacaatagatatttttgcgtgtggttgttttgatttttgcgtgcggtagattcgcccgtttggagcgggctgtctgggaaaatcgtgattttctcgtgcgggtgcttatgtcacccgcacggaaaaataaaaatctgaaaaaaaaataaaatttcaaaaaattgaaatcctaaccatagatcggggcaccctgccgccactgccgcgccggctcccaccgccactggatccggcgtggggtagc

SEQ ID NO: 35879 - DNA, 438 bp, Oryza sativa
ttttattaaattctgaaatgtttgctaaatgctgtttatgcaaatggaaccctattatgccatcctttggtatccttgtgcacttgcatatttgctgcgtggcttgctgagtatgtcatatactcaccttgcaatcattcatcagaggaagagttctacaatgatgctgatggtgtggaggattaggtgtagccttggtcaagctgcctgtggagtggagccgtctgcgccgtttatcttattttccgttgcttagatctttattgattgagaggaactatctacctctgtaatgacattttattcgcctattaattagagtaataattgtactctattatcaatttgttattgtgtgcctcggctgattcctggacgagggttcacacacatgtaagcgtttggaattttggatagaaattccgggcgtgacaggcg

SEQ ID NO: 35880 - DNA, 194 bp, Oryza sativa
tggctcagggatcctcagtccgatcccccctcctcgctaggcatggtcctccttttatactctaagaggatactacatgtgctgcgagtgctacctagggagaagggaaaatattctctatattaattacatgtcttctgccttagcctagaagctatctgcacgtcggttgctacgcggggcccatcaaatca

SEQ ID NO: 35881 - DNA, 309 bp, Oryza sativa
atttggccagctgctagcaggatttggccagtgggatggcttggccagagagttaaggtcttttttttttcatatgtgggctataatttagcttggagtggcatttggcaatactcttggagatgctctaatgtgaccgtttttctcttttcttttttttttccctgaagaagatttgtccgtttaaggcttgtttaattggtgaaatgaaaatttttggatgtcacatctaacgtttgaccggatgtcggaaggggttttcggacacgaatgaaaaactgtcggtgatatggtcccgggggtatcatg

SEQ ID NO: 35882 - DNA, 168 bp, Oryza sativa
tccagacctgtgatgacatcagacagcctctgagctactgcagagactttcctatacctatggaccacttgatcggtgacattctcaaaatatatccaaaatctgactatttctcaccacccccagcactggcatgtgccccaggccaccacctcctctccccacagg

SEQ ID NO: 35883 - DNA, 1501 bp, Oryza sativa
ttgaaaacaaataaccttttgtgagctggaatgatgcattttgctgcacatctaatcctttataaaagtcacgttttccttgtatcaaacatttctagttttctccctttgacgattccttttccaacctatcgtttaaacattatgcttttcgttcgattatttattttagaaagttctcttgtattaatgcttttgacacgctaactgcactttaaaactttattttggtttcttgagtgacgttgtttttcacacttgaatttcaactaggtactccctttttggaacttctctttggactttaaaactatattttagttctgtaatctcaatttcctaaattttttatgtacttatgcttactggttcgtgaaaatattgcttgcatttagtccttgcggcttttttgtgctctgatgttttaatcgtagacttataactaagttctagagttatgtttccctgtttatcgaaaaaatatcttggttgcggtctagacgtctacatttggttgcatcctgttgattttatgataaccgtagtttgcttgttccgaacgatttataggtttcttcgttgacgcttcatttttcatccataagtttaatttttttacatttagttggattccttgattctgtaatgttcttcttgcatcgattcttcaaataacctttttggagtttccaatttttttctgttgtcatggttcatcttaaggttgtttgaacattgttttctggtttataaaaacaaaatattcttttgcattgaagcctaattgatttattttgctcttataattgagttgtagagttgagtctccctgtttatcgaaaacaaataactttgttgtgagctgggcccatgcattttgttgcaccttgaagcttttatgaaaatcaaggtttccttgtgtcgaacatttctaggattctcccttgacgattcattttttgtcctttcgtttaaacctactgcatttagttggatttctttattttcgagcgttctcttgtattaatgcttttgacatgctatttggtctttaaaactttattttggtttctcgagtgatggttgttttttcatccttgagtttcggtttagttctgctagtttgatttcttcaattacaaagtttctctttctttatcttctctttggacattaaatctttattttagttctgaaatctcagtttctgaaattttgtttgaacttatgattaataatttttcacaagaacatatttgtgtgcatttaaaccttgtggggtttttttgtgctatgtcgctttaattttggccttataattaaattctagagttacgcctcctttttatcaaaaaaaaaatattttggttgcgagctggatgtctacattcggttgcatcttattgattttatgaaaatcgtagtttggttgtaccaaacaatttcttggtttctccgttgaggcatcatttttcatcgagaaatttatattttgtacttt

SEQ ID NO: 35884 - DNA, 581 bp, Oryza sativa
aatagattagaaaacaacataatacaacaattagattttccacataccttggaacttggaagagtgagaaacagagaatcatccttctgtacagtgtgcatattgaactgaagaatagcaaggagttcggaggaggaagaaacaaatggagagggtgactgtgacgaagtgctaaaaaatgtaactgaggtaactttcggtgctataaacctaaaatcgtaaactttcagtgctaaaactgaacataatactgcctaggatcctgattgatccgcttttagctaacgtggcagagtgggacccacatgttagtgaataacacttctcttcctcctctcctctctcttcccctctcccttccatatggtcgacgtcgaccaccgcctgccagtgccgcatggcctcctgcactcaccctcccatgccaccggcctccatcgcctcaccacccatggctctgctatcaccaccctgcgcgtgtcacccgccacagcgtctccctcctcctaccccacagtcgctcccttaccgtccactgtcctcgctcacctcgccaccgctagggtctctgtcctcccagg

SEQ ID NO: 35885 - DNA, 1327 bp, Oryza sativa
tttttttaatgactcattcattagaggacgtaagtagcttttggtctccccgcgaaaaaaaaaagtagcttttggtcagttctacgaactaattaaagctctaatttttttattaagaaccaggtttgcctcggtctccattaacatgttattcaaactttttaacggtatatttcgtgcgaaaactttatacatagaagttactttataataacaaataaattcatttttcaagtttaaaataattaaaactcaatcaatcatgcactaatgactttttttttcactgtatacgtactaaatgttcatatatatttttagtgaacttaaatggggcctaattccattcgtgtagtagctcgggaagacatgttgactgttgagacatcagtaattcgctactcctgtaatcctgttctatgagctagctcgaagcccagccggacggtgttgccatacatgcaatcgaaaccgcacacgcgcagttggttggcgagacggttgctcccaacatggaactcgatccagcttagctggggaccgcgcttaatttggttggtttctagccatggccatataggttgtgtttagttcagcgcaaagtttagattttggttgaaattaaagatgatgtgactgaaaagttgtgtgtgtatgacaggttgatgtgatggaaaataactgaagtttggatccaaactttagatatatataaacacagtcatagcttaattagatcgaatgctcatgcatgaacacacatatgttggatcctactcctgcatacgcgaacagtcaatctctctgtagtacacagtggcatatactctacggatgcacgaacggttttatcatcgtatgtgcgcgcaaacagcactcattataagttcataacagtgacggatgcaggtgatcaatcgatggctgatgtcgttgtactatatggtatagtagcaagtacagtaatgtgtatacgtgcttgcatgtgatatgatggagagatcgatcgacgtacgtgccacggtgcagatcgacagtgttgacgaccaaagtttcagaccagcctcagcatgcatgatttggtgtttaattatcccttctttgttgtgtttgtgtagctgttctatcttctctatcaatgaaatgaggcaaacctttatttttgtcccattttatcagatgagaaaaatgtacttgcattgcatgtgtgtgcccttgatgcgtgtgaaagaaaaaggaataaagggtagtactgtagtaaaactactgcggagaaaaggaaagaattgttgctgcttgctgctgctgtgacttgtgactcttcagg

SEQ ID NO: 35886 - DNA, 1089 bp, Oryza sativa
gcggccaccgcaccggccggccggccgccggcatgcatgccgcgtccgggtgctcttatcatcgtatgccccaggtactcctcgggctcgatccgtgatcctgcaaaattttttgggcggttgccgtacgcggccggatctacaacgacggtgagtcggtgacgcacgcacgcgcgtgtgtacttgctgtacggattccctcttgctttgtacgaagagtcctttgatttgtcctgctaattttgttcgtcttttccaagggatcccaactcccaactgccttttcctttcttgggattacaaaatactaactgtatttactgtgacattgactgattttgattggttccaagagatggatcttggaaataaccgacataaaatttgcatggatctactgatttcccctcagatctgcgcgcatctctcgttcaattccttttcttactgtagctctcaagattggaatgttcgttgcatcagcttaattagaggaggtgacgggaagaggaaagaaatttccctcagatctgctaattactccttccatctcactaaccaccagatcgatcaggtcagtagctagctattgctgccacagatttcttgtgtgtcctctacttgttcagttctacacgtgtcgctgctgcttgaagtaattgcgtgatagaacccctgtctcctgaatcctgatagctccagaaatagtagggactaggtcactgtccacttactgttctattggtgacgtctcgtacttatctctacaatgcaagccgccgtacttatctgcagtgccactgtccccccccccccctccctctctctctctctctctctcaaaggaaaacttcccaaatcaaaacaaattttgcgcaaacctgcaactatgtacatacattagcttcaaccattttggtttaggggagatctagctggatgtggaatcttgttagtcttaatcttttaagaaaaaaagaactctcttcggtttttgtttcattttcagcttactagaaacaaatggtccggttgtttctcttattctgtttaaccagataaagtaaattcagaggttttattatggtg

SEQ ID NO: 35887 - DNA, 1501 bp, Oryza sativa
aaaaattgctgggcatcatccatgccgataacagttaacacatagaggaaaatcaagttaacaactttgctgctgagcagtctgcaattaattggtaatcaaacagcggtttgatgatgggagaaaaagaaaatgtttgaaggctagtaatgaatctttttgcttttattccagaagctaatacgaggtaatggtgaaacgtttgtttgtgtccatttatagaaactcatttaaacaatgttgacatgataaatattggaaaagattcgaacatgctcaggaaattgtattaactttgaccaagtgtttcactttccagcatgaacactgaaatttttgacatgacctgttttcacttaaaaaaacatataacagtctagcctgagaaaatcatgttttgttgatctggtgtgcttctgactgtgttattaaaactggaagcaatatctctgaactttcaatttggtttgtaaagaatttgactgtttactggaggaggtcgaggaatgggatgaataaaggtagaaaaggacgtgtccctttcccggaccgctgtaaaccttaccctccctgcataatcaactcgttgatcaagctacactgttccattctggatttagtgcgtcgatgcttttgtcctgtgttcttcatagagtcgctgcaaaactgttagtgatgctttcctttatgttggcctaataattggctacagttacttcacatgtggttttctttggacctcactttattcgcatattgctgaattgcatttgcattatttcaagcgtgcaactgtttcatcctgtactataaccctttatgtcatcaagaagcactgtactgtaattgttgggaattgtaggacaatgattacgtattgtctactctctccgtcccaaaaaaggcaaactctgagtttccgtgccaaagtttgactgtccgttttatataaaaaaattttataattagtattttcattgttgttagatgataaaacatgattaatactttatgcgtgacttatctttttaattttttttataattttttcaaataagacgaacgttcaaacgttagacacggaaaccagggtttgtttttttttgggacggagtgagtatgaatgtagtagtgcaccattgtattcatcatggtgagttttgaaaacgagcttcttgcttgctgtaagtatagattttcttgaaagaaagagtcgtacgtctccaatatatatagaaagtttacggattcacgactagggatgagaaggctcccgtgtgccagaaacacctggtaacatgcaaaaaacacacacggtaacaaacatacagcggcttcattgatttaccgtgcgcacttcttgggtgttctatgattttgaacacgagatggccagaaccatctatatatagtgtttagatatagcagatttctatgggtgtgtttagttcacgtcaaaattagaagtttggttgaaattaaaacgatgtgacagaaaagt

SEQ ID NO: 35888 - DNA, 284 bp, Oryza sativa
tgactaccaaattgtgataatattactcgtattcaccaagtcatcataattgaatgtgtaaactgtaacctagttaaccatttttttttaatttttttacagctgtcaaatgcagaaaaaccttgtattcgttctagtcataaaaacataacacgcatgctgtcataagaagactgaaaagaaatggtgtgtcagcactcagcagtaggaatttgaaagatatatccacaaaaggtagctattaacataaatcagtcataagactgtaaaagaattagtgtgta

SEQ ID NO: 35889 - DNA, 1501 bp, Oryza sativa
gaagctaacgttggtgggtggtggtgtcgccgcgggcttcgctcgcggcgtcggctcacgcgaggagatcttttcttccaagtatttttttcgtgggccggcctaagcccacgtaggcccaaacgaccacggcgacttggataaccacgacaccgaggagaaaaaaaaaatgaagaaagaggagagaaaaactagaggtggaagacgacggcttctcgagtccatagaaagaggggaggagagagaggcggtggtgggaagcaagaatggcgtgctctccgcgtgtgttcctctcggcgtcggctactcctcctcctccatctgctgctgcttcctcttcgtctccgttcctctccacggggcatgtgtcctcggctccgtccacgtccaggcaagcgtttctttcatatggtgtccccattgatccgcgcttgccttcttgctcgtgttcttggccacccatttctatctcttttttttttccgatgcataattcatggttcgaaggtaaaggtgctccgtgatgctacgttcgtttgtccagtaagttggggagattgttgtggtggttagtacacaagaaaatcattcgctgtcagttgttggtttgttccaactgctctgcaattcgagtgaatttagcatcagctgttccatatattgatgatatttggtacgactagtttagaacttttcattgtgatgaatttggtggccatcgtcgctggctcacttcactggatcagtctggcacagcactagccctcattttcccaaaaaaaaagaagaaaaaaaaagagagataatgtctggcactacccacaattacttttggtagcagaagaatactactcgtttttctagagtgttaaacaattcaccttcaccttttgggttgggagtgatcaaactactattggaattactattatgtgccaacggctatttctttgcttcagtttatcatctgtagtatttccaccgagttaactgatgcccaattatatgttttttccttgcttagatggactgtccaatacaagcagccaggacatacattctatcgaaggacccatgtgcaaagcttcttggcttttgctagcacagatgtatgattcaggctttctgtgtagatcatttcatttttgggggttcaaaagtacttttggtttggtaggtctacagaatgtaaaattacaaaatttattgaatatggtattggtaacttcaagtgtttttgtaggagcatgatatttagtagtggatcttgagcaggtgctgtatccctcaagaatttctgcagaaagagattcattatttttagctatagagtagatattattttgcctctaaaaatggattcaatacttcttttgaaactaatatacaatgttcttttgctttagtcaaaactttgtcattatcgtttggtatctaagacactgagttcaaatgaatcaggcatcagaaggcaaaagaagttcaggtgataatgtggtaa

SEQ ID NO: 35890 - DNA, 229 bp, Oryza sativa
  unsure (1)..(229): unsure at all n locations
atttttttcatggcacccccccgnnnntcctttnnntggnnaaattnnanaaattcttttcccccctctcctctttnnntttgggaacaaaaaannnnnnaaaancttaaaaagggttttccccccccccccccaagactgggcanctaacccccccgtcctctcaaactctggggggggggatgtnttnnntntcncccaggggananacaatgagagatgaacacca

SEQ ID NO: 35891 - DNA, 312 bp, Oryza sativa
  unsure (1)..(312): unsure at all n locations
cgtgtgtgtnnnagtgagtaatcgcatctttataaggcgaattcnagctcggtacccgtattggtgacgttgcttacaatctgcttaaaattccttaaacttagattgggacagtacgtaaggtttggttgatttctgggtgggtggtactgtctcgatcgatataggttttaccaggtacttatgtcgaacgaacgggtacgaccacagtttctagaatggggatagacctagttattatgttaattaacaatatggcacctctgtatagtggttcttatttttaagtcctcgcgcaggaggcaactatag

SEQ ID NO: 35892 - DNA, 355 bp, Oryza sativa
  unsure (1)..(355): unsure at all n locations
cttttttatggtgtttatttacacccaaacaaaattatttaacagaatatttttttttgtttttataacggttnnaaattnnacatatttctttgctnccatatcgaatttaaattggaccacatgccatcgnatcaannnaaggtaggcaaaaaaaaaccaacttacacaaattactggnnnnnnggccacatcccctccctcccttntattnngnccttatttnataatatgagcataattgtcactgcaggtgatctatattcggcactaaaaagtctatattgtttgctccttttatctttatattgtatttgcatctgaatattaattgatttgttgggacttctacaaa

SEQ ID NO: 35893 - DNA, 1501 bp, Oryza sativa
  unsure (1)..(1501): unsure at all n locations
aaaatgtaaaatcttaaaactagtgcataaactagcattttttttcttctgaaacttatggtaggataaatcaaataataaccctaatatggtgtatcttaggtatttttgaaaatagtatagtccgatggtatattgtataataattgataacttccngatatattatagaaagagacgctgtaaataaataatttttaaatagttggattgggacaaatagagttgatttaacagatgcttttggtcccaaaaataaaatatagtacttcccccaatgaagaaggtgtgtgtgattattgtatttcctgtgcacacatatgcaaaaatgccatccattcatcccagtgcaatgccctatctacctatccaatcccaatccacctgagcgagagagagagaaagggtctcctcctcaacatcaacaatggcggtcgcaacctccttcgccacactcgtaagctcactcatccatggcctctgctctcctcttcttccccaccgagctctcaatcttattatcgtcgctctttcttctcttgtgtttgcactgcaggccatcgcgcggccggcggcggagcgggccctcctcgcctccaaaaccccctcgccgctcctctccatccgcaccggcaccggcaccgcacgcctcccctcatcggccgtctttggaggtttcactcctgcgctttccgctgctcacagccgcgcgcgcttcgtctcctccgccaccgctgaccccaaggtactgtgtccccggatcttcttcttttatctgccctacatatatctttctattgccgcaccgcatccattcttgtaatcctgtctagtagtatatcagtcaaattactactccaccttactggactattattatgcaatcagcctccgcaataccggcccctgtttgttgcctctttgaaggaagagatattgggttagcacagatgacctcgaccttccaacaccattaaattaaaactaatactagtaatgcctttgtatgtcaaattttgttatcagatttttaaatcaccaggtgaaatttatgctaccaaaattgcagtttcaggcttatcatcaccaatgctttattatgtattcacctgctctgattaataattttagttgcctcgaccatagggttctgctacttacaggtcttaccttgtatgtgcaccgaatgtaaacacgttattcatcatcagtgactgcctgcaccattgtgagaaaacacgtgtgcccttctgtactactgaaagctgggttttcctttcccatgtgcactatgcgctttcatgttttcctccactagatgttaacttacgatatactacctccttcctttaatatatgacgttggttagttcaattaacatcatacataaaagaacagcgcaagtatcgattattcttaccctatgtgggagaactggataccacgcttcaaatttattctttcagttttgctaaacttctcccatacattgcaggaagt

SEQ ID NO: 35894 - DNA, 583 bp, Oryza sativa
ctaattgctctatgatttgacaatgtggtgctacagtaaacatttgctaatgatggattaattaggcttaataaattcgtctcgcggtttattgatggattctgtaattagtttttttattagtgtccgaacacccaatgcgacatcctatataatacccggaaacgccaaaactttacaaccctggatgtaaacacccccataatgaggattccggttccccttccctaaaatagcagtgtggttagatagatggagaaatggattagcgattgatgtgtgtgtatgtgactatcaatcatgtcatgtcatgtaggagtagtatatatgcacaatagtagcgtgataatttgtgttatcaacaagtgagtcagcttgacattattacacagagaaagggaaacatgggctcgcggctatctatcaagtctagctaacagtaggaattcccgttgtttttgacctatgcgaattaatcaataaggaaaggcggatagagcaataataggttaacaaagtgaagagagggagagagagatgtggatctaaatctgggggaagagggagatgagatggggagggg

SEQ ID NO: 35895 - DNA, 1501 bp, Oryza sativa
  unsure (1)..(1501): unsure at all n locations
atctagtggaggaaaacatgaaagcgcatagtgcacatgggaaaggaaaacccagctttcagtagtacagaagggcacacgtgttttctcacaatggtgcaggcagtcactgatgatgaataacgtgtttacattcggtgcacatacaaggtaagacctgtaagtagcagaaccctatggtcgaggcaactaaaattattaatcagagcaggtgaatacataataaagcattggtgatgataagcctgaaactgcaattttggtagcataaatttcacctggtgatttaaaaatctgataacaaaatttgacatacaaaggcattactagtattagttttaatttaatggtgttggaaggtcgaggtcatctgtgctaacccaatatctcttccttcaaagaggcaacaaacaggggccggtattgcggaggctgattgcataataatagtccagtaaggtggagtagtaatttgactgatatactactagacaggattacaagaatggatgcggtgcggcaatagaaagatatatgtagggcagataaaagaagaagatccggggacacagtaccttggggtcagcggtggcggaggagacgaagcgcgcgcggctgtgagcagcggaaagcgcaggagtgaaacctccaaagacggccgatgaggggaggcgtgcggtgccggtgccggtgcggatggagaggagcggcgagggggttttggaggcgaggagggcccgctccgccgccggccgcgcgatggcctgcagtgcaaacacaagagaagaaagagcgacgataataagattgagagctcggtggggaagaagaggagagcagaggccatggatgagtgagcttacgagtgtggcgaaggaggttgcgaccgccattgttgatgttgaggaggagaccctttctctctctctcgctcaggtggattgggattggataggtagatagggcattgcactgggatgaatggatggcatttttgcatatgtgtgcacaggaaatacaataatcacacacaccttcttcattgggggaagtactatattttatttttgggaccaaaagcatctgttaaatcaactctatttgtcccaatccaactatttaaaaattatttatttacagcgtctctttctataatatatcnggaagttatcaattattatacaatataccatcggactatactattttcaaaaatacctaagatacaccatattagggttattatttgatttatcctaccataagtttcagaagaaaaaaaatgctagtttatgcactagttttaagattttacatttttatatttttttaaaaaacattatttatccattatatacggcaagaattttttttgtgctgtttttaatgtaacttttttcgagaacatacctcatttctaatgtaaattatcttttgcgtaagtaatttctctctcataaaaaactcaaaaatattttttttaaaaaagtgaaaacttgaa

SEQ ID NO: 35896 - DNA, 1501 bp, Oryza sativa
attggagtcatctttgctgagactctgacgagtgaatcgtccagtttccagcacatgcatcagtcgtcggctcgtcgcgggctctcgggctcaaccgggctcgggctgttgatgtctgaacgccacttccaccgccacgcggctcgcttgtataaatactggcgatctcttcttcgtcctcgtcgcatcgcatccacttcatatccaagctcatcaccttcttttttgtcactttgtcagtcaccacacgcaccatcgagtcgatcgatcgagcaatggccgatttcgtcaccgtcgcgatgcccaccgcattggccaccgagcagatcatcgacgccgataagaagctgcggcgcgcgctggtgggcggcggcgctggcaaggtcgccgcggcgctcgtcctcgcccttttcaggtcgccgggcggcgtgttcgttcgcagcaaggcgctcttcgacgcctattacgtgatgctgctcgccgttgccgtgttcggcgcgcgggaggtgggcgtcggctgctgggtctctgcttccccgagcgaccggcggcgaggcgttgggaagctcgacgtctgggcctccgtcgtgccaatcgttgtcgtcgccggacttggaggtttcgcggtactcaagtaatcaatggtgcagatgagtaacgttgggtgcctgcttgttctgccagtttaatctgcagtcgtttgcttggtgcaagtaatgagtgtgtttttgtagcgggttgatatcaaattactgttttatttctgcactgtatatgctgtttctgaattattttacctatcaatttgtgattcgagtgtacattgatcaaaacagagctactgatttttgtccttgacgggcgacaagctcgccggaaaacgcggttgctgcgaagtctctgaaccgggtgtctctcaccacctcgtgttctcgtcgtcgtttgcgcgcgacggagctccggcgagctccggaagcgggggagatgacatctttgttttttatgtgaaccgttggatgtgatttcatcggcccagatggagacggataagctgtacaaatggcagggcacgttaccactggcccagaaaaatacggccggtctggtttagtaggccgaggaaaagattggcccattatgattggcagcgatccatatcaccaattcattcttgtcattctggcccaacttgctctttggcgcatgtaattatcagactattcaaatttgttgttttttttatattattaatacatttaaaaaagactattcaaatatatagtattaggttatgtcccattgaatatttggttgctatatttttgaacggagagattagcctttacgctattgccaaaatttgaatttttaaaaaaataagtttgatgtttttctcatcgtaatttattttacaatttaggttttaaaacactaaaaacatattgtcagggttacgggttaggtataccctttgcccttcgatatacgttacatattgata

SEQ ID NO: 35897 - DNA, 370 bp, Oryza sativa
cgtccatttcctttttaacgctccctgcgttgtattacaccctgcttagaggttgaggttaaggttacgccgaagacttgttgcaccaaaaggagtatgcttggtgcaagctcacaaacccaccgctgatttggatctcggacctctgggcgtcaccacttccctcagcattctcctaataataatttcctcctgtgctagtacgctcgtcactcgtagtacgctctcaaggttgctgcagtattgtgggaaggttgcttgaaaatgatcttgtcgcagacccaccggcctccacccctcctcctccacctaggctccttccttcttgctgtcccctaccgttatccctttcacggtatctctccctaga

SEQ ID NO: 35898 - DNA, 258 bp, Oryza sativa
tatggccataccatcacaagctgagctagctaagagcgagcttcattaacatacgagacagagaggtcagtgaaggtagcaatggcggcagcctcctctgttcttcgttgctgcctcctcgtcgcagcactgatgacgctgtccgcaatgggagctgaagccatcacaaggcagtacctattcgatgtaagtgcatgcatatccacggtgtggtgtatcacatcgatacacaagtttcgccaaaaaaaaccaacgcga

SEQ ID NO: 35899 - DNA, 1501 bp, Oryza sativa
gctcaacctcccgtgcctccatgagacgagtgaggatactctgcagtattaaatcctgaaaaattcgtttatacaggaagtcaaacttaagatctaaggtgttactaagacttttgtaaccactagattataggccatttcgctcttattgagttttggccggatgataaatctaatttcatctcacattttgtttgtgaagactctttagttgggtaatataatcccttttcctaaaaaaaaaactatgagcagtattatgccggttcaaatttggcactaagtgaacaggcagtgatagaatataacagatctccgaagcactgaccttttttcttaaacagatcgtttaaccattagagatgaccattttgttctttgtgttcattatgcaaagcgtctctctgatcaggcactaattgactgacttccccagatgattgtcgaggaagccgccggctaatcaggacgctctgcaactgcaaacattcggacccctttttagcactcggtagacgttcacctatcttttacatgttaaatatatagttataaaatacattttttaaaaaataacaagatagattagtagtatgtaatatatcactccacaaacatacaagtttaaattcaacttttataaattataaaaaaaacaaattgtctgtaaatatatatactaattaaagtttaatttattgtttttattataacttatagaaatttaaatttaagtttaagtgtttgtagagtgatatattatgtattaatctatcctattactttttaaaaaaaatataaccatttagttacgtggaagaaacggacgaacgggcaagattagaatccatcctcgcctatatacagcctcagagttgacggatgcacgtcttgagtttcgagctgactttgactcaacggcaggcgatgctctagctacctgcacattccaagtttccaactgatgttctttgtggtcagtttcttcaagaacatgggcaggaattgcggggaataattttaaactgataaactatatcactatattatccaagcaatcagatcatgattaaccagtagttgtcacctcgtcagtgtcaactcaagttggtataagataaacaccatgctgttcagttctagcagttatttatgttatcaggcttgtccccagtttgcttctttttttttgtccaaagaaatagttcatgcgtttatatctgcgtgtctttttcagctcataatgtttatgtttgtcctaggttaattaggcagcatgcttatagaactcgagcgatcatcgcgccggcagatgccagatggcagcgttaacgagctggctagctagcattcagaatgctactactagctgtctcatgaatcttatgttttctagggtcaacgcaatcatcgaaacagaccaactgcacgtctgcacaggtattagctagcacaaattcagaataaaatgatcatagaaataatagcttcagcacgagac

SEQ ID NO: 35900 - DNA, 1501 bp, Oryza sativa
aaccacaccgtacctgcggtgatatcggtggtgactaaccatgacatgacggcgcagacgacgccgatgatccgcttggtctccgacgggatggaccggccggacatgcagcagccgcagcagccgccgacggccgacacggtgatctgcactaacagcaggaagacggccgcgcagacccccagctcggctgcggggttctgcgggtacaggcactcgccgcgcgcgccgaccagtacatcggtcgcctgcaacaacatcgtttgccgtcgtcatacaccgataccactactcgcgcatgcaccgcagcaagctcattttcgcacatgttgtacaaggaaagacatcggtagtgtgcttacagtgatctttgtaacctcggcggagaaccccaggatggcgctcagcaaccccagggacccgacaaccgcggaggcgatgatcgtcgtcttgtccattttccccgccattcttctcccaagtcttcccaaggcttgccgtgtgtgcgtcactgcgtcggtcttcattaacagcgaatgagctgccgcactactactactgtcaccccatttacgaaaactagctgggtggcccgcgcaattacgcggctagcatctatataaaattatatattttttaagtatgattttacttaaaatttattaaatagttatctcgttgtcttaagattttgaaaaaccaaatcttatcatcgtcgtgtttctaattttgtagtttttaaaagacacatcagttgatacctcttacttatgtcatattattttttattagcttgctctatctatcgctgtttctatttattctccttggaacttttaaaaattggatctaaaaactattagagttcattttcctgttgggcttatttttaataatttctagaagtcccgtcaaacgctgctattatactcctctacaaccgtccactgcatcttctctttattatcattgctattttaaaaattaaacataagtatcgtttaggttcattttttttactttctagaagtttcgccaaaacgtcaacgctttgtcactgtactcctctacggctcgtccgctgtcgtccttctttattgtcattgagattttaaaatcaaacataattatcattggggattattttttttttaccttttagaagcccgtacctttaaaaattgaaccttatagtttttaaagttttgttgtctcgttgggttttatgtttttttataatttttagaaatcccatcaaacactaccatatactcctctacgacccgtccgccgcataatctttattgtcattgggattgtaaaaattaaacataactatcgttgaaattcattttttactttctataagaccgaccaaccatcagcggctctaccattgcactcctatacgacccgtccgttgcctctcatttttattgtaattgagattttaaaaatcaaatataattatcattgaagtttattttttttactttttaga

SEQ ID NO: 35901 - DNA, 1501 bp, Oryza sativa
ccaacgaatcgattttctggatccgctactgaccttaagcgatgccgatgctgataccaccgctgatgctgccgccgccatcgatgccgctgcctccgccgctctaaccgctctaaccgatgccgccgcctccgccgccatagccgaggccgatgccgtgacgccgtcgccggtgtttgatggtattttggtgatatgcaaggattactcgtatttgccaaagtaagcaaacaatgtgaaagttatatgcactagtggagctggctctagcttgtcattctgtacgtgatgcatggccatgcaaatacatgcacaggcagaagcatacaccatgccctatatatacttggttaattagtatgtatatgcgcgcacgtgtataaactaaaggaaatcaagagctagtcatatcccatatgataattggctggtgaagcaattacgtgcatgcatgcatagcaatgcacaaacatattatatatatggtcctcaattaatggccaggtgacactggtggagaaaccatctttcgtcggtcggccgatttccacaatagtcccggatgcaataaaaaccggggctaaagatgatctttagtcccggttcaaaagggtaacgggcatatttgatctttagtcccggtttgtgttaccaaccgggactaaagatcatctttagtcccggttcgaatgctgtcaggacctgtcaggcccccccgggatctttagttccggttggtagcaccaactgggactaaagatcttaactttagtcccggttggtaataccaaccgggactaaagatcccggtgatctttagctccggttggtgctactaaccgagactaaagatcttaactttagtcccggttggtaataccaaccgggactaatgatcccggtaatctttagccccggttggtgctaccaaccgggactaaagtcccacccctatatatatatatgtcttcttcctcctccagctgcccgagcaagcttcaaaatttcttcaaaaaagaggggaggtcatgccaaaatttctattgaatttattttggtgattacatacaaatcggaggtgcctaaaaggtttgcaacttcatcctccaatgtttttttttgtcatactacatttgcacctatgttttgcacactttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatattaaataatagaaaacaaactaaaataaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttgtgtgcggtttttttgactcatgtaga

SEQ ID NO: 35902 - DNA, 312 bp, Oryza sativa
actctagaggatcccctgcctaaacttatcccgcggtcgctcgtccctaaaccaaaaaagggtaaaacactgctagatagaaaacaaaaagaaaagaataaacgtgagaccaaatgggctgggaaaaagaaaatttttcaatgggcccataggacggaagaattcttaatgggccgaggcctgagaagaatccgcttctggaagtctcgaggcctctctctctctctctctctctctctctctctctcttctcccccgagttgccgttcaacttccacctcttctctctctctctctctccacacgcgcagc

SEQ ID NO: 35903 - DNA, 884 bp, Oryza sativa
atattctcaacccaccatatatatttattcatagacatgtataactatacatatgaggccatatgttgatgctgcgtatagtgtatcttgatacgttattcatacaatgtatgagtcggttttaaatccgtttgattttaaaaatacaaatctatatttgagccaggttttaggttcgcttttggaaatacggaaggagtcgtataagatatatttttaaaaaactcgcatgctaacttgagatgatcaggctcttaattgcagcttatgattttctaaaaagtatatacccaagtgaatttccacattgaatttcatcttaactaaattatataacaataataagattataataacattcacccgttacaatgcataaatatttttttatagtattattaagaaaaacatgtactctaaaaaaacatggagtacgtggtagtgaggtgtgagacatgtccgaatggtgtccggatatgattccaacatgatttctattttttttagggtagcaattttttttaccaagtttgagtagaattaatttctctctatattttgtctaaccttaatacttataggtatccaatcaacctcaaccgttataatataggctcatcatgatctaatattttagattttttttctctctttttttttctattaaagtaggaatttgtatccttgatggcgaacacggtgttttcttccaaagctatcttaataatataataataataatagggaggcagcaacatgaaagcgtaagaagaatacgtcaagtccacactaaagcggtattcgatggggacaaaccaggataaggcgaactttccggcgggaagccaagccgagctctcccgcctctcccacgggcacagcca

SEQ ID NO: 35904 - DNA, 262 bp, Oryza sativa
acatgtatagataagtcttaaaaagtcctttaataaaatcatatatttgttaacatttttatacatattataatgaaaaataatggtcaaagttgttttttggagaccgtgcccttgtccaaaagaccaaaccaacaagtattatcaacccggagggagtaaatgttatgctgctgaaaaattatggcttggttcttatgccaatagttgactggtgcattctgttcttgacgcctgattgcctatagttttgtattgtagt

SEQ ID NO: 35905 - DNA, 1501 bp, Oryza sativa
aacatcagcaaacactacatctctttcagttgttgctgccaaaaatcaacactggcgcggatcctatcaacagcacctcccatcacacccaggcaactattggcaattctacttagcacataggcgcagcatcttatgttcagcaaagacccacctaacaaaagttgttcggtatccagcctttgctttaagagccccgtaaccgtatcatctgtagaacaatcatcagccatcaccattgataccctccttccaagattccattcgttcaaacaagaagacagagtttcagaaattgcttgagctgtatgcgggcatggcacatgtataaagctgcatgtggcaatcaaagcacaataagtttttacattaaaatagtctgaatagaactttggaccgagaaaactgcaactatatttgaaaatatacatacacacatctatgcgctcgaaaaataatgaaaaaggaacacacctcagtagacggcactggaatgtccaggattggtcgataaaatgagctctgacagccacataacctctattttgatcatctgatgtccatatatctgctggtattgcaatccgacctttagcctcccacaaaatttccctggttctgaccctctccgtctcataaatgctgataacatccttcttaagactactgttgggaaccagctggaacaatggttgaagagccctaacaaacctttggaaaccgtaatgctccataatagacaaaggatattcatgcaagataatcattctcgcaagctccatcctggcaacatcctggctaaaggtggagctttctaaagaagcaacagtgggttcctgatcaatatcctttgtacatttggagggagttggcttgctgactttattactcctgcgacgaggacatttgctgagatgatcgtgcaaatgtttggtgccattcttagtgtcccctccgagcctcttatggcaccataggcactcggctttccacttgctgacgattttcttcctcttgaattctttccacacactcgatgtcagctttctcttactaacatattcttcttcaacagcatgactggaatcaggagcagcagttgagtttttggcagctccaagacccagagggatgtcatctttcataaccaactctgaattctgcaaagtagaacaggcaacaggggtagtgagaaacaaatggcagtagaaagatgataattctccctggattttctttttcacttgggctaatttctcatctctatctctactattataaaaattcaagatgtttttgcggtactttggtacgtcatccgtgtatgagtcggtttttaagttcgtttgcttttggaaatacatattcgtatttgaataggtttttaagttcgttcgcttttggaaatacagaaggagtcgtataagaaatccttttttttaaaaaaatcgcatgctaacttacacggttggactcctaactacagctcatgatttttgta

SEQ ID NO: 35906 - DNA, 1501 bp, Oryza sativa
  unsure (1)..(1501): unsure at all n locations
cttgcttctcctcatctcttcatcttgacttccaagagcttcttcagttagattaatccccaacctcttagcaaaacttcccttagactcctgagaatccatgtaatcttcactgtcccccggatctactttgtccttgtcttcttgattcaaacccatatcaaaactgactctattctccttatcccctggaacatctgtctaagagctttctaattcttcagccaacttttgattcatcggttgctgcagagtatcaacctgctcctgtgacatttcctttttcccaacctctttccttcttcacagcactgagtcagaatacagtctcctttctgcagttgcattgccaactccatgtctctcaagatctgtgcacatttgatcttatgttctcccagcatcaattctggcaccaggacttgcttctgacaaacttcaatagcccgttacccgtcttactgacatgggatcttctgtcatgggatccaccaccacaacttgcttaccctctctctgactgctaccctccagagtattttcttgtatctcaattttctcaaaagtgtcatctagctgatcactaaaccaccccagttccaccacctcctctagactgaaatgagcttggaacaaaagtcccttgggagaagttaacactagtttcaaaggcagaacacccagctccatcattccacttttgccctgatcacattgctagctctgaaagtagccatatcaacctncaagacaagccctagatttgacccaatttcatacaaagcttggtaacccttcatttnctcaggaattccagtgattttgacccagacaatatgcaacttccaactgcttcagatttctgggtccattctttcacattaacttgcacatcagtgcccttgacattgaaataatcaaagtttgcaagctcatcaaactttatcttgttacgaaatctcatctgaaagcttccattaggcattgctttagctttccaaacccaattccacttaaattgttgcgtgaaaccttgctcaagttgagcttctgtcaattctccaccaaagacagtagagatcatagccagaggattattatgctccttaggtgggtcaggcttagtgttttgaattaagatgcaacctaaacctggagcaccataccctactagctttgccataggcctcggctgcttgtcatagatgcaatcctctgtcctatgtgtgggtttggcacaatttatacagaagacaacattgctacaatccctagccatgtggccaaaacctttgcatctgtggcagaaaattctctgtgggttagtttgcataccaatgcgagaattgggtggtggagttggttgctgggttgcagtctgaggagtcactgcagatgtcgcaatcttctcttcagattgattcttctccttctgaactggacgatattgctgcagcttcccccctttgttcatctggcccctcatctctccacctccagc

SEQ ID NO: 35907 - DNA, 1259 bp, Oryza sativa
  unsure (1)..(1259): unsure at all n locations
gttctttgaatgtttcacaataaagaaattttaccatataataaaaatagaaccccatatttagaaacacgtgatgccccgttttgacagtaatggatccccccaaatccactcacctccaacagttggttccccatctccatcatctgtggggagagagcccgagaaatttagggttgagaggtgagtggcgacggaaggaatccacaagttgcaagggtgtggaggcgaaggagtggcctcgattggggatcggaggtggtgaatctcggtggagaggcacaatccaaggcgataagcgtcgatttgcaagggtggttcgtgggcgaatggcgaatcaagggcatccaggcggagggtggcgtcggcgtccaccgtggtgagaaaggtcgccctcccgcagtggcgcaccaggggggctcctcgcaagctgggagtgagcaatccaccaaggctggaggtggagagatgaggggccagatgaacaaaggggggaagctgcagcaatatcgtccagttcagaaggagaagaatcaatctgaagagaagattgcgacatctgcagtgactcctcagactgcaacccagcaaccaactccaccacccaattctcgcattggtatgcaaactaacccacagagaattttctgccacagatgcaaaggttttggccacatggctagggattgtagcaatgttgtcttctgtataaattgtgccaaacccacacataggacagaggattgcatctatgacaagcagccgaggcctatggcaaagctagtagggtatggtgctccaggtttaggttgcatcttaattcaaaacactaagcctgacccacctaaggagcataataatcctctggctatgatctctactgtctttggtggagaattgacagaagctcaacttgagcaaggtttcacgcaacaatttaagtggaattgggtttggaaagctaaagcaatgcctaatggaagctttcagatgagatttcgtaacaagataaagtttgatgagcttgcaaactttgattatttcaatgtcaagggcactgatgtgcaagttaatgtgaaagaatggacccagaaatctgaagcagttggaagttgcatattgtctgggtcaaaatcactggaattcctgagnaaatgaagggttaccaagctttgtatgaaattgggtcaaatctagggcttgtcttgnaggttgatatggctactttcagagctagcaatgtgatcagggcaaaagtg

SEQ ID NO: 35908 - DNA, 420 bp, Oryza sativa
ttttcacaaaggttcggaaacttgccggtttcctaatccccgttgaggagatgtctcaccctaaaaatcgtaaatatataaattgttgtttaattggaattattagaatttattttaaaagcctagaagagaagatctaattttaattaataaattccaatataaaatggggccagataaaatttcattaaatactttgcttaattctataattcctagatttttctgggatttatttgagctaaggaagtatttttaataaatggaattgcatttcatgaataatttaaatagaaaaatgtttttaaaagtctcttttggctttgggccgaaagtcggcccaaaaccctctttctctctccccggcccaagtcggcccagtccgccgcagccgcgcgcgcgccctcgctcgctgacagg

SEQ ID NO: 35909 - DNA, 153 bp, Oryza sativa
  unsure (1)..(153): unsure at all n locations
gaagaaaaacaaaaaannncacaagcccaggccggccgccccccccccccccccccccctccncctcangnncccccaccccccatccccccctggggnctcacccccctcctctcctancctccccctaccnannnnttgtgacgacccagg

SEQ ID NO: 35910 - DNA, 162 bp, Oryza sativa
tcctcaccccgccgtacccaccggcgttccacgctcttctgggagaggctagtatgctagctaccgagtcaacgccctacctagtggacccgacagcggcacagccacctgttccggagttggtgcacactccactgatccctacaccttctccacagctgg

SEQ ID NO: 35911 - DNA, 504 bp, Oryza sativa
ttaaaaaaatttacacaaatatataaaatataaatcatgcttaaagtattttgagtgataaaacaactcacagcaaaataaattataattacgtattttttaaataagataaatgatcaaacatgtgataaaaggtcagcggcgtcatctattaaaaaacggaggtagtaataagctagtgctcaagtgctttttgataaaaaaaaatggtgcttttagattgcagattaataggaaactgaaatgtcattttctgtttgagagccttatctcaaagcgttatattttgatttcactagtcgaatcattcaccccttttaaatgtattttgtggtaaatcatgatattcattttgggtcattttgacagtatattagtataaccccttcatagagagataagatgttatacatcctaaatggacaatgaggtttatcttttttggataatatgtggctctcctggtcactgttttctacgaatgatgtttttgtttactgcagg

SEQ ID NO: 35912 - DNA, 453 bp, Oryza sativa
ttcaatgagacgcctactcatgtatctggagtagcagttgattcatgtctttagctgtgacatcgtactgtactcagtagatatgtcgaagtttcttatttggctgattttccagtacttgttgcttttcctttctgttggaaaaaatggtatcatgaaagtgtgggagtggaactagctcccaggtgctaaacaagttggcgttggtgaccaatgcacaccaattttctagacttggaactggagagttttaatggggattacactaaatctagactccatgggtatataatacagtctgggaaactgatggatctttcatctcggtttaattgtttttttcaagatgtgcctactttgcccgcatgttaaaagtctaattcatttcattgtcttagtgttatttttctgtgtccattttaattggtagactgccttgtgtgacagatgttg

SEQ ID NO: 35913 - DNA, 159 bp, Oryza sativa
catctttcaaagttttggaacaataagcaatgaagggatagcttttcttttctgtggaagttattgtacattatatgaaagcctctcttccttttcttttaatcgattattcggtcacgggttatgttgaaatagaactcatagtaatcttgtacatgt

SEQ ID NO: 35914 - DNA, 436 bp, Oryza sativa
agaaatttaagccatgtaagctacctattgggatcatatctggaaaagataaaagggaaaggaaagaactgtgcgccgcaagaatgagtagataaaattagggtttgaattgttcgatacatccttcagattcagaagcggcttatattcttacgccattacaagcacacacaaaaaatgacgtagcacagtacggcaacggacagctacagctactacttcgatcagtgtgatcccttggatcttcattaacttctcctgtgaaccggtatcgtgtaatatgggccgtccatctccttatctcctcttcttctcagaacttaacttcaactgaacaatttcttttcaaaactctgcattctcagttcctgtcacgcttgctatgggaggccatgcggtggaccggtggtgagcggcgcggcgcaggagacagaga

SEQ ID NO: 35915 - DNA, 211 bp, Oryza sativa
gacgagagcccatgattaggcgtccaattaccaaattctaagcccacaattgggaatatttttaccaaaatttctataaacgaaaagcgcaaggggccctcgacaaaatatcacccaagtcctcttctctcttctcttctccgccgccgcctccatccgcggcgcatcccatctcgccccggcgactcgtcggcgtcggcgtcggccatgg

SEQ ID NO: 35916 - DNA, 224 bp, Oryza sativa
taccctttggagagaaaccattggtagcatcatctctcttttcaacttttttcttgacataatcagttatcactcttaccctttcgagacacatgtacgttaaagcgatctttaccaattttaaataactgtgtgtatccataattgaaaccgaacattaaaagagaaacagaaaagctaatatttatcaaaacgtcggattgaacagagcagacatgtacaga

SEQ ID NO: 35917 - DNA, 331 bp, Oryza sativa
agtccttttctaaacatattctatctatataagctatctactataaccaatcggatatacatgccatatgggtatgcggtacccataatctttccaatttcattctagctctgcccctgtctacaatgtgggtcttaaaagacccatagaggtccttatgatgaaccttatacattgtgagacttaaccatgaggcattgaatattaagattgaccttaagcttgtggctcacctttaggaataaaataattggataaataaactgcacacgtagcgagtgagagaataataacaaggctctgtcataaaaaacgtgccatttcttaaaaa

SEQ ID NO: 35918 - DNA, 366 bp, Oryza sativa
tagtactccttccgtttcacaatgtaagactttttagcattgtccatatacatatagatgtaatgaatctaacacatacatatgtctagattcattatatgatgaatgtagacaatgctagaaagttttatattgtgaaacggaggaagtagtaacaataatcgtttacgacaaaaatacgcatgggcccactagtcagtgtcttcccagctccgcacagtggggaatacctctcgcaaggtgggccccaccaagcgcccatttcttaaccgacgaaacgggctcacgtgtctgaccatcgctcgcaatcgcaattcgcaagttggcatccaactccgtcccgtccctccctcccccccaacccga

SEQ ID NO: 35919 - DNA, 295 bp, Oryza sativa
atgtcgacaacagttagataggctaccccaaatattgtactggtgtgattatggtgaataagagcaatatcggcttcggccaacaggatgtagggttattatctgacaattcaggggcccgaacctgtataaaaatcatcgtctccgtctcttttacctcagtctcgcgtataccctagcaccaacgatccccatactatgcaaatactggaatcgcgacatcaaacgtcgacagtggcgcaccaggtagggggattttggtgcttcaggatttcgacgagatgggtttaagaga

SEQ ID NO: 35920 - DNA, 328 bp, Oryza sativa
tgtgtacctttgtagatacatgccggatgtatctatgaaattagtagatcaatttaaaaaaccaatctatcaattaccttgtcacgtactcgttcgatatcatgcgatctgacatcttttggtacgtcgcgtatcttgaggcttggtcgatctcgagagatcgaattgttgatgacgatggttccgatctcgtcgggagatgtacttagacaggttggatctccccacagctaaagtcgtcgagtagcttgttgtcggagagtccatctcttaaacccatctcgtcgaaatcctgaagcaccaaaatccccctacctggtgcgccact

SEQ ID NO: 35921 - DNA, 294 bp, Oryza sativa
tccttgagaagatttgaatttaaactatgaatttggaaaggtttcactatggtttggagtatagcaaatccttactaatattagggtaaattaaggaaataatctaaagattgaaatttgagagaatttgctcaaatttagtaaggttcggaataaagggtataattagggtaaattagtagggttctaaagaagtaatacttgaaccacttaggaataaatagatttttaaaacacactaaattaatcaaaagccagcatgatgcagtcaaattttagttttaaaatttgagg

SEQ ID NO: 35922 - DNA, 262 bp, Oryza sativa
  unsure (1)..(262): unsure at all n locations
gctgtttnnttttttgagtcaccgatccactataggccgaatncgagctcggtacccagtgcgcagcataaataaactattttactactgttaggtgatatggcagtgtaaatagatatgtaccatatatctagaaaataggagtaagattgattctactacccattagagactgctaccaaaattgttaattttcttatatttctcatgtaaagcattcagacatattttcagtaatttatacggttcagtttctcttagg

SEQ ID NO: 35923 - DNA, 211 bp, Oryza sativa
acttgtgtgtattcatgtgcagttctttggttgaatccttgtgttcctccggcgtgcgtgtttgttagaagtgtaaaaaggggattgaagtgtagatgtctgtaagatagaacaagatcttgtttcttgtatgttgggcttaaaaagttttgagcaagagaatgaatgaatggttgagggagccgtcggtctgaatgtggggttaaaatga

SEQ ID NO: 35924 - DNA, 321 bp, Oryza sativa
cacaagctgcaattaacaactaatagcaccggtcatcgaaatctgctgaaatcagctcagcctcactcatcatcagaggcactgcttatggacaatataaaaaacagagctgccataattatactacatcttgataagctcaagtccaaagattgtttgtatgtatgcatggccacatgatgtcatggttgggcggatccaacttgagacatgggggttcagtgtaatgaaaattaagagaagagcttcttccagatctagaagagaagctagtcccgatggggggagagagagatgaaatcagaaggcagaggatgggga

SEQ ID NO: 35925 - DNA, 349 bp, Oryza sativa
tttttgtatgcacattactatagcgcgaattcgagctcggtaccctccttgagaagaggtgaatttaaactatgaatttggaaaggtttcactatggtctggagtatagcaaatccttactaatattagggggaagtaaggaaataatctagagagtgaaatttgagagaatttgctcaaatttagtaaggttcggaataaagggtataattagggtaaattagtagggttctaaagaagtaatacttgaaccacttaggaatcaaatagatttttaaaacacactaaattaatcaaaagccagcatgatgcagtcaaattttagttttaaaatttgaggatgttacaa

SEQ ID NO: 35926 - DNA, 205 bp, Oryza sativa
  unsure (1)..(205): unsure at all n locations
agtgagagcacatattgactatanggcgaattcgagctcggtacccagtctgccgcaaatctcgatatttcccccggaggatcgttcgcacacaagacaactgcctaatgaagagaactcttagatttgagcggagagaacgattctttcggccaaagcgaagccatcccggagatcgagattatccatgaggatcctctgcaca

SEQ ID NO: 35927 - DNA, 259 bp, Oryza sativa
  unsure (1)..(259): unsure at all n locations
ttttagagtcgcactatccactatangccgaattcgagctcggtaccccacccaccccaccaatccccaccagatccaacggcccagatctccccctcacctttatccaacgcctccccttcgtcttctccctggagtagtaccccacctcaccccgagccttccactcccccttctnctcctcctcccttctttttacccacccaccctttngnccncgcaaaacccatccaagaagagcttccccccgccacttcca

SEQ ID NO: 35928 - DNA, 368 bp, Oryza sativa
gttttccgtgtgttgtgcaatcctctattttatacttacattcctatcagaatattatgtttttcatattcatccgtttttttcattaacacattagtttttactagcttttcatagcaccttaagaaatcagtaatatctcccccttgttcgtttacgaaccggacagagacttgaagagtttgcaacgatccgtgatatccaacatgtagtagtaatacttattcagtcccaaaaaatggctcttatccgagacgaactacaggccgacatctaccttaacttctccatatatttaattaactgaaccctaccaacgtactttacaaacaaatcgaacaccaccgtatgttgtctgacgacccagg

SEQ ID NO: 35929 - DNA, 180 bp, Oryza sativa
tttaaatccagctaactaattatttttttttatttcataattaatttacatacacagttttctgaagtaacagtagtacttatagtacaatgatcatgtaagtttacatcttgattcctatacacttgttaaatttcgcaggaaaaaatgtatttggagagtctactcaactgagcaaca

SEQ ID NO: 35930 - DNA, 163 bp, Oryza sativa
ggtcccacatatcacacacacattatctctcgtagtttatgttggagcgggtaccaaatatgtaggccgctcctctaatctctcttcatttatctgtgatatgtgttttagagcgggctcaatatctgtgattgtatctgctcttccccatatgtattttagg

SEQ ID NO: 35931 - DNA, 245 bp, Oryza sativa
tctagggacaaaaatccacttccggtatatcaccaccacccatcactctctacacctgtcgctagctcgatagtgctcacggtaacggccggaaactgcccctcgaatctcgatcagcttagcttagctataaattcagcaccatgcatgccattgcaacctgcgcctgagaacacagctagctcactctcaagctaagctaagctaggagattagacgaagaagaagacctctagctttttcca

SEQ ID NO: 35932 - DNA, 501 bp, Oryza sativa
ttgggacgaggctcatgtgttgggcagtcgcggagtgcgggtaaagtgtacatccactgcagtgtgagtaaaccaaatctattcgaatagccgtgctcgcggttattgagcaccgggacatgtattacacttggctagactctaaattcttaacttgtgggggatgggttattgcatgatgaattttatgctgatggagccacttcccgataggagggaaggtggacatcctcagaaaaccatgacgattcaatggcgggaagctatccttgggatcacaatggatggtggacagaaccgtcgttgtttaaagtgaacactggtactaaaatttgatcagtctatgctaggttttaggcttgtgaaaagaattgtaaaattagctttatgcaaaagaacctgaagccattccttgaaataccctctatcatatgcattgttgttgtggtggcttgctgagtacggttggtactcacccttgctattcatatatcttttagg

SEQ ID NO: 35933 - DNA, 1501 bp, Oryza sativa
atcttttgtgaagatttcagtaaatactttgtttggttttgatttataattaatcatatggaatatgttcatggaaacactaggtgtgaaggaaagaacaggtaatctagaactggttcaaacatccatagcagccaaaatactttttagaaaacaataaagttatggatacataactggacatcacaaatacctgcaaagctttctcaaggtcacttgatagaccccaattatatatgaattacctagagaaagggcaggaaagagacatatcaatttctccttgtcatcaagcgatgttcttgacattacaagcaacagttaatcagggagcatcagtattcagttctaccatttgcagagaataacacatttaggctatttggttaagaaaaagtaacggccacttatttctagacacaggtgcccttttcaccagtacaaaatctaagagatgcttaccgagccacatgcacatacaaagggttcagcctactgtttaagttatctaaatgtgttgcagatgcatacaaggcaagctttcgacagatgaagaagtgacctttcaaatcacgaattaattaattaagtcaataaaattgcaacagcggtgtgcaactgccatatacaagaggaattagtgtctaaaaagtttgtgagatagcagtaaggctcagttagaatatgaataaataacaatcaatttcaagtttcaggtgatgtagatatgaaaatcatcagcaaaaagttttcaggtaatgtagatagaaaatcagcagtacaattcaaaatagaacaatccatgtaccaaattgcaaaagtaacagtaatagcatatacatgatacatcagggttgcataactacaaataatgaattacctttttcaatgttatgagaaggtcctctgtgcaaggcacagacagaaattgaaggagatacaaaaaacagcaaacgtttacaaactagttggcacaactaatgatgaatggaatagtgtgagcaactttccatagagaagcgatataaaaaaaattgaagtatatctgtattcattcaaaaacatgaattcaaaatataatagagctaatcatcatatgcatgtccaaactcaaccaaaacaaaaaaaaaacaaaaatcaagtgcacacagaagtaaatattgcatatattacaagcaaacaccaagtgtatagaaaataatgttaagcccatgcaggataagagggcttcaaatttagtgaacttcgaaagtgaagttggatctccaaacttcgaatttggtgcgcgtacagtatcaacaaagagcacattgccacattccctccatgggcatcaattgttgggcatagataccgtgtaatacatgaggaggattagttgctgcgcatggctacctaacagcaaacacaaatgtattataccctcacagcgtaactcacactcaaaacacttgaaaggacgcgacgcactcggttgaaagcttgaagctgcaaccaaaca

SEQ ID NO: 35934 - DNA, 1501 bp, Oryza sativa
ttgcttccacctagagtttgcaaccatgatatattattccaattctggacttcaaggtagtctatgtaaaatggtaaaaatgcaaaacttccttcatttgttctgtgttggagttatcatgagaaaaatctactgatttgttttgtagctaattggctatacataatgcctatgcatatattcttgacaagcattaaataagtcagtgggaattttattggtgttccgtgatatccttaatatttgttgatattgaatccaactattgaataccatgttgcttgtttaaaccacaatttcatgagaaatcatctactgcacaagtgcacattctgctgcagcccagctattggtctgttgaccccttctgcttaatttatgaccttggtattttccaaatttccagtagctaaacatgtctgacaggaggaatatagctgttatacttctagatttttttttctttcactattttttggcaatggtactttgttttattatcccctctatttcttcttaattgttactagtattgtttatatttcactgtctcggagttacaatttggaccttctctgctatagtttaacatccaggtatatccattaaactattatattacagccggaaggtcagccagggatttaatgaaaaaaaatttaaaaaagccttcatttagtgttgacatattaatggtcaaaccttgcagaattttaagggtagttctgacactgaaaggagtatttattgaaagagagagtggtaatagatatttcaatattattattggcttttgttcattgcgtatgtttcctttcagctttacattaataatgactacacttgtctgctgtaggaaactagtatttttacgtgaaagatttgatttcaaacgccttctgttgcatgccatttcacttgaaaaatgtgcattgtgtctcagtgttgcatgtgtatgttgctttattttcatgatgtgaagctgtggattcattctcctagcaacatgaaacttggcctctagacagttatgccatctaggatcgagtctgttctctgtacagactatcatatgttatagtaatttgaaattgttcagtttatcttgtgatcttccttgtaaatacactttactcttctcgaatgggagtattttaaactatttcctgtggttcctgattttgagatgcttggtttcaggatggtgctgttcttaatagagtattccaaccttatgagtctcacattccctatcttcttcactttttggtaagagcaacacttagtttcttttcatagttgttgtgaactgcaagaacagtatttcattttgtctcttatgcagtcttaacataataaataccacagtctagcttttatgatatatagtatattgatatttgagcggctggagtgccaggatattaatgattgaattgaacctgtgaatggagaagaacaaccaaatgatcaaatatcttaccgcagttctgtaaggctc

SEQ ID NO: 35935 - DNA, 158 bp, Oryza sativa
tactgtgccatccggctatacgtggtgaaccaagtgttctaggacaacttgatttaaaaaatgttgtacaggctgaccaccaggcgttgccaacccggccgatgcacctattgaaccttggtgctggattcgactgaatgatttgctgtcttaacagc

SEQ ID NO: 35936 - DNA, 560 bp, Oryza sativa
ttgtcgatggcattactgggacttggacgcttgtcaatagcatttcttggattatcttttttctaatagaatttatatgtagctgagttggtaaaggagagaggtgttgggttcgaatcctaaccatgacaaggccggtataaaaaaaatacttaggatgatagtttaatatagtgtggaactaatgctacatatgaagtgttgcaatgtaattttttgccatatctattttgtggcaatatgaaaatttgttatcactaaataaaaatcattacaataacctattaccactatatttattagcaacaatttaaaaatgatagcaacatatatgtattgccacgattttttttcgtggtgacaaatcattttcggtagtgatattcgtttcatattataattcgctttaatttttttcctagtaaaactttgttaggtttgatcaaatttatagaaaaatttagtaacatctaaaacgccaaaataatgatgttaaattctaccaggaaaatagtatgtttgttttgtacgaaaatggtactatatctttttataaactt

SEQ ID NO: 35937 - DNA, 1501 bp, Oryza sativa
caccaacatgtctgtcatacaagtggcataatggatgagagcaagcattggtcaatttgatgaacaagctaaaataaaccaaaacaggcatcaaacaaaataaaaaataattatctaagttaatgaaagtatctcaatcaaccactggattggtcaattatgatgcaatcaattgctctcctgtagatttcacctttttatgaaggatctgcacctatttacctatctactccctctgtcccaaaaagaatcaacctaggaggggtcacatcccctcctaggttaatgctttttgggatggagggagtaggtgctatcagaaaaatgtatgacacagtgatgcactattgcgcaaaaaagaattttgagagattacaagaccagggaatgacttggtttgtcaatctgactctcatgtgcgatatatcaagggaaacctatgctcagagtagtgtacaacatggttctgcagcatgacagcatcaataattccctagggaagttttttattactaagttgttcagtgttattatttggactgatcttatatacaactgttaggaaagtcctctttgtatggggcgctggggatcaacaaggcctttgattcggactcctggagctgctcactgaaagttcattaagggcaatattgtatctttctttaaaaagacaccaaactattgtcatgacccaaggccatgacgggataaacaccgccgggaagatagccgggcggcgtcggctcctggagaagggatgtagatttaggctagggagaagaatattattgggagggagagattagactaattgatattcattgcttaactagagatgaatacaatccatcccttatatagagatgatatgacttgacccttaagaaactaactcaaactaactctatctaatcctatcctatgtcctaaccaactgctacagtactcgtggtactgtttatccgctaggacttggcctcgtgggcctcggcctctctgcccaacgcctatgacaactatattttcatagaaatctgaccattttgtatgtacattggattgttttgaccaacattttaaacagcaccaatcgctccatctggactgggtaaatgcacaatcactatgaacggtagttctcacagaaagtcaaccttcatagtagtattttcatctttggagtagttttgatttttatcagaggttccaaaactaggagagtattaatagaaaacataatgagcaaccataataacgcagagatgaattatgataattgtaaattttgatcatggtattgcaccctaaagcctaaaattaaagtatggatagaataatcaccattctaatatttaaggtactgcccagcctaccttgaaaataaacgaagcttagtcagtgcatggaccatgaaaaacatctgtagcatttttaaggagtcgatcacctcatctatctgctgaatgaaaaaaaaaagtaaaatcaattaaactgaaat

SEQ ID NO: 35938 - DNA, 1501 bp, Oryza sativa
ggctggaggaggaagaaggaggaaaaggcacggctggtatttcacatgttgtttttcgaaagataaaatgaataccaaagaaaattgaacagaactttgtacggaatgctgaatatgagagcaggttaactttcgatgctattaagtgaaacgcgaactttcggtgctataaaactaaaaactggaacttttgatgctgcagaaccaatttttccttaattaatactcgtatctgattagtactaggcttaatagtcatttgtaattatatctttattttttatatttctacctaattagcatccagtcattgtagttcattctacaccctggaaagggcaaaatttgacattcttattcctacaggcgttcagtatgaaatggcaactaactataactggcacttgctcttgcagttggttatgtgtcaatccactgaagcaagcgggctatttgagaagatagggtagctatactttcagtggctccagaaactgctagacttggatatgtgaaattaacatccattacgaatgatctgatcccggagctagcattctagttaaattgctgtgactggccaaataacgatcggtacatactcaattctattgagaactcaacttcatcaaaatttggtggaagagctagagcaattttcagtcagtttgcacacgccaaggtagctgtgatcacagggactaagaaggtatctttgaaattatcatacattctatgttatgttttattcccaaattgttgattgctcatgttacatttgtgatgcacgttttgtccgattatcttattcttatcacccatttcttcttgattaagattagtcacacttaatttaattaagtaggctgatattgtcatgtggggccagcactatatctgttggcaccacagccagttcaaccatggtgcagctgcagaaacaggggtgcactcagcccccttggtatccttatcagattagaatctatctgttaaagagtttcttggttacatttacctttgttgagatattagttaggatatattagaacacacatagagttattttaggagatgttagctatatatgttagggcctctcctatataaaggacttggcacatatacctggacttaatcagatagaaaacagaaaacccaaatacctctcgttctccttggcgcatcacggcgccatggcgataggactctttctcttgacctcccacatcccacgacaacttcctcctcccctctaatccccaaacacatgagccgctgactgatatgacattgtgtatcacctgtgtactaaattgtttatctttctcctttttcttttcctccattatctttatttttcaggatcaatttccaggtcaaaagagatatccatatacattatatatccagaagttgaagtgtaattgcttgtgaaaatggttcgcaggagactggaacatgatgaaattactagattctacttttgttatggtgaaga

SEQ ID NO: 35939 - DNA, 555 bp, Oryza sativa
catgtatgcaaaaatagtactccctccgtttcacaatgtaagactttctagcattgcccacatatatatagatgttaatgaatctaaacacattcatttagatgctaatgaatctagacatatgtatgtggttagattcattaacatctatatatatatatatatgggcaatgctaaaaagtcttacattgtgaaacggagaaagcattatttatttgtttgttatcatttgccatttacacagcttatcattatttattattgttttccctctagaacagtttggactatcaaccaaatgaaatagtataccactataacttactataagtacagtgctattctgttaaaacttaatctttcttgaattttccggtatcatcattcacttcatatcatttaaaacacattatattttctctgttaatccacattcgctcttctgctatttttcaacttctaaactgggatttatcgatatccctctgtttttcaatcagaatgctgaagcgaataagcagaatgaatcatttcaacacatggaaagtagcgagt

SEQ ID NO: 35940 - DNA, 646 bp, Oryza sativa
ctgccgctacggtgaaggaaccgggcatctctgttgatgcgacgtccctccttcgcccgccgccgatgctgcttgtaccaccaccttgcctgcctggaagttttgcaaggaggtgatgttcaagaagggcttcaccgggtactggggggctacgctcgtgtacatgggcgacagcaggttctgcctggtggattgccgggtgcctgatgactgtgacgtccgcaccaccctccgtgtgctcaccatcacctcctttggtctcaagtatgataaggccggtgaactggtcaccactcggtaccgtgcttacgcatcgatctcataccagattgctggcaaatttaagagactcgaggatcctatagcattctggatgtaatttatttatgatcatgcaaaactagttagtagtatcaggtgttattgtcctactcagttttattatatatatatgtgagcatgcaattttggcataacctgttttatatatggtcgccttgtcaatttggtccatctttgtcagcactgtgttttgctgtaaactgcttttccctcttgtagcacaatgcttaaaaaactgggggaaatgaatccctataactttacaaagtgagttatgtctgatgcctaatcagtacattttgcc

SEQ ID NO: 35941 - DNA, 1501 bp, Oryza sativa
gtttgcggaggtagtccctcccaagcaccggaccatgatctacgccttcgaccgtgcattcgagggctcattcgcctcgctggcagctcccgctgtcggcttggtcaccgagaagatatatggctatgacagcaagactgtgaaccttgcgaacgggtcagcagaaggagcgtatgcgctctccaggggacttctgacaatgatgattgttcctttcggcgtctgcgtcctgttctacagccccttgtaccttgtgttcaagcgtgaccgggagaatgcgaaactgtcgagcttcaaggatcaggagctggtatgaagaaaccgcttgtgctccgactaaagctctggtctggcagctcaaagaaaattcaggttcgggcttcttcaggctacaacatgaagcattcatcttcaggtggatagtttgacctggtgattacccatgtggagagaaagtggtgtttttgctgtaactgtttgcaggcaattgcagctatcatgaccacttgttctttggtaggcaaagagagagtagatggtgtaatccatgctgatgtgatttatgttagtaataccgaattcctagttttgtaacggattaactggaaaattccactgtcaacagattcagtttggatattatgctcattattcagaatacaattttttgagattgctctgggtgctgagctgaccctaatagttgacgttgaattggaaatcatatggtgttctacagcttaagcctatcttcatatgatacggtacctacatgcctccctttgtaaaaatactgtacagaaatagtcataagaatctataatggttttattggtttaaaccccggcttactattccaatcggttttcgcgaaactgctatcaaatttcaatttggaatttcttggcatgatagattctcttgtacaaagaaacaaaatttaaaagcttaagcaaaatatctaataaacaatcacgcgagttaataaaaaaaatcaaaagaacaatggatgaattaatctcatgaaaatgaaaacaaaaacaacttctaacgatggctttctcttttttcacatttcatcatttgatttcaaattcagcaaaatatcctctctatttttccactgtaagaagtgactatcaaattccaatttggaatttcacggcatgatagattgtcttatcctacgtactaagaaagagcttaagcaaaatatccaataaataatcacacgagattataataaaaaaacaaaaagaacgatgatttagggcttgttcagatcgatactatttcaaaccatgccattatttggtaaaatcgtcaactatgtaattatatttagtttgttaccaaattttggtaatgtctatggaattttgataatattgaatcgagcacattctactaaaatttgacaatgttactaatttaccaaaattttgaaaatgttcattttgacataatctgaacagacccttaaaccttcaggatgaaaatg

SEQ ID NO: 35942 - DNA, 433 bp, Oryza sativa
atgctcctcttttttttccccaatttgttgggaaagcaatgctccgtgaagctggggtgtggtggaatcttggtgatgctttgattcaaataaaacaagaaatgggaaatgagaaggatttgtttatagcttgcttttgttttctttctttttagtttttttttggcatttcttagacatacgggctatttggtatctcaaacgaggattctcgatgttatatatgggtatttggtaccagatcgagcacaagaagctcaagaaatgctttttgggtgatatgccatgtgcttacatcggcaagcatcgcagcaaagcttcgtcttttagtcttttatatcgggtcaagtaggataagattagtgagaattttgattcagatccatggctaatggcttcatgtatgggcaatgccgtcggtggctagactgca

SEQ ID NO: 35943 - DNA, 1501 bp, Oryza sativa
gaacgacctctctactctacggatctaacgcaaaaaccaacccatagccacagatcggatcaagccccatccatccacgaactgagtcactggatctcatgagcaggggggggataatgagggagagagcgtgggggaaaattaattacgcggggtggagggggcgaagaggacgaggccgtcgtagaggtactggccgtagcggtggagtgagagcttggggtcgtcggcgaggcggaagtcgagatcgaaccctcgcccctggagcgacgcgaagaaggccgagtgcgacgaccgcaccgccaggtcgtccacgagcaccagcacccgcctcccccgcggtcccccctcgtccgccgccgcggcggtgacgacgaggagggcgagggcgacggcgagggcgaggtggtggtggcgcggcgccgccattgctgcgagatctcgcggcgtggggaggttttgtttcgcgtggggtttgggagaggaggcgacgacgacgaggaggacttgaggacgcttggaggggggagagggagagatctgggccgtccgatcgtgcgatccgacggcttccaatggactggatcgaagtggccgtgtgcagtgtggctgtctggtctaggtggtgattgacaatccggccccaccgtcagtggttgtttttgtttgcattttcatcctgaaggtttaagggtctgttcagattatgtcaaaatgaacattttcaaaattttggtaaattagtaacattgtcaaattttagtagaatgtgctcgattcaatattatcaaaattccatagacattaccaaaatttggtaacaaactaaatataattacatagttgacgattttaccaaataatggcatggtttgaaatagtatcgatctgaacaagccctaaatcatcgttctttttgtttttttattataatctcgtgtgattatttattggatattttgcttaagctctttcttagtacgtaggataagacaatctatcatgccgtgaaattccaaattggaatttgatagtcacttcttacagtggaaaaatagagaggatattttgctgaatttgaaatcaaatgatgaaatgtgaaaaaagagaaagccatcgttagaagttgtttttgttttcattttcatgagattaattcatccattgttcttttgattttttttattaactcgcgtgattgtttattagatattttgcttaagcttttaaattttgtttctttgtacaagagaatctatcatgccaagaaattccaaattgaaatttgatagcagtttcgcgaaaaccgattggaatagtaagccggggtttaaaccaataaaaccattatagattcttatgactatttctgtacagtatttttacaaagggaggcatgtaggtaccgtatcatatgaagataggcttaagctgtagaacaccatatgatttccaattcaacgtcaactattagggtcagctcagcacccagagcaatctc

SEQ ID NO: 35944 - DNA, 200 bp, Oryza sativa
tcaatatatgcagatcttagtgctgcatatttctgaatagacatacctgaaactgaaagcatattgtaacttttgtcactgtattaatgtttgtcatattatgctttgtatgttaaaaatggttgtatgatatcctcaatcaaatggaaatgatattaactttatatatttgtcatatattggtgcaggcatgagaaagc

SEQ ID NO: 35945 - DNA, 314 bp, Oryza sativa
tcccatctcctcttgattgatgtaccacagcccattacgcctgactccagtccaaatcctcctccaaggcagtagccaaaaaaccagccaaaacaagagacgtaccacctccttcttagttcctgcagcaaacaatcctcctatgtcaccaagtctgcagccaagccaccatcctccttttcccttagctgagctcctcacatttcctgcgtgagcagcaggttacaacacacgcgctgcgcccgcgcggccgcgcgcagcgcgcgctcaccagcccctcaacgtggctgtgtgtagaggctggtcaggccgga

SEQ ID NO: 35946 - DNA, 507 bp, Oryza sativa
atatggtcaaatttgtagaggacccggcttgctgcgcgaagccggtctgaccgccgccatagggccgatcagaccaacggtgtggggccagtttgactggcggtatgtagccgataagaccggcagggtccagttctgagtctagtttcatcggttctcgggatttttttgcttgggttgaggtttttcgagtcctaattggtttctacacctagtgggacgtggagagggtcctgtggagggcctgaccaacccctttataagggtcatggctggttcaattgagatacacaatgtacaacaacgcaatttgctaattgaatcgttctttcaataaagcatctactttttgcctagcttttagcctagtttgtctatcttcgttggtttgtgcttgttggagaaacgggaaccagggtccccttttccccaggatcatgagacacaggggcccacaaaaatcactttctaccacatacatatatgtatctataattcgttgccagg

SEQ ID NO: 35947 - DNA, 192 bp, Oryza sativa
aggggaatagaagaaagaagatggggggaggtcactggggtagggtggtggtgccgccgccggtggctgggaacggtcaccggcggcggcgaggttgtgcagaatctggagttcaaatgtcaggagagagccattcatgagttgcaaagacaaacatggtacaagtagcagcttgatgtgttagttggacca

SEQ ID NO: 35948 - DNA, 260 bp, Oryza sativa
aatccaaaaatgcattttgagtcattcgtacaagtttaaggaccgcacgtgtgcttcactcaaaagaaaactaattaggatttctccacagtatccacgaaacaatattcagcacgacacataattcacaattcgatagaatgatggaaagctttttctgatgtgtctctaatttccgatgtgtctctaacatgtgggttccatcataattccattttttttattgacggtaagtaccacgttgtcgacattttaggtca

SEQ ID NO: 35949 - DNA, 1396 bp, Oryza sativa
aggaccagcacgtcaatgtcagggttttcgccggttttcctttaattaaccgtgctgttgtaaggtttttggtccaattttccttataaactggatcaactctcttcttctgtaatgaactacatgaactccctacctgtcccctcgaaaaaaaatgtcttcaaccaagtgctaagtttcgtaaacaaaaacaaggctaaataaatatacccagcaaaataatacaacactcagatgcaaattcttaaatcagtaagatcactattagatcaaaatataagagtttgagatttgaaaattgtattggtagatttgtcaatatttgtataaatattacaaaatttcaatcagaaaaatattgatcttatcagtaagaactgaggtaatatatcagcatgattttttttctttataatacaacactcagatgcaaattcttaaatcagtaagatcactattagatcaaaatataagagtttgagatatgaaaattgtattgatagatttgtcaatatttgtataaatattacaaaattttaatcagaaacatattgatcttatcagtaagaactgaggtaatatatcagcaagatttttttcaaagaagaaatccgcacatataagcaacacacttaatataaaacagtgcttaactattgcatcgttgtcaagcaagttgcggtgtgatttcttgcatgggaaatactccctccgtggctccgttcaaaaacaaacgtagttctagataaccaaatgcatattaggaaagagaaactgaaacagtattatgcgtataattaatatggagaggaaacaaggaagatgatacgacaaaaatgagaagaaaatgatgtagtggtattaaagaagttgtatggaccactccattttttttaggttaaaaatacacttttttgaggatggaatggaggagtaaatatgtagctccaaattacctctatttggttaaaaaaaatgaatactatagaatgatctaatatcaaataattaaaatggatgaggcttcaagtcgtctagcccatcaccttggtgaagctaaccgaaagatttctgggcgtttctgattctttgtttggttatataacaaatcgacaaactcttacggactactacgtaaaagatctacttggtgatctactgatgttcgtgaaagttttgaattttcttcgtaatagggcagcaatagcatacgcataacttaaacccggtccacagtaaaatcaattgcaatggctggtaaaatttaacatcccgacatataaataagatttcatcgttgagaattacttgagatatatatggaattgatgagtatcaaagggaaagaaaacaaattcagaatgcgtctcttatatttttgatttcgttctctagc

SEQ ID NO: 35950 - DNA, 483 bp, Oryza sativa
ccaaacaataattttggtaaaaacctaaggattcatttcctataggatttgccatggcatgaaattcctacattatgttttttcatgtgtttttgaaatccccgttccaaaggagcccatcatttggagggcttcaagacctcgaagtacccaggcgagtaagcaaatatatttttaaggagcaccatcctttatttatcagctaataataatacataaaccatagcattacatcatattattgcattttacaagccataacatgacaaaagcatactataattttcttctttcattttagatgtagcaaagcatactccctctaccgcgttgcaagtcgtaagagggcacatcacaatctctccatcggtccgtccatctctgctgcaaaccatcaatggcaatgatccaacggctgggaatgtctcagccacgaacaccagagggcaaagatcgcaccgccacgtggcagcagcagcatcc

SEQ ID NO: 35951 - DNA, 177 bp, Oryza sativa
ccaaacaataattttggtaaaaacctaaggattcatttcctataggatttgccatggcatgaaattcctacattatgttttttcatgtgtttttgaaatccccgttccaaaggagcccatcatttggagggcttcaagacctcgaagtacccaggcgagtaagcaaatatattttta

SEQ ID NO: 35952 - DNA, 1501 bp, Oryza sativa
tcaaatttctaacatgtcattctatatactaccagtatatattgatagtatattgtaccataaaagttctatgataaatgccattacaaattacctattcatagccgtgctactcaaattttataaaattagaaccataccatcaccgtgacgtttttcatcttcttccccatctgcacgtggggtccacccctcagattcatcttcctccttttttttctttcttttttctcattccctaaacacatttgcaatggcacggatcaaatcaatctcttttttttttctttttgctctacattgtcttcagtacaattatctgttcggtcctacccgttgtcggtgatcggaccacccagctttccggtccttaaaacggagtagaagaacgggagatatcaacgtgaagtacggctaccggagtagtagcaagttgcaagctctccccggttgtttgaggctggccggatggccctggctcctcgcatcaatcacgggctgcgccgaatcgtcaagaggcgtatcgttgacggatttatgtctgatttgatcgagcttgagatcgcatgtatatttgtcgtaaaactacaaggccccctcgaagcttgaatgctatcaatgcaaagggaaggagccaacgaaggagaggcgagagcgttgagtttggtaagaaaaaaaaaggaaaaaaaaagaaagctaatagaatcgaccatgcatgcaatgcaaccactttttgatactgatgtccgaatagaattgaaatcaacattgattgatggagggaattggctagagagtaccccctgtcttaatgctttggcttatatggctaagtaacaatgattagcttggaggttaagcccaggaggtaaggtgactcgatcttccctccatatgatgccctttagaccctacttaagtctcatccaagagaattatgcatcagtatcatcactgtattcgctagtctgtcctgtgccgcgtgcaactgatgcagtgccatgtttgggtgaaacatgtcttcagaagttcagatgtatctctggagagaggagcctgccactcatcccatgcacttcaccgacttggagggcactcaattctatcccaagtttccaaccacatccagggcccggacattcttcaaggatgctaccaatctaacaacacagatacacaagggtagggcatatatggtacagtttgttaaaaacacacctcctgacagcttgtatgtagtactaccagtagctgtaaagaccaattcaaatgtgtgaggccaagggcattgaattgttctcaggggagaataatggtctcagatcagcaatggtaaatgggggtactgctgctgataatattattgcttgcatgagggccatagcccatacagccttggggtaaacttgcatgagggccatagcccatacaaccttggggtaaaaaacaaggctgcagagagcacacaacaaacttgcaaagggacagatgaacaaagaca

SEQ ID NO: 35953 - DNA, 1501 bp, Oryza sativa
ccatttaagccctctcgctttggttcttttgaatatttttattgtttaagccgctgttttttaaaccttaagtagtagactgttagcttcacatagaccagaaaagctactgtaacctagcttttagcttaacatagagtgacttatgaccttaaaaaatacaaacgaaaaaatatctatttatttaggtttaaacataaacaaaagagggccttaatcaacaaacagccggatgctcatgctcatgtgtcgttgagaggatcccactcgataatcaattggcttaataaactcagctagaggggtaaaatatcgatcagtagatcacacagataataatcccttttatcagaagctgatttcctataagaaaaatgtagagcagccgcatccacgatgcgcaaaacaaccaaaagggcaatattcaatccaccgaacacccttcaggataattcgtatacaaaacttgcaggtacacaactaattatggtccaattcctaagctgcgtaaacggtggaaatgtacatacaaattgtcaatcgaacagtcctcatgccatcgaaatgcttctgaatttagttaaaataaaatgcttctgaagagaaccatcccatcacagctcgcatacagaacaccctgcttgaattcagaggataaaaacatcattataacaagaaaactaacaaagaatcacaaggggcacgtacctgttaaatctgtgttaaatcctcttaaaaggatcagtactgcatctttaagttcacattgaaccttttgcttcggtaacagctgacagatctgtacagatttcagactaactgcttatctttcaccgcaataaagcttgtaccaggatgatataatcatcacttacctgacttgtgcactctgcagatactttgtagttaatctagcttggtgggacttgggagcattttgtttagacaaacaagttttttatctgacttgtgcactctgcagatactttgtagttaatctagcttggtgggacttggaagcattttgcttagacaaacaagttttttacctgacttgtgcactctgcagatactttgtagttaatctagctttggtgggacttggaagcattttgcttagacaaacaagctttttacaatagggggtaacaccccgcaaaacgaggactgataatggagtaccaaattcaatagagttggtagctcatcgtcttatctggaaaaaaaaactgtcttcaaactggaaagataatactacttcccttatttgtttacaacaaatttctttgtttgcctcttgttacttcttttaccatacacaataacttcctcagttcaaatagtcttcttgtctaatgtaattgagtttccttttttttaaaaaaaaactagtgagttgataacccagcatgtttctatgggtatacacaacatatttatattgctgcttttggcaaacctggattctgcatttcttgactctgttttcatatccaatagt

SEQ ID NO: 35954 - DNA, 1116 bp, Oryza sativa
agtgttgcatagatagaattgacaagaccacgatctataatggtttggagaggtttggaaagatatttcatcttggttgttgtttacacccaaatttggcacctagggtcgaaatagaaaaaattgcgaaagtttggggctctgccggtttcctccagaaagggccggtctgaccgccatatgtgggccggtcagaccgccgccggagagccggtcagaccggtggcatgtggccggtctgaccggtagagtctgagttagactccgttttcgtcaggtctcgggtggttggcgactccatatcaccgcaaggcgtttaggtgctgcgatcgtgcttgttgacttgtcacaaaaagttgctcttgcctttgataccagctcttgcccaaacaccatatatattgcataatcatcccaattccctccttccacaatatatacttcggacccagccaatagcaccatgtagaccgtgtgcctacaaagattcttaccaaaagaaacttaaaggccaaaatcccatgagtaccgcatatgaatatctccaacccagattgagcttcaagacagagcaaattttatcttgctttgggcaagacatcctcgaccttgtttggcaaaagtttaaagagagacaaatgaaaatatttcaagattatttctttcatctcttataaggcagagaaagaaacccagccatacaagtaatcatatacatgcttcctatcttaaggttagatgatcatcaggtaatctctgacccatcctatagattcatggttctcaaagccgaaataaatctccaaagattccgaaacttacccacatacaaccatgatgaaatatctctccaaaccattatagatcatggtcttgtcaattctatctatgcaacactagatcggattcttcaatttgatttaggaagcgctgtaaaagatgtctgtagaagacttagaaatggaagatacaggattatcttctcctccataccacctaaattcacaccacatgctcgtccagcaattcactatatatatatatatatatatatatatatatatatatatatatatatatatatatatatatatatatatatatatatatatatca

SEQ ID NO: 35955 - DNA, 1501 bp, Oryza sativa
cgtggatttcatcaatcatgagctggtcctgaaaacaacaatattgatcttaagttaatccattatataatcaatcaggtgcccaacaaaaaaatatggttagtaggttgaccttttttgtccggatgcagcgtatgctcatttctagctgattttctagagtttgcagttccttgacacccaatccagaaagatcttgccccatcaactgcctgccatcaaccaatggatgttatagtgttgttctgatgatatacagagtgaatattgacacttaattttagctgatcaacagacagctgttaattgataataaaaataatttgtacctttctagtttaggtattgtaaattaggcctgaaggacaaaatggagtgtttgaacaataatttaccaggcagaaagcacaggtgaagaaaatgtgatattcactctcctttgtaaatttggtctgtccgcctttgatgggtgctcagttctgtttttcttttagagataaccggaaatgcataaaaatcgaatggctgaaggtatatatttcttacttttaaatgatatagaaaattcacgtgccttcttcatttcttttgtttgtgaaggttaaacaatgcattatctataggaaatttggaatcagcatatatcactttcatactctgttttttcttcttttttctaagtatcatatacccaagcactaggtgcttgtttttatgatctggtactagtttatatttactatacaatcaggtgctggaagtattattgtcgctagcagttgctggattcatgagcaagtccccacaaaaaaaaaaagttcatcatcaagggttcatgatgcatgtatttcatagtagtagatatatgatggtttatgtttttctatcttgaggaattttctgatggaacattgaaaaacttgcagggttttatggccataccgatgattttcttgcaagctgtgcagttgttgtctcaagcttgctgcctccctttgccagaactattggatatgaaaacagagtcaagaaatgcagaatccaggtttgccaaaagcagcaatataaatatgttgtgtatacccatagaaacatgctgggttatcaactcactagtttttttttaaaaaaaaggaaactcaattacattagacaagaagactatttgaactgaggaagttattgtgtatggtaaaagaagtaacaagaggcaaacaaagaaatttgttgtaaacaaataagggaagtagtattatctttccagtttgaagacagtttttttttccagataagacgatgagctaccaactctattgaatttggtactccattatcagtcctcgttttgcggggtgttaccccctattgtaaaaagcttgtttgtctaagcaaaatgcttccaagtcccaccaaagctagattaactacaaagtatctgcagagtgcacaagtcaggtaaaaaacttgtttgtctaagcaaaatgcttccaagtcccaccaa

SEQ ID NO: 35956 - DNA, 465 bp, Oryza sativa
tttttttttgcatctttgcacctattattccctgtcatatgtatacatatacatcggccataagtgtttaagaactaatgcatgtgtcaggttcttcaatttcctgttagtctcagattaactactagttgttcatctttgtttttaaccttcttctagctagggtccccctatgtatggccatatgtcagttgtgtgtttactattttgtcatgcatatttttcgaaggaataaatatgtcaactatgctttgcagtgaagcaataattgatctagcactcttggaataaaattgtgtgataactgtacacttatacgtatgatttctgctcacttcatataattgttaatttaccctttttgccgtactcttacactcaaaagctagcacacgcatgcatgtgctttcagattacaaaaataatcttagtaagagttgtgccggccattcgttttgtgcagca

SEQ ID NO: 35957 - DNA, 275 bp, Oryza sativa
atagacattgatatgtgtaacactaagaaagcggaactcacatataagtgaccgtaatggtatagtgatattatggtagaggatcctcacccgatttgttgtcctctttatttccctttttttaagaaagatgacgtgtgtgacttgttagttgtaagatagattcacttgttttaggcgggattatttctcacactacagcaaaagagggggagcaaacacctgattttggtaaccttggtaaagactagaaatgtttctattttctctcaaaa

SEQ ID NO: 35958 - DNA, 1501 bp, Oryza sativa
gccagatcaacatatctctgtccccctctaggacataatcttgtatcatatttcttaacacttccagctcagcctccccaacactgtccagatttcttctaaactccaaactccatatcccctcatcatacaaatccttcacagtagtattttgatgacagccgatttcaaaaagctttggaaacaacacctttagagaagactgaccacaccaaacatctgtccaaaaatatacaccatccctttatgaacttctttcattactaatctctccaacaccactctacactcatgcagtcttttccagaattgagatccccctttgaagaactatgaaaaaaaagcccttgacatcttttactagttttgttgtatgttttgggatagaggaagtaaattatacgatgagttcgtaatttctatgggtgaacatgtctacatgaagccatcaacaatctagctacttgtaccatccaagcccaatcaaatactctgataaattatgaaaggcaaaacaaggaaattatcactattggtgttatagttgtggtacctgcatgacttcatttattgggatttaaattttgatatctaaatttagttgtgtgcagttggtgcagagctggggagttatatttcctcttactatgaaaaaaaattcaacgacaatatatacttgggcccctgaattaattatctaccacaaattcctagctgcaggtggtacattttgagtacttgaaatttgttgatatggtgagcattgcctcttcgattaagatgatttttaaatcacaggaaatagaaaaaaaagtaggaatagagtagaaatgtatacaaaataaataattggctcacatagaattatttcgcatagcagccctatgttttttttcttcgacatgaatagtgcctattcatcatattttcaatagtttcctgtgtgtacgctcgaaacaggcttaaaatgcataatcaaaaattggcaagttgcattttgcaaacaaaataatatacgtacggcgaaatgtttaaaatgtcatccaaaaacatcaccgtgcgcgttggtagttcccgttcctcgaccatctaacccctctctctctctctcctggacaggtgtcgccgccagtgaagatctcgcccatccacctccccatccgacggctcccgatttcccgcacgcgcccccttcgcgtcttcgcgagccttctcgacaggcagagcatgcaggaggcgcaggcccaacccacgcgcccacttgccggcgatcggcggtggcgggtgggcggacggtacacctgtcggggtgccccgcagcagcgccccccctctgaaaatggcgccgggggcgacgtggccgccggagcgccgctcgtccgccgcattttttattactcccccggaaaccccaccccacttggcgtgggggcgcctgctttgctttgggggttatctctctctctcttcatctacaaagagcaccaccaccaccacacgc

SEQ ID NO: 35959 - DNA, 1073 bp, Oryza sativa
ttgggagagaaaggtgacaaggtggtggaacaagagtcccaagagctgataaatcccattgagatgctgacccaggaagatttagagggaactcagaatgattggctgacaatgggtgaaaaaaacttgttggatgatgagatggagaggtgtcaaattcccactgattctgacatagaaaggttgagggaggaagaaaatagagatgatgaatagagctttcaagaggtgtctcataagaagaaaagtagggggagaaaaactgaacctacaattacatccaggatgagcttaaggaatagggagttggctgatgttcctgtcaccaggagggctagaattctcactcagaagaagaacatggaaggtaatgcttcaaacccttttgctatttttcagctgctagattcagttgagttaaataaaattgctattgctgctaagatagatttgggtagtacttctactgagattgatactaatttagaatccttgaaatcaaaagagatagcccatgctaaactagctgaactaaactggaaaaaagagatggaaaattgaaaagtaaggaaggtaatgtagaaaaatctgaggaggtgaatcaaaagttaggaaaagaggttgtggctaaaaaagtaagatgccattagaggaggtggctgctgaaaagagccctgagctgataaagagaggtggtgtgttcaaacaaaggaaaaaaaaatgattatcttgttctaaaatattaaagggttaggtagtgtagctagaggtggacaactgaaagagctgatcaaagaaaagagggtgtacattatctgtttacaagaaactaagaaagaggtgttcttagatagagagttgaattccttccaaggagggaggtcttttgtgtggtgctgaaagcatccaggggacttctggtggcattcttgtaggtgtgaattctgagatgtttgaggttatctctactcatgccggagcttatttcctatgttgtgttttgaaaaataagaaagatgactatctctacgaaatcattagtgtgtgtggtcctgtggacaatcacttgaagg

SEQ ID NO: 35960 - DNA, 1501 bp, Oryza sativa
cctcaagaatgaatctcctaggaatgaaggttgtttgggtaggagaaatcacatcattagctacctctgagagtctgttattcaccactttactgagaaatttgaagcaatcattcagcacacagatgggcctgtattgtctaatgtctgtgggctaattgtttttgggaatcaaagaaatcaccccaaagttcagtctcttgagatctaactcctcattatgaaacataagcaacatctcaaacaaatcatttctcacttgaggccaaaagctctgcaaaaaaggatgctaaaaccatctggactaggagcagtgttcaattttgcctcctgaagcgccttatctaactcctcaatcttgaagggtctaatcaaactctctttgttgtcagcagaaaggttcagaccgccactccagatatctcgagccaagtgggtatagttaaaacatcagctctaaaaaagggttttgtaataagagacaatatgattttttttatatcttctttactagtcagctctgtatctccatccatcaaagagattattgagcactttcttttcctgccattagcaaccctatgaaaaaactcagtgttcctatccccctccaagatccattgttctccacatcttttatgctagtacaactcttccatcttataagtgtgttctagatccctttccacctcatatctctaattccattcttcaggggataagtcatcttctaaagctttcctatctagctcctccaattttccctgaagagttttcttttcccttcttttctcattcaggatattgattccccaatgtcacgtcctgataaattcatcccgaaataaaaatcattttccaaaaggaataatagaattaattaaaattcgaaaagaaattggcaaacactaaaatacgtacaagaaaaattcaaatgtggcccggagaatttttgttaaattctccttggtctaaaatgagccctcaaattttacttgaattttcagaacaccggaaataattattaagcaacaaaaacaattatcaaagtttattaaaaagaaaaacctaaaaataaatcctcttcctcctttgggccaagcccagcccgaagtccctctctcctccctctttttctctccctctccttccctccctccttccccggcccactccctcctcctccctctctccccgggccacccctcccctcctctcctcctgggccggccgcccggcccacgccgtgcccctgcctgagccgctcccctcccgcgcacgcacgccgcgcgtgcgctgaccgagcgcccgaccgcgtggggcccacgcgccaggccggtcgtctccttcctcccgcccggtctcctctctctctctcccgtgaaccctagcttcgttcctccctcgaatccgcgcgatttaagcgttggattccaaaattaattggggggaattaatcccctttccctcatctctctttcccccttaatttccccttgaa

SEQ ID NO: 35961 - DNA, 1501 bp, Oryza sativa
ggtcttaggcttgtgaaaagaattagaaaacttgctttgcgcaaaagaaccatagccatcctttgaaatacccctatcatgtgcattgttgatgtggtggcttgctgagtacggttggtactcacccttgcaaatataaacttaatcagaggccggagatgaagcttcggaggatccctatgcctattaccaggagggtgatgcagacgatggcgctcaataggtcttagttacggtcgttgcctgtggcaatggcatgccgctgctttatctatttctgctgtgggatgtattccggactgctcggttgtcacgcccggaaattcacaagtaatttccaaacttatttgtgcataaaatcctcgtccaggaatcagccgaggtacacaaactgacaatttaatatacagattcatcaaattaactaaaacgataagtacttacttaagaggcacttagtcctcaccaagaagaaaactgcagcggaaaataaaatctagcgaagctccggctccactcccacaggcagctcaactggggtataagccaaacgtcttctccttcgcaacttgtcttcaactgaggttgattgattgttacaagaatgagcatatgacatactcaacaagccacacagcaaatatgcaagtgcacaaggataccaaaggatggcataatataggctcatttgcaaaagcagcatttaacaaaacatttaagagaagtaaaacagtggagtaattaatcagaaattttaatcaacactgaacagcacacccatgctgcacaggcccaaccatcctgaacaaccatacccggctgtacagatctaactccaaaccaggagctaagcaaattattaccagttataacatccataattattgtgagaggtgtgagactaatcacgaaaaacattgctcaactcgcccataaccgcgggcacggctattcgaatagtttttactctggccagaggtgtaccactgtacccacaagacacagcctcaacatcatgtctaccatgcgtcgcgatactggaaagtacccgaatagaggctgtgacaataccctttgtacaacacaactcaccacagtgcaccattcctggatcataatcacccccttataaaacaaggcatggactccccagtgacccccgtgggcttatctccgccacttctcagtctggtgctccgcaatgaatcatgctatacaaaaggtaaagccgttgcccacgctggcttgtggttggcacgattaatgtttcacaatagtagctcgcgaaccggtccttaattgtcatgagcacgactctcaaaaccatgtgctcacaacccaccattatcaagttttagttggcaagtaattaattaaccaatcacgattgaccatcgtgaactatcattaagccatcattaaataatgagtcataagttatcccaatagtgtgctaatgtttctaagcatggctaagcaattatatctaatatctagttga

SEQ ID NO: 35962 - DNA, 1501 bp, Oryza sativa
cataattttaatttcgaatttcagttatttttaaattgtatttctactcaaactcttcttttccttttttttttttgctaatttcagattttattttgttgttctgaaaattaattaatctcgtattgggttcgtgtgttagtttaccatgagcctatgcttttcacagtaaatctagaattctaagcacaggagccgtgcagccagacagagtatgaagggccggtcggcactcggctcctgggcagctgcaattctaccccgtaacggtttcattaaagaaaaggaaaaattcgtgcggctgcaatcctaatcctactccttaacggtttcatcaaagaaaaataatccgattctgcctgattccaaatatgagcagtagattgctatatttcatccacaacttattataatttaaaaactacaattgtactacatatatattgctatcaacctacaccgttataatttagatccactacgatctaacggtgtagatttttctttttttctccgattaatgtgagaatttctagtcccacagcgaacgtggtgcctcctttcaaggctgttttaataatataacagatagatagatatctggtcctacctgttatacacacattacgttctgaagtccgtgttacagctggctacagatgtatagtccgctgctcttctctttctttatttatctttttaaaatataatttatatctggtttatagccctgtaattgtacttgctctcagtggcttgtggtgacatcgcgcattcgcaggtcaggtcgagataagagactccactcagccggcagggctgcctcctcgtgttggctttctggtaattttctttccccccaaaaaattttccggcctcgacgtggtcgatgcgatccatccatgatgtgatgtgaccaactcaccaacggcggaaagccaagcccatcgagcgaagcgaaggccgccgcggacagcgagagggcgcaatttttgtgtagtactcactccgtccacggtataagtgattttaatttttttttttcaccactcgtcttatttaaatttttttttataaatatataaaataaaaagttatgcttaaagtataaagtaagtcacaaataaaataaataataatttttaaaaaattaaataagatgagtggttaaatattgtaaacaaaaactcaaaatccctatattatgggacggtgggagattatgggacggtgggagtaaaagcgtttccacttcattataaaaaaggcggcggccgcgctggccacgctcgggcaccaggaaggcggagagagaagaagttttccgcatcgcgaccgcgcggacgaggcaggctggccgtcggatcgggctgaccgcgtctcgtttagaaatatcctcgtgacttctcctcctcctgagtcgtcgtcgtcgtggtggtgctcgtcctcctcggcggcggaggcttcggggggcgggagatccgggcggcggagatggcga

SEQ ID NO: 35963 - DNA, 1351 bp, Oryza sativa
gtttattatccccaggtcttctacctttaactgtcatggttttcacctttttgagaatccagttttccttttcataataaaagatgttgccgaaggtgctctaatctttctcctttgtttctcatttttcttgccatagtatcatcaggtgattcactaccttaccatattattatcaggtgattcagatgtagtgaaaggatgtaattgcatgaagtgcatgatttgatcaatacacaaaatagaagtgcaactgatcgtcatctgcagtacagggcaggtatttcagtatttcactatccatcagttaagtgtgttagtattcgttctccgtagcttctattttacggattgtttttttctctttctgaattcatcctgcaaatatcacgttttttgtttagtttaaaaaagtctagaaatgtataagctttactagggaaaattttcagctatttgtttactcaataaagtgcaatactgcattacgaggtaaaacttaactgaccctttcaaatgttcccatagaattttacttaatctattgttcaaagtgtgttgtacgtattttttatatatatttgaaaatatatacactgttaattacacaccgttaacttcacatgcagcctacacattgttgctcgactaaccgagttttttttactgtagatggcaggttcatttgttgtacgtatggctggagctcagaagttgcttgcaacctaatcaggctaaccattcaatcatgacgtaagaatataacaaactggtgaatgtgattcagtaaacaaataagctgctaattaattaagaacttccattattctaggtgaacatcttcacaattcactgctacaaacatcagggtttcaaattaattatcatgtaacattagactatatgaaacaactttcggtcaatatctattactaaaagtttacaactctaggtcatgcaaaaaaatatcccgcagcaacgcgcgaggtattatctagtatatatataggcagtcccttaatattatgattagctttaatttttgttctaatcaaaccttttaaatttgtccgagttaatagaaaaaaaataataatatcttttaacacaaaataaacatattatcaaaatatattcaatgtcatatttaatgaaactaatttggtattatagatattgctaattttttaaatttgattaaacttaaaaagtttaactagaaaaataatcaaggctacttataatacgaaacgaagagaatacatagtatgaacatgatataaacacaatatttagtatttaccctcttcacgggcgtttctgcaaatatggttttttaggccgagggaca

SEQ ID NO: 35964 - DNA, 1501 bp, Oryza sativa
cagggattgaggtgagagaggaaacaagccaggaaagaatagaccagaactagagacaggaccttaaaggaactaactcttcttgctgatgtgttgtttgtttcacttattctgcaagttgattaaacaaacaacctaccaacatggttacatcacaccccactgatgcaaaccaagcgctacacacacaagcaaggaaacacacaactaacgactctaccctagagggtggcttaggttctgcgacgggttctccaagatcttcactccttcacagctggcttcactgcttcctccacttcgctagcggatcctacagtcttctggagcttcggcaaacaactgacgatgtcttcttcttcactgacctgaccatccagtactagttgaaatccgaagaaggaagaagggagtaaacattttgaaaatagcattagggaaaggaggaaaaggaactttcgcaaatagtttcatttataaaatatgtccttaggttttatccacttggcttatcctacagtcgagacggctctgataccatcttgtcgcgaccgagaaaattgcattttcccgaacgctagtgtattaatccccgtcccaggaaaagccggggtacaccatacaaacatgatataaaatacacatctttattatatcgataatatttacattattacaaaggcacttaaggcctgacaatcaaaaataaacagcagcggattagcgggcctatggctccatcttcacaggcgctcaactggggtgtaagccaagactccacctaagacatcttctccaaagcttctcttactgaaggggggagaaagatagagcaagaatgagtacaaccacagtactcagcaagccacaccggcggatgcacgattaatgcaagggggtacaaggggtaatgatataggggttaagttttgcagaaaacggcatttaaaaatcacttagttgcccaaagccattttaaaaagacgatcctagagctacacagtattattaatcaaggtcgtgaacccgcacgaacctgccttaacccaaggcctacgatgattcagaccgaactggcaacccgaccctgggtcccagctcgtcccaagccaacccaggccaaccattccacattttagctgttaagcaaattttaagaattaaaacactaacttgggtgcattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagttcccaacccatcctagccataaacaagagtaccgacccaaccccacctacggccggaacctccgggacaggtaggcaggattgagcccctagcagcaggacaccagccctgtaccatgacatctcgactaccgggccgcagctcgtgtagccttcatttgtcctaga

SEQ ID NO: 35965 - DNA, 591 bp, Oryza sativa
cctagaaaaaacaaaaatagtgcccagctgaaatcggttagatccatgaaattttaagaagaaaagcaatcagtcatctacctctccaagaaaaacaatcacaaaagagtttcttttataatcagtcatccacccctccaatttacacttgcaatatctaaaatcaaatcatataaaacacttgaaaaatccttgatggcctcgacgacctgagactaagaagaatggcacggtgatgccgaggagctcggaggaggcggtggttggaagcggcagccggttactggggatggaggagacaacacctagcggttggcagcacctagcggttggcagatgtgtcgcccggtgactggaggcggcggccagagcacggggatgaacgagacgacgctcggtggccggatctgcgtcccatgaccttgtggaggacggatctggcacccggcgggatggaggtggcagtgcttggcggttggaggagatggcgcccggtggacggattcgtcctccattaggctgggggacgtggatccggcgcccgacggtcgggggacagaggcggtggccactggcggtcggggatggagg

SEQ ID NO: 35966 - DNA, 1401 bp, Oryza sativa
taggtgacactatagaatactcaagcttggggcccaataggagcattctgggtaccattgtcagaccagactccgtgctcctagaccggaaaggctggaacaaggacgctacaatacctgacatgttaacagaaccctgggaaccattaccccgtcagtttgatagcgataatgatgcagtctataattggcatgtgatagatgatgaaccactgcccaggaatactcgatcctcatcggaggacacaaggccatcacctacacaaaaaaggaagtcttccaaaccaaaacagagatcgcggaaaaaggccaaggctgattcttcgagtggtaacaatgctgaaaatggtttcaagcgggggaaaggattagcacaatgtgatagatcgcatcaaagtgcaggaagcagcagacggagcaaagggccgagagagtatgacagatttacaaataccctcccacaatatactcagcacattagtaggtggtgactttaggctgttactgatagcatttacagtacagttcgggattgggagatcccacgaggttttgacaggcagaatggcgccttggcagacgtcgaagttcaagcagctttctgtagccatatgtatgatttattatttatttgtttgtctaaggttattcggtcctttgtaacgccgatgaaaccgatatattcagttatattatcatcgtatgaactgcaatttcgccaacttgtctatggcaaagtttcagactattaaaaattatctttggctggaacgtgaattcataattcataacaagacgtcacttcggtgacatccgataaaaataattcataacaagacgccttgaaaggtttaagttttattaaacgaaagaggaacataatttagattgtcgcagctaccaatcacactaaatacatgattggaagttaaataaaatcaagcttatagtcgaatgaaataaaaaggttccaccttcttttcccagtttagaactgaacaagtaaacagctttgtttaccgttaccacaacgacactgcaagcttaatacagctagctaccgtcttttactcgtctttcttctgtgcgaatcctgggggaaaggactccagccttttctattccgctcaaaagaataaggaaatataacgagaattgtatatgaggaatacaggataatcagctatcaagcactttgtgttcaaatatcaagcctcttatacctctgctctattttcctttcgagagctgctcctatgttttttccatagtataacggaaaaaaaaggtcaatcaacaatatgacaggttaaataaacattgaaagtaaaaatgcaaaacaaaagaagctaataaaccgatattgtaaggccacccaacaaacagctgacaggatcaaga

SEQ ID NO: 35967 - DNA, 1501 bp, Oryza sativa
tcattcaggaacaccaattgtgtagcatttctccatttagaaaaaaaagaagaaaagatttgtcgtgttcagaacttcaggctcaacaatcttgcgggcgttttcttttgttttcggaaatggtgacactcgtttcagatggtgtcctgtgtcacacaagttatgtgtgttgcacagccattcctctagcagatttctctcgacgtggttgcgtggtctttgcaatgtcaagaagggtgggggttagccggttaggctgtctgtcatggatcaatcaccgtcagttttgcaccctaattgagcttctgcctaattaatatcgtccactaaataacagtgcttttcatcaaactgttgtccggtggatggaccagtcgccaaaagttgagagaaatttccctcaaaaaaaaaagttgagagaaaaatttactactctgcttcgttgaaaaaaagctgtccagcgaaataaatcctacctagacacagtggcggagacaggataaaattatagtggaggcttctcagggcctgttcactttgttgccaaaaaaaaaccttaccaaaatttagcatttgccaaaatttttgcagagttaccaaaattttggtaggatttcttatatagttatcaaaatttagcagcaaactaaatatagccattttttttgcaactttacaaaaatttggtaaggttgaaaatggcatcaaagtgaacaggccctcagtcttttgggtttttgggtcttctaaaaatcagacaaaagtctattttagcccccttcaatagatatatggattgggtagtggtttttaacccccttcaatagatatatggattgggtagtggggtcgaaagaaccctcccctccccccatgctgactccgccactgcgtagacacagcaagatcacaacatcgtgatttccccgacacgttttcaagttaaagtgcgcatcctgacccatcaaccatgggtcacctaggtcacagtcacattagatctgttccaccacaggtccaaccggagttataactttagattctaggcctatacaacccaaaagactagtctgatggatgagcatcattcctatcttttaagtcgtgtttctctatcgtcaattatcgatgtgggattacacccaacaccgtcgacggcgaaggccacgtcgtcgcggaagcgagacggcagaccgcccggcgggtggccgcgcctgcagcagcatatgcagcgttcggggatgcctggatggctgggtttgagttgggctagtcacctagtttcaccgggggcccaattcggttgggatcccatcccacggcggaagcccaagtcgagccgagccgcatgggcggcgccgctgcccaccaccgcaccaggccaccaccacaacacctcggtggctcggtgcgcacgcactcgcgcttgcggccacgcgcgatgcgacgcgacccgactttttcccccctgcgcgtacgcgtgatggcgcgtgaggacgga

SEQ ID NO: 35968 - DNA, 1501 bp, Oryza sativa
tcttaaatgggcctgaacacttaaatgggccgaatttactttagcctcccttgtaaagcttttctctttttttttttttgagaatttcttgtaaaacattagatcttggctggatcacagcgacatgggatcccaacaagcgagagaggaggacgctgatccgccgccgccgccgacgacgacgacgaggctgccctttctattcaacctgtcgcgcggggagctagtacggcggcagcgtttgatcgacgaggcggtggaacggctgcgccgctgcggctgcgacattcgtcgctgcaggggaggcggggtcccatgccctgaacggcggtacgtcttcgatctcaattctcatgccatgtttgcgcctccattgatcatcgtctacagctagctcgtcacgatcgatctgcaagttttccctatgttgattgattgtttagatctcaagcggtttggctcgggccggggccgtttggaaaattgaacttgcaattcctctcacgattccattaaaaaaaaatcctctcacgatatattgttgtgtgccacagcataatggtcatagaaaagaactttttttaagagagagagagagagagagagaatagtttttataaaacccaatctattgtagtctcacaaaactatataaattttgacacaaccacatcattaacaaatttgacatacttttatatcacaattttaagaagctttacttatatggatgtaacatttatatacaacagataaaaaaactcataaatttgatatgtgattgttgattgtagacctcaaacgtgtagtagatcaaagttaaaataaatattaggaaagggcctaatatcaaataattagaaggggtaaagcttcgaacccaggtcgtttagcccaccaccttgtggagctagccgaaaaacccctaggtgtttctccgatcaaagttaaaatgataaatagtttagtttcgtgaaactttatagcccataataccaacccagggttatgtgatacatgccaaaacctttgtgattttgtacaacttaattagaccataatatctaaggttgcgtaatttttttcttttaacaactcgcacgagacggtgcgaagttctattgatagagcagaaaaaaaatacaagattacaatactggaaggtcataaccaggaaaaagaaaaaaatatataccaccatccacatatcgacagcgcaaacacacatatctgggagaaggctagcactggatcggccgctgctaagcgtgaccgaccaccctaggccaataaaagaacacagacgagaacgaaaaaaaaatgtccttacaaccaacacgaaaggttgcgtaaaatttagaattactctcgttgctggactaatttcttgttggatactttttcgaattgcgttttgtttttgaatttaacaatataagtgcatcgagcagtgatagggttttttttggaaggaagcatatttcttcattttcttaagatg

SEQ ID NO: 35969 - DNA, 1501 bp, Oryza sativa
taagcaccgtaagtaaaggttaaaaaaactaattacctttcttggagcgatcaagctagatggcagattttcttcccccccggagatttgcctcctaaaatagagtatatacgagtcttttctcgtgtgtggttgtgccaggccccatggccaagggtttaaaaacacttcgaaaataacattgcattacatccgcgtgcttcgtttctcaaatcgccgtgccgtggattgaccgcttatgctgatagctgacatacaaatccagtcatacaggacaaaggacgagatgttgaggcatcttaacattcgtcgtacgtccccggaagtccagtacaatatacgtcctcttctccctgttgccgtcttgataaatgacatgctgacttatcttgctcagtagctggaactggaattcgggaagggaaagctcaaggatgcatcatccacaagataataaatagcgtatagcgggttggtagtggattagtgtttgaatagcgaattgcggatagtaggtgctattgcggatgctaagttccaagagcaaaattaagaaaaataactgtatatcaatattaacatcaagttttagttaaagtttaaaatttagactacacgtttaatagcgatctaataaagtcaatagtgggccgctatagcggccgcgaagcgctataacggccgttaagttccaatacgctatttgcagtccactaccctgtagcggtagaggtccgctacagctatatagtggccgctattacgggcgctataaacgctatttattaccttaatcatccatgcaaattgggcttcttatcttctcgcctgcggctgtggagcgagctccccgtgccatgtcggctatcgacagcggcatgcttgaggtcgaacatcttctttcgtccaagtcaccaacacggagtcacggactcaccggctgattgagcttgctgcaagcctccaaccagcccactgttcgctggtaagaaatctgaagtctgaacctgtaccaacctattgaccggattgcccgcccactctgaatctgaagcttcgtgcatcgatcgatcgtttagagaaacctattcgccttgtgtttattcaacagaatccaaatttgatccgatgaaatcaagaaagtaactagagatccaaagcatgtttctttcgggaagaaaaaaagagagaaaaagaagaagattggaaggagtacttactccgacgatatccaatctcctcggaaacaacgatcgacatactcacccccatgcacgtagctcctcgtactcctgtcaatggcgaacggccacctcggggcatccaggacgggacgccgtcgggaggaagcgcgaggagacggagttgcaagccagcccgttccattgggtcacgacgcgcagcccacgtcagcacctaaaagtcttaaatgggcctgaacacttaaatgggccgaatttactttagcctcccttgtaaagcttttctctttttttttttt

SEQ ID NO: 35970 - DNA, 1501 bp, Oryza sativa
tcacttccctagcagcgtgataaactgacgtcatgtgatttatggtgcagtgatttggtctaaaacctcaaaagctgacagaatcattttaccgaattgtgttcattagcttaacaccacgcataaggtggcacatcaatccccatatggctaggtagttcagattgctcttctcaggcctaagaataactgcacaagattttctgaaagcaaaattacacgcattgtgacattttacgaacccatatgcaccagtcatactcatcttggttgaaacagtttctgcatcatgagcaaacatattgcagacagaccgaattcagaattcaaatgacaaaacacaactaatgtaaggtttttaaaattagctgcaaacccatgtaatcctgcatcccggtagaatgtcaagagagtgggacatcattcttgagctggaagtggagcaggaagaaaaaccacttccagtgggggcttgtgtgtgtttcggttcggacacagaactcaacagcccaaccgctccagttgagtttgacagaatgctggaaccaccaaacttcccttggttgccttcttcatcttcttcttcctcccctttcccgcgaaagggccactcccgctgcatcctcgacgcctacccagctatcctcatctcctcctccattaaactccagccctcgccccctttttaaatccaccgaccaaacttcctgaaccttgccaacagtacagaggcctcgcttgttcatcttcgtctcggctctgcctgaaccttagcgccatggacggcagtggtgtgcgccggatttaagctttgtttaggctgatgggtcttcatgcttcggttcatcttcgtctcggctctggagttcttgtaaggtatggtaaccatgtttcggttttgcaatgaatatgttcattagctgcttctgttgatgaaatttgctgggttagtcatatgtattctgcacttactagatatgtgcagtataatggcaaggttaattctcttagtatttaggaatcatataatatgatttgctcggtataataagttttcacttggacccaatttcgatataatgatattaatcctgcaatacaatgagctatacacttaatccttagagaccttggggagatactagaaggtaccatttttttttctttttaataaaatttagtacctcctagtcaaatacagcaagaccattctaatccttaatacttggaggcaaaaaaaattatgttcatatttgtggtttgttttcataacgcaaactgataaaattgtatccaaagctcaaatgtctgaggttaaattgatgaactgataagcaattgagatgttgagtttcatctagcaaccaacaaccactaatcatggttgctttagaaattagaataccagagaaagaaaactcctttagaagagcttgacactagagtcatgtcagctttagaaattagaatactagagaaagaaaactcttttaaaactctt

SEQ ID NO: 35971 - DNA, 1501 bp, Oryza sativa
attattgttaccgctacatatactcctcatcttaagaaaatgaagaaatatgcttccttccaaaaaaaaccctatcactgctcgatgcacttatattgttaaattcaaaaacaaaacgcaattcgaaaaagtatccaacaagaaattagtccagcaacgagagtaattctaaattttacgcaacctttcgtgttggttgtaaggacatttttttttcgttctcgtctgtgttcttttattggcctagggtggtcggtcacgcttagcagcggccgatccagtgctagccttctcccagatatgtgtgtttgcgctgtcgatatgtggatggtggtatatatttttttctttttcctggttatgaccttccagtattgtaatcttgtattttttttctgctctatcaatagaacttcgcaccgtctcgtgcgagttgttaaaagaaaaaaattacgcaaccttagatattatggtctaattaagttgtacaaaatcacaaaggttttggcatgtatcacataaccctgggttggtattatgggctataaagtttcacgaaactaaactatttatcattttaactttgatcggagaaacacctaggggtttttcggctagctccacaaggtggtgggctaaacgacctgggttcgaagctttaccccttctaattatttgatattaggccctttcctaatatttattttaactttgatctactacacgtttgaggtctacaatcaacaatcacatatcaaatttatgagtttttttatctgttgtatataaatgttacatccatataagtaaagcttcttaaaattgtgatataaaagtatgtcaaatttgttaatgatgtggttgtgtcaaaatttatatagttttgtgagactacaatagattgggttttataaaaactattctctctctctctctctctctcttaaaaaaagttcttttctatgaccattatgctgtggcacacaacaatatatcgtgagaggatttttttttaatggaatcgtgagaggaattgcaagttcaattttccaaacggccccggcccgagccaaaccgcttgagatctaaacaatcaatcaacatagggaaaacttgcagatcgatcgtgacgagctagctgtagacgatgatcaatggaggcgcaaacatggcatgagaattgagatcgaagacgtaccgccgttcagggcatgggaccccgcctcccctgcagcgacgaatgtcgcagccgcagcggcgcagccgttccaccgcctcgtcgatcaaacgctgccgccgtactagctccccgcgcgacaggttgaatagaaagggcagcctcgtcgtcgtcgtcggcggcggcggcggatcagcgtcctcctctctcgcttgttgggatcccatgtcgctgtgatccagccaagatctaatgttttacaagaaattctcaaaaaaaaaaaaagagaaaagctttacaagggaggctaaagtaaattcggcc

SEQ ID NO: 35972 - DNA, 1501 bp, Oryza sativa
cagcgaacagtgggctggttggaggcttgcagcaagctcaatcagccggtgagtccgtgactccgtgttggtgacttggacgaaagaagatgttcgacctcaagcatgccgctgtcgatagccgacatggcacggggagctcgctccacagccgcaggcgagaagataagaagcccaatttgcatggatgattaaggtaataaatagcgtttatagcgcccgtaatagcggccactatatagctgtagcggacctctaccgctacagggtagtggactgcaaatagcgtattggaacttaacggccgttatagcgcttcgcggccgctatagcggcccactattgactttattagatcgctattaaacgtgtagtctaaattttaaactttaactaaaacttgatgttaatattgatatacagttatttttcttaattttgctcttggaacttagcatccgcaatagcacctactatccgcaattcgctattcaaacactaatccactaccaacccgctatacgctatttattatcttgtggatgatgcatccttgagctttcccttcccgaattccagttccagctactgagcaagataagtcagcatgtcatttatcaagacggcaacagggagaagaggacgtatattgtactggacttccggggacgtacgacgaatgttaagatgcctcaacatctcgtcctttgtcctgtatgactggatttgtatgtcagctatcagcataagcggtcaatccacggcacggcgatttgagaaacgaagcacgcggatgtaatgcaatgttattttcgaagtgtttttaaacccttggccatggggcctggcacaaccacacacgagaaaagactcgtatatactctattttaggaggcaaatctccgggggggaagaaaatctgccatctagcttgatcgctccaagaaaggtaattagtttttttaacctttacttacggtgcttaaaaaaagttttctaaacataatttcttatacatctattatgagctatggaatgattacaattatgaaacatgtcaggattaatttttcgttgttccgatgtgccttgcacgggcaccattctatgcctgattttcaaacatatgactttttttattgtttgatttgcatttttaaaatattgttgtagcgttaggacatgcatattactagtatatatatattggagaaacaacttttactgtgatatttatggatattataatcaatctaaattttccatattttctcatacaatgaaataggccaatttatcctatcaccttaatcagtagcccaagagtataaatgtctactcaatagatcaatggattaggtcgttgccgttggtagaagaacaaccttgcacagactatttatgttcatgagaatgtttttggcttatccttttcaggtcataaaagagataccaagcccttacataacaaaacataccatggttgttccatcggcattgc

SEQ ID NO: 35973 - DNA, 1501 bp, Oryza sativa
aatattggacttaaccgagaaagtactaattacattgatacaagcgaagttgacggaacttatttctcaccggagatcgaaactgatgcaacacagctcgaaactaagaactcgtagaaaactaaattatggtggtgatgcgccgaaagttatatatttatctggtcatagttaccaagactctgggcatacatacttataccctcgggctaaaacgagtctgctcgaacatgattcgactggcttaggattctatctccttaataaaaggaaaattaatacatgtcttacctatagaaataaatctaaaaaaaaatctaactaaccaaacctatcctagattttccaaccgtaccaagccaaatttatagtgtcaacttctccttttgacttgccttgactaacgacaattgtcaaattttgccgttaacagtttcttacaatgatctagctcgagctacatcaggcttcttcgagtaaaacctaataggaagagaaatctatggttcatagttactgacttagttctaagcacgacttagtagatcaaacttaactgatgcatcactaagtatgaaaagaaacataatatctagacaatcaagcctttgattgattttcagggtggtggataccttagttaatctaatctagcaagataatttaaccgataccagtataaaccctaaaatgaatctcagccgatatgatcaaattaagatgctaatctagattaactaagatatatgataaataggtaggtaaatatatcaaccgatccagagtgatccaagagggcgaagtgatgtaaccttgaacaacatcaatgtagctgatacaatctctagggccggcgaaatgtaggacttgccccttcaccggagatcgaactgaaccgatgcagccttgcatcaggtgacaagtttcgccggttgataagtaaaaaccttgaaaaagagggtggcgatgcgccgagagtagttgtattgatctgtgagatagtttacaatgactccatgtgtacatatttatatccatgggtagatactagtccttattggataataaagaaacttttctaagataaaaaggaaaacataaagtccttatcggacactaaacacactctcctaaagataacaagaaactaatggactcttcctaattaatagataaactctgcatcctccttttgaactcggtctcttatggataaatttcctttaattcaattaatttccttaaccgaacccatcaagaatcagactactggcgactgttagtgcccatcggccgatttgtcacaccccaatccggcaccgccatacaacggcacctgacaagagcgtgtcgtaggaaaaacggcgcgaaccgcttcatacgaaaccacgatcttagtaccagtcccaggacatagcgctggtacccacggtgacaaatatgaatcattgcaatccttaaaataaatagaggacttatttaccttaacttaggttgcagc

SEQ ID NO: 35974 - DNA, 1501 bp, Oryza sativa; identical to SEQ ID NO: 31219

SEQ ID NO: 35975 - DNA, 1501 bp, Oryza sativa
gatgtctacgtaccgagcggtcgtctcccatcggtgtcgagatggttggggaggtgtgttgtggcttgtgggtggcaggtgggacacatccacgactccaccgccgttcactcggtgcacgtttggcacaagcacaacccaaggcgcaggtcgatctcgcaatctgccgagccgatgatggttgcctgccgatcgaggaccgtggccagattctccccgtaggcccatccatccaccgagataagggtaatgacgagagggacgcaatcgtctgtacgagtacaagggaggggaggatagcggcggtgcggcaagtgttgtggggaggcgacaaggaggcaaggacggaaccggataaggccgacccaagtcaagttgcgattatgttgatagtagttgggttttttttacgctctcgccaaacccagtatgctccttccgtttcgtatgattttcttttctaatcaaattttattaagtttgactaaatttatagaaataactaacgatattaaacaccaaattaattttattaaatctagcattgaatatattttaataatatgtttattttgtgtaaaaaatactacaatatttttttataaacttagttcaacataaagaaattcgattaagaaaaaaaatcaaaataacatatataatataaaatgtagggaatacttgataagccgtaggcatcgtgaggtacgttgagtggagtttgtgcgtctacattgtacggagtatacttgcctagtatacaaacaatgcttttttttaagtaaatgtaagttaattggttagaatttttatggtgtaattagactacccgaatttaaatcctagatttatcacgagcgactgcatttgtggctaattattatttcagacactcgttaccagttaggcgaccgtaatgattttgtcaatttcaagatatattggtctagttttctggagatactcgtaggggtcaggtgcgcgtgtgtacgcacgttataagctcctgtgttactaagggaccaaaacattcaaattttttcatcctttagatccaacaccgacatcattgctagcaaacccacggagagtagaaatataataaggattatcccaaaaattaggcaaacaataggggtctaatggtgtagctacacactatacttactttgtaaggggggtttagatctaagggtgtaaagttttggcgtgtcacatcgggtattatatatggtgtcgtatggggtgttctagcactaataaaaaaactaattacagaatacgtccgtaaaccgtgagatgaatttattaaacctaattaatctattattagtaaatgtttagtgtaacaccacattgtcaaatcatagagcaattaggcttaaaaaattcgtctcgcaaattagtcgtaatctatgcaattagtttttttagcctatatttaatactttatgtaggtgttcaaacgttcgatgtgatagggtgaaaatttttggggtgg

SEQ ID NO: 35976 - DNA, 1501 bp, Oryza sativa
cgcacattgtcatcgtcgctggtgtggccaccaatgcgcgcgcgccgccgagaactgaaaccgtctgcatatgcaatatgcatgccgcagcaggcgtcggatatctcgctggcgaccattaagccaagtgggttggagtatgatgcaccaacaacctacgcaggcaaattaaaccaactgcctcaacacccaactgccaaacggccggttttagtggtcaatccgtccgtgggattgctaaattgagcaggggcaccaattgtgcaatggttccgtgccagtttgcttagtactttacatgcacttaattaggacctgattaatttgtgcaatggttctgggccaagtggtacgatgattagattcatatctctcaaatgatcgtcaggggtcaaatgttattggcagcacttgccaaagctggttagtcgctcgttgtccactgggcctctgagtggaatcggaaggggaaatgcattcccaatttcccattatatacagccctttgttgattaccaaactctcttttagtttttattatctttgtttataaagtgcacatctcaatcatactgatgctgcatgagagttcttatagagccagtttgaggtctgaggagtggccgttcgaaaaaaaaggtctatgaagttttagattataagttcagccggtgagaaacgaaaaaaaaactagttttcgtttttttattttattttctgaattctacaattacggtttctcaaaatataaaagaaaactaaattagttaagaaaaaaaatttattttaagagaaactgtagctaccaaaacttccaaaaatatataatagaatttaaaagatattatatatacaactagcgaaagataacgggctttatggcggaagttggtcagtggagaatgtacgtaggagtgggacaaatccaaagtgacatcgactgttgccacatactatatgtatgcagaatgtgatgcatatggtgtcgctcgtgaccgcctactcatgcatgcataggcatagcggaacctagataatggtgagaataaaactactccttccttcgaaaacataataatattagatcaaacaagatatattttaatactataaatttaaacgtgtcttatttcatctgaaattactatattttgatacgtatattttaggatagatatagtaaggtcgtagatatatgaagattgttttgatcttgtcgtggcccattatgcaattgagctatgatgtccttcctattctttcagcagatatatggagatcgttctgatcttgtcacggcccaatacgcgattgaactatgatgctctctctctctctctctctctgaaatttcgaatgtatcgatctttcatggtcttaatattcttttacgttgttgctgacattttttccccaaaacttcaacatatatttttcatggtctcaacttttttaatcatacgagagttgataataaccaaacaattttgggcgtataagt

SEQ ID NO: 35977 - DNA, 255 bp, Oryza sativa
aggtgagagtttagggccgttatagatgatatgatccggcgtagtgtggatccgccgctcagacaaagttagaggggtacaatactaccatctctgtttcacattataagaaacattataagatattttaggttttaaatatattcatgaacgaaactatgtgtgtgtcgatccatgtatgtgttttatatatgatgttttatatatgcgtctaaattcatatgtatgaaggagccaaaacatgaatggaaggaa

SEQ ID NO: 35978 - DNA, 1501 bp, Oryza sativa
aaaaaacgaaaagttgtgcttaaagtactgtagataataaagtaagtcacaaataaaataattaataattttaaaatgttatgaataagacgagtggtcaaacgttgcaagtaaaaactcaaaatctcttatattatgggacagagggaatatgtctctaagggtattttgggtatttttgaaaagaatgttcagtccaatagcgtattgtataacaattgataaagtcgccaatatattatagaaagagacaatgtcaatagcaaatattgaacttgaaccaactaaatgttatagaatagattctctctttttatttaaccagcagcttacacgtgaactgaatggccaacgcctccttgcatacatgtgaattcattaaatcaatatgtaaccaaatagccatgcgttccacataagactaatgcgttgatttcttttaaacacttcatttttcataggcgtcgatcaaacatggacaacagatgaagtatggtagccctagtaattaaaaccttgtagtatatttattgccccacgcataagcataccactactctgtcatatccaaatagtagcactctgggatataatcgggcaccagaccaatgccttcacgttgtcggtgttattattaaagtaaaactagctgggtggtccgcacaattgcgcggctaacacccaaataaaatcatatatttttttaagtatgatttcacttaaaatttattaaataactatcttattgccttaagactttgaaagaccaaatcttatcatcctcgtgtttctaattatataatttttaaaagtcacaccagttgctacctcttatgtcatctccttctttatttgcttactcgatctactattatttctatccattctttttggaacctttaaaaattggaattttatagtttttagagtttattgtcacattgggttttgtttttataatttctagatgtcccgtcaaatgttgtcattatactgctctacggtccgtccactgctcttctctttgttgttattgagattttaaaaatcgaacataattatcatttgggttcatttttactttctagaagtcccaccaaaccaccagcagctttaccattgtactcctctacaactcgcctgctgcctccctttcttattgtcattgagattttaaaatcgtacatgattatcattgatttttttttactttttagaagttacgaacctttaaaaattggacttggagttttattttttttataatttttagaagtcccatcaaacgatgccattatgcccctttacagcctgtccgccggctactcttattggtattgggaatctaaaaattgaacataactatcggtggaattcattttttattttctagaagtcctgtcaaccgtcggcgggtctgcaactatactgttatacaccccgcacgctgcttctccttttttttgtcattgagattttaaaagtcgaaataattatcaat

SEQ ID NO: 35979 - DNA, 295 bp, Oryza sativa
atgtgcctaccagggaacttatagacttaattttctttgtttagtaattagtactcattacaacttcagtgagtttaagttctgtagacttgtatgtttgcattcagtagctgaaaaaaccgaacccgtataaagaaacagtagcaacaaaagaagaatttatattcctccatggcgcctccaatgccacataaaagtatgctataatttcactgcacaaaaaatgatcctgctgctcacattatcgaagtcagtgatacagtaggacttattttggggggaaatgttgcagagt

SEQ ID NO: 35980 - DNA, 930 bp, Oryza sativa
agggggctcggcattgggttttataggtggcgaggatggagcttcgaggggaaggaaggagggctcacgggcgtggtcaaagggcgtgggcgacgagctggctcggcgtcagctgctcctctgccatggcgctggaaacgagcgaggagagctggcgtcggcccgagaggggaaaggggaaaacggagggggagaaagggggctcgcgccttgccgatttcgggagagagagggatgggagcgagaggcgctgcctctcggttttggacggacgctggtggagcggcttgggcacgcgctgcagagctcgcggcaggcagcggggccgagcggcagcgcggcgcaggcgctgacgacggtggcgaccgggcggtcggccacgaccggcgcatgcgcgggaaccaaaggcggtggggggttcaaatggcggcggcgggaatcggcgccagggagagaggaagcagagagagcaagagagagagagagggtggcgctctctctcggctcgggcacgacgcacgtgcggaggggaggggaaacgggctgagaggagggatgggccgagggagaggaatttggcccacaaaacagagggatgcaaatagacttttgcagaggaattgaattggagagaattggagtttggaaatggaatttggatatctttggagtcgggcgaatatttagcaaggttttgagatttggaatttgaatttcgaatttgattacttggactcagggaaacagggaggggtcaaggaatggattcaaggtggactcggatatttgtggaatcgagacaaatattttggcgatgattcaaaggaggctattgacctttggaaaaattgaatcggaattggaatcttgaggtggaggattttgatggcgatgaaagggaacaacaatggagatttgaattgagatctt

SEQ ID NO: 35981 - DNA, 1501 bp, Oryza sativa
aacgtactagctaatactctagtacaaacttatataaacagattggtccatataaacatatcaaatataaatcaagcatgaaggtgtaggaatctagccgatactgactaaaacttgatatgcttatataaaacgatctatctatataagtggcgaatatacatgaaacaggggggtgaaacatgcatattaggtaagatcggctgaaacccgatactatccttattatgcctaattgtaggctagtttgcatggttctaagcatgcaagggatgatgcatcttaaagtatgaaaagaaacatacagtgtagacaatcaagaaattagacacttttcaggatggtaggtgccttagctaatctaatctagcaagacaatttaactaaaaccaacacaaaccctgaagtgagcaacagccgatagagctaaattgagaagctaagaatagattaaagacatatgacagcaatgactcgcgatgtcgagcctaacacgtcagcgcgggccattgagacgagttacctcttgcgaagaactcgctggaaaacgagaaaagtaaaacagtggcgatgcgccaaagttgtattggattggcttccgtattacaatgctatggggctcatatttatacctcgagtacaaacttagtccattatggacacgactcaaacatttctaaagttaagaaacaaacaagaccatatacggcgatctcttaccaaatctctaacaaaccgactcaataccctaattattagatacagttgccttaatcgagctctatctctatttggcaatgacggtgtaacgctccgcttttcgtgaggcgttaaaaactaattcggcaaaatcctaattgcgaaaattttcgttctttgtgtgagagtctaagttgtgccaaggatctcaattcaaatcccgttgttccctctcatcgaaatcaaaatcctccgcctcaaatctcctctcccaattcaagtctccgaaatctaaattcgaaagtcaatcccttcctttgaatcctcgccaaatacatttccaaatcccaaaatgtccaaacccccgttttgtttcctttccttgactccaccctatgttcccgagaacaaatacccaagttttccttttgaatctttcccatgacttctccttgaattccccttgatacatccctaaaccctcgagttcgagtatcaaatttgaactcgaatccaaaccctaaatctctccaattctatccaaatcagttttctctgtaaaagtctaccttacctccctgtgattttggatgggccgattctcctcccccggcccatctcccctcccagcccatcatcttcccccccccctcgcacgtgcgttgcacgcatgtgagccgagagagagagagccgtcgctcgctctctctgtctctctcgctctcgctgtttctctctctctctctctctttctctctctcgcgccgacaccgcttcccgccgtcgccgcccaaaacctcca

SEQ ID NO: 35982 - DNA, 1501 bp, Oryza sativa
ggtctatactgcctcaggaccctttttacatggttagggatagttgaggggtagagatttctagcattgaggattggggatctcatataaattcgatgtaaagttaaagggacgtcaggtgaacttattccacgccgaagacgcttcctcgcgagaagcatatgcagccactagcccactaccttaagaggggaaaaagataagaaaaggaaaatcttcggcggtcctggcggatttcattcccatttccccaacacgcaaatcagagaacactggcaagaggacaaactactggcgacgaaaaatcgaagtaaacagtaaacaccaaaggagtcgctctctcttctcttctcttctcttctcttagcaatgggccatggcagtggatgcaacactgctgtagaggccgtggaactgcgttttaaaagttctgtatccaggggcctaaacccgctgtatatgcaagttaattagtatctctagtctacggcaaaccgacgattacagggagagttcgccgtggcggtgctccctgttcgagcagaggttcgttaactttctcttgttttgttttctgattagactgtatgcataaagcactgcatgtcttatttactgcgggctctggcttgaataggcctaaccactcctagttcccgtctacctacaatgacaatataatacttgtgtgtgcttgacttatgtgatatatctccacagataacgatgtgagagagaacgacggaaatagtgacgggagtggcatggttttaattttaaaaatttacagtggctactagccgataacgtaaacagtactatagtagtgacatttttctgatttgtcacatttacagtggcatggatccaattaaccctatacagtaccatattcactcgtagattttattatgagacagataaagcaatagcgaagctttcttttctagccgtatgtgttttacttgggccgtacaaccactgctggtcactttgtacgttacgcacgcgctgtgctcaacctctttgtggacaattgcgcgccgcgactgacacttcgacggtaactgctagatatctgcagcatgtgaagtaaaactttggcaagaggacgtaatactggtctactgcctccggagatggaaaatctggatcggtaaaagcggtcgagaactcgagatacggcagagaaatggacgagggcgccagatgtgacactgctgtagaattgtgttttttaaggccattgtccaaggaccaactgcccaatctggtactacttgtcttcggcaaaacagatttacagggagaattcgcaaccgctgttcgctccgagtggagattcccgtcgattcctatcagtatgccctacgcactgcctcagcgatttcatattgtgcacatggacataaaatacatcatatgcctattcattcatattttgcaggtgatatgtgttccgagcaagagcaacccgtgaaactcgccatgtttatacaac

SEQ ID NO: 35983 - DNA, 994 bp, Oryza sativa
cttttggcaccaaactttggctatgccctccaaagtatccaacaggtaaaacaagtttgaaggtcacatttcagcagtgttactgagcaaaacatggcatcagtaattcagaatcgtcgcagtactaatgtgctcccaagtgcaaatgcacctataattttaccatttgaatcattgcaataagataacatctataatcctcaggaagcttacatccagcaagaccctttttgtgatgttatcatgttttttttcttgaatggaatcagcacgagattatgctatttcattaaatatagcgagagaaatgtacaacccccctaggagaagaaaggaaaaggctatacaaaactatacgtgtgaaggatgaaactctctaagctttttagctccggccagaacccaagttcatgcttcttcctttattttggccaacagcctaggatgtgttattttccatggtttcccaacccatctcctttgtttttcgcgtgtacgtttttcaaattgctaaacgatacatattttacaaaatgtttatatgggaaagttgctttaaaaaaaatcatattagtccattttcaagtttttatagctaatacttaattaattttgttttaatctatcgctccattttccgtgcggagaggaggggtttccaaccccttcaaaagaacacaaccttaaacttatgttcgaaaacacgctgatttctctccttccttgatgttatcatgttaaatatgttcaaatgacaacacctagagaagtagatctatcgatattggtatatccatctattcgtctcctagtgacaaaattctggcataaaatcgtacccgttcttttcatctctaccctattaaaattctatagaataaaaacttgcaaaaactttgaccacaccaaaaattccagtggtgtgtttggttgggttgatgagcctgtataggagatggtcgtccgagtttttgtagtgtttggttggagggca

SEQ ID NO: 35984 - DNA, 1501 bp, Oryza sativa
catccaaacgtaagtaagtccaccgttatttttatttgtgtctcttgggtgttcaccaaacagacggacatgcttgtctgtgtaatatttcagacgtttgagataactgtaccagaattgagcacatatattagatcttagtatgctcccatggacgtttaatccaatgaatgatctattcaccaaagccgcgatgtccatacatatggatgctagcttaggctcctctacaggacttgtgctcccaaatgcaatcgtcttgaagaaataccaaaaaacttcttttgggagaaaatctaattggagtgcctttgttgttccaaacaattctatcttgtttgatcggctcattattatgatcttactcacaggtgctatgtggtctcctctaaggctgtgcaatatcttcttccatgtttcatcatccatctcatcaacaagttcaatgatagctaatgactgtttgcctgagacaggatttcgatatttgactgcgccggtatctggaagaaacgccatgtctccattattctcaatgctaccaaggccatagaaaacaattgtagagaagtatttacgcaccctttcatcatggcagacatgctcaacaagagtgctcttcccaaccctgcctgggccaattatcggaagcacatcaataacttcttcaccgccgggaggatgtcgtgctagcaggaagttgatgaccctttcctgttcttcttggcgaccaaacatgcagttctctagcaacaagtagctgcaataaggttgtcgactcatacgagggtagctgctcacaaacacaacaaactcctgcatgtctgaaacaatgctttccaggtgaccaagcatcttatgcagctcttttctctccgaaacttcagataccattttccttgttgtagtggagaagcaaaactgctttaatggattgaaagaggacagggcaagagagtgatcacgcacctcatcttgagcatgcgcttgaacgattcggcacctgaaattatcaaggaagtagtagcccctgtacatcatattgctcagcattctaagttgcagcagcatagcttgatttgtgatgtgcctactgtcagcctcctcaacgatggcttggatccggagcagcaagcgatgtaagcattgtagattctcctcaacaccctgatgcttctggtagtaactgtcaaccatgaaggatatggacctgctgagaagatcaccaagaactgcagaaaagaaggtatccatagtgatatatcttgtgcttagaaaaggcaaagcaatcaggaatgcaactcaacagcaaaatgccaactctgaaaacacaaagctagcgaggagtaaagagttgtcatgtagctgaattgcatcgtaaggccgctgtctaggtgcaatgcacggaacgctttgcacagtgggtcatttattgatggctcagttgatttctgcacaattagccataggtggccagtgaaaaggcttgtaagaggcaacg

SEQ ID NO: 35985 - DNA, 1501 bp, Oryza sativa
tataacatagatctagagaccggccggtggttggtggcggagatgactggcgctggctggacattgacggcgtcgcggcatggaggtggtcgttgctgctcctccatggcactggctagcaaccggatctgaaaatgtacttggttgtattcacatgagcataatgtactctgctatacctgaaaatgagaaagcaaaaattaaatccggactatagtgttcttgggctcgccttactcccagcctacaattaaacattgtgctactcagcggaatgagaaaacaaataccaaatccagaaataaatctatttggtcaagatgatcggaataaatcattcagctgcaaggttcattttctagattttctagttcaactgagccgaatgaatcattccgctgcactatattacagatgggcaaatggcacagttctagaagggttaaaactagagggtgagcatttaagtaaaaccaaatagatccgtctaaaacaatgataaattctcagatcatgaatcatgacacatcagtaaataacatttgaaaaatagatttttttcctccgtgatgcaaaactgggataaaaaatggctcattttttccttcgcataaataaatgggaatcaaggagttttaatccttcactgataaaaaacgttaccatcatcacgttaataggttgtagattattttattcaaacacctatgctctgttgaaccacaaaatttcagagagcagttcagagaaaatcaattgatatgctctgttgaaccacaaaacttcatagaactgctaccgaattgagcttctagagttttcatttatcaaacatatcagagaacctgatgatgatgctattggcagttttccaaatattgcacgcacaaatatatcactaaacaaatgaaattcacatgggaacacttttctgaatatattgcacaaacaactcatgactgaacaaatgaaaattaagatgagagcatggttcttcatgcgttgcaaaaaaaacctctggtatcagggctattcactcatgatgcttgatccagcaaaagcagcaatcatcacaacaatacatagaaccaaattcactaagaatacatgatcatttatgaaaatatgtccaattacagctatttctgaaaatgcaagctctaacagatagcaccggtggtttatacaagttttgagttgtataaatttgagattactgtcgaaattcaaacatacacagatcatatcagccatgacatcttaatttatgaataacgctagcacaagtggcttggataatttctgaatcatataaattttgaacagaacacatgaacattgagaatttagcaggcttattacaaactacaaagatataaaggggcaaatttttcatttaatacctttatcgctattgatttgtaatacttggttactgctaagcaagggaataatattaagatgctcttagaacagctctgttcaactagatcgagaccac

SEQ ID NO: 35986 - DNA, 267 bp, Oryza sativa
acaaacccaaccgtgcgggtgcgtgtgcgtgtgcgtgtgcgagttggggtgggtgggtgggtggtggtggcccgccaggcatgcccgcacggttgggtttgatggcaacgtcgcaccgttcagttgatgtgtgattcttgcctctctgttttcctttttctttcttcttctctcggtttgctggttgatttatggggggtgtttggttcgttcttcatcgtttccttgtgtactgtttccttgaccagaacctcgcttgcttgcagt

SEQ ID NO: 35987 - DNA, 1501 bp, Oryza sativa
ctactagtgcggtgcctgagcgttatcccagccgtgcgatgggatcatgaacggccgagattaatccctggggattatttgtgggactttagggcaaagataagcacgccctcagcctcaaaaatatctaaagtataatttgctagtgacaaggatgaaaggtgcagttattactactagagatacagtagggtttttttttttaatacacgacaaacacacatgcgcacacacccaataccaacacttacactttatgaatgtgcccaacggaaccagaaatacatctttgatctcataaaaattatgttgaaagatcacctacttgtacataataatatatgttaatcataaataaaatattgaattataggtagcacattttttagaactaaattttttttctcggggatgagattcgtcggttcattgaataaagtcacttaagaaatatctttagcatctcgccgaagtgggcaaggaagaggcagatggagagaacttactagctagggattgtggatgcatcttctacaccactttaactgtgacgaacattaagtgcaaaccaaaccatctttattgaatcagcaatggttgggtttagaaggagactagcataactatgtctcaagttaggcgagagagaatgagggcgatcataagggtataaaataggaactcaagttgattaggaagatgggtgattagtggggtacagaggtgaggaacatggtatcgtaacagagagaggagtggtgaatcaaagagggagcgataaaggatatataagggttaaggggcataagtagcagaaaaaggcttatccactggatctcttcccggatacccaaaaggaacctccctctcacaaataaagaagacaccattgctcaagaaggagaacaaattacatgaagcacttgtaaactagatgttattacaatattgagagagggagggagaatatctcccaccaaacactaatactctctaaaatcttttacataggtgtgcttctccgtcaatataaattaaaccttttatctctttgtaataaaaaaaaccccaaaatcagcttaaccatatctacttttctcaagctacttcatgtgcttttagcaacaatgtgctatggttagagagcgcgcaacatgctaatcacaaaaattaaaggtatcaagatttctttttaaatatagaagtttatctcatttcttgtggattgaactaattcatgtgaaaaaaaaactataacttcattcgtccccttacaaaatctaattgaactattccatgtgaaatcatgggttcctatggagaccttaatatatgttatatttaaattaaggtgaaaaacttaagaattccttaggacatgtgcaaagtgaggtgataagggaggtgtaattaagaagttttcggtatctctagatctagagccaaacattgtgcagggtgaagctaacatgaaaaatcttggaactaaagcatgtccaaa

SEQ ID NO: 35988 - DNA, 330 bp, Oryza sativa
  unsure (1)..(330): unsure at all n locations
tcatacggaagtgtgtgaatgacggcaaaattgttgtggagttcgtccggattaagaagcagcgggcgaatgcattaacgaaagaattgccgtcgncaaaagctggcgacgccgagacaccttcttggtgttcgttcactaggcccacggcagaattaagggggagattgttaattaatttcagttgtggcccaatgcaatcctattctatcgaaggtgaccggaagtttatctccctctcttcctccctacagtcattcccctcgccctctctcacgcctctcgcgtgatgggtccggcgacggcgaccgcaggtggatccgcccgcaa

SEQ ID NO: 35989 - DNA, 1501 bp, Oryza sativa
gttgcaatcaaagcatctgggtgcattctagaagttgagatcagtgtcagtccttaatactttgtccgacaaacgacaagtgccagcttttcctcatagagaggcctgatgatgtaggaaagccaactgatagacttgagttgactttacacacacaaaaaggaggaggaatattaatctgatggcgctttatactactattacattaggcgcaaattactgctgctactaaataccacggctttaacgagacagcaacccgtctgcatgattggagtacatgccttgctgcagcctgcatgggtggcgacctaacctggaccgacgcgtcacttcggggcttcaccctgtcggctctcgcggtctcacccgtactactggctacacgaacccaacccacagtgctccgcctgacggtacggtgcgtgcccccattcgctgcacttgcccatgcatatgcttgtctcgcagcgcagctagcagctagctttgctcacgttgtgcacggcgttttttttttctttccatgacctaatcaacgaaacgacgcctcggcttgaagattgatttctggcatgttgtgcacgtttcgccgctgaccttgagccgcttggttgccgagaaaccacagctcgatcgatcgatcgatcgattttgggggaaatggggatggaaatctgtcgatctgataggttccatcactcttggccatagaattatcttttctcgtcgtcgcgctcacggagattgctctcccgtatcttcacgtagcagcggacgcgcgcgcacacggcagaaaatctccatcttgagatttaagaataagatcgataggctcacagtgacactcaattccgatcccttcgttcggaggtttgacccgatatataataattagacagtgtatcattcctgagtatccttccaactttattaccaagtgtttcgagtctgttccacacaagaatcattaaccaatcgccacagaggccgatcgatctatccagctttccagctgctatccgttcgaaaaagcttcagaaaagtcaaacgacaagaagggcaataaaaaaaaaagggtttcagggtcaacacgactgagagtggagttcattggctgtgaatgaaacaaacaatcgggtcactttgtgctgcaaaatcttgaggccacatgaggccacgtttcccagcatttccacatgattttccggtggatatatattgcgccacccccatgctccatctctccccctcctatccatctccacaggattttaagcgactaatttaatttgattatagttaagtttagttaattattgctgatctgaaaaaaaaaagtacacacagagtcgtagagggagaagtaaaagcgagtgggatggccgtctcttccgctatataaagggtcgcttcgcccaaccaaccccctcctcccccgcgcatccatggcgaacctcccctccaccgccgccgccgccgccgcagacgcctccgggtt

SEQ ID NO: 35990 - DNA, 1501 bp, Oryza sativa
tcctatatgttgctgtagctgatgctatggttaattggctagcatgtcacagcaatgttaattgcatattttttttggggagactagcatagaatggttagttgtgtactgcataaatattaggcagcatgttccttgcctaatccatcaagtccatctaacttctttaggtctcaaaatcttgtgatcttatctccaaatcacacattttgaacaggtgtactgctaccgttttaatttatgtgtccactagaaaccatatacgaagtttcagcaaatcttattcaattgccgtgcaaagttgcaactgcagatggataaataataaataaggatggagtagatagataggattagcccttcgaagaaagaatagtgatatatgatatttgaggagttttacctttatcttgagatacctaaatttatattaaaatcttttataccttaaaatacttagtacctagagatgtgtacctccaggtatacttctcaaatatggtaaaattaccctataagattatgtcatggtacataccataccttattaattgatgctttgcctcatcttttttgaatggcacttatgttttggacatgtatatatttacatgttattgacaatttagcgcatgctgacaaattaaggaacctaatattagtgggtcgcggctatatgtttagtttggccactttagctttaattgcagacataatattaatttccaaaaaaagagaaaaatttcaatttattgtgcatcttattcacatgttcatagttcctcctccttttttttttgttatttcacattagttaggcactgtttgtttctgcttaagattattgtaatctagattattaaatcagattactctaagctggattataataagctgatataaaataagccacgagttatttgtttctctggattattagaggcatctaagagtagtgggtctttagccactcaataatttggaaaaagctcctctagagaagattattggattatagtaatctagcttatagattataataatctagcataataatctacttgtttgtttcagtttacaactaataatctagattataataatcctaagctgaatcaaacagggcttagttccattttgaattaccaatgtcaaatgaaaaatagaagggctgggtatgtagtccttgatatacgatgcagcgacattaggtttcttgcgatcgaacttatatactcgggttgacttgatgtaggtgctcggctaataactcttaattacagttttgataccagtgctctcgtttatagataaaatgtgctcgtagagcgcgatagtgtgtgcatgtacatgttcatagtaataagtgtgtgtagggtgagtatattcacgtgtatatgagcgtatatgttaatttgtggtttgttccgaaaaagaaaaggaaaaattatggctagaggcacacaataacaggtttgttggaccaggctatcacatggcc

SEQ ID NO: 35991 - DNA, 1009 bp, Oryza sativa
cccccccccccccacacacacacactttgatacatcagctgataatctgatctgttaatacaaggctcaagtatgccaacagtcatgaagaaccatgatgattttttttatgttaccaacagaatgatgtgttgttaagtactctatgcgccgtttaaggattccccatattttgggagattaggcttgaagtttaacttagtgactagatatctgcagccaattataattttttctgtcttatataattttatctcacttcataaatgaaggtacggatgttgaggaaagcttatcaacaagtatttatgccatctattaatagtcagagtagctttgatgagagacttgctgaactggtaaacacacattggccatctttctagttgttacttccactccatgtatttatttatttgggaatctgtgtaacaggaacgggaaattgagttatcagaaactcatgtatcctatatggtggaatctattcgcatgtcctttggccaaggacgtcgtggaatttgcaaatttagaagttggaaccgctgaaatttctataaactttcaagttttactggcaatttccgagacatcacttaggtaatgcattcaattatcaaactttttgtgttatatgaggtggatgataatatttttgggcaaatgcgatgtcataagaactaacttatacaaaatataatcatggaagagacaatccaactccagaacgaggaaatatcgttccagaaagattgaacacaaccaacaaattgaaaactgcacacaaatgtgcctgaagattgacctggactttcaatcgtgaaagttgaaaccaaccaaaccaacttcttctcttactgcttagggaagtgcatgagctcacataaacatgtggagatacacttcttttcccaaaaagttgcttcctggtgtttcataatttctagaataagttttggattgattctggttgggttgttttggtcctcatgtttattgtatgtttctg

SEQ ID NO: 35992 - DNA, 1501 bp, Oryza sativa
acagcagcagaaaatgttttaacatgcaccacatgttttactagtagatcaatatcgattgatgaaattaacgggaccagaccggagtcagtccccattttacctgacgaacttctccaactacgttagatatacgtagagctagcatatagatgacgataatcacgtaggtcatcagatgctactgttttcgtttcacagagaccagatcaacagagattaattaatccttccaattgtttacagtagtcatttggcttgcgacattaccaatatacgtgcttaatgtccgtatcaagtgcacatatgcattatttctgctcatcgtagaccgaagttacgacgatggacactaccgaaaaggcactgactgcaagcaagcgtcacttatcttgctatcttgctggctttacttgtagcggagagtggaaagaccagttcagattcagtagttttactgaacctgaacctgaccatttctaccacatttctgcatttcatttcagaaaaaaaaagtagtaatagtcttaaaatcttaatacaagcggaaaacggaaaagaaaaacaaatactatttttcagcttttcttttttgtttcctgaataattcgacaacagtttggaagtctaatacgcatgcagctaattcagcatctgtttagttatccccagaagaaaagatcatgtggccgagaagaacatcagactggatcactggaactagcgttcttgtgttggaagtcaaaattaccattcaagaaaaaaaatataaaactggttataaaaattggttgcaacgtccaatggattatatgctcatctagataggagcatatacgtacgacgaactgcggtagttgccaagttataatcaagttaggtcctcctaggcctgtagaatatatgatcgctgatcagagggcacaagcaagcgcccgcccatggacattatttctgtcgcttgaccaaagcatttttctatgccgcacatacaccttccctacaagaaaaaaccgtcgagtcgatcttgaaattaaatcctgcaaactcaaataaataactagtcggcgacagggacggactaagtacaattataatcattcttaaaaaaactagacatctcatttttaatttattccatcctaaagacaacaacgaaagacacggttgtctcaccatcggtgtctctcgtaaaatacacagagagacgaagctgaccggtggtggtggttgaagttttctatggcttttcttgacgtctcgcgatgtgagaggcgatgtgtgtgtgtgcgagcgagcgctagctaggtcaactttgctctcagctctcgctcccgatgccacacgctgacgctgtgctcgttataaacccccggcctcgccggggcctcaccaaccacggccgcgcttcgcttcttcctctgatcagagtggggtgaggcgaagtgctcgatcgggagcggtggtggtggtggggagagagagagagagaacttaacga

SEQ ID NO: 35993 - DNA, 782 bp, Oryza sativa
tggcatcttctctgaatatctgccttctcttccacagtgcattgacaaatggcttcggatgaggatttcatgcccagtatgcaaatctgaggtgatctgacaggagtccataccattggcaagtaatttttttttttggaatagcatgacaaaccgtgtccatacggaccaccatcggaaatattttttggaatagcatgaatatctgtttaagccgtctcttttttttaccaatagaaagcgttgttacttgtaacctgttagctgttactgccggtgccgcagtgtgtaaatagcacggtagtgtgtgctgctttctgctctttcatggatctctatgaacatgagatatttgaaagctgtggagtattttacgctgcgagaagaaaagaaaggcatttcataatatcttgtgttccttgttgtatacgttggtatacccctctacagggaagacaagtggcaattatcgctttttattatttttagttccagagttccactgactcaattttacaaaaccgcctcaaatttaaactcaactatacaaaactgctccaatttaaactccaattcggcgcgattcggagctcagaacgcaaccgttcgcgtatataataaactgagacgcagctcgcgacgccacgaggtgtgtctctctcccgttcacccgtccgtatccttcccggatcactctctccactctccgctccccaccgcgcgagagatattttcgcgcgccatgtcgctgcccgccctcgccgccggccgcgccgcctccg

SEQ ID NO: 35994 - DNA, 1501 bp, Oryza sativa
aaacattcctatcaaacaagttatatatctttctttcctgggctttctaaatctaagttcttatggcctatgggctcctatatccatagcatatatatatggggttgtgccccttgacttcgagggctcagtgcgatggcacagctcgacccttcttagggccaggcctatcgacgctatcattggtgctgagacattggacctcgacaccaaggtcactagtgcctagaaaaaggataattccttgaacaagtttatccgtggttctatttgtgaaataatttttcataaagggccaaagtgttaaaaatccatgttggtaggaagccaattttgaacggtgtgttgaaagttgaaactgagtattaaacaataaccaagtccaagaaactaacattattaatttagtgcattattcactctattctaaaatatactccctctgtactcgtaaaggaaatcgttttggacagcgacactgtctccaaaacacaattttgacttgttgtttctataacaatatttattgaaacgtgatatatgtatacttttataaaagtatttttcaagacaaatctattcatataatttttcattttcaaacttaacaacttgagagttattcacgatttatattcccaaggtttgatttaaacattgtccaaaacgactttttttacgagtacggagggagtagtaactaagactgcatgagatatatgtctagattcataggactaagttatattacatttggatggataactatccccttatccattcacaaaatcctaattcctattggggataagactcgaatttgtgatttatgatccttgaggtattactttgttttatattaaaataagtttataagattatgaaaatactataatcatatatgcatttaattttttaaatttacggacatccgtaagtttaaattgaataagtttaaatattttaaattttaattatgtgaaaacatcttcaccataatccatataaaattgatcccctttaatcatgccttccttttcccaacaaaccctagccgccactccctctcctagctattgcggtgactcttctaaccccacaatccatataaaatcgatccccttcccttcttctcaaaccctagccaccactccacctacccccaccattgtggcgattcttcttaccattgttttgttgttgctctagtgcaacacaattcgtcaacacttgaccacatcttttcttgtgccttttctttcttcctgttttcttttgcaccgtttatctctataatatcattgttcttgtctcaccaccatggtatacctttgaatttgttgccttgccttgtcccaccatttttcccgacggattcaacaacattaccggtggcatgctaccttagtcgttcctccaaacgcctaatctatgtttcttttaactccaacataaaaattttagcttgttagattcatcaccgcctattgctatcactaga

SEQ ID NO: 35995 - DNA, 195 bp, Oryza sativa
gatctaagctttgattctctttctgaacagcttgtcatggtaattaataatacgaaaatgaatcataatatgcacatctgttgtcagattacatcggagaacactgccaatcgccaaatccactttttttcacttagacctaggactatcacatccccccggcataaaaataaggactatcgcatcctactaagt

SEQ ID NO: 35996 - DNA, 403 bp, Oryza sativa
tctggaatgcccccttcgaatcgatttgtatcaagatagatttctaccaaggtggtgatgttgccaagggcctgcgggatggttccagttagcttgttcgcagaaagataaagataagctagattggacagagagcctaaatttggaggaagtgcaccagttagggcatttcctgagaggtctatgtacgttaagctggaacaatttgtgagttcatcaggaattatccctgtcaaattgtttttatacagatagagtgcctgaagttgcttaagattgccaaggcgaggtaaggagccaagtaagttattatcgccgaggtcaagtatattaaggaaggataggtttccgagagaggaccttatttggcctgtcaaactttggctggagagattgagcgcca

SEQ ID NO: 35997 - DNA, 1501 bp, Oryza sativa
tccaacttgattgtgaagtacaaaaccataggtccagagtagtgaaagcaatataagggacttggaaaaaaaaaaccaccctcgaaaacgtttgctctagtcactcaaaattattatgttaatagagcaaaaaagaaagcattatatcgtgtgatataaataattcatattacaatctgatagatcaatctatatataattgtatataagatatgattgtacttaatttagttagcataatttgcatgatactacctactacctaaaatagatcttaccacgcatttgcacaggccacgctgctagttaaactgatacaataacaaaggtatttcttgtagtgtaacacttatttgaattcaatctccaacttgactgtgaagtacaaaaccagagatccagagtagggagagcaatataagggacttggaaaaaaaaaccattctctcgccttttcttctcctgtcattaatatgaacttgatttttataaatgtgatgaactacgccaagactatgcacgcaactatttccagacatctggtattgatttcatattcaaaccaacgtgctttcgacctgttcattgggttggtggtcacggctgatatttcaccacttcctgagatattcatataatcagtatggtgacatagccgtggatgacacggcattcgtatgtagcactgctatccaaatcgaatacatacaagtttgctagacccgctgctctgtcaacgaacgaatcctgaccgcagaaacaaattctggaagaaccaaaatgaatttgtggaacgagaatcttgaaaggtaaaccgttcatgtgctcaaagcttatctgcatacaagccttcgagaccggtcgcggctgtcgcatatcagcgcagaatttctctgtccggttccggctgaaaagtagggggatagatgaatagtacggccatcggattcgaggttcgagctggacatgccgcaacaaccttgtccagatcaaacagggacagcagcgtttggtgatgagccgacgaggtgaaaagttgcagtaactggcaggtttgacggactccaggtcttgcctctagtggcggtcaagctgagataaggagtgacaattaagtgagtggatgcgacaatgctgtaaaaccgtttttaaacccccgggacctgggagggctgctgagcaaagttcagagttcacaaaccaccacacccagcggcaccatagacaccaagcagaacaggctgctgagctccggccgaccgaaggtgctccattctctctcctcatcattattgatatttgcaggatcgatcacttgaggtaaatcatagaagctcaaagtgaagtgcgaatatttttgaaaaattgagttttgttctgcttttaagctttgaaaagtcagatgtgttcgtggatgatcacataagcgaccatttgcctcgatcggttagcataggcagcatgccataatgttcatggttgtatatttttgcaggtaaca

SEQ ID NO: 35998 - DNA, 306 bp, Oryza sativa
tatggttttctatgttgttgtatagatcatttatgggcatatccacgatgacaacttttgtaaggactactatccagtgatgtaataaagcagtcactttcattccacatttattcgatgtgtaccagatgatgcggacatcactaactcggatacacacaacaatcctccaacggtcattcaaggaccgatatcaagagctcgtgcgcgacaattaaatttagaggtgagctcgttcctatgttcttctttgtatgaattcgagaatagattgctacctaatgattatattgtgattaggaacaa

SEQ ID NO: 35999 - DNA, 282 bp, Oryza sativa
aatatatttattttacaaaacttctggtgagtcaagtttttgctgttgggaggaggctcactcctcgtctcatttcacaagttactttgcaacaacttgtcacaatgattattaacaataattacttgttttcctctattagtttcttttcactttcacaacaactagattaaagcaatattattacaacaacactatttctcatagttaacctagctatatcaacacatcaaaacaccatctcggccctaacaacaccttggtgcctgacgacaccccagg

SEQ ID NO: 36000 - DNA, 1501 bp, Oryza sativa
cggcagtaggagtacataacactacaagcaactctgacaatcagcagatataatgcataactgcagagttaatcaaaatgacatgcatcctttctcttggatggaactatgaggaaactcaaaatgacaagtttcaatttgatagaacaaaacagattcatgcaacaatcagattttacgatgctcataccagagtttaatatttttttagttattgaactaagtaatgatgaaacttggcttctctttttgcaaaactggaacaatcatactgaaaccagatctcttagtaccatgggtaaaagaacaatggtggtcacctattcaaatacaactaattgatgtgtcgttactacaatatttgccaaaggtagtgaacggtgactggtgactggtgagatatgctatatgataattaatctgagcttgtaagtaatgcacatactgctctagttcaggtcttcaggaatcaggataaacctaacctctaatgccctaactcactcaacaaaggcacaaaacctgttattatgtttatagttcagttataagataaactaacaaaaataattctagaggatgtaaaaaagagcaaataacaaacatcaatgcatattaaatatagctaaaaaagttgaaaatatgaatagccatagaagctaacaagacagataacaatgcagtaccaaactacaaacgcctaaagcaaagccacaatacaccgcaagacacaccaacatatattatacacatataatcaaagttgagaagcacaagtattgttcaagatgatctttaaccagtgaactatctcacagtgcaagtcgagagcataccattagtaattttaattccttacctcagacaattaagcacaaatcctattatgaactgatatgaccgaaatgaaagcaaaacccagaaacaaaaacctagcacaaaagtatagagatgtatggccatctgatcagggctagcccaaaagaaaattcctagcacaaaatacttgaacattaacgagtcacaagtcaaaaatccagaaccataaacatacatagtaagagatcattagagcagatgaatatctaataagaaaacccacttgccggttgccacaaattccaaattggcaaagctaaagcatgaattcaattcgactgtataatagaaaatttatcagatcataagtgcagatgagagatcatattagaatgagtagaagatccctcttgccaatatcaaaatacagccaactagaaaggcgtacagacatcaacatacacataacccagtctgatttagaatggtgaggttgaggcctgcattttatgatgaggtatactccctaatattatagtgtgtatatacggccaagtaattgaagcatgatatgaagaaagctaattgacagttgaatttcaaacttagtaaacctcccaatctgaggagatatcaaccaggcattgccaaatttaagcacgctggaatatctgagacagct

SEQ ID NO: 36001 - DNA, 197 bp, Oryza sativa
cagagccgatctggctgaagtagtggagggcagggaaagggacgtgggggaggacagagactggaaggcatcagggaaacctttgacaaagcttctcagccttataaacaattgctagatgctgagcagtgtcatttccacagaagcaattgtccctagcctgaactgttgctataggctcctaactactgtttcaa

SEQ ID NO: 36002 - DNA, 842 bp, Oryza sativa
acacctctcgtgccttttcctctctctctcactctccctgtcgtgccggcggatcggcgagcggtggtgggctccgtgagctatcgacctatcgtcgcgcgcgcggcgcggtggggtggcgtgcggtgcggggccggaggagcgggagaggtcgcgatcgcgatcgcgccggggtggagctgtcggtgctagttgtaaagtccgtggcttggcttgctgcgcgcgcctgcggctgcagctgcgggcgagggtcacgtgcctcgtgcggttacgtacctttgctttcctttgggcgaaggtggggaacgtgggagggatggggacgccgctgccggccgcggatcgtgccgtgtgattcatgagaaaattgcaatattagtacggtaaacattggggttttgctgttttgacactttaagtggatgacaaataagtctatttatgtctatgaaatatgggtctaatatctttatagtaaaaattaatgtttgcagtgtcataattgcaaatccctggtgattcaacaggctgccccggccctcaaggctagaacaatattctgcttttcgccggttcggcccggccaggaccaaaatatgttttttagggtacgtagctggtaatcaagtggtgttctagctctccgtgctgtttgattgtctttttgaatggataactttttttaatacaaacgagaggagtcggtttgtatccggtgaaataaactgccccgttataaagcgagctaaaatacgttacaaacacaattgatggttttatttcacggcgcatgggcaacataagaaagaacttaagcagatcacattgtcagtcatcacgca

SEQ ID NO: 36003 - DNA, 1501 bp, Oryza sativa
cgtcgaattgcggaacggcgtgtgccccgtgcggccgggtttcggcacagctctgcaagcccgcacgtacgcggcacgcgcgatcgatggtttgtctacccctacctaccacgagtagagctactatgcggccttggaagtttgccttgtgccgttgtgctggtgtcccggactcccggttggccggttgataggcatgttggggagttcacggttcagtgtctcggagactcggataatgttctatgcgtgggcatgatcattaaacgggctctgtccgtgactgggggacatccggcccagtacggtccagtagcggagctctcggtgaaacgctgaaagagagagcccacggtcagatagtttatgtaagtgcaagagcgaagaatagttactggagtatctccgttacaaaataaatttatttttcgtctatctcacacataccaatacaaaagaaaaaaactaaaatactattgttttatcaaagcttaatataactttcttactttaactactcccaatacaattattacctacttttacaaacttcaatgcaatgattactctaaaaatgaacttattttggtacaaatagaatgagctaaaaatacttaatatgaggcaaaggaaataacatccttgtacgtgtacaacctacatacacatccatggcccatgtacattggttgtacattggattagggccgttgtagtatgttttttttttttaaaacaagtttatttaattatcatttattttattgtgactaggttctttaagcatggtttatatttttagatgtttgcagcaagaattaaatatgacaaatggttaactgtatgccaaaaatcagtgatgttttatattaaaaaacgaaggcagcatatgaattaattgtggtggtgttggagcgtgtacctacaaagtaagtggggtgtttgcaaactgagggcctgtttagatcctccaaaatagcaaaagttttgccgttttggaccactttttggcaaaatgatctaaacactagtagcaaaaagtaggcaagttgacatttgtaatttgggagtccatagcagcaaatttagcaaaaaaaaaaaaagcatcgggcccgtgcatgagagagacagcagcaattaatggcaaaactttaccatgtatctaaacaccaacttataaaattcaatgctaaatcttttgctaccaaaacttttaccaaaaaaaatttgccgcagcaaattgatctaaacatgccctaatttgataaactgaacaatgaacctgataaaatatgcagtaatagactgtcttgtgatgtgtgatgtttgctgtctgcctctttgggctggcactgaagattggcttttgttgatgcctgaagatggaagctggattttgggtatgttttcaaactgtattactgcaatgtattggcaagctggaatccccagccgatcctactagtctagttagatttctgtttagttcccgtttgttgtt

SEQ ID NO: 36004 - DNA, 1501 bp, Oryza sativa
ccacgacggcaccgggcaccggcggaggaggagataacgcggaggcctcgcggcgcaaactccccaggtactcgcgctccttcctccccgcaacccaccagctcgagcctcgccggcgctccgaccagcactcgccgtgcgtttctcttgcggttgggaaggggtttaccccgctcggagttgctccgccggcggagaatgtggtagccacgccgcggccgaaacctcgtggtgtgtgtgtgtgtgtgatggcggcgccgccgccgagcgcgacggtggggctgattcccaacctggcggggcgcggggtcttgctccccgcctcggcgcctgattcgagcgcgtgccacgggttcgtggttccgacgaggaggaggaggagggtctccgtggcgccgtttggttggggtttggcgaggagaggccgggtttctgacgcgagagcggatggttttggtgctatgtgcgcggtggctggcggcgaggctggtcccggttcgtccgagttgcggcacgtcgagaaggagctgacgtttagcccgactttcaccgactatgtgaagatcatggagtcggtgaagttggacaggagcaagagtttagagagcacagaatcggatggaaggagctcgaggaggaggtttacaggcgatggcgatgcaccggttgttcggcgaggggacgagaggtcaggtgatggaaggagtacatcttttgataggcaaaagggatctcagaggaacagaggggatgtgaatgagaggagcatggcgaataatgatattcagaacaatagtattaggttagtagagaaaaaaaagccaggtgatgttgaaaagcgtcggggaagacagggaaaggtagatgaatatgtacagagaagaattgttcgaggtgagattagtgaagatgaaggtaatgttgataaaaatgagcgcaagcagtttacattgcagttgaagatgaaagatactagaggtagtatggttgctcatcaatcagagagaaacatgcatgttcagtcaaatgcacggaagggtttgcaaagacagtcgacttcgatggtaagccatatttctagcccttcaaacagcagaattatattggagaacaccaagtctttggtaaaaaggggaaaggagaactttagtagcccagcaagaagcatatatgagaacaatttcaaatatcccagagaaagaaaatttaccaactatgatgtcaatgctgatgataaatttcaaagataccagcaaacaacagaaaattcagggagaggtgttgtagtgggaaggtttggagagggtgatattgattataacaaggctactgtaagcaaaagatatggcaataggcaggcaacgtctgggcatgatggtcatccaacggtcagcttgaagcgtggaaaacctgaagcaattcgaatgcagagaggggaaaatgtccaaacagggaagtttattaggagagatgcgaaagctatagacttggacgatagagc

SEQ ID NO: 36005 - DNA, 1501 bp, Oryza sativa
tctattttcgaagttttttaagctaataattaattgatcacgtactaatccatcgctccgttttccgtatcagaggtgtcacctaagaacacagccttaagggcctgttttgcacagctccagctccagctctaggagccaaacagtttcagctccatcaaaaaaaaagggagcgaagttggatggagctctctcatgttctgattctacacagtgatttgctctagctctagacggtgtccctgcagctgcaggttcaggtgaggcaaaccgtggaacgacttggagaggccgatcctgacggcccaggacggctggaccagggcccagcgtgaccggcccagcccatctcccctctttgactcctcttctccttctccactccatctttctctcttcggtatcctccacacctcgtcgccgatctcccaccccgcgcggcgccggcgcccgtccgtcctctcctctcctgcctccgccgcatcctcgcctcgcctcgccggtgaggaacccgtcgccgcacatccctctctctctctgtctctctctctctcgtctctctacctgcccggacctgtggaagattttttttcttttctctttggcgttaaacccctcctagatctggagcacttgagagttcctgctgtttcttggatccgtggaggccactactcctcctctcccgccttagcttttgtctcgtggatctgggatgggatgggggtggcttcttcacagccgagatccgtgtgccggatacgacggtgatcgaccgggacggtcagattgcatggttcttgggttcagtttctgtaaccaaatttgcgtggttctcgaaccaaagcttgtcgcggggggattcgcttcccgttcccacagagcgccaatcaaaaccgacgggatttattttaagcttttcccgattccggcttcgcccccgagttgtctcttgctcgcgtggtgttgtactacctccgcatagatgttaatgaatctaggcacacatatatgtctagattcattaacatatatatgaatgtgggtaatgttagaaagtcttataatatgaaacggaagaagtactaaatagcagtctgtttccaagacaatttgtgagtaaatttgcatttcaagtttttgcgccagtgtccggcagatcaggagctgtgtaaatttgcatcctcgcggctcttcaatccggtagctgccagcatttttcatgcgcctatacttgctgtaattctgaatgctagaggagcctcacttgttattgttatagtgttgaattctgaatgctagggcctcattatgtttttattgtagtgctgaaaaaggatctgattttgatacctagctactgaagatgtagtaaactttactggttacatgaagcacagattcagattaatcataagtaaagcaccagacctgttttaagagaatcgttggtaatcgtatttttgaactgctccatgtagaacacacaagattttgagga

SEQ ID NO: 36006 - DNA, 1501 bp, Oryza sativa
attgggccacgtggcttcctataaatgaagcttcacctctctgtaaatctgccgcatgtctccttgctctcctcctgctacacctcccgcatcatttcatcgagaacctacgcgcaaatgctgattagcacccgttatcctcacggttgtagagtttttatgaggtcgggttcacttttaggaaactgtgagattagcttttccacggggtgaggcccacgtctcttggacgatgcatgatgcatgatttaaaataatgttaaaaaaacaaatactcaatgactcaattggtacaaccacggtgcacatacatttccgtacgcctttttcacagaagttaaaaaatgataatgtggaagtgaaatacatttccatgcacaatactccctccatacccataaagaaagttgtttagcacaatgcttaagtcaaaccttggaaatataaatcattaataactcaagttgttgagtttgaaaatgtaaaaattatatgtatagatttgtcttgaaaaatactttcataaaagtatacatatatcactttttaataaatatttttatagaaacaagaagttaaaatctgtgttttggagactgtgtcactgtcctaaacgacttcctttatgagtttggatggagtatatattatactgataccaaatgaactctcagataaatttatatcaccaaaaaaataatcatttaaacatatagtagtgcatacaaacattcagaaatgtaatacaaatatgatcttcaagataagtacattcaaattccagagtattgcatagaaatgatttcttcaagaaaaaaaatggtgtacttcgagttttgaaattcgttgtaccacgagtactagttgcttgggttcaaatttagatttaaattgcaacacttatgaattgctcaaaaggcaaatatatgtacgacgttgccagaaaacacagaatacatttatctctacagcatcatacatagatgcattaagtgtgttctatgtacattttgcacaaggaaaaaatgttgaatgcacagtagtatacacgtgcattcaaaatgtaatgcgttatttctcacaagaaagaaatgctactacaaaaattcatttgaactgcaccatagtatacacctgcattaaaaattagtacattattttcttatagaagaaaaaaaatgccctcataatacatttgaactgcacaacatttatagacagatacatttgaattgtgttattaaaaaaatggattttatcatttttatagacatacggaggaagggcagagccaccgcctgactagcccaagtggccgcggaggctcactgacaaaaactccattaaatttataagttattgaatgaattgatgatgaaatttatataacaaatactagaagcgaagtttgctcgggctcaaaaatatttctcgctccgccattgtgaggagagataaaatgggaatactagtttcattactttggttcattggaatttgt

SEQ ID NO: 36007 - DNA, 482 bp, Oryza sativa
caaagggtcaaattgtcaaaatttgtgcctagagcacccaaaaacttcatattattctgacccggaacgttatgtacatatattacccctacttttaaatatataacattgttactttttacatatatttcgccattcgttttattttaaaagaaaagttgtatataaatataaaaatatggttatgctttatatcaaaataaatgataaatgataaaatgtatggttaaaaaattaagagcatcataaatttaaagtgaagggagcactaaattgtatccaattaaattacacttgaaacttcttatattaactaatgttgcatacatatatacttcgatatgtttctaaatttcacttgaaaatcactctaacctaattctcaagtgactttgaaacatgccaatacaattaagagagaacattctccaattaagttaggtactcttggctagttaggcagagagctagaccagctgaga

SEQ ID NO: 36008 - DNA, 1501 bp, Oryza sativa
taagtacatgtaagcccctactcatgagccaaatgatgatcagtggtttgcaggtcacctcgggctcggttcgtttcacaaacgagctacgaaagaggcttgagcttagctcatttggctttcaagctgagctgagccgagttggtcaaacgggcctaagctttttatccacctatgttcgtgtgtaacttttagtactagtatatttatgttaccgctattcattccaccacagatctaatggttgaaaatggttacaccacatgtcaagtcacaagtagggagataaaacattttgggtagtaaaataggatcccatctcgctcatgacgattagtccttttacttagtcatatagcccattgccccacatgtccttggttttgctctcgcggggatgagaagacattgaattaggttaggcggtgaagaaaatctatggaaggagactcctaccaagaaatctccttgctggtagtctcaagaggtgaacacggagcttaaaaaaaacattgctaaaggcattataagagagatgatggttcttagagttgaagaatcaaggaaagaaacgagatataggaaaaggctaaccaatggagaaagatgatatagagttagcgatagagaaggctatgaaagggaggcaccgatacaccagccactagaaacgaacaaggaaagggaagagtattggagaaggtgttatcacaaaagtagaattgagatccctctaccttctgtctttaaacgcactgtgttttaatcactgacatatgggtcagtgatttattaggcttacacgtcagtgacaaaattaaagtcgcgtgacttcaaaactagaggagcttgatcctcatagagtgataccttggaaatacccagagctacctcctccaaaagcaaaaccccaaaaacatttttttaaaaaaacacgtatacagccaaaatacgttacacggtggcctagccagtatataagttgaattgaagccttgaaggtatataggcaactggttagacttttttttccctttgcccataataaagccatctctcataaagccatcgacctcatctcctcctcctcctctctctgtctctctctggctgttcttatcagtttacgttgtcctcatcgtcgccggcgccgccctccaaagcttcatagatagctcgatcgatcgatcccgtcgtcgtcgatcgtcgtcgacgcagcagcctcgccggcggccggagactggggagatcgatcgagagggagggaggttgagtaaggtggatccacgggtcaggcatggcaagaggcccctaccggccggcgaggaggaggaagaagaccagccaccgccttcgacaccaccagcaaagcaggagcagcaggacgaggaggagctcgccgcggtcgtcatcagcggcggcggagcaggagcagctccggcgccggagacgtacgcgcagtactactacgcggcgcgcgccgaccacgacgcctccgcca

SEQ ID NO: 36009 - DNA, 1501 bp, Oryza sativa
caatcaaaggcgaaaatgctacctagatgcatgaggacaggatgatgcccccggccgccggccggcgacgagccgaaatctttgaagggagctacacagctagaggcgaccgcgcggccgccggcatttgactgatagaccgctatcttagacgtggtaaactgtgataaggccgtgtttagtttcaaagtttttctttaaactttcaactttttcatcacatcgaaacttttctacacacacaaatttccaacttttccgtcacatcgtttcaattttaaccaaactttcaattttaacatgaactaaacacaacctaagttgtggtttaaaaagcaaagaagcctcgttatgaccggatgtaataactcgaagatacacttataaccgaagcgatgaagaataatggtaaggtaagaattttgcacttctattcctagccgtctagaaaaaaaaacacatgtggttcatgaaccaaagcttgcccaaattatatcattatattaaccatactttctttgtcaagtgtatcaaagctgatataatcaaaatcatagcacacttcaaaccagccatgacctacacttaaaaagaaaataaaaatcttgccacctattataactaattaaaaacatatctaatatggttaaacttatcttactacatgtgtgacaaaatataacaattaacttcaaccatgaaccaaacatcctcaaatgttaaaattggtccggaaatcagcaaagcatgccctaactacagctgtgtttagatttaggggtgtaaaattttagcgtgtcatatcggatatacgaacacacatttaaagtattaaacatagactaataacaaatcaaattacagatttcgcctataaaccgcgagacgaatttattaagcctaattaatccattattagcaaatgtttactatagtatcacattgtcaaatcatgaagaaatcatgcttaaaagatttttctcgcaatttacactccatgcatgtttaatactacagggtgaaaatcatacgcgatatgacagggtgaaaaattttgctaggagacatgtgtccaaatattcgatatgacagggtgaaaaattttgccagagaatctaaacatgccctacgataactgcacagatctgacctaagttccgtgtaaagaatcacctcgttttttttttatagctagctaggctagtttgtgtcattctgaatggcaaagccacaaaggtcattttctccaggaatccatatgctgcatccggccggccggccggccgtccgggctccggggtgaacctttcatttcgaacgtacaaattttggttcgtaaagaaaaagcaaagagctagctataggcggacgttggatccacgtggtcatgcttaatttgctttgccaccggatcaaacaaaatggtgaaataaaattgaaagcctacagtccaaattttgcgcatatatatatatatatatatatatatatatatatatga

SEQ ID NO: 36010 - DNA, 354 bp, Oryza sativa
atccttgcagaagtccttgagcaaatgatcagcacgatagcaggtgccagtcttttcatctttaaccatcagatctgtaaatttgtcgacatggccagaggccttcaagacaacttcaggagtcacacatgggcagtccacctcaagcatcccctcctccaacacgaaatgctaagaaggtaccaaagtagacggtaagtcaatgatgtatgcataaatactacattctcagaatgtaacaaagataatacgtactagaatgatgcctttggcacatgctgagatgtacatctatggagaatctagtactaaaaaaaaatttcctgttaccgacagtgatgataggggaattat

SEQ ID NO: 36011 - DNA, 192 bp, Oryza sativa
atcggttaagtcccagacagatatttagataagattagagcatcccctctcttcctcttctcagatctaatcctcttcctcctcccatcccctgtgttcctcccctcctccccttcctcttctcctcccctctccttcctcctcctcccctttactccgtcttctatcagccggccggcggcggcgtggcca

SEQ ID NO: 36012 - DNA, 326 bp, Oryza sativa
ggctttctgtttgcaatgggcttcctgataagttctttcaagaaaaatgcatggttaactaattataattatgaagatgtttatgcctgcccaaccgatcacagctgttgtttactgctttgatctctactatgtaccaaacttaccacatgcattcttcttgaaaaacaaacacctttttttttgttaatgttaggtgtggtagcattaatctgaactcagtttaatccaagtatatagatcattaatctgaactcagtttaatccaagtatatagattatgatatctccaaggaagaaattttttctagcttggatcctttagt

SEQ ID NO: 36013 - DNA, 158 bp, Oryza sativa
tgttgctgaaatgatgtgctgttgttgatgctgctggcctactgctagttgtgatctgctgatgattgcttgccatgctgctgctgatcacgctgatccgaattgatactactgatctgctattgttgaaaatgatacgctgctgttggttcttcagg

SEQ ID NO: 36014 - DNA, 492 bp, Oryza sativa
cctaccagaaagttcgtcctcacagtcagtttttccttgaattccccgcggacgtttttatggaatcatgcctgcagttccaaactacaactaatgaagcttgatgcacatagtagcaatagaatcaaccataatgacaatgggatggatgacattacctattaatcatttcaatgattgagttgaaagtttccctgggtttctgcatagagtctaggatatagatcatgctctagaatgtgcatattgcgtgaaacaattaacatatcattgtatgaataccagaaagaaattagtacagaaggcggtaaaaactcactttgtgttgtatgtaaagagtatgaatctctactacttaaaaagtcgtagtggtggtcttgattcctgatacaacaaacatatatgacagacacgcgtaatctcaaccatccgatggcatatccaacggcgtcaatctcctccccatcacgcgattgctcttccctcgatcga

SEQ ID NO: 36015 - DNA, 622 bp, Oryza sativa
aaatgaaattaaacacttgttttagactggcaccgacggtaagattgggtggtatctgggaaaggctagtaccgtccccggtcaattaaagaccgagccatgaagttaagcatgaaacgaccccatacaatcacacttctcgcatggggatagacctagcggagtaaatagctgagcgaaggcagtatccatgcatagtggtttcttgatgcgtaaggcaagggctctacagtggtgttgccattggtaggactaccatgtgttaatttaaacataattataacttaatgcatgtgtgtgagtcttcccttcccggatacgccagaactcctctcactactagaaactgtgtacgcctagagtgcatgaggatgaaaagttcatggagcgggtactgtcaatgtgaggttatcgaaaagctttgccgtgatacgtctcatgtgttgggacgaggctcatgtgttgggcagtcgcggagtgtgggtaaagtgtacatccactgcagtgtgagtaaaacgaatctattcgaatagccgtgctcgcggttattgagcaccgggacatgtattatacttggctagactctaaattcttaacttgtgtgggaagggttattgcatga

SEQ ID NO: 36016 - DNA, 1501 bp, Oryza sativa
ggaaacgcttgctggctctcgtcggcgacgaagccggcgagcgtctggaggttgctcttcttcgcgagcttctcgagctcgttgctgatcaccaccgtcttcttcccacgttgatctgggaggagaagcttgaactttccgaccaggtgagctaggcatggcaggccgacgacttgtagtggcagcattgtcaccttggtcttgctgagatggatcgtctccaagagtttcagccttcggatattgtctggcagcatggtgacattgctgctcatccctatgcttaggtatcttaggttccagagcttgcagatgtcagcgaggtgatcgtcgctcagagcagtggtgcactgctcgaggtcaaggactctgaggagcttgcactttcggaggttggagacggcgtcgccgccatctccgaagacggtcagcgagcggacgcaagacaggtccgtcgtgctcagcgccgccgtcgtggtgttcccgccgccgcttggatggagaggtggcggactctcttgcgcctcggaggagcacgggaggagaagatgaagctctcggcgatggacttgtgcaggacgaactcgtgcacgatgccgtgagtcctgcacctcctcgtgcggtggtcgtcgtcgtcgtcgtcgtcggcagggtgggcgacgatgatgctctggtcgacgaacgacctgaagtggccgtcggcgacgtccacgtcggtgctgttgccaagcacgtcctcgccgccgcgcgcgtacccttcggccagccaccgccggacgagcacgctcctcttgaggcggcggccgtcgttggggaagacggccaggtacagcaggcaggtcctggcggcgtagtcagggaggcccgcgtagctgtccatcagaacccggcggagcctcgcgaagctgtcggcggcggcgccgtcccggcgagcctcgggacgttgcgctcgtcgagcaggagggagccgaggaggtggcacaggtcggcgcagtgccgccccgtgagattgcccaggcaccgcaggtggttggcgacgctgacgagggcgagcgggaggccgtcgcacttcgccataagcgtcgccgagccgtgctccagctccggcggtcgctgatcgctgccgccgccgagggcgagctccttggcgtgcgcttctccgagagtctgcatcttgtagacgcagccatggcgacggatgcagcatccgccgttggctccggacttgtaggccgtgcaactgttggcgaccgagaggatggccgtcgtcacgattaccctgctgcctctaccattgttctcaaatatcgattctatggcattccactgctccatgctgatgtcgtcaagaacaattagatacctaattaaagagagaaaattaaaatgtggttaaacaaaaaaaatggataagttgcgctcacggtatacacgtgtgcaacgtataacaacttgcgaacgattgagggtcagtcattaaatcaaaataatttgacgtagc

SEQ ID NO: 36017 - DNA, 1501 bp, Oryza sativa
aaggtgatctatggtccttataattaattaatatggtgagataggatttctttagcattatttttataaataataaataagcgtttcttataattaatatggtgaagtatgacttcttttaccaatcttttataaataagttgcccgcgcatttgcgcgggcttccttcctagttattataaaaccaaaaccatagttgtcctcctgcctccccctcatgttacgtgcataaccacccattctggagaaaaccgtggaaaaaaaatcaaagggttggttaaaaacaaaacaagaaaaaaatggttaaaaaaataaccggttaaattccatcattgtctatggttgtatatatgtcgcacatccttacatcattgtctatgggtgtaatacggacatttaactatttgtcatttttaagatgtggcaattaagaatttgccactcgctctctatgacatgtggccctcatgtgattatgacatgtgaatgcagtgacaaataatttatcatcactcgtaaaagtggcgaatagttaattattccggtgtaatacacgggtatagtactagtataacaaaaaattcaaagcaaaattccataaactcaaattatttttttttgggaaaaactcaaatttaaattaatcaagaaaaaaaatcaaagggttggttaaaaacaaaatctggttaaaacaaaacggttatattagatgccagagcagttagctaggcctatgcagcccatccctatatgaacccgttgcaacgcaccgagtacttagtaattagaaattcacatattttcttcatcttgtctttgaggttggtgaggtggtcgctgttggtgacgcagaagtaccagtcggtgtactcctcctgcgacagggagttgggcgggttcgcggtgccgatgacgagcatcgccgcacgccgcggctgcacggcggccgcatgcggcttcgtccccgcggttgtcgagcagcagattcggctggcaaaggcatggcaaatttgcaaagattttagagaggataaaacgatccccttttatattttttctccatatctatactttataaatgaagaagaaaattacatgcaaattaaataaaaatcttgaatgaaattttgtaaattttatgaattataattttatttcatgtaactttgtagtttagtacctttcgtctaaggaagatggttctttatttaaatgaataataggagagtgatgagaaccatttgattgccatcaaaaggatgaaaattaaggtgactggcatttttggaaatgacagtccaaatcaaagttactaaatttatttatttacttgatgaagctctgcgtgctactgctggaatattgtatgatatgcagatagaaacaaattgtaagacgaatttgttctgttgccgcgaatgacctagcaaaacgtagaaatagaaatatttttccattttcaaagaaacaatatgttttcgtggcttcagtttctgcatca

SEQ ID NO: 36018 - DNA, 1169 bp, Oryza sativa
tgtaaaaggttagtgaaccaaatcctaggggaatattattattctaacagtatatgcattgcaagtataactagttcttctctattttggtaatattgacggtcaaaactgatcgctaacgacaatcaacaacaggtccgacccctaagcaaagagggggcagccgccactccaccccaggccggaccctccttggggaagtgccacgtgggtttgggggcggcctcctccctctaaacatgataccgccgggcccatatcacagacgcagtcagacttatataggtgtgttccttctaaaatgttatgtaggccaacatgtctactttatggtaaacattaaggtatgcaccaacttgccatatagatgaggagagaagtacatcaaagaaatgagcctctcctcctagctacccaatagcttatttcaacatcctaattcacgccatctctaaccatatacgataggttactactattgtgtaactcaaaagggtcttaaacccatctcactcgatgcactgcctatcacattttgcgatagtccctcaatgaactgatctgctagatttttagcaatctggacatatggctgcgttcgaatctccaacaaaagttggatgaaaactttgatattcatatcatgcttttcaaaatattaaatggtgtgtttcatgcgaaaacattctatgtggaagttgctctaaaatatcatataaatctattttctaagtttgtaataattaaaacttaattaatcgtacgttaataccacattgttatgcgtaaaacacttcatcttcatttacatgagtttcaaacacatagtctaattctatcactccgaagtattttaggattctcatagacttcaatcttctttttatatgtctgtatgactttatgttgtcctttaaactgttcaccttaataatcgtcatttgattatcacggttcataagtcactggtttttcaaccacggttaatccatcggaggcccatgaagtactcgatctcaatagtggcagtgctacgtcaaattattttgatttaatgactgaccctcaatcgttcgcaagttgttatacgttgcacacgtgtataccgtgagcgcaacttatccattttttttgtttaaccacattttaattttctctctttaattagg

SEQ ID NO: 36019 - DNA, 1501 bp, Oryza sativa
ctaaataaccgtagatccgtttcaggtggttcaagttgctaaatttttctaaaataaagatctacatattaaaattgtccataaattgaattaaatttatttaattctttttaaatgggctttaaatagatttaatctcgtaaaattcataataaattcatttgaagtctgaatgaggccgttcaagtctcataattcatctaaaattatgatttacatgtttgtttactttttatgtactgtttatttggtttttattagtctttttcttcgttttgcgtgttagcttgtcgtttccgtcgttgcgaaggttcgtgagtgcgtcggaagtgatcaagaagattaattgaagatcgattattgcaaggcaagtcacacagatcccaaacaatcctttgagcatgttgatcctatatttaaattctctatttgtttcaactgtgcatttattttcgaatgtcatcgggtggtgtgaacctattcctttgttatggccaatttgcattgaatgccctattccttgataccttggggtaataaaattgattagcttgaaccttatgtattggtttggttcagctaaatgttaagtatatatataattgcttagcaatgcttagaaacattagctcactaatgggatgaatcatatatactacattattatttatggttatatttaatggtagctcacgatggttaatcgtgttatgataattaactggtaattaaaatatgattaatggtgggttgtgagcacatggttttggaggtcgtgctcatggcaattaaggaccggttcgcgagctactgttgtgaaacatttaccgtgcccaccacaagccagcatgggcacgggctttatcttttgtatagtgtgattcattatagtgcgccagactgagaagtggcgaaaagtccatgggggtcgctggggagtccatgccttgtttataagggggtgattatgatccaggaacggtgcactgttttgagttgtgttgtgcaaagggtattgtcacgatttccccctttgcaatgccgtggtggtatttcagggcatggcgacatgtgtggaatcgtgtcttgtgggtacagtggtacacctctggccagagtaaaactattcgaatagccgtgcccgcggttatgggcgggttgagcaatgtttttcgtgattagtctcacacctctcacaataattattgatgattaactggtaataatttgcttagctcctggtttggagttagatctgttcagccgggtatggttgttcaggatggttgggcctgtacagcatgggtgtgctgttcagtgttgattaaaatttctgattaattactctactgttttactactcttaactctttgctaaatgctgctttcgcaaatgagcctatattatgccatcctttggaatctttgtgcacttgcatatttgctgtgtggcttgttgagtatgtcatatgctcattcttgcaataatcaatcaacctca

SEQ ID NO: 36020 - DNA, 1501 bp, Oryza sativa
ggcgatcttctcttcgtcgttgtggagctcgatgctctcgcggcggccgtggctggcaacgacggccggcgccaccatcttcaacaacgggagcgaattagagccctctggctttgctgctgcggccatgtcggccgtcttgcgccgcttctgcgcctcatcgagcttccgctttgtagcagccgtcatcagcttctcgccgccgtcactgtgattgggcttgacaccatcgcggcggccggcggcttcttcttcggcggatgggttggctccttcggctttgttgccgagcccatgtcggccggagcactcctcttgggcagcgatggctctgaggccttcgccgtgctgacgccaccggtagtgcgcgcttcaccttcgcatccagatcggagactggccgatcggcggcctcgatgcgctccggtgtctgagagagcttctccatggcgaccccgatcctgacaaggtctcgcttcacggccgccctccaccggcggacgatgtcggtggcgaggccgcggatccgctccgagtcgtgcttcctcagcgcgccgaccaccccggcgagatcggtggtcgccagcgtcctgggcgtcacgggcaccaaccgcagcgtcaggagagactccgccatcacctcgtcgagcaccgagcagagctcctccgcctcccggtcgtcctccgcgccgcggagcatccccacgatgcggcctctcgcgcgccggatctcgctgcgggagatccccaggtcggcggcctcgatctcgatggcgtcgtcgacggaggcgaacgcggcgaggaagggcttccaccggcgcagggggttccgcgcggcggccatggcggcgcggggagcacgaaacccctatggatggtggcgggggtggcggcggacggacgacgagagatccccaaaccctagctctggtggcggcggcggcgcacaaaccctagcgctggaggtggatggatgggagggagaaattgaaagagagaggggatgggaataatgtggcggatcgcgttcgtttcgtcccctcgctcgatttagagagcgacgaggcgggaattcgagtccaaagcggggattcgtggcggttgcgagaaaatgggcagtcgccagtgattgcaattttggttctaaattttggacaaccggcaagtcattacatggaccaaaattttaggatttcttgaaattttgttgaatttagtcaaagtttattcaatacagtcaaaatttgttacaattttaaataattttgataaaaagtgtaaaaaataacgaaatttcgtaactatcggtgctaacgaaattgcgcgttcgccaaaaaatcgaaattttcgccgaaatcaaaagtatagtcatcaccgtgaaaaagatttactatgtgcgatccatgtttggtgttcactgtgcagattgcctccctgataaaatttgatagattagagcaattccaacacgctcattcgcggaaaggaagacaacgacagt

SEQ ID NO: 36021 - DNA, 1501 bp, Oryza sativa
caaaaaattaattgggaatccagccatttttagattctcagagattgactatcaatcaaccgtttctcaaaatcttacactctctgaacaaggcataggcggctccaaaatctcacaatagacatttttttaaaaaaaaataatcagtctttgacaatttatgatacgcatgtttaatttgtctttgactattcttccatgatttattaaggttgtccgtactgtatagtacggagtcagtgatgatatggtataaagaaaattgaggtcattgacagtgccatgttgccaatataagactgagaaggcgttaggtgagctaattttgatattgttacaccaaaacgatcacctgaacatgtactttggtgaactacagtaccatgtggccatgtgttctttctaaaatgaactctgtctgggtttaatcagagattgtgacaaattgcgtaccccagtttcagcaaaagaaaaaaaaggtaatagtactttcccaaatcatactaagagaacgtaataaatagacaagtaacaatgctattcagatagtatcaaccaaatatgcttcatggatcgaagctggataaaacagaattaccgattcatgcccagatacagtagccagttggacagggtaaatcgaagcatgcaacaatgataaggaaatgctatgtgcaggaaaaaaaaaaatctagaattggtcatgctttgagaagagatatgttcaattgtgtattcaacaggtgtagccctgtagggacttgagaagcaacatgattgttcaatgtttcatggaatgagagatattatcatacactccaagtctccaaccatcagtgtggacatattcttcgcccacatgaaattttaattccagcagcaaggcacctactgtaagtaaatttcgaccgcacatgcccagttttacggaaatcatgcatacttacagcaaaaactagcatttgtcagatttggacgaattcacggtcaatcctataaagaagtctaagaacacctgtaacgatatttacagatgcaaacattgtctgaatcctgcaagtgactcatcagcagtagggagggtagtgataacaagtctggtggtaccgtaccagtagtagaaacgtcaaagccgaggtcgccatttcatcgagcgacttgcgggcgtgcggaggcaaccaggaagacggcggagaagcaggtgacggacacggcccagatggcgagcgccacagagaggggcacggcggggctgtagatctggagctggacgaggccggtgagggcgacgcagagcgcgacgacggcggccctgagccactgcctccgtggccccgccggagcgcgcgcgacggcgcccatgcagcggaagaagagcaccagcacgagcatggacgccatggagtaggccgctgaggccgggtcgcggcggcgggccgccgccgccaacatgctcccgaagaagatgatgcgccgcggcgacagcaggttggcttccatg

SEQ ID NO: 36022 - DNA, 230 bp, Oryza sativa
tcagctaaatgccttatgtaagtttgcttatccatgcctagaaacatagctaattaaagggtttaattataaactatattatgtaattgttaattagggttatattcaatggtagctcacgatggtaaatcgtgtgatgataattaattgataattaaaacctggataaggtgggttgtgagcatatggttttgatggttgtgctcatgacaattaaggaccggttctcg

SEQ ID NO: 36023 - DNA, 1501 bp, Oryza sativa
ctgagaagtggcgagaagtccacgggggtcgctggggagtccatgccttgttttaaagggggtgattatgatccaggaaaggtgcactgtaatgggttatgttgtgcgaggggtattgtcacgactcctgtcacgcccggaaattcactagtaatttccgaacttatttgtgcataaaatcctcgtccaagaatcagccgaggtacacaaactgacaatttaatatacagattcatcaataactaaagcgaataaatacttacttaagaggcacttagtcctcatcaggaagaaaactgcagcggaaaataaaatctagcgaagctccggctccactcccacaggcagctcaactggggtataagccaaacgtcttctccttccggatcctttttcttcaactgaggttgattgattattgcaagaatgagcatatgacatactcaacaagccacacagcaaatatgcaagtgcacaaagattccaaaggatggcataatataggctcatttgcgaaagcagcatttagcaaagagttaagagtagtaaaacagtagagtaattaatcagaaattttaatcaacactgaacagcacacccatgctgtacaggcccaaccatcctgaacaaccatacccggctgaacagatctaactccaaaccaggagctaagcaaattattaccagttaatcatcaataattattgtgagaggtgtgagactaatcacgaaaaacattgctcaacccgcccataaccgcgggcacggctattcgaatagttttactctggccagaggtgtaccactgtacccacaagacacgattccacacatgtcgccatgccctgaaataccaccacggcattgcaaagggggaaatcgtgacaataccctttgcacaacacaactcaaaacagtgcaccgttcctggatcataatcacccccttataaacaaggcatggactccccagcgacccccatggacttttcgccacttctcagtctggcgcactataatgaatcacactatacaaaagataaagcccgtgcccatgctggcttgtggtgggcacggtaaatgtttcacaacagtagctcgcgaaccggtccttaattgccatgagcacgacctccaaaaccatgtgctcacaacccaccattaatcatattttaattaccagttaattatcataacacgattaaccatcgtgagctaccattaaatataaccataaataataatgtagtatatatgattcatcccattagtgagctaatgtttctaagcattgctaagcaattatatatatacttaacatttagctgaaccaaaccaatacataaggttcaagctaatcaattttattaccccaaggtatcaaggaatagggcattcaatgcaaattggccataacaaaggaataggttcacaccacccgatgacattcgaaaataaatgcacagttgaaacaaatagagaatttaaatataggatcaaca

SEQ ID NO: 36024 - DNA, 295 bp, Oryza sativa
ttcccctgcttttttttgttctggctgctaaatgaccggatggatcaaaacgcaccgatccatcatctcgtgatttttcttaacctttccgtgacctgcaccgttgtggcagcaggacctccactgtgcgtccgccgtggcagcagccaattcctctggacgctcttcttctggcccgccgtcccgaccagctcaggcatgtatacaacagcccagacctgctcacggagcccgccgtcgggaaaggccacgtctcggcgtaagacacaggggtgtaggtcgtgcgatggtggca

SEQ ID NO: 36025 - DNA, 189 bp, Oryza sativa
tatctttaagtcaaatccttaagtgcataatttctgcaacttttctggtgaaaaggagaacaacttgtgaacacgaacatggggtgtttctggctactacatcaataaattattgttcttccctatttcaagcatgcagcttttacttttctagtcatatgtttaacatcaaattccttggtggttagg

SEQ ID NO: 36026 - DNA, 169 bp, Oryza sativa
acggatccgattaaaggtggagattaggggacccgtgatgcgcgcgaagaggatgagcttcgacgccaacttctcgctcaaaatccaacggggaatctaggtgcaagatctcaagggcgtcaaggtggcgagccagatcgtggtgcgagaccggcggatcgaggtgagg

SEQ ID NO: 36027 - DNA, 390 bp, Oryza sativa
aaaaggaaacctgtattttcttctgtgaacttagttcatcaaaggctatgatatgaccaaatagcaatgctagctacttgaaatgtgattgttgccaatttgttgtagaatttagggcctgctcaaattcgagtcttttgtcaatgtgggtattcttataagttaagctgtcgcacaaacattagtgaaagtttggagctcaaatatagttgttactaagatttatttgatatgttggtgttggagcaaggacatattattttccaagtaatagcatgtttcctttaaggcatgataaatggaagtaatttacggattcgatgatgttgaaatacattcctctgtacattactaactaaactggagaggctcggagtttggagatcgaga

SEQ ID NO: 36028 - DNA, 204 bp, Oryza sativa
tcctgcagcccggtcagtaggagatcccgacgagggcaaccatggtgtaggcgacgagctcctcccgcgacctccgctcgcctggcgacaacgacgacgagcgcccgtagccagacagctgcggcagctgcaccctgcgccgcccgctcaggaacatccgcatctcgccggcgaggaactccgcggccgcggagcgcgacgcag

SEQ ID NO: 36029 - DNA, 907 bp, Oryza sativa
cgaatgaggggttcgggtctctcaagtacttcatgtttgtctgtacagcaccatgcatgacttttgtggaaggagcaatgccgagtgtgcaaagattaaatctaaggttcaatgccaacgagttcaagcagtatgactctaaggagacagggttggaacacttggtcgcccttgcagagatctctgcaagaattgggggcactgatgatgatgaatcaaacaaaactgaagtggagtctgccttgaggactgcaattcgcaagcatccgacgccgagcactcttatggttgatatacaatgggtggattggatctttggtgctgaagggagagacttggatgaagatttggcacaacaagatgatcacgggtatggatttttcattctattcccaggttacaacttacaaggattattgagcttctttctttctctgccgtggcttctatctttaccttctatgcatcttcaacctgacttgatgattgtttgaaaccaattttaatggaagttaaatgttattgttgtgaccctgaatcaggttttgtatgctaccggaatcctcttcacgtcttcagagtagaggtaattttgtttcttgtcattttacagttacagttcatctacttaaggaattaatgggaggtcctatattttctcgggtacctagaaggtgtggttcctagtcttacctccttaagaaccgtagaatgttggccctaacacttggatcaaagaacgaaaggtgtatgcactatagtatcctttatatattgcacaagtcaagacatttgttaaaacacacccagtgctagtaatttgtttactgagatatgaattatcgccaaatacccatactgagcctattagtaaaatatttacgaggtgtttgaggacagcataact

SEQ ID NO: 36030 - DNA, 1501 bp, Oryza sativa
gtagaatgttatttgttttgagaggaactatctacctctgtaataattttaatttgcgaatatttgatagttaattatttgtactctattatcaaattgtcattgtgtgcctcggttgattcctggacgagggttaacacacatgtaagcgtttggaattttggatagaaattccgggcgtgacaccgtcaacttctcctggatcgtcccgtctaatcttgtatcgtagtgctttgcaaacagggcatgcttctaggttctcatactcctcaccgtgatataggatacaatcgttcggacatgcgtgaatcttatgaacttccagtcctaacgggcagactatcttcttagcctcgtacgttgtctcgggcaatttgtttccccccggaagaatgttcttgacgagtttcaataaatcgccaaatgccttgtcactaaccccattttttgccttccattgcaacaactccagagtggtatccaactttttgtgcccctgctcgcaacctgggtacaacgaagttctgtggtcctccaacatcttgtccaatttatgggcctccttttcactttcgcagtcctccctggcgtcctgcaacatctgaccaagatcatccgcaacgtcgttaccatcagcagctatttcctcctcgcccgtttgatttccttcaaatccaacatactgagcaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaacccctttgcctgttagcttcggccactctcaaaaaatagtgcacgccgtcaataaactctttggaccgccggtcagcgtacatccattgccgatccatctacatgagtcaaaaaaaccgtacacaaataattattcttacaataatgacagtcatacaataattataagatatctttattcatacaaaaatcataaaatattacaccaaataattcttaaaaactatttgtaaagttttaaactaattttaatgtgttttacttcttttaattttcattttagtttgttttctattatttaagattaactttcactagagttttccttctcaactattttataaaaccatgtttagcaaatgaactaaatttctatatattctttcttccccacacacattttctctctcatcaacttacaactaaattttggagacaaaaaaagtgtgcaaaacataggtgcaaatgtagtatgacaaaaaaaacattggaggatgaagttgcaaaccttttaggcacctccgatttgtatgtaatcaccaaaataaattcaatagaaattttggcatgacctcccctcttttttgaagaaattttgaagcttgctcaggcagctggaggaggaagaagac

SEQ ID NO: 36031 - DNA, 316 bp, Oryza sativa
tcgcttcgttccgacgcaaggcgggagtagtcgcttagttagatcgttgccgtagttcgttgtgttagattgcttgtttaagtttgtttgtgagtgtgtgggttgtacttgttgcttacatcaatggtgggatgtaacagcatgagtctagttcttttgcttgtcagagtgtaagatagttggtgagatagtgttaatgcaacttaaatataatcatacacagttaagagcaatatagaatttaaattaattaaataactccgttctaagggtgtctctctgtcgttctttcctgttgtctctgcttatcgtcaga

SEQ ID NO: 36032 - DNA, 1501 bp, Oryza sativa
gatgccatggcactggactagtacgcgggtggtctcacccctatgtgtgtggcgcacccggtctagatcttgttgctaggggctcaaccctggcctgcctgtcccgggataccggccgtaggcagggttgggtcggtacttttgttcacggctaggatgggtgaagggttatgtcacatgtttacgacgggttccaaggccatggaatgcggagtaaagatgtgtcttgtgggtaaagatgtacacctctgatcagagtaaatctattcgaatagccgagccctcggatatgggcaagcctagcaatgtacccaagtcagtgttttaattcttaaaatttgctcaacaactaaaatgtggaatggttggcctgggttggcttgggacgagctgggacccaggtcgggttgccagttcggtctgaatcatcgtaggccttgggttaaggcaggttcgtgtgggtccacggccttgattaataatattgtgtagctctaggatcgtctttataaaatagctttgggcaactaagtgacttttaaatgctgtttactgcaaaacctaacccctattattatccccttgtacccccttgcattaatcatgcatctgccggtgtggcttgctgagtactgtggttgtactcattcttgctctatctttctccccccttcagtaagagaagctttggagaagatgtcttaggtggagtcctggcttataccccagttgagcgcctgtgaagatggagccgtaggcccgctagtccgctgctgtttatttttgtatgtcaggcctgaagtgtctttgtaataatgtaaatattatcgatataataaagatgtgtcttttatatcatgtttgtgtggtgtaccccggcttttcctgggacggggattaatacactagcgttcgggaaaaggcaattttcccggtcgcgacagactccccagcgacccccgtggacttctcgccacttctcagtcgggcgcactataatgaatcacgctatacaaaagataaagccgttgcccacgctggcttgtggttggcacgataaatgtttcacaacagtagctcgcgaaccggtccttaattgtcatgagcataaccatcaaaaccatatgctcacaacccaccttatccaggttttaattatcaattaattatcatcacacgatttaccatcgtgagctaccattgaatataaccctaattaacaattacataatatagtttataattaaaccctttaattagctatgtttctaggcatggataagcaaacttacataaggcatttagctgaaccaatccaatatataaggttcatgctaatcaaattataacccataggaaaataaagtcatctccggccattaattaactgggaaaggttcaccacccgatgacattcgaaaataatgcatagttgaaataataatagctttaaatgggttcaacatgctcaaagggttgtttgggatctgtgtgacttgcc

SEQ ID NO: 36033 - DNA, 1501 bp, Oryza sativa
tacatcccacccatgatgtaagcaacaactaaaacccacacactcacaagcaaacttaaacaagcaatctaacacagcgaactacggcaacgtcttaactaagcgactaatcccgccttgcgtcggaacgaagcgatggatcttcttcctctggagtagctggctctctttcttcagggtcttcctcctcttcctcatcacttatgatgtcgatgacaggttcagcacgatcgggcacagcttcacccatcacacgaatcttcgaagctaactggagacgaggtggcggacaggttctctttcttgcgacgaggcgtagcttgggtgttggtggcggcgtttctcctttaagttcagacaattccttctgtagacggtacaccttgctctccaacttgcaaatcttgcctcgattccagttttccctgtcatgagctgctttgtctcgctccacacttactgcatccatagcactaagcatatgcaccacatgcataagagtggcactctcttcaccatcaggacaggtataggttccatagtcttgaccatgaggcttgtgaggatgatactggaaagctgatgaatccaactcttcttcaaagcgttgacgcaactctccaatggccaccaaagctacttcttgacaagcatggcagtacgatcttcctccagcttcaaacttaaaagacggaaggtcttcacgatcactagccaacatcacacgaacacgacatttctcctcgtcggggtcatgggaaatctggcgatactcaggagcaacttcatagcctacctcaaaagccatcaacctcagctccctgatgaatcctaacacctcgatcaaatttctcggtgaatggggaggcatctaaagaaacatagaagagaagaattaatgcatatttttctaagttagctgcaccaactagacttaactgatttttgaccaaaaaggaataaaagaaaagacacatacaaagctattttataaatattttgtaggatttaacctttttttttgacagggacaaatattttttttttgacaaataactaaaacaaaactaaaatacttaagatctattttaagcacggtacagtgtcaccattaaaagagatgagtagtactagtgccaacatgattttatcgataccataatagatgtacagtgccgactaatcaataagatttgataaagagaaaaagaaatattttgagaaggacaactttttgcttttaaaagaaaagaaattgaattaaataaattttgtgcataaccttgcatgtgctgcgaacttaattaatttataagagaatagagaagagcagttctatttttttcaaaatattttgaaggctacttaaggtttaccatttggcttatcctaaggtcaaggtggctctgataccaacttgtcacgcccggaatttctatccaaaattccaaacgcttacatgtgtgttaaccctcgtccaggaatcaaccgaggcacacaa

SEQ ID NO: 36034 - DNA, 1501 bp, Oryza sativa
tctcttcaccatcaggacaggtataggttccatagtcttgaccatgaggcttgtgaggatgatactggaaagctgatgaatccaactcttcttcaaagcgttgacgcaactctccaatggccaccaaagctacttcttgacaagcatggcagtacgatcttcctccagcttcaaacttaaaagacggaaggtcttcacgatcactagccaacatcacacgaacacgacatttctcctcgtcggggtcatgggaaatctggcgatactcaggagcaacttcatagcctacctcaaaagccatcaacctcagctccctgatgaatcctaacacctcgatcaaatttctcggtgaatggggaggcatctaaagaaacatagaagagaagaattaatgcatatttttctaagttagctgcaccaactagacttaactgatttttgaccaaaaaggaataaaagaaaagacacatacaaagctattttataaatattttgtaggatttaacctttttttttgacagggacaaatattttttttttgacaaataactaaaacaaaactaaaatacttaagatctattttaagcacggtacagtgtcaccattaaaagagatgagtagtactagtgccaacatgattttatcgataccataatagatgtacagtgccgactaatcaataagatttgataaagagaaaaagaaatattttgagaaggacaactttttgcttttaaaagaaaagaaattgaattaaataaattttgtgcataaccttgcatgtgctgcgaacttaattaatttataagagaatagagaagagcagttctatttttttcaaaatattttgaaggctacttaaggtttaccatttggcttatcctaaggtcaaggtggctctgataccaacttgtcacgcccggaatttctatccaaaattccaaacgcttacatgtgtgttaaccctcgtccaggaatcaaccgaggcacacaatgacaatttgataatagagtacaaataattaactatcaaatattcgcaaattaaaattattacagaggtagatagttcctctcaaaacaaataacattctacgcagcggaaaacaaaactaaaacaaactacggaacagctatggcgactccactccacaggcaacttaaccaagaacaagcctaatcctccagatcatcaccttcactgaagtactcctcttctgatgaatgaatattgcaagaatgagcatataacatactcaacaagccacacagcaaatatgcaagtgcacaggataacaaaggatggcataatacagttcatttgcagcaaacagcatttaataaatatttaagagaatagtaaaacagttgtataattaatcaatattaaataaacaccatacaacacacccgtgttgcataggcccaaccacatttgtacaaccaaccccagttgaataaattaaacctccaaaccaggaattatccattccaaaccagg

SEQ ID NO: 36035 - DNA, 1501 bp, Oryza sativa
attaactgggaaaggttcaccacccgatgacattcgaaaacaatgcatagttgaaataaaataatagctttaaacgggttcaacatgctcaaagggttgtttgggatctgtgtgacttgccttgggcttccgcaaacgcttcggaaccttcctcaacggaaacgctctcctccggaacgtcggaaactaaagcaattaaacaaaaatcaacaaaacagtaaaaaacaaacataaacagtacatgtggatatttttatcatgtagatcttgattttagaaaaatttagaaacttgaaccacctaaaacggatctacggttatttagttatgattttctgaagttttaatctattagaaaatcgggaaaaagaaaaagaaaaggagacgatgacgtcagccctaatgatgacgtcagccctggtgatgacgtcatgctgacgtcggcaatggcggccggctcgggttggagagctcgccggagctagggaggtcggccgcggaaacggagggcatctacgcgtagagggcatcgagacgaacccgatggtactcaccactacgacaaacgatgcacgacggcggccggcgacgagaaaaagcggcgcggcggctcgggtcgacggcggcgaaggggctccggtggtcggcggtgaaagaggaggggcggccgagcttcctctcaccacggcgcacctcttggcggcgacggcaagcggcggcaacggcggagacggcggcgcgacgtgaccgaagacggccgccggcgctacgaggcacgagagaggacgggagagggggcaaacggaagaggagaacaaggggaagctttatatggcattggatcgaagagatcgaactccaaacgagaggaatcgattcgggaagaaatcaaactcggttttagggataaaatcaaaacgaattcaattcggagagaatactcaacgattcgttttgattcttgggggaaaagaaagaggagaacgagaggaacaaaacccctaaatcaatcggactcgaggagaccggattggagcggatttggagggggaaaacggcggctcgggcggcttgcgcgacggcggccggaggttgaagacggccctgacatgtgggccccacatgtcagcggctggaggaggagggggcgggcggctcggcttgggccggcatgggccggttcggccgcgcggagagagagagagtattgggccgaattcggcccaatgaccaaagaaggggttttttgaacttttttaaataaaacaatttgtgaaatgttgtttcaattattaaaaatacttcccttgctcaaataattcccagaaaattctagaaaatagaggagcaagcatagtatttaataaaattttatctagctcatttttatgttgaaaattttcctagaaaattagggtttagcttgtaggcttttaaaatagtttctaaaaatgatttaaaatatgcatttttaatttagtcgatttttagggcgtgacac

SEQ ID NO: 36036 - DNA, 1501 bp, Oryza sativa
gcatggagcagagaatacgcatcatctgaaatcttgtgcttcctgtcatgcaggacaaccatcagaatacactatactatcagtccagacagagtaagtaaagactaacataccgcaaaatctcaatactttgagcttgcagtaacttcttttgcttttcctcctggagataagaaaaaaatgattggcattaacataaacactatgaccaatgatcaacaaaaggaatgtcaagaagggaggcgcacctccaaattctgcagctttttcagcttactcttgctcatcttcgggtcttccttgattttcttaccatcctggcaattcaggtagcataagtcacacatcacacccccaaacagtaggtggaaataaaaatggcagcaccttgtctttcccttgtcctttgttcttcctcttgcacggcagaatcagcgtgttgctgtcctccatgctcgaactacaagcagagcaaagcagaaaaatctcacaaccgatgcagacgagggacatccgagccagtgagcccgggaaggaactcaccctgtaagctggtgctcaccgacgtcggcagcgtccgcgagggggcaagccggcggtgctggcccgcgtggtgaaattggacacctccctccctcaagggacaactcgctggagcaagctgatgctccggcagagagaagccggtgcgccgccgacgccgcagccgccgccgagcctgcagccctcggaggtgcaagcgatgggagaggcggcggcggcggcgatggacctaatcgaagagtagaggggatccagtttgggccgggcttgtttgtgacgcctaatgggccgaaggagaaaggcccataaaagcccaacgacatttcgtcatttcccctgcttgttcatccggctaccgggtcgcggccgtcgacgagacacgagaaaggcgacgaccactgcctcctccactcctccagatcgccgccgccgccgccatggggggcggctccacggcgcccctcctcgcggccttcgcctgcgtcttcctcgccgtcttccctcccgtcgcctccggtgagttggtcctctactgaccatcgccgagtctatatcgctttgtttgctctggactctggggtgtaacaaattctaccgaatcgagatggtctcatgcttcgttgggtatcttctgttatgtgatgcgtttctagggtgaaattgtgtagggggtaggtctcagcgtagccttgaggtgaattaggtagtggactgctaaacctagttagttctgaagcttgggcgaacacctccgttgttgtgctgataggcctctagttgtgctcatggagctttgacatgcgactataattttttttctagtatctcattctaggaagttttgtgattgctaaagtattgtgatgtcttaggtgtaggtttgtttaggttcatttgaattataaaatcgtgatactgcttactgtcttaatatatttatatatgggacacaggtttg

SEQ ID NO: 36037 - DNA, 261 bp, Oryza sativa
gggaggaggaggaggaggaggacgacgacgacgacgacgaataacattggtttttctgtgtaatatgcatgtaagtttggttgttatattctgcatcgatcatacatgttggggggattcgaacactcaaattggattccttttgttatgcaggggcgttatctccaatcctgtggtcacgtgtatgaggttctaaactgctaatctagctgcaattttgttgcacaatctcagttaccatgtgttttgtgctgctgcagc

SEQ ID NO: 36038 - DNA, 1501 bp, Oryza sativa
gaaaatagttgtttccaagtgttcaagtcaatggaaaagaagccaagattccattcccctggctagtgttcaatgagaaagctgtaggacctgttgcgactaaaattagcactacatatcgactgttagggtgtgtttatagttcacaccaaaattaaaagtttggttgaaattggaacgatgtgacggaaaagttggaagtttatgttagaataattgggctaggcccaatttatcctattaaatctcaaaggcccataataagtgttaaggataataataccacctcaggatttaagcgaggaatatctcaacctaaatagggagttattggaggctccctgttgactagttgaggtgggggtcggaaggccccacgcgcgtgcgcgcgccgggccagggcgaggcgtggcgggcgtacgtcacgtcgctactcttttgcaaccacgaacccacgttcccacgactgcctccgcaacagcgcgtccacgatcctacgttcccacgactgcctccgcaacagcgcgtccacgatcctacgttcccatgactgccctgtgctgttctcgtctcctcgcttctaatcgcttgcgcgcacgagagatgcactgccctgtgttgttctcgcctcctcgcttctaatcgcttgcgcgcacgagagatgcacgactgcctctctcctgatagataaggaggcctgatagataaggaggtcgcgagtccgatcagaacgatccgcttgcttctttcccgggtgttagttcctcctcctccgcgcctgtgctgttctcgcctcctcgcttctgatcgcttgcgcgcacgagagatgcacgactgctcgtcctcgcccaccatgtctgcgcctggagccggcgctgctgcttctgctggaggagatggcgcgcctggagctggagccgccggaggtggtgcgccaggagctggagccggtgccgcgaacaacaacatcaacggaggcaattctgcctcacaatccagcggagggccattctgcctggagctggagccgccggaggtggtgcgccaggagctggagccggtgccgtgaacaacaacatcaacggaggcaattctgcctcacaatccagcggagggccattctcggggtatatccttctcctgttcctgttgttagcgctttactgctatgttcctgttcctgatattcatgatgcctttagcatgctactgcgttactactatgttcttgttcctgatattcatgatgcacatgatgcatttagtatgctactggttatgttacatgttgtcactagatcaccctacactgtttatgccatgattattgtcttaacattttggattaaaatatgccgatttattaccatatttccgacaatccaaaaacctgataggtcattttcggtagttggctttgctgctgcactaaaaccacatgcttttgatggttctaactataagagatggaaagcacgtgcactattgtggttgacagcga

SEQ ID NO: 36039 - DNA, 1501 bp, Oryza sativa
aactcagtcgcggtcagtatcactcaggttgtgatccatgagagatagtcatggttagtaaccaggtggtaaaccatgccagctgtgttcgttgcccctggtttgcaacttctttattttccgtacacacgttttttaaactactaaactactaaacagtgtattttttataaaaagtttctatacagaaattacttaaaaaagtcatattgatccacttttgcaaaaaaaggtctatctagcgaggcctctcgcgatagtcttaacgcgagacccaaccgtgtgaacagtggagtggagaagccagtacatatgcatgcctgttttcattacacatgcatgttttttccctttcttataattttttctctcaaattacttatccgatctacaatccgattacaacattgtgttcgttacaattaaatcttcacaataagatcttacatgattatattacgatgaaaaaaaatttatatttgtaaattacttttattacatgtgaaagttacttttatcatatatatatatatatatataaaagttacttttagatttgactaaattacttcttagacgtataaaaggaaattcaatatagtctaaaagtaatttacatatattataaaagtaccttaaaacaaaacggaagtaactttgtcacgacattagaagtaaattcgttgtagggataaaaatatgaatttatctagaaataaaatttaatcggcacatatcaacacacgtaagtttaacagtttttaaaagtaacttcaatgttaattggaaataacttttgcattgttcaaaagtaactatctataaaatcatcgattgttttttcctttcatttttagctgtgtagtcacgcccaatgaaaaaggacattcattaaagttactttccttttattataagttatttctataatatatgtaaactacttttaggctttattgaatttactttcatatgtctaagaagtaatttagtgaaatctaaaagtaatttagatatattataaaagtaatttataatttttcatcaaaatataatcatgtgggatcttgttattaagatttaattgttacgaacacaacggtgtaatcggatcgtagatcggataagtagtttaagagaaaattgtatttaaagtataggtggatagtgtctcttacgtatggagtggtagctagtttagacaaaccagctaccactagctgtgtaatcacgtccttaattaatcacgcgctaatggaccgctcagttttccgtgcttccggttagtaacactgtcttccgaacacagccatcattgggcctgtccccatcttccattgggccgggcaaaatagcccgagttcgtaggcccacggcccaccccacagggacacaaaaatcccaaaagaaaaaaaaaagaagcgtcgacttcagtgccacttgtctctccttccactctccagtcagcatcaaacagtgaggagaagacaaaacctcgcca

SEQ ID NO: 36040 - DNA, 1501 bp, Oryza sativa
ttaaattatttattttacttttgagcaaactgccttggtctctgcagctctatgaaagatgaagcataggaatttggcaagaatagcatatatcatgttcatgatctcttctagcacatacttataattatttctgaactatcgatatcttcatatttggaacctcaaattaactgtttgtcacatcatgccctcattgtagccaactgcatgtactgttccttttgcgccgaaacaagatgatagaagcacaatttgttagtaaactactaataccatccatcttatattctctttaaagctcaaaatgcatcggataactgttagtccagtgaaacatatctccattatctaacttattgttctatttctactggaccatatattccagcaacatttgacaaaattaatggcatatgtctttgttatgtggtgcttcagattcatatagcttgatatatagccttctggtaatttacataggcgctaatctttagttgtaaactagagcatatcatagtgttgacaccgttaacacttaacacatagataccaatctaagtgtaaaatattaatcttagaacatacgtagtagatactaaactttaggtgtaaattagcacttggcaaactggttttcccaaaggagcaatcaaagcggtgtgacatataaactgattagtaaccggtggtgtgacaagcaaagatgtttcagcaataataacatagctaaagcatgtataccttgcagtactttttgggcaaaagaagccagttctattactgaagtacactcttcgatttaactgttctattactgaggtactcttcgattttgtggttgactgtaacggtaatgctaatacttgacataattaggtagagctctgaggagctacatgagatgtcaatactttgctcttatgcccaccatttcaccatttggatctcatgttcacagtttcatctagggacatccaggttgattcttctatagttatattgacaatattgcgcagtgaaccactgcaggatattaaaaacatcgttcattgactatgggcgccgcgggaggaagacggcgccagccgagcatcgcaggaggaagacagcgcggcggcggcgccgagaagacgaggatgtctaggcggtggctggtgtggtgattgagtggactgaggggatggagggatgagcgatgaccgtgtggacggctggatggaatcaccagttggacatctgacggcgcatgcatggcgagggactgtagtactgtagcagcatttctctggcctaagatgaatcgcaacactgttggtagtgggtcacgaaaactaaagatttgatatgataagaacaagcagcccttctcaaaaaaaaaaagaaaaagaaaaagaaaaagaaagaaaaaaaaagaaagaagaaggagcaagcctcgcctacttaagcacaacagcagccttgctccagctgcgagctagagccatggcgaccggagagc

SEQ ID NO: 36041 - DNA, 683 bp, Oryza sativa
gagttgctccgagccaaaattcgaaggcacacagcttctccttacttcctccgttgataatgacttcttttatcgtctttgtctagtatatatatggcacttatatagttaactaggaagggcaccttgtttaatgtagctttcatttttattatgaatgttaaggatgatattatattgttgaagtatttttttactccttgtaaacatgtattggttaataacgaagtagtttggacattagttatgattttcttctgattacccttgcaacatataaactccatactaaaattattaaaaaaaatgtgtcataataatggagttggtttatatctatttgtactatgtgtgatttttttaaaatatctagcatatcagtttccaaaattttactaacaatttttcttgtatgctatcaatgactttatggatttattatagtaatgaaaaatatttttcattaaaacgtagctaatagattactttatttaagtaaaggtagacttatattggttatactacctccgtcacagcacgcatcatgaacgataaatcaaatgaaattgatgaatatacatgacaatcaaagaactaggcatagaggctgtagaggctaggtccttctcctagcctcctcctgccatgcatggcagctactgcgtccctcgatttccctgcca

SEQ ID NO: 36042 - DNA, 1501 bp, Oryza sativa
gaaagtagatgatctcaatacaaggtaaggtgctaaccttgttgaactcgagcacgtcggacttgaaccggacgcggtcgcccttgtcgcacctcacgtcggccggcacgtcggcgatcaccccgactcccggcacggtgagcggcgtcgtctcgccgcgcctctcgaccaggcagccggcgccgccgcccttgcagtacttgagcctcaggtcgccggccatgtcgaagccgcggccgaggcacctcaccgccttctcggccgccgccacggcggccatggatgatagctctctctttggtggctggctagttgactacgaccagacatgctgccattgcagcttcatgtccaggaaactgaaggagcatgatggttttaggcagaggctatatataataaggatgtcaaggatctttttttttttttggtttcctggtgtgaaactaagatatgtagctatcaatcatgaaatcaagcaagaatgaatctgtatttttttagttgagataacaaggctgcttcttgatgtttgaatggcgacttcatcagatcagcgggtagttgattgtatgtataatatgcagggagaaatgggcatgggaacggacttagtggaatggtggtggcaaccaacgtttcagtggttgactcgtagtttttcttgtatttttttactctgggctcttccaggggaaaaaagttaccttattttggatccctcggaggtaatttgaatagtttcatccattgtttttggcaccccaaaattatctcgacttaatgtgaactcattagtatacatgtgtcatgtgcgaaaatgatagaccatcttgtcgtagtcaagattataggtgtgcgattttaataggaatttataaggtacaagatccttttatcttcggtgtgtacgttagggggctctcgtatcaaaatttattgagaaaggggcgaaactcgaacctagatcgactaattcataccttaacagtactaggcagaagacaagccttatatatatatatatatatatatatatatatatatatatatatatatatatatatatatatatatatatatatatatatatatatatatatatagtaaatttgtttggtgctccatggtgcccgggcaccattgttgaaattgagtatatacccaattcaaatgagtatgaaactttttcaattacttaggcattaccattaactactttactaactagtttaaagcaagtttgaactgaatttgaacttgtttttgttagattttgattctaggtatatagcatccatacatataattagttaggtatgtaatcatggattgtgaaataaagttaaatttgagttgttttgttgataagtataggtatgaatcaaattattataactaggtatatactcacaatttgaaaattttgaaaaatttgagtaattttgtgcattagataccatgttgcccgggcaccatggtgccccatatgagtgtccta

SEQ ID NO: 36043 - DNA, 311 bp, Oryza sativa
catcactattataatttctcccatataagaaattggtttcccacagcctagattggcatcattttcaacgttggatatatgtttttagacaagagcatttgatatatcaggtgtttatttccacctgtaaaagtagtaaatgttatacctaaaactttgaacaaaacttgaacactacgagtggcactatttaccacagtagtcccagcatctttgctagactagagtacgtagtagtacgtgcatagctaggacctctttccatctttctctcatttcttgttaccgggatgccctctcgatctctcagt

SEQ ID NO: 36044 - DNA, 1501 bp, Oryza sativa
gtgattacacagctagtggtagctggtttgtctaaactagctaccactccatacgtaagagacactatccacctatactttaaatacaattttctcttaaactacttatccgatctacgatccgattacaccgttgtgttcgtaacaattaaatcttaataacaagatcccacatgattatattttgatgaaaaattataaattacttttataatatatctaaattacttttagatttcactaaattacttcttagacatatgaaagtaaattcaataaagcctaaaagtagtttacatatattatagaaataacttataataaaaggaaagtaactttaatgaatgtcctttttcattgggcgtgactacacagctaaaaatgaaaggaaaaaacaatcgatgattttatagatagttacttttgaacaatgcaaaagttatttccaattaacattgaagttacttttaaaaactgttaaacttacgtgtgttgatatgtgccgattaaattttatttctagataaattcatatttttatccctacaacgaatttacttctaatgtcgtgacaaagttacttccgttttgttttaaggtacttttataatatatgtaaattacttttagactatattgaatttccttttatacgtctaagaagtaatttagtcaaatctaaaagtaacttttatatatatatatatatatatgataaaagtaactttcacatgtaataaaagtaatttacaaatataaattttttttcatcgtaatataatcatgtaagatcttattgtgaagatttaattgtaacgaacacaatgttgtaatcggattgtagatcggataagtaatttgagagaaaaaattataagaaagggaaaaaacatgcatgtgtaatgaaaacaggcatgcatatgtactggcttctccactccactgttcacacggttgggtctcgcgttaagactatcgcgagaggcctcgctagatagacctttttttgcaaaagtggatcaatatgacttttttaagtaatttctgtatagaaactttttataaaaaatacactgtttagtagtttagtagtttaaaaaacgtgtgtacggaaaataaagaagttgcaaaccaggggcaacgaacacagctggcatggtttaccacctggttactaaccatgactatctctcatggatcacaacctgagtgatactgaccgcgactgagttcttttctttgctttctaaacttgcctctttcatttttcagtacatactttttaaattactaaacggataaaaaaatatatatatacaaaaaattatattaatctattttcaagttttttttctaatacttaattaattatatattaataaatgaccacattttttttccgggaagtagagttcgagaagcttctggtaacagttgtttctttaggaagctttagtttctcagacaatatagattcttacctagattttaagaatatgta

SEQ ID NO: 36045 - DNA, 1501 bp, Oryza sativa
tggcgcacactaaaaattagatgctaagcaaatccatttctcgaaaaaaaaagttttgttttttgtatcaagaagttggcacatactcgctccgtaaaaaaacattacctaacccctcctagtataacgaatctccgtccaaaaaaactaacctagatttgttgtactagtagatgggtcacatgaccatttataggttagtttttttttgacagagggagtaggatattagttccttttcacgtatcaattttgaaaataagttttgtgatagtttatttttaaaatttataaaattaataagtttaaaaagttaaaaaaaatctgcgtgggagccgtacgagcatcgaggtggcagagtttagtacagacaatataaaatcaaaccctagcatttcaatgcaaaattagtggagagtgaaaacgactaaaatgtctctcattattgaaaaaaatagtaattgtgataggtagataaatgatattgaaggaataatacttctcattttacgtgttgagggtaggtagaatggtaaaagttaatttcctgtagaataaaatttaaactttagaagtcgattttttttatagagggagtacaatgtttggtcaaacgattggcccttgccgtgcagtaggagtccgatgccggttgtggtttctgaatttagaaactgtaataggttttggaaatagaaagattgagttctgatgggattagaagttgacttctagtactaaatctatgtcggagattttttatataaaaaatagacgaagagggttagatgaacaataaaagttattaatatttgcctagggtttaatatattcatagatgagagaggagtgatttgtaaacaaacacacaccccctccaacaccaacggcctgaatttcgccgtccccttggcggcgcctcctctccttgcgagttcgcccaccgcctgcctgcgccgatcgatctccataggcgccgtcttcctgcggcttccgcccgggtgagcatcctgtccagttacgcaaacccaccccacttttgtctcggatttttgcttgcgttaaccctagcttctcttgatctagacctgtggaagaagctcttattaatattaacaagtacttcctccgtttcacaatgtaagactttctagcattgctcatatttatttagatgttaatgaatctagacatatacgtgtttagattcattaacatctatatgtatgtgggatgctagaaagtcttacattgtacagtttgtccgttccccccaaaagtttaggggagttattagccatgagtttgttcttgcatttactactacacttgattgaacttcgtaccagcgactgtcatcttccgagaagtactgtaaaaagaaaggagatattagcctgcttaatattaattgaagtgtttaattgcattttctttaatttgcagttgtgtaattgtattttctttctgatttgttttgccaggttctaccttggttaac

SEQ ID NO: 36046 - DNA, 1501 bp, Oryza sativa
gtccatgccttgttttataagggggtgattatgatccaggaatggtgcactgtggtgagttgtgttgtacaaagggtattgtcacagcctctattcgggtactttccagtatcgcgacgcatggtagacatgatgttgaggctgtgtcttgtgggtacagtggtacacctctggccagagtaaaactattcgaatagccgtgcccgcggttatggacgagttgagcaatgtttttcgtgattagtctcacacctctcacaataattatggatgttataactggtaataatttgcttagctccggtttggaatggataattcctggtttggagattagatctgtacagccgggtatggttgtttcagaatggttgggcctgagcagcataggcatgttgttcagtgttgattaaaatttttgattaattactccactgttttacttctcttaaatgttttgttaaatgctgcttttgcaaatgagcctatattatgccatcctttggtatccttgtgcacttgcatatttgctgtgtggcttgttgagtatgtcatatgctcattcttgcaataatcaatcaacctcagttgaagacaagttgcgaaggagaagacgtttggctcataccccagttgagctgcctgtgggagtggagccggagcttcgctagattttattttccgctgcagttttcttcttggtgaggacttagtgcctcttaagtaagtacttatcgttttagttaatttgatgaatctgtatattaaattgtcagtttgtgtacctcggctgattcctggacgaggattttatgcacaaataagtttggaaatcacttgtgaatttccgggcgtgacatgtaccccggctggtcctggacggggaatttaatgcacattctgcttgaaattctattcgggaatttctgggcgtgacaagttggtattagagccgaccttgaccgtaggacaagccaaatggaaaaacctaaaagccctctgaatccttttcattgcatatgttcttggcaattggatttgttccgggaaaattgggatccgttcttgtggttcaagggaaaaatcttggtcgctcgtttaagtgagatttgtcaaaacgagtcaatctagagttttagtaaaactcttgagatttattcgttagtcagttgggatttgatgggtgaaatgcattaggtcctagctcaggaacatgggttgcaaggtatttcagctcttattgttattattagtatgtatctaatttccccattattttatcgttatgtgagtctgtcttatttattcgcactcatgcaaaatgatctatgcataaaatttcgctcttattcgattctcttatttgagtcttttattgctttatttaaatttggatttgagcatgcattgatcctactcctttgtcttctctagatggccggacacccacccaaccaccgcggagaaggcatgattgattttgtggcagagttggcacgca

SEQ ID NO: 36047 - DNA, 1501 bp, Oryza sativa; identical to SEQ ID NO: 32248

SEQ ID NO: 36048 - DNA, 1501 bp, Oryza sativa
tacagatctaatctccaaaccaggaattatccattccaaaccggagctaagcaaattattaccagttataacatccataattattgtgagaggtgtgagactaatcacgaaaaacattgctcaactcgtccataaccgcgggcacggctattcgaatagttttactctggccagaggtgtaccactgtacccacaagacacagcctcaacatcatgtctaccatgcgtcgcgatactggaaagtacccgaatagaggctgtgacaataccctttgtacaacacaactcaccacagtgcaccattcctggatcataatcacccccttataaaacaaggcatggactccccagcgacccccgtgggcttatctccgccacttctcagtctggtgctccgcaatgaatcatgctatacaaaaggtaaagccgttgcccacgctggcttgtggttggcacgattaatgtttcacaatagtagctcgcgaaccggtccttaattgtcatgagcacgactctcaaaaccatgtgctcacaacccaccattatcaagttttagttggcaagtaattaattaaccaatcacgattgaccatcgtgaactatcattaagccatcattaaataatgagtcataagttatcccaatagtgtgctaatgtttctaagcatggctaagcaattatatctaatatctagttgaaccaatatatataaagctcaactagtccaattataatcacccaaggtatcaaggaataaagtaatcaatgaaaacaggccataacaaaggaataggttcacaccacccagtgacattcgaaaataaatgcacagttgaaataaatagagaatttaaatataggatcaacatgctcaaaggattgtgtttaggatctgtgtgacttgccttgcaataatcggtcttcaattaatcttcttgaatacttccggcgcactcacgaaccttcgcaacaacggaaacgacaagctatcacgcaaaacgaggaaaaagactaataaaaaccaattaaacaatacataaaaaataaacaaacatgtagatcataattttagatgaattatgagacttgaacggcctcattctgacttcaaatgaatttattacgaattttacaagattaaatctatttaaagcccatttaaaaagaattaaataaatttaattcaatttatggacaattttaatatgtagatctttattttatataatttttgcaacttgaaccacattaaactgagttcaaatgaattagttatgaatttttaaagattaaatcggattaaaacacttatatggattttaattgaattatgacgcaataatgaattatttttgaaaaggaaaaaggatttattgcatcagcggctagggtttgcggtggaccgggtgcacggcgacggttcacgggaacggacggccgagatcaaccctatccaaaacggaaggccgagatcaaacgggtccacgaccggctcacggg

SEQ ID NO: 36049 - DNA, 188 bp, Oryza sativa
ccaattctgctgtctatgcagatattccttttatgattaatagttctaaaactgcttgattttcaggctgtactaggtggaactgtcacagtaccaacccttacgggcaacgtttcagtcaaggtattgatttcatttttgctgcgtgacactaaccatgtaatccagttatttcaatggcttaccaa

SEQ ID NO: 36050 - DNA, 1501 bp, Oryza sativa
aacaatttactcaaatgaatgaagatgacaaataagcatgtgagaagaagaaaaaaaaatcttaactagtggataaacttctttccactcaaagaaaactccaacaaattattttttttctccctctaaaaaagagatgtttttggattttgtcttgtgatcgtgtcagccctgtcgcttagcgcccaagatttttgtcagcgatcagctgagatgacagcgtggcaccaaaaccaccacaaccgtctgtggctgtggctggccctcgctgctcccaaccgtccatctgttcgttccctccgtgacgtggcagcaccacagccttccactccaattgacacgctcgcactcactgccaggtgggccaccacggctgggccccgctacttggagggacctatttgaaatttgaagaaacctgagggggcttttcgctcatcccgcggggagtggattcaaaaaatttgggagtattcaaatccgccgcaggaagcggcggcgcacaacgcccagatgattttgatttgtggggagatctgcgtggacccggttcacggtgaacgggtgtggacacgaacacgttggtgtggggcccacgtgagtgtgggaccccggggacagtgggatacggttcagggcttcacgcgttgagtttaatgggtgggtgtacaatattctgctcctgctcctcgtgctaaattttggtggaaacgttttaaatcagtcccactatttcttttttttctcttccctgaatgtggtcaggtgtcataaatttgaaattttttggtggagaagaacacacaccatattcattattttgattttgaaattgtaagctttgataaataatataattcaaacaaactaatatttgtagcataaaagtcgtatcactatattcataatcaagagtatttcactaatatatttattatatagttaaaggcttaaagctgctccctttaatattgcttggttagaaattaagcggtcaaccttagtttgctcttggtcaaaaacaataagacctttcttagagcaaaggaatatcgtggaaattgaaataatttcaacaaaaaatacaataaaaattatacttaaaataggagccatctatttcacttaaaatttttaagtcctagttcttttcttcaactttatattttttctgttagcacatttttcaaacgtatttgttgtaaaaagtttttaatttaaaagttgtttaacaaattcaaataactttatttttaaagtttataataattaatacttaattaatcatgtgttaaccatctttatcgtttcacgtgcgttaaaaatttaggctaaaaccaatgaaaaaacagaactattagaaataaaatttaaaccaggcattattaaggactactcctatatagggcattaataatttgatacttggagggtcgaagcgcaaaaaacccacgcgctgtcgcaggagaaacgaagccgaagctcccatttccattccacc

SEQ ID NO: 36051 - DNA, 188 bp, Oryza sativa
attcaccaatttggagtggcttgatacgctgcctctggctactaccttgtgcctcctggaatacaatcattttccttttacggttatccatcctgttcttcttgtcttcaagtcgaattgctttgtcaaccagctgctgaaaatcaacatagtcatgggagattaacgtaactgacagttcatccttt

SEQ ID NO: 36052 - DNA, 410 bp, Oryza sativa
gacccagctcctccaccaccgcggcggcggcgatggcagtagcactgctggtgccaagaagatgatcagcagcatgatcgcccggcttcgaggggagcttaaccggcggcggtggatcgccgacgaggtcaccctgttcagcgcccgcgtgaaggaggccattcgccgccaggagagctaccatcttggcaggcgcacctcgagctcgaggccgagagaagaagtcgacgacgacgatcgcgaggactccgccggcaacgaacgccgccggtttctgtcgctgacgttcgggatggacgacgctgctgtgcacggccagctcgttggtagggatatttcgatgcaaaagctcgtccggtggctggccgacggcgagccgaagctcaaggtggcttccattgttggatccg

SEQ ID NO: 36053 - DNA, 1141 bp, Oryza sativa
gcgagaacgagaacgatcgaacgaagacaagcgagaacgagggaacgaacatgaatgagaacaagcgaacgaacgtgaatgagaacgagcgaacgaacgaggacgaacgttaacgtgaaatgcaatatatatatatatatatatatatatatatgttacttcgcatttattctaatacatctttttgtatcttgcagaaaagacgtgttgtcggagtcgtccgtcaagcctgagtggaagagctagccctagaaggaattggagcaggcaagtgacgtaataatataaatgattgttatatttgtaatgcaattaattaagattattagacctgtaattagacttatcatataagattgtgtagtgttctaatattatttgagttttaatataagattattttattgcaaattagacttagtatgacatatattattgactacggaattggtgtgactcctagcaattgactattgtagtcttaattagacttagcatatacgcacgaaacacttagcatatacatgactattttagtcttagcatgtaatattatttgagttttaatataagattactttatttgtaattagacttagtatgtaattattgactacggaattggtgcgacaagtagcaattgactattgtagtcttaattagacttagcatatacgcacgaaacacttagcatatacatgactattttagtcttagcatgtaatattatttgagttttaatataagattactttatttgtaattagacttagtatgtaattattgactacggaattggtgcgacaagtagcaattgactattgtagtcttaattagacttagcatatacgcacgaaacacttagcatatacatgactattttagtcttagcatgtaatattatttgagttttaatataagattattttatttgtaattaaacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtaacttagcagatgtttcttgtatcaacaga

SEQ ID NO: 36054 - DNA, 1501 bp, Oryza sativa
aacaaataatcatatattcttttgagggtacaaataatcatatattaaaaatatatagtgtgaatttgaatttaattgagagaaaaaataattttaaataattactgtcatatattgcaaaatttacgttataggatactccccccgtcccaaaaaaagacaaaccctggtttccgtgtccaaaccgtccgtcttatttgaaaaaattatgaaaaaaaattaaaaagataagtcacgcataaagtattcatcatgttttatcatctaacaacaatgaaaatactaattataaaaaaatttcatataagacgaacagtcaaacgttggcacgcaaacccgcggtttgcctttttttttttttgacggagggagtacactgtgaaaagttcacacaggcactgtaatttattaactttcgtgtatatacgcaagcaaaattagcaaactaattaagtaacttgattaactaatattgaacaaaactgaaaataaaagaaaatcatagtataggttacaaggtaaaaggtactctatatgtacatgcattgtaatttggtaaattctcccatcatatcatatactcctactccgtactattgttttcccggtgctgactgttcattctttgccctctcgctaggccacgttgacggcgattggtagccatcagatacactgcgtgtcgcccacatcctgggacctggagacctgctggctggagcccgttcgtcgtggggaaaaagaacgagcccaaagcctcagcccccaatacctcaaccttggcgtctctgtgcctccgccgaagtagaaaaagaaaagaaaaaaagaaaaaaattcaactttgactccttaaatagtactccctcctttccaaatactccctccatctcaaaatatttaacgccgttgactttttaaaacatgtttgaccgttcatcttattcaaaaaatttaagtaattattaattctttttctatcatttgataatcattaaatatacttttatatatacatatagttttacacatttcacaaattttttttgaataagacgaacggtcaaacatatttaaaaaagtcaacggtgtcaaacatttagggaaggagggagtttataagtttatacactaaaagaacaatttaaatcacattaatcaagataccatgcacacattctccgacaatacatgcaaaccccttgccagttacaccgtagcacgcacacattcttttatactgtgttaaattatattcggatgaaatccgtctcacacgaggagtagtagaagcgcactaggcatatgagcgatctcattggaggcatttgtgtgccagcgataggcacaggtgggagattcgaattgtaacttcacctcgagggccgcaccgccatcgctccgtgtcgaggtcgagccatgccatcgctccgcctcgaggccgcgtcatccactggtggagaaaccctctgtagtctcggttcgtaacctccctttagtctcg

SEQ ID NO: 36055 - DNA, 1501 bp, Oryza sativa
ttattaaaaaaaattaagtaattattatttattttcctatcatttgattcattgttaaatatatttttacgtatacatataattttacatatttcacaaaagtttttgaataagacgaatgatcaaacatgtttaaaaaagtcaatggcgtcaaatatttagcgacggagggagtacctctgcttgaaatttcttccaaacaatttgtggtatgactagttaccgcctccgtaggatgaaaatagtagatcgtggtaccaatctctgctacaaaggctccctcagataactccatttgcaacggatatatcgatcgcatcataagagtataagacgatggctggcaatggcatcttcacggacaatgttacatggaaacatggtccgtccatggcgtgtaccttctttaccgtgcgcgtgcgcacttggatggatgcttccgtgagtgagaagaaactttggctattctgcctggttgccaaggggatgtgacaattgcgtttcacgagcatagctgctgtacactaccggctggctggtcactgccttttggcctaagatcttggttgcttctgcctttcagctaagcaggatgagcaagatgctgtagccaactactagcaagtactagtagcaatctaacatgtcattctactgtagtaacatacccctgcttgcttgcagacggtaggtaatgtaacacgacagtattggtcataaaccagagtaaaagccggagaaaattgttgctgagacggttgcatttgcatcttgcctgtcctgcagcttcggtaatcacacccacaactagcagcaatacgattatcaggtcacgagaataagcaacttgatgggtgcacacacaaggattttatatgaatttcactgattgagaactcttaacaaaacgccatagcccctcctacgatcttttaaacaaaaatcactacaagtttggcattccctttttatgctagcagtagaaactttgatggaacaatcactctggcacgttaaccaattcatactcaacaagcgataggttattgtcttctttcacggcgaaactggcaggctctgtaacctccacacgtccccacttgtcgacagcaagcctcattgagcccttgaacatatcgattctcgcattccgcaagattgctgtatttcctggcatcagcatgtccactgcaaaagtagaaccaaaagcacaaaaaaatgagctcaagcacttcaaaacttcatatctcgaaagagagattagtgactaaaatttaaaagcacgaaaaatctccaaatctgcttcccctatacagtgcaattgtagttcatcttagtgttcttttaagtacttctgtagcaccaaaatacatgccatccaattactttggaaaaaaaagggataagtgtccagcatctgttaaggtcagcatttagttttaacttgtgcttatgcaagtgagaaaaacaccaattttgatccacatttcagccaagtaga

SEQ ID NO: 36056 - DNA, 1501 bp, Oryza sativa
gttgcttggtgttggtggtggtgattaccaaggactgacagcatgctttcaacgttggctcaagattcatcttttgtcttgtacttttagagactgctgtccctgttgtaatgtgctctctggtctgtgtgatgtgtgtacttgtgctgctattgttatcctagttccttttagggatctctctccccttgtttagttttaaaaacacttccattgtttctatggtctgattttgaggtttctctctaatttctacttggtcaagtatattgttgaacaacgtgtagtgggcctttggctgttaggcaaactagatctttttggcagtgtgggctgccgatttagtgttttcacattgcctattcctaggacacggtctaaattctctgtgtaggcctgtagggaaccttggtcatataattcttgtggctgcagtgcgcacagcctagattaatcataacttaatataactataaatggttagtatttactttggcagtatcgggtattaattgagtatttgagttagctacctaaaggataccttggctttatagctcattttaattaaaaggtggggatgaaaattcaagttgttctgaaattgatttatttgatataccatttggaactcgttccattcgtatggtgctcaacttttaatctctttcctttagtgttgggggtatgtataatgacctgaccctttcaggctgtatatttggacaaattccttttggcattccactcatgagaagttttccattcttattgttttctgaatttttagtgtctaatttgagacacatggttttttattcatttctcagcataccatagtaggcctttttaaccgttttaagggcaaatgaaaaaaaagttaacctctctttccaagaaagcctatcttttaaggcaaaatggaaaaaaaaagggtaccatctattttccaactccctctctacggtgtggtgtaagaacaaaaatagggttctgaaaaaaaagatattaaaagaaaaggttgactttcaaaatcaattttgtgtgtagcggaaaggagttgctgtttcttctttttcctatggaacatctactgataagaatatgaaattgttaatagcaagtaattattgccttgcatggtctaagtctatggatataccaaaaaaaacgcttatacaatttcatctacttggctgaaatgtggatcaaaattggtgtttttctcacttgcataagcacaagttaaaactaaatgctgaccttaacagatgctggacacttatcccttttttttccaaagtaattggatggcatgtattttggtgctacagaagtacttaaaagaacactaagatgaactacaattgcactgtataggggaagcagatttggagatttttcgtgcttttaaattttagtcactaatctctctttcgagatatgaagttttgaagtgcttgagctcatttttttgtgcttttggttctacttttgcagt

SEQ ID NO: 36057 - DNA, 1501 bp, Oryza sativa
aacctgcaatttcacactaaattggaacttttctaatgagtaaagattactagggagactatgggtatcaggtgtgtatatgacccgtatatccgattactataggaggagaccataactatggtatttggaattgtatatgtcttagttgctagagttttcctatcggttatgccctgcccatgacggcgttggaagtggagcaggggatgagagagtagagaagatagatgggagtagatcggatcaattgcttgtgttattcataaatcagtagcccttaaataggcttacaatgaactgaattaccgctaatgaggaaacaactaattaacttaatcctatccatgcaagcgtgatcactgttccttgttcggcaattgcggagctaactcatgagccgtcgttctaagcgccgtcctctgccatcttcttgtgattattgcgttcgtagaccataccgaccataacaagtagaatattacttcttatcgagagagtttgaacctgtctaaacctttattcgtacaattcattcactttaagacctcatatgttacatcttttattattgtcgatatagaacatcgataattactctgctcggttcctaacttctttttttttacgatcgcttccatacgttaagttacacatagcttcgcccattgacgatgcacatccagaatggatgtagtggccggcttttaatcaattttatttttttaaagaaatacgtcttcttacgtcgagccaagattctactccatcctccaggaatgtcgctgatgacgataaacaaatcccttcatacactatggttgttagtggatcgaaatatattatgtgatccaaattccaagccgatacatcgtcggtttgtttgctgctcaccatctttatcttgcttgtggtttacgtggcgaccaggctacaacaaaaatggagatcgatcgagacccatgactcatcaatcaacttaacagtggatgcctgattttctcagtagttgatggaaaacccaaaacccagtcgccctctctgacaaggacaacctcccatgctggtcaccgacgcacttaagtgccctaatcattaggttcacactacgagaggaacccctttagcaatacatatatgtattgaaaaagtgaaaataaacattgctaggctctgtatcaacgcatttaatatgcgttgcctatgctactgttgctagcaccaataacaacacatacacaatcgttggtaacatgtaagcataaacgttgctagttagcaacaaagtaaatagttttcagccatacttgtatgcgttggcagtttcggtgatgaacaattctatataatccttgcaatggctataatcaagttgcaccaacactaataagtattgcaatataggcaactattcattccagcatgcctttgcacaattatcttgttgggttagaggcccgtaaactcaaatgatgtacacatgagaaaaaccaagtcattc

SEQ ID NO: 36058 - DNA, 1501 bp, Oryza sativa
gcccattgacgatgcacatccagaatggatgtagtggccggcttttaatcaattttatttttttaaagaaatacgtcttcttacgtcgagccaagattctactccatcctccaggaatgtcgctgatgacgataaacaaatcccttcatacactatggttgttagtggatcgaaatatattatgtgatccaaattccaagccgatacatcgtcggtttgtttgctgctcaccatctttatcttgcttgtggtttacgtggcgaccaggctacaacaaaaatggagatcgatcgagacccatgactcatcaatcaacttaacagtggatgcctgattttctcagtagttgatggaaaacccaaaacccagtcgccctctctgacaaggacaacctcccatgctggtcaccgacgcacttaagtgccctaatcattaggttcacactacgagaggaacccctttagcaatacatatatgtattgaaaaagtgaaaataaacattgctaggctctgtatcaacgcatttaatatgcgttgcctatgctactgttgctagcaccaataacaacacatacacaatcgttggtaacatgtaagcataaacgttgctagttagcaacaaagtaaatagttttcagccatacttgtatgcgttggcagtttcggtgatgaacaattctatataatccttgcaatggctataatcaagttgcaccaacactaataagtattgcaatataggcaactattcattccagcatgcctttgcacaattatcttgttgggttagaggcccgtaaactcaaatgatgtacacatgagaaaaaccaagtcattcataaaactaattgtaattaaagagaattttttgtattacatggaaaatcatcctcataagtcatgacattaaattttgttcagaacatcatgcacaaatgtaatctaaactatagaaaaaaaacatgcatatgaagttgccactatcattgccaccatcttccacattacagtcatcatcatattcacaagggatctttagatgacagttgtccaccttgcagtaaccatattgtcccagatcatgatccatttatcttgtcaacttgtaacagaaaaaaaaacaaccattgatacaacattggaagaaagaagaccacatctaaagaaattgagaaatagcaccgtacaaaaattgctggccacgcaatatcaagtcctacgacattgccaataattttgtagcctttgtatggcctgatcatctagctctgttccttatggatgattggatagaacacaaacaattgatatataaattaaatattgtgtattataaactaacaaaaaaagagttcagaaaaagttatctaaataatgctgatgtatattatttttagagaaattatggtaccgtagtacggataatccagactgaaaagaacacgctcttacacccatataagcaagcaagcaagcaagcagagagcaaaacagagcagag

SEQ ID NO: 36059 - DNA, 1501 bp, Oryza sativa
atctctcacatgcatgtcaggatttgtacaatttcttccaaactcaaagtaaacaccgggctatatatcggttgcattgattgcttgctactactgttttcttgtttctttcctctcccctatagacattgacatcagatacaacaaaaaacaaaacagacatatccctgaagtatggaccattccaaatcatataattaaggaaacaagtaagtatatgctatatcatgattcattagctatgtatcaacaagaagataagcctattttcatgacaagtggggcccttgggttgtgagatatcttaccctgagtattggtgtagccttggctgtaccatagccattgcaaatctggtactctccctgcagctccaaaacttttgttactacaaatactgatgggtcatcgtctccccaacttgtgctttcaccgtagtaatctgctgtcactgagttagatcccaatgctatctgccaaattaaccgaaatgtcacgtgttgtttaacaaggagtaattgtaattgtaataggaggggcattgtacaacagcatgtactcaccacattgtacatgttcacttaatatgaagtagggtgatgcctagtattcaccatgtaactttatagtgtgttaatcaaattgagtacatggatgttaagtttttaaatacgaccactattaagtaagaagccaagatttcagataatatacgaaaccaagatttcagataatagaaaaaaactctctgcctcttcacaccgtgatatatgcattatttaaaaaagcatattaaaaaaaggtagaattggtgtgatgatgaagtcgtgagtatatgattttccacgtaaaagtttgaacattgatgtccacaacactacacgcctaaatgcgtttgtataaatatttagtgagatcagtggtttggcacattcctttttctaaagcatgttaaaaattacgtatgcgttcataccagatatgtgtatgtgccagggttaatcctatcggttaggccgatttgatcgggcctcgccgaaatgccgaaatttcgaaaatttcggtccaaaatttctaatattttaaacaaaatttagttgaatttgaataaatattaccaaaatttatgaaaaaaataaaaaatttcagccgaagtaatatcgtattggaggggactgaaatgagaaatttcggtccgaaatttccaaccctggtatgtgtgtctttcgtgtaatcgcgaaaaaaaagaagtacaatggtgtagctcctcttaggcagtgcttcttccacataaacacgcgtgccattatgaatgtcagtgcgcacggtttcttatctgattaattaattaattaaataaattacctgcaagaagtgcccatttggcgccctaatccgcacccggctcttgtcgccgtcgtcgcgcaccacctggaacgtctccgacggccccggcgcggcggccaccgccaccaccgccgcgccgccgtcgctcccggcg

SEQ ID NO: 36060 - DNA, 1501 bp, Oryza sativa
gtggaaaatcatatactcacgacttcatcatcacaccaattctacctttttttaatatgcttttttaaataatgcatatatcacggtgtgaagaggcagagagtttttttctattatctgaaatcttggtttcgtatattatctgaaatcttggcttcttacttaatagtggtcgtatttaaaaacttaacatccatgtactcaatttgattaacacactataaagttacatggtgaatactaggcatcaccctacttcatattaagtgaacatgtacaatgtggtgagtacatgctgttgtacaatgcccctcctattacaattacaattactccttgttaaacaacacgtgacatttcggttaatttggcagatagcattgggatctaactcagtgacagcagattactacggtgaaagcacaagttggggagacgatgacccatcagtatttgtagtaacaaaagttttggagctgcagggagagtaccagatttgcaatggctatggtacagccaaggctacaccaatactcagggtaagatatctcacaacccaagggccccacttgtcatgaaaataggcttatcttcttgttgatacatagctaatgaatcatgatatagcatatacttacttgtttccttaattatatgatttggaatggtccatacttcagggatatgtctgttttgttttttgttgtatctgatgtcaatgtctataggggagaggaaagaaacaagaaaacagtagtagcaagcaatcaatgcaaccgatatatagcccggtgtttactttgagtttggaagaaattgtacaaatcctgacatgcatgtgagagatcagtgatcacatatgagttgcaaattgcatctatgctatgattacctcttgtacaattccggtgggccaattacaggtggaatagtgtttatcttatctgaaaggacctgaaatttactaggcatgcaaacatgactccattctaaacttttttctttttgataatgaaatttaatccaatatccgtgtacatcatcataaactacagagaattgaagcactcctgtgcatcccaaatgtgtgaaggggtctgttcattactacttggcacttgcagaattcagagtaaaattttcacatacatatgctgagttcagcttgcttgaacgaaactatcttgtttttgtcttgcgttctgtcccgtcaaagattgccaatccaaacactatgatttggtcccaattttgttgtcataagtgaaagccgaggccttagcttgtgtgtctgaatgattgagggaaccaattcattaaatgattattggcactggtcctatatatgccaaacagtagcatgatttctttttctgaaatttagtaatagacccagcaaaatcaatgaaaatatgtttgcacgattatggttgctttgtactgatgaattgggatcattttcacttcagttttgtgaatcaattatatattattttctggc

SEQ ID NO: 36061 - DNA, 1501 bp, Oryza sativa
atgtctgacgggggaagttggaagtttagaccatggtattcatgggagaacatgaactcaatttttctccgtttacataaaactgcattgaagtggtaagtagtagcataattcggatacgttaaattgtaatcgcatggtttcaatttcacaaattttaatggtatttttcaaaacggacaaatttatagtgacatggatccaattaatatatatatatatatatatatatatatatatatatatatatatatatatatatatatatatatatatatatatatatatatataggacactcatatggggcaccatggtgcccgggcaacatggtatctaatgcacaaaattactcaaatttttcaaaattttcaaattgtgagtatatacctagttataataatttgattcatacctatacttatcaacaaaacaactcaaatttaactttatttcacaatccatgattacatacctaactaattatatgtatggatgctatatacctagaatcaaaatctaacaaaaacaagttcaaattcagttcaaacttgctttaaactagttagtaaagtagttaatggtaatgcctaagtaattgaaaaagtttcatactcatttgaattgggtatatactcaatttcaacaatggtgcccgggcaccatggagcaccaaacaaatttactatatatatatatatatatatatatatatatatatatatatatatatatatatatatatatatatatatatatatatatatatatatatatataaggcttgtcttctgcctagtactgttaaggtatgaattagtcgatctaggttcgagtttcgcccctttctcaataaattttgatacgagagccccctaacgtacacaccgaagataaaaggatcttgtaccttataaattcctattaaaatcgcacacctataatcttgactacgacaagatggtctatcattttcgcacatgacacatgtatactaatgagttcacattaagtcgagataattttggggtgccaaaaacaatggatgaaactattcaaattacctccgagggatccaaaataaggtaacttttttcccctggaagagcccagagtaaaaaaatacaagaaaaactacgagtcaaccactgaaacgttggttgccaccaccattccactaagtccgttcccatgcccatttctccctgcatattatacatacaatcaactacccgctgatctgatgaagtcgccattcaaacatcaagaagcagccttgttatctcaactaaaaaaatacagattcattcttgcttgatttcatgattgatagctacatatcttagtttcacaccaggaaaccaaaaaaaaaaaaagatccttgacatccttattatatatagcctctgcctaaaaccatcatgctccttcagtttcctggacatgaagctgcaatggcagcatgtctggtcgtagtcaactagccagccaccaaagagag

SEQ ID NO: 36062 - DNA, 1501 bp, Oryza sativa
ttatattgttctctgtaaatttttctgtggattcatttattccaaataggccattacatgttgaccagaaaaaaagggtgccaaaaaaaggtatggcacagtacggagtacttattctgaagcctatgcaaaagtaaaaggtgcaaaatgaagagccagtggtccttacctgtattcccagctgaaaaatattaaaatctgcatggattcttcatggcattctcgacattgatgtttatgtggagagccgaggcagtcgcatgtgatgtttttgaatggagagcaaaggcagctacatgtggtgttcttgaacacaaccccatagtgtgatggtatccatcctccgtccttcgaaaagtccaatgcccgtttgtagcatcaaaggtgaaacttctgtgtgcaactggattttaagtgctgcaaggaaaatggaatgtggcctcattctcatgatatcaagacaatgatgctgcaactcgaacaaggcagatgcttttcctgttcctgtttggtccgaatgatcctgtacagctgtatttagtggacaaggaaagttgtacctgcatgcctgcatatgaatacattatgaatgtataaaacagaaacaggaagacataccacagaataacattgctatggtagaaaatttatcagcactgggtaaaatatggaattatggcaaactaatgtgtaattcttacctgtaacagaagtgtccacagtgaataacttgttcccagacatgcattaatctttttcctctgcactgaaaaatgttacaattttgtcgaaagagactcttgtaagaatcgtatttatctcatttatatgagaaacttgacgagcaattgctaaaattttattgaaaattttgtagggcctttatcattatatttagttaagtatgcaagggtcatgtagaacaggtccagatagcagtttttcaccaaaggatgaaggatgaagtactagatactcccgttacagtcaaggaaaagcaaataaaagaagaaagaagattgctaatgacctgcctctacctccccaggtttcatactcttgcattgtgatgtcgatcaaaagattctctctccagctgagtgctcaccactcagagaagtatcattgaacacgaaatgactcatcgtaaacctttggcctagcccaggcaaggcgccatgcaggggaggctaactcttggagctttaaacatacctccagatctttggggaatatatgcatgaaaaactgaccatagatatcaatcacaaagaccatatgcaatacagaagcaactataagggaaataaatattatataaaaagcaagattccatttgctcatagtgctcaatggaatgttgtgaacataaagtggatgcttcactcctaatataaatttacatcgaaccgctctgttctttcccacagaaaatttgttagctagcccttccaccttattgaatatttcccaattcccttctcaccaaggatcaataaaa

SEQ ID NO: 36063 - DNA, 1501 bp, Oryza sativa
tacagtcctggagtattggagtacaaaagtacctcaattaccttggtcgttaaatctgttggaccgtaagagtctaggggatgccattaatgtccattgtactctctaactgaaatcaccactacttacaaagttataatcactctggcaagcaatttagacgacgcgactccatcggtcccaaatcccccaaacaaattttgaaaaaacagcaattcaccatcacatggattttacctgtcctcatccaccccagcctctcccgcgcaccgccgcccccgaagccatccacctgggcggggagctcctcccacagctgcttgctccgcaccgccagctcccacgtgtcactcccgggcgtccggtgtgacatccataggtatccctgccctgcgcgagcgcacacaccaacgggacatcaaaaccctagaggccatattacccaactccccccacgcacatgcacgcgcactgagggtacctgcgccggtggcgccggtgcacgggacggcggcgtccgcgacggcgacggagagcggggtgtggaggaggaggtggcgcgcgatggagagcccgatgatcccggcgccaacaaccaccacgtcgtggtgggacgcggacgcgggcgccggctcggggcgctgcgatcggagcgcgtggagcgggaggcgctgcccccgccgccgccgccacgggtcgcggacggagaagcggagaacccgcgagtacgaggcggagagagaggaggaggaggagggcgcgtggctagggttcggagcggaggcgaaggcggtggcatccatcggaaggtggtgtggtgagcggcggcgagacgaggtgatgagtgatgagctcgaagagtcgagaggaggtaggtgacggaggagggaggcgagtcaacggtcttcttttatacagacgctgacgtggcttatcctggtcccacatagtcagttctagtgggccgaattttgataggcctattgggtcgagtagtttcacttcgatccatggacgccacgagcccatgattgatggtttctttctgagttccgacggattttttttttttgagggacatcgcttgtagattgatccttcatcctgcttggtcgaaaaccaaatcctttctttgtctgcggtatttgataggaggattttgtgacgccatctccgatttgaaggctacatctgtttgctgctgttttgcgaattgaaggtaaggtactatttcttccttcctcataatcagggattacattaccggttgatcactaaatttcgagccccatcggtgtcacggttttcgataaattttaatcggttttcgaatttggaccaaatctacagtttaaccttcgaaattccaatcgaaacttaattccgagccgtgtcgaaactcgaaatttcgcggaattcggccgattttcgttgaaattgtgaaccctgctcataactgttagatcgatctgaggggtttttcctcttttctccatgcacc

SEQ ID NO: 36064 - DNA, 437 bp, Oryza sativa
tcactcagaagaatgctcaagggaactgggggcaggctccttgatagcgcatagacaattggaacctagaaaatgtcaacctgaatagaattttgcgcatatgaatataattatctaattatggaggatgtttctttctggagaatcaatcaatgcctacatgtatttttgtaatggttgatctgcctttatcatgactaaggaccaattagatcttagggatgggcatggattactccttgagtacacaccaagtgacccgcgttcatccttactagaattgtaaatatgcttgaggaactttcatggccattccagattggtgttgtctaagcattgtgtttgcactagtttgatagtttgaggacagtattttgatatcttgatgctgttaaattacatatatataatgcgttgacgatgctttgatcttcaga

SEQ ID NO: 36065 - DNA, 1501 bp, Oryza sativa
tcgttgttgcgctgctgtggtcaccggcgagggggacttgtttgtttctggtaccagtatcgaagggaaaaagaagatgcagccgttggatgatgatggaaggattggattggagctaatgccaccctctgcattagcttcttcaatgcagaggatctggatccgattttcttgggcttcttcccacgccttgtacattctgatgatcgagtccaccactccttgtactgagccgtaagctgcattgaaaattctagcatttctttagagccaaattccccaagtcattttcatctagttcatcaaattaacgccacttattatttattgagtttattttcctaaaatatttaatttatccttagtcaagtagacaatccatatcaataatttgatgagtaataagtagcacaagtttattgcaggtaagcttatctttggcttctacatgggcaagccttgtggggaactctttttatttctcgaggaacgcccctttattcattaaaatgccaagttaatgattatgaaaaactattaaaacatttgatagcatgtgtattgagtatatgtactccgttcaataaactctcaaccgagtctaaatccatcgtactaacaattaatacctacactattcatgcaatgatttgtctttttttcccaatgtgtatatcatgtttaaacttggctgattagtagagtgataaatgccactatactccatattatcaaaattattttggggcattaaattaaatttctatctcctaagtaaactcatccaaattagaggccccatcgtttggctttttccataataagtcaaaacggtttattaggaaaaaaagaatttgtaggtaaaatttttatatatgtgtttttagtgatttaaaagctaatgctgaaaaagaaacaatgttaaaaatatcttaaaattaagtttgaaaatttaaagtttagctttttctttggctgattaggccatccgatcggagcctacgtgtggattaattgaagaactatggtgcatataagacccaaacaaagtactccatagtcgatatatcattaaaaattagccattattattacatatcgacgttcaagcgtcgtgtatatatacatgcaaaattttgcagcaaccatgcaaatccgtagatcattacaaaaccttacgacaaatctaccaaagcatccttgtacagatgggaggagccaagcatctaatgaaaccaaaaaaacaaagatctagaaaaaccttgtaaaatacagcaaccatgatgcatcctctcgatgtccatatgtctaagcagattggcagcatctatcttcggagttttcagataagcttcttgtgatctagaaaaccttgtaaaatacagtaaccatgatgcattctctcgatgtgctaatatatacatgttcagagttttcagagaagcttcttgtgatcctaattctcgcaatgtacttactaatatatatgtatgttcagagt

SEQ ID NO: 36066 - DNA, 1501 bp, Oryza sativa
gcataccaaagaaatcttagacgtctgacgatacaaatcaaggaatcttcaatttcttttgctggagatattgagattccaagacagctaagatgcctaacattaccaaaaaatgtgcttttgcctttcattgcacacacagaaaaaggggcagattgagctgatctgatggtgacatacaaaaacagtatgcgtaacaaaatacaacaagaaaacatcatatttttcatctaagatagtacttgaaagttgaaagcatgatcatgcaaagagaatactaagttggcctccaacatcagggcttttttagttttcctctctctgtcagcctttcgagggcttacccatcatgtaatttctggatattgcttttttgttctctccctgctataaattaatgggacaaaactcctgcaccctttttcgaaaaacaaaaaaaaaaggagaacaagcaatacacagcaaacaagtactccattcttttaatgctctactaggtgcagtataccttcatttagtactgtgaattatccccgtttcacaaagctctaacaaaattgacatgtgccgattctcaattaggtgctcccaatttgtttaaccgagtactttatgttaagtactacaatttagtgaatcattggcgaaagaattatgcatcatgatagcgaaaatgacttgaagtggcactagtcactacagctaaaataataatagaaatgactggctaatctgctacaatctcaatcatatgaaagaacattttataagatgacaggggaattgaatttagccagctcaatttcactgttacattgtccctatagatgttttagccaagaaagtgtaaaaaaaatggagtgcgtctgacataccttgaaccatcttctgcaatgcttcaatggcaagcgtatcagacatggcatatgtggggttccttgtcatgatcttggacatgatggtttgctccacccgcagcccctcagcaaccacccttgtagctacatcctgcgattggaatcccgaaaaagaatgaaaacaagaaccatcttcatctcgaatcgtagtactaaaattagaccaagtgcaaagcatgttggctttttggttcacagcagagtaaaaagcataaattgaactccatggcttagtggaaatcgacttcactttaccttaactaattctaccttttttgccaaaaccgaatgaaaaagaaaaggcagaggaaaagtatgcatcaataagtataaatgtataattgcagagactagtgaacacatggtcaacaaaaatgactcctaattttttggatgaaaacatccaaaatctaaaggagaacaaaatatcttaaactttgacacccacaaaaagccacttgctatgctccaaactgagaatccaatccaggcatcgatgtttttcaaaagagcaacgagaaggtgtcgcatccgcatagcatcaaattgaaagaatcaaaccatcttctatcttccaaaatcag

SEQ ID NO: 36067 - DNA, 1501 bp, Oryza sativa
tcctatgaagccctttgaaacaaaggattgaatcatatccaatcctttgaaattcctatggaatggacaatcctatagagattttggagaaaatttagcaagaacttcaacctcttggtaactttcctttgagtctatctctctcatccaattcctacgtttttcctgcggttcaatcaaacggtcattctagtgtttttcttgcgttttgcaatcctctgttttacacttacatttctatcaaaatcctgcgtttttcctattcctacgttttctcaatcctgctattcaaagaggcccttaatagttttagcggttaaagcgaaataatgatgctggcggttatttgaaaacagatgaagtaactgtaaatcgacgtatagttaaatttaggagtttaaatcttgccaaacagcccaacttagtaccaaattagtaacacttagcttctcttgtatttgttgtcgttgagacagtagtttggttcgtaacagttctctgatagaaatgaaacaaacgcataaacagaaatacagacagcacatccactttctcttatcttctcctaagccacaacaatgatgtaccatttcgttttccgtcatttatgaacatcacttgttgccgatgtgttgtcaaatgcgttcatacgtactaagtagaatcccgttttcagattgatacgcaacgaattggttgctacgaaaatgtcagagtttcccatatcatgactcatcagctcatgacagatgatcgtctgcaagacagtgacatgactggactaacttggatcatattgctgctagctaatgttcatgctgcagctagccaagaaattaacacatcgaaatccagatgcagcagcagctaccagtcactgaaacttcagtggcagctgcgagtgttcagagtcacacaacactgcatgcatcgcaacaaacgactcccagctgcagccgtttccatcactgaaagcctgaaacgaaatcagcgacagcattcgacgccataggagcagatagagaagcatattgtcccttttcagctaggagtgacgatccattttgaggccagaaacgttcagagaattccagtggatataatataatcaggcacagctaaaagataaaattcattcgtgaattaagctgtatttttacaaggtgcacacaaaattgaaattggaattctgatcagccaccaaaacagttgaggaaataagaggagtgtgacaaagcatcagttgcatggagacaaagaagatgacagcaacaggattggaagtgatcagagacaggcaatgaaatcctgagaacaacctgaacctcacaactcgtactatccctttgcacagccagcaggttaaccaggttcagtcacttcactccagtgcagtgaagtgcaggcaggactaaatacaggcctaagcttagtttcaggtttatcttcagttcagagttcagaacttcagacacaggttgagaaagaaaagaagcagcaa

SEQ ID NO: 36068 - DNA, 1501 bp, Oryza sativa
gagggggactgtaactctatctagtttccttataccccactgcatatgtagatgggagggggactataactctatctagtttcctcataccccactgctgaggaggtggcagtggcaagaggacttgccccaaacaaaggcctcaaattgattaatgtatctgacacggaaaacagagcaataaattagtacgtggttaattacttattagcttataaaaacttaaaaatggattaatatgattttttaaaataacttttctttagatttttttttcaaaacatgcaccgtttagcagtttaggaagcgcacacgcggtaaccgagagagtgaggttggtaacttgaactcaagaacacaacctcagctgcgtgccgtcctccgggtcgggatatctctccatgacatagaggctgccaccgccgctgctggggacgaagagagagatgggatctgacttgggcttgtggatgtttggcatagccatcacgctgcgggcatcaacgtcacagaggcgtgtgatcccagtgtggtccaccattaccaccttgcgatctgcaagggggaagcagtcgatattacgctgatcatagggcatatatgtgcatttcaacctcaacatcggtctgggaaaccgaatcctctctatttgtatccttaagccccgtttattcttcggattataggagtcagcagccggtgctgctgctgctgtgttgccgaacagatggcgcgtcaggtcgatggagcgcagccattgggcgcccgcgtaggaagagtccacgatgagattctgaaaccgccgcgataggcccatggcggattattcgatcccaatttcgagccgacctttgcttactgaccgactgtaaaagggaaggatgggaaaaaaaaagaagaagaagaaaggaaattatattgggtgcatggagaaaagaggaaaaacccctcagatcgatctaacagttatgagcagggttcacaatttcaacgaaaatcggccgaattccgcgaaatttcgagtttcgacacggctcggaattaagtttcgattggaatttcgaaggttaaactgtagatttggtccaaattcgaaaaccgattaaaatttatcgaaaaccgtgacaccgatggggctcgaaatttagtgatcaaccggtaatgtaatccctgattatgaggaaggaagaaatagtaccttaccttcaattcgcaaaacagcagcaaacagatgtagccttcaaatcggagatggcgtcacaaaatcctcctatcaaataccgcagacaaagaaaggatttggttttcgaccaagcaggatgaaggatcaatctacaagcgatgtccctcaaaaaaaaaaaatccgtcggaactcagaaagaaaccatcaatcatgggctcgtggcgtccatggatcgaagtgaaactactcgacccaataggcctatcaaaattcggcccactagaactgactatgtgggaccaggataagccacgtcag

SEQ ID NO: 36069 - DNA, 480 bp, Oryza sativa
gtatttcttgtatgctttgtttgtcgtttagattctgtcagtttcggtgatccagtttatttcgaagtggttgccgaggtttcatcagcacaagagcaaggcaagtcatacatacaggattgatcatgttgagcctattttataaaatcccctgctttctattaaattgcattgttttagaatgtcgtgtgggatggatgcctatcatactcggcctgttgaatatcttatgctattgataacttgggttataattgactagatgatatgtttaggaatgcttagccatgcttagatcaactagttcacaatgggattcattataatttagtccttaattatatgatgataaccagcatgggctttaggctaaatctagagtataacttaacctagctgacataccatggcaagggtagaggcaatggtgtagttcgggcctggatattaatctttgttgtttccggatttacctaggca

SEQ ID NO: 36070 - DNA, 294 bp, Oryza sativa
aattgtgaagaatatgtaaaatattgtactagattaattccagtacggatctccaagtttatagtacaaaagagaaagtgggttagtgagaaatacctgtagtcttccagctagttccatgagatggtgggctagccggcttaggttcaaagtatcactccttatatttatttgatattagatcattctctaatattcatgttttttagaaagtgggttagttttctcagtacaccggctaaaccattagagttatccctgataattcataaatgaaaacgtaataacaccata

SEQ ID NO: 36071 - DNA, 1501 bp, Oryza sativa
aagccaaaacatatatatagtaatagattagctataaggtttgctacaatttttttctcctcactctatctctcacttatacatttaatgtatttgtcttggaatttgtgataaataactcttgcatgagagccaaaattcctaatttttcactacctctctcctccacctaactttatagtaagcctatagctcactgaaacgggcgacttctatcgcccgccgatacacacgattccgcgataaaaaattgggccacaccgaaccccatcgatcccgtgtgacttttttccctacatcagctctcacctctcctgctctagatcactttttccgtccgcacaaatcgcctactcctactccacatgagccccaccgccgttcatcagagattcggagtcaatttccaccgccgttggaaaccacgtacgccgcgaagctccgccactgttgccaaatcaaagcccacgcacctcatatatcatgttcctctcatgctgaaccatcagatcgatggttgctgcgcgctagatcgatgttgtccttatgaagaagaagaagccgttgttgccatgccatatctcatgccgccttgtggctgttctgttgattgagcaaacaagcagctagaagaagtggttctgagttctgttgtgtcagtggatttggggatctttttttctgtttctttttacatcttctctcgatatatacctgttgtttatttacacaaagtagatgatttttttaggagcgatgcaattgtgataagatttggatctttccatcaacacttcactagcagtaattatctaaagactaatcatttttttacgaattcttgttgatatcacaagttcacatcatacagatggctacacagatatagtttagttttgatcatacacatttatcttggcacacataattaattatttgatcactgaggtgcagtctatatataagagctaatctattgtactagttggctttagtattagctataaaatataaaggtaagtgaagctagctgctggctatattattgaccttgctcttatcaggctagtctattccctcgcgagcattttctcaaactacttgatgacgtgttttgaaataaaattatataatttaaattagtttattttcgtgttaaatatagttaataatcaattgagccatgtattgattcgaacaaagcctctttactgctattctgggcgtgtttatggtcaatttttaattttactaaattttagtagcacaattaaagtttgatagggtaaaacaccattaccaacacaacttctggagctttccactctcaaatctctaccaaattttgataagattctaacccaaatagcaaatgatttagtcacagagcttgataatcgtttaatcagccatacggaaaaacaattaataaagcttttgtgtcaccaaaattcgaggatcaagtttgtgcgaagagatacaagaaacagcgagtcgtagt

SEQ ID NO: 36072 - DNA, 383 bp, Oryza sativa
gctcagattatttagttatgaatttcacaatataagctgggttattacaaataaccgaaaacccttaatcatttattacgtattattgcccaaagataaatagatcaatggaaatatatctccggtaagcaagcctcacgaattagcgactccacaagccaatactttgtgacccgggaccatccaaacggtcaaccgaaccggcgaatggaaccagcggctcaaaacgactataaactaaagaacgactgaacgaactaatactttgacaacactacacgcgaacgaacggttagcggcttaacgaacggctgtggcaaaggcggcaactaagcactattagcggcaacgactcggtacagcaaacgataggccggtaggta

SEQ ID NO: 36073 - DNA, 1501 bp, Oryza sativa
ttaccttaggattgaaaaatgaacataaaagatatgttcacgccaccccgagtaaaatttttactctcggggtaaaagtttacttgaagtaaaaaatttactcggggggacgtggataaatccttaacgtttattttttttaacctggggtagttatcaactttgcattataggtggtttgccccacatattttccttttacttactgcactgacaaatactaaatttatgtctaactatcaatatttatcatttcctttccaactctattattatcttcgcctactcactaataaaaaaaactaagataaaaaattcaaacaacctcttataagtcatgaatctttctaatctaccaatacaacttaattccgtgccattaaaacattccccactcccatctttgcctagattttgatttttagtgatttcttgcattatgtggatctcgatagtatcttctcttgctgggcatgaaatttaatacactttttctataatatgtgattgatgtcatatttcaacaccatagcgctagtggaattaaagtgtgtaaaagtggaaggtggaaggaagccgaggtatacaccccactttgcttattgcaatagtggggccatgatttataaaaaccgtgcggttataatggttatcatgtatggtaacatttttagtttttgaaaccacggtatacctcgtggtaaccgcatggttatctcggtaaccgtcaaaccatggggtggtggtaaccccaccccaaacagcttagtaaaccttgagtggggctcatagggtgtgaaaaattgttgaaaactgatagaggtaggagattaaaagagaaattaacttgtgaggagcacatgcacgaaattaagttctttgggagaaattgaaaagaacattgacttgttggtatgtatttggattttcctcttgaaactttttttttttggcgggcattttcctcttaaaactaaacaatcagacaccagtccttataggggtagggtttacgtgcgtgtgttcataggggtgagtgtgcatgcattgtgagtgtctgcgttgtactgtgtaattctaaaaaaaaaaaccgtaccattgaccccgaacttaaaaactcattaaacaccatatgcatgcactggccataaaatcgcgagcgcattaacagatcgactagctgagttttttttagtaaactctaaatctaggcacgcacccaccctgctagttttattatgttttccactttcgctatggcttggatgggttttgtccccaaaagaccacctctcaaaccaccaatagattcttgggttaattagatccatgccattattaatctgaccgtatttgactatggcttggttgtttggattaagttgcccctggttgaattagtataccaaccgaatcggcttgtgcagctgcaacccgatcacctctccctcgagccctcaaaccctaaaagaagcggtggtgacaacgacgacgacgtcgg

SEQ ID NO: 36074 - DNA, 1501 bp, Oryza sativa
tttttaaatgaagtcgtagaatcttgtgtggtttttgtttgaaatctccacggagaaagggtgaaacttaaaaactttagattctagtgcccttttgtttttttattccttgaaaattgataagaattagttggtgattaggatagtgtttttttaaccaaattttatagattcttgcgaagtttacagaattattcataccttcgtctatttgagtctgtttcaaactgttgagggatgcatttgccgattccaagttacatatggagtgcaatgcatgggtggtcgatagttaagggatgcattcgccacgtttaatcgaaaaagaaattaatactccctccgtttcgaaatgtttgacaccgttgactttttagtacgtgtttgaccattcgtcttattcaaaaaaaatttaagtaattatttattcttttcatatcatttgattcattgttaaatatactttcatgtacacatatagttttacatatttcacatttttgtttgaataagacgaacggtcaaatatgtgctaaaaagtcaacggtgtcaaacattttgaaacggagggagtagattggaaagtaggggtgcctatacaattctccttcttgatctatatgcatctatcaatctatcttgttgagtgggactccaaacaaccagctgctgaactgcccacaagagcaagttgcattgcgacgcgttatagaaaaccgggtccatcctttgctgcatcatcgatcgatcactcgtgatgcatctgaaaaaaactttcctctgttcatatggcagcaaaccgctcaagctagcaaaaccaaaactgaaactagttgtgacagcaaacacagagatggaactgacttattgacaatatcaaaattgctaaaaatatcctgtgtaggactagcgcgatcgatctcgtatagcggcggccgacttggtgctagtgcttctcctgggatatgtaaggagtcgctatcacgtggtagtgtgtctttcttttcccaggttatagctttcggacggtaatcttgtaattttttccgctatgttaatatgaaacctcgcactacctcatgcgggttgtttttttttaaaaaaactaaaacagctgaggtttcgtcttgcactctgaatgtccttttcatagagagctgttcttttcctcattctgccaaaaaaaaaaagaaaagctttcagccaatcatgagctgtatccgtcatacatagagatactctcaagtcggcttttcttgcagacaaaattgtctgataaagaaaaagaaaaaggaaaaaagaagatgcctcttttttcttgcagacaaaattgtctgatactgttgttttgtctcgagaggttgtcaactgaactgaagtggtgctgtgtttttctcctgctactcagtatttgctccatggatgattggtgctgttgcgagcagaagagctgtctccttcatacagcctctcaactaccagcttcattcattcatgatca

SEQ ID NO: 36075 - DNA, 1501 bp, Oryza sativa
tggctatagcaatcagcatgtgccaggattcataaatcaggctgagcagctcaaagccaagggtgtagacgacatcttgcttgtcagtggtatgtttctgtcatttgtttctccatgttcatattcccaaatttagcttttgtcagaaatcttcagtcaattatttgaactaaacatggtaaggacaaaggaaaattttattctatttcagatattgtgattttcccgtgttctcggtaaagttgtgtagggtagatatactgactggtgtacaaagtagaaacactatccactttctgactgtatatagtaccgaatcaaggcagctgtggcagaatatgacttatctgtggatctatgatataattttgcagttaacgacccctttgtcatgaaggcgtgggcaaagtcataccctgagaataagcatgtgaaattccttgccgatggtttgggaacatacaccaaggcacttggtcttgagcttgacctttcggagaaagggcttggtattcgttcgagacggtttgctctccttgctgacaacctcaaggttactgttgcaaacattgaggaaggtggccaattcacaatctctggtgctgaggagatcctcaaggcactgtaagagcttcagctcttaggaacggcagcgatcacttggacctatcgtgtcaatcttgtttaaatttgtctgcaaaatacttgtgcgaataaaattgtcgatgagctgcctagttgtgaggactttatgataatgtttgaatctgtatccactgttgaatcaagtagtaatgttcagtgctcatgttaagttataatcttcagtttatatctccagaaaaaggtttgatctttccgttgacacttagacagtgacttctagagtaaactggattattggtcaagaagagagaattttatggtagaaactgatcggatcgcaacagcaatgcccgttctctgaacaggcatatactgcctctgcacagcttaatactcttttaatagatgacgctgttgactttttctcacacatttgaccattcgtcttattcaaaaattttatgcaaatatataagatataaatcacacttaaagtactatgagtgataaaacaactcataacaaaataaagtataattacgtaaattttttgaataagatgaatggttaaacatgtgagaaaaagtcaacggcgtcatctattaaaaaagaaggtagtatcagcgtgcgaagatggcaataaggaggctgtgcggttatttcatttacaaggtaaatatggtgataaatctaggcttaatgcctgggccatcttgccaattacttatactccgcatagtttacagcaactgtagcttgcatatctttgtgttactgttggtgcgcgcacgtctgcttttgtattccgaaggaaaatatgctagtgtgcattctgttattcagatactagcggtttcacattttgaatttctgatctattcatgcaaaaattttc

SEQ ID NO: 36076 - DNA, 1501 bp, Oryza sativa
atcctcgctatatctcttatccaagaaccacattgtggctatctatttctcgccccatttcaccactgtgcttaagctcgacatcaacaaccccaaaccgaagctacctgttgatgcaaaaaacacacactggcctgggagatctgtttagctccactgcaggaccaaaggttgatgagatgcgggcgtgccagtcagtttgaccctgcaactgacaagatatacaaatagcaaatcaatgagccgatcggctgacaagccgatagattacttccaaccgatgttgataccagccgatagcgatagggttttgagctatcggctataattctgatgtagattctgatgcttgatgtaaataacaatataaaggcaaccggctgatgataatgcaagaaagcaacaatataattcaatagaaaccaatcggctaacaatgatatgatagaacaagtattgatccgaaggttaaaacatacatcggctggaggtccgatatcataaaatccacagattaaattaaacggtgaaatatttgttatcattggctaaatccaacttatatgcaatccttgtaagtcgatgcaacatccaaatacctcatcggctgaaaccccgatgaaacccttattggcagtcaaaaagcaggctagggattatggttctaaacacggcttagtagatcaaacttaactgatgcagcactaagtatgaaaagaaacacaatatcgagacaattaagccgttgactgatgtttagggtggtagatgccttagctaatctaatctagtaaaacaatttagccgataccggcagaaaccctaaagcgagaagacaacagattgagctaaattgagatactaagactagattaattaagacatgttaaatagccaggcaaatatatcaaccaaaccagagcaatccaagaggtcgaatgtactgatgcagccttgaacgacaccgacatagacgatacaattgcctgggccggcggaacattggacttaccccttcgccggagatcgaaaaccaatgcagccccgcgtcaggtgccaagtctcgccagacgataaaataaagtagaaaaggtaaaaggcagcgatgcgtcgaattgtattgatcatggagagatgttacaatgaccccgggtgtacatatttatacccatgggtagatactagtccttgtaggacaagaaagaaactttcctaaaagataaaaggaaaacataaagtccttatgggacactaacaaatattgcctaattaatagataaactaccatgtcgcattctcctggaactcggtcacttctagataatcttcctttaatatattaattttttaaccgaatatagcaggaatccgactattggcgacgtgataattctctttgaggcttaccaaattttactgttaacactaccgtactcgatatcccacttcagtgtacaacccttaatatacccccgcctaccactgactccatcatggtgaa

SEQ ID NO: 36077 - DNA, 508 bp, Oryza sativa
tatcgactaatggttttatgggcaggacaaaagttctcccagatgtgggtacacacagaatgttaatacataggcagttccgcataaaaaaaggttcacatgcagtaaacattatctccaattgttcgaagtgagccaccaatctataaaccattttaacattgtcaaatcaatggagtagacagcattactatgtttttcatgagtaataccaactgccaacgtgcttttgccttctgcatactatctgggtatttccctctcaactaaaggatggtgtgatgatttagttccagttagtgcgcaaagtagttctcatctgtatgtaaaagatttttcaacttttgatagtaacgcttagtgcggtgctaatttcttatgctttaaaagtatttacaaattagaagcagagagtgactacctcattgttccttaaagcttcttgaaacagagataaacaatcggtagcttcatacagaactaactccgctattccatccttttcagg

SEQ ID NO: 36078 - DNA, 964 bp, Oryza sativa
agtgatgatgtcccagctagttagtagatgacaaggctacatgatggagtatcatttagctttctgaatatatccatatacttgggatttgataaatttaactataaagcataaaagtggcatcgtcacctgtacaaggtgattacgaaaatacgtgaaattaaatgaggggtggttgtgatcggttaagatgagaaaataggtagaaaaattatttgaatatacatgattgtgattgttgagatgaagcggtaggttccaagataaattttaaacgctagatgttgctatgttttattttgggaaggagggagtagtacaattacaaaatagaattaataatcaaatatttctatagtaatactcaaactctaaatacgtgtaagtattttttttccctgaataattgaaagccatttgctaatttaagaataaaaatggtgacaaccttgttatgtgtttccacattgcttaaaactactctaaatatgatcaaagttgagaagtggatgtttaataatttagtgttaaatattatccagtttaaaagttcaagggtgttttttaagactcatcaaattcagggcgtacaatagactggctcttctcaaagaaatagagtgtttaattcatgtggcgtcgtgttttgcaaggagttgacagactctataatgtcaaatatcactagctcttgctggatattccaaacttcaaattaccgccaagagagcatgtgatttttattttcaggaaattataataagtagggcgtttcacgatcactgaaaagtataatgcatatatcaatttcatatgccgttccacgtgttgcttaaccagctattaaaccgtaggataagtacccccattaaaaacatcaattagattttttttattttagaattggctgtttcttttttatatatttgggtctttccaaatctccccttccatcttttacagg

SEQ ID NO: 36079 - DNA, 1501 bp, Oryza sativa
tgagatataaaaacacaaattcagatacaatatttttttacgggaattcagatactatacagaatggccatttgtgcttgggcccaggagtaatctgaaccaaacgggccaactccaacgatacgagtgggccctttccttctttcaacccacggaaaccggaaccccaccatctggccatctccaactccaatcaggcgtccaaatgcaaaaatccgttaccaaaattatggaaagcctccttccccacgccggctcattctaacaggctgcgttacccactcaccagtcggtatgccgtatgccaatcgggctgcgccctgactgcttacgacgatactatgacaaaataaaagcgaaaatgattatccagtcggttgcgttgcattccattccgtgtcggacacgatgagtttgccctgcgttcgcagcgatcgccctggactccgatcaggtctcgaggcgcatacgcattcgcgcctataaatccagggcatatgcgccatccaaacccccttccatattgagttcccgagggagaattcgatcgaagaatacgagcaaattaaaatcgatcgcgatacttcggtgttgacgaaacagcgtgatctctctgccccgcaatatgccgccggctgctgcgggctactccgccggcatgaagcggcctctcgccgcggtggcgccgtcgtgcgacgtcgacgggcgcaatgccgctgccgctgccgctgcgaaacggcgggaacgacgacgggaggccaagcgggcgcgcgcggcggcggctgcggcgacgggcgctctggtcccgtacgtggcgcccatcgacgcccggcccatacgcgccgtcccgctcgccgccgccgcggccgcgcggaggaaggaggccgacgaccaggcggcggcggtgccgtccgcggagccggcgtggatccgcaagatactgctcgagcggctggggatgacgtacgaccagccggtggtgttcatcgcgaggaagacggtgaccaggaccgacctcgacccgcaccagaaccggttccgcctcccgatcttcggcgtggagcgccgcctcctcccgatgctcaccgtcgacgaggccaaggaggccaacctggtggagaacgacgaggagaagggggttcctcgcccgaggccgaggcccaagaagaagcgacgcacggagaaaggcagcgtcgtcatcgccgccaccgccgccgccgacggggagctgcagaagccgcagggaacgacgccggagacgaacgtggagggagaggatcaggctcctcctcgcccaaagccggtgccgaagaagaagaagcgacgaacggagaaaggcagcgtcgacgtcgccgacggtgagcagcagcagcagcagaaggggagggagaaggagccgaggaagaaggcgcaggggaaggaccacggcggggtgccggtgacggtgctgcacctgagcggcgccatgaaggagctgcggctggtgctctgggacagcagc

SEQ ID NO: 36080 - DNA, 1501 bp, Oryza sativa
ggattttgatcggtggaagtaaaattatgaatgtatttagggcatccacaatatggtgtaaaagtagttcataagcaatagaatattccattcagccacctattaccattgtgcaactagtccatatagaaaaaataacaaaaggtatctatatgcatatggactacccatatggaataaattatattatctatctctactcctctctcttctcctaatgatacctcgtttccatatacattgtggagattgtcatagataaaaactatttatgtgggtttcatctatatggatcactttgccatatatattggtgatgcccttagttcttgttatgctaaaaaaaagttatagttgaaagtgctttcatacaatattagtcatttggaataagtctattttacctccctcatctcttgttctaggttgaaattgcatccctcagccataaaaaccggtataacgcatcccctatctttcaaaaccgatataaatagaatccttcggtggtttgaaaagtggtttttgcagataggacccacatatcagtgcgatatgggaaaccgtatacaatgggcccagcatgtcagtgacacatgggaaaaaaatgtacagccagttacctttcacgagtagctgctcgacaacagcaatccaacgttcgcagctgagttcatgtgcctctctgccctacgtgcgtgccattcacgtagatgtgtcgatggtcgtcccgcgagctgacttgcgtgaggaggcaacgctcggtggtgactaggcctcgacgtaaaaggtgagggaggaagatagggagtttgcggacacggcggcggcaccgcggatctgttctcgcgagaaggtggtggaggacacagcgagctcctccccgcgcacgggcagccggcaacacctcccccgcggcccgctagcggcactatcggcaatctccttcctgtgcgcacattgtggctgaccggcgagctcctccctgcatgcagctgtgaggtgagagaggggaaaggtgaggaagaagatatgatggagtaggtcactgacagatggggtctacaagataactcaggcattcaacgaggtcaaagctgccacatcagaaaacaacctcccgaaccgccaaaagaggcgatatacaccggtttttaaagacgagggatacattatacccggttttacggtcaagggatgcgattcaacaagaaacaagagttgaaggacgcaaaatagtttattctctcaagttaacatgattatactaggcccgaaacagtattttagtgaactgggccggcccaggctagcccaaagctctacacgtcctaactccaagccatccagtccgttcactcccttcgcacacgaatctcaaagcggacagccacacacccctcacaggcgagctcggtcggagcggcggcggcggcggcggcgaaccgaccctaccttgccggcggcgagcggcggcggcggatgggcatggaggcgagga

SEQ ID NO: 36081 - DNA, 286 bp, Oryza sativa
tctccactaacaattctgcattcaactgagttatcacttactccccctatctcacacgtgatatattataatacaacaaatctggacaaagataagtccagattcgtagtagtataatgtgtcacatcccatcctaatttttttttacggggaagtagacctctagaaggctttcctttcagcaaaagaagagagagagaagaaaaagaacaaaaaagaattaaggaggtcaatattcacagtaatattcagaacactgagctagacaggtagtgagcccgtacta

SEQ ID NO: 36082 - DNA, 1501 bp, Oryza sativa; identical to SEQ ID NO: 30963

SEQ ID NO: 36083 - DNA, 1501 bp, Oryza sativa
tttacccgcaatccatgacgtgccaaacacattagccttgtcatggcaaagctttttggttactaacatcagtggtacatgttccatgaactctagtccccatacgctctgaacgtaacgttatcagcagcgagaggagttctggcgttcccgaggtctttagagagaactgattgtatgacaccatgtcatcgcaatcagggttcacaaacaagtcgacatcaataaatctcatatatttacctgcgcctcggtaaatatcgcaattgcccttcgcgacataaatttgcctcctgcgcgaggacttaaaatagaaccactgtacaaaggcaccacttttgctagataacttaatcagctaggtctatacccatacgagaattgtggtcgtactcgtatgtttttcacatgtacttggcaattttatgtcggttggaacagtactagccacccggaaatcaaccatttatattgtactgtcccaatctaacttcattaaattttatgcataatctaactaggcagggctaagcaaagctagcatatatctggtttactatgttcaggttatgcattcaaaatcatgtatgtctaatgcatggaataatagagatataaaatataggaattaattatgctcaaaggggaggaataataacttgccttgctccaacgtaaataaatccgagatagacaacctgattatctgatccttgaaataccacaggttgtcatccaaaatataatagactctactacagaagaggaagaaccaaattcaataaaagccataaaatagaaagaaagagataaacggttgggacggttaggatttagggtatagcctatctcttttatagggtatatggattactgggctgatattttatgtgtgggttattgtcacaccccgaagttttcctcccaagccaaaaattgaatttacaaatgaccccaagaaaatgcaggtgaaatcaggaaaaaaaaccctaataaagtaatgcaaataataatcggattggacatgtggaatttttcttgagttctacatgtcaaaattcattaacaggatttttagtggaattttcagagctctagaaataattttaaccaattaaaattgagcaagcaatatttttattccagggaaaatcctttttccttttctttttctttttttttcctttctttttcctcctttttgtcaaatgggccgtcggcccatttccctttttccttccctcctccttgctgggccggccgcaggccgaggcccagcccaggccgcccgcctccctcctctctcggggtcgccgacaggtggggcccacctgtcgggcccgtctcccacctcccgccgcgcccgcaaccgccgccgcgcccgcaaccgccgccgcgcccacgtctccgccttccccgggccacgtcgaccacgcccgcgcgtgcgccgcatcccccgcgcccgttcccctctctctcccgctcgcgcccgcgcccgaga

SEQ ID NO: 36084 - DNA, 1501 bp, Oryza sativa
aagcatggaacttgaattatttaaacagaaccataatctggaatattgaaataagaataacatcgtaaacacaagataaagttgaaatatatatggcgtaaacaaacaatctgaatataagcaatcacatatcacatatcacataaaaatatatcggacataaatagatagagcaaacaatctatgaatcacacagttagttcgtcatgcacttgcctttaaccttgacggcaacctggcgaaaccccctccacacctgtggagtaaagctacaagtaaaacctctatcgaggaatcgttgagactaactatacatgtccaaaacattatgaaagatcaaaacctaaatttggtatttatctggcaaccacacaaaaccacctatactagccctatacaatgttatatacatatttcacaatccacctaacaaaaagtagcaaccgatatcactttagacatctagacaaaattctctacaactttcatgtgggtgaaaaaaatcagattaagcctatgaaagtcccagattatggaaaacgaattattgtcctagtactgtttctattgtttctcccaaaccatttatcggaattgagtgaaaccagcgccattagaaagatattgatgatgaatacaaactttatttaggacaactaacctgaatcacaatggcctgtttaatgccagattttaaaatactgtttcagcccataatcaagaacctcaaaaattgcacaagcgactatcgaatcaatttctattcgaatcttatacttctagggagtaaccaaaagtactgttgcagcgaggatactagaatttcgaaacaaacccactagttgcgaagtcaccgaaatccccaaaattactcggcctttaccttcccttcttcctcctgttcccctgcttcctctgctctctgcacccttctcctctctgaccgatgcagtaccagccaccagcagcagcagcagcaggggaaggttagtagcggcagcaagcaaacaagcaacagccctagatcagattggcagcagtaagacctcaccgggaagaagcggaaccgaaagaatccaccggttgtgatggaggatgatggctgcagcgaccggcaatggtcggggcagtggtggcgacacaaaagcggcggcggtgacaggaatggcagcagcagcgccagggcgctggagtagcggtggctagggcttctgtagcgatctctccttttttttcctttttctttttttttaagttatataaagagactaaaacacaagatctaacggcccacatcgtttcaatccccaggacttcgttcggactccgattactataaacttatagtctattttacactactcagtgagctctacgcatccacggtacctgatcgcctattcgaaaaacggtttaaaaactgaacttttgcgcgttcgttttaagatctcccgaaatatactaattcgaaactcggggtattacagtcaaacctccgtgc

SEQ ID NO: 36085 - DNA, 681 bp, Oryza sativa
atggtcgcctctcccttccttctcatgtcgcagagactgtatagcaaatttaatttgctcgatctcgagcttcagatcacgatattccttgtctagacgttcctcctgtatgatcgtaaagggtctttcctaccttaaaaggtagccaatgatgtgaggggcttctccactacgtatatgttaggtcccttgtttttctacaaccaatgtgagactattcaacacctccttatcacctaattaatcaaagaacacaacatagaagaaaaaaagaccgttaaataaatatcaagactaaaattatatacaataattacttatggtgggaaagcatctatcactgcaatgaatactcgatcatgcatatttgctaggagccaggaaacgtttagagcacagacaaatttaagtatgtgaccatatcgagtgtttgctattattgttctgttttcaatcaccataataacccagtactaaatatgtccactgaacttacagatatattcctgaaaccgtacttatgataaaatacctcaatgaaaccaatttattctagatgttcttgtcgtagtaatcatgatcaatgcaaattaagcataaaatgattaattatatatgcaaattaagtgtgcaaaggtaataatgcgtgccatatacatattggagaaactacttaagcga

SEQ ID NO: 36086 - DNA, 1501 bp, Oryza sativa
ggaataaaaatattgcttgctcaattttaattggttaaaattatttctagagctctgaaaattccactaaaaatcctgttaatgaattttgacatgtagaactcaagaaaaattccacatgtccaatccgattattatttgcattactttattagggttttttttcctgatttcacctgcattttcttggggtcatttgtaaattcaatttttggcttgggaggaaaacttcggggtgtgacaataacccacacataaaatatcagcccagtaatccatataccctataaaagagataggctataccctaaatcctaaccgtcccaaccgtttatctctttctttctattttatggcttttattgaatttggttcttcctcttctgtagtagagtctattatattttggatgacaacctgtggtatttcaaggatcagataatcaggttgtctatctcggatttatttacgttggagcaaggcaagttattattcctcccctttgagcataattaattcctatattttatatctctattattccatgcattagacatacatgattttgaatgcataacctgaacatagtaaaccagatatatgctagctttgcttagccctgcctagttagattatgcataaaatttaatgaagttagattgggacagtacaatataaatggttgatttccgggtggctagtactgttccaaccgacataaaattgccaagtacatgtgaaaaacatacgagtacgaccacaattctcgtatgggtatagacctagctgattaagttatctagcaaaagtggtgcctttgtacagtggttctattttaagtcctcgcgcaggaggcaaatttatgtcgcgaagggcaattgcgatatttaccgaggcgcaggtaaatatatgagatttattgatgtcgacttgtttgtgaaccctgattgcgatgacatggtgtcatacaatcagttctctctaaagacctcgggaacgccagaactcctctcgctgctgataacgttacgttcagagcgtatggggactagagttcatggaacatgtaccactgatgttagtaaccaaaaagctttgccatgacaaggctaatgtgtttggcacgtcatggattgcgggtaaagcgtacatttactacagtaaagtataaatgaatctattcgaatagccgtgctcacggatttgagcattgggactcatatggtatttggttagaaacttaattccaaattttattaaatactgttgcatttaaaacattttaggctttcttcctctatattctttgctttctgcaagtaaacctagctttactcagatattaccatttcatgcattcattattgaatataatagattgccgagtacgttgtactcacccttgcttcaacccctttttcagtcattttggagtccttgctaaagttgggagttcaaacacataagttagtttcattctaacttaattcgcaaatataga

SEQ ID NO: 36087 - DNA, 1501 bp, Oryza sativa
tgaggagttccctgaagatgaaggcttcggtgtctagctcgtgcctgccgtcaagtgcctgtggtcgtcgccctagtcttccgctgtttttcgttgtctttgagtgtgctgggccttcgttgcccatgtaataattttatatacgcttccgcttgttaaactctgatttgtatcaacttttggtgtaccttgcctcctgggacaaggattaatgcacgcacgtaaggaatgcccgttgggttatttccggtcgtgacaagttggtatcagagcctcctttgaccctaggacgagccgtagatcccaagccttagctatatttttaaaaataaaaatcctttattatttgtgaaaacccgctattctctctctgtcttgctgcttcatttatcgtcaaaatctgatcttttaaatgttgtttttcttttgtttttgtttatagatggccggcagcgttacccgtcgtggtttggacatgactggcttcgtcttggagctgcgaggcatgtgcgtggtcttggggtatccacatggagtggattaccaggccaggccgctcccggagcaggagggtgaggatgcagagcctcacgctggttgggaggtcactgcagtgatcctctccggctctcctgagcggacttcgctggcagtcactgcgggtggagattccttccccgccgcttgccagaacgccgctctcctcgccatcggcactcttcaccagcgctacccggacgagttgcagcactcgccctaccgctaccacccccgtcgcggaggagccagcgacctcgccaccttccgagacgccagctcggaggatgacgctaccgtcgtgcatctggcacgcatggtggaggcgtacgacgcggctcgtatcgacttccatcagatggtgcgtcgtggcatggtggagaacaacctgaagatcctggagctgcgccaagagaatctgcagctcaagaaggacctcgacgcgttggaggcgcagctgcatcagctcaaggtcgcccagggagagatctgccgccccaagcgtcgccgcgtctgccgcagccagaagatcaccgcccgcaagagcacctccaggcccgagcttgttcgtcagtccctggcgtggacttgcttcgtcgagacccctcgtgccgagcctgcgcccgtggttccccaggagggggaagcctccggcgttggtagctcggagggtgcgctgttgctcaccttccgccctggcccgtcgcagcggtagacgagcagttagtaggcctgcgcgtgtgtttttcttcgtttttcttcttgagttgtgtggggcatggttacaccggtgtgtggtgtaactatgtcggagcctgtcttattttgtttgcctaagcaacttgaacattaatgaaccaatttaatagcagtaataattttaagaataatagtagtcgtgggtggttagttttaatcgtcagctcttcttctctgtttgctggttctgtgtggggttttctga

SEQ ID NO: 36088 - DNA, 1447 bp, Oryza sativa
gagccctcggatatgggcaagcctagcaatgtacccaagtcagtgttataattcttaaaatttgctcaacaactaaaatgtggaatggttggcctgggttggcttaggacgagctgggacccagggtcgggttgccagttcggtctgaatcatcataggccttgggttaaggcaggttcgtgtgggttcacggccttgattaataacattgtttagttctaggatcgtgtttacaactagctttgagcaactaaattcctttaaatgctgtttactgcaactctaaccccttatgttataattccattgtactcccttgcatttattttgcatttgtgggtgtgtcttgttgagtacggtggttgtactcagtcttgcttaattttcccaagcccagatgaggagttccctgaagatgaaggcttcggtgtctagctcgtgcctgccgtcaagtgcctgtggtcgtcgccctagtcttccgctgtttttcgttgtctttgagtgtgctgggccttcgttgcccatgtaataattttatatacgcttccgcttgttaaactctgatttgtatcaacttttggtgtaccttgcctcctgggacaaggattaatgcacgcacgtaaggaatgcccgttgggttatttctggtcgtgacatcagctccctactggtcatgtgattccatcggcagatgaattaggaaagaggaaatattgtaaatggcacaatacagtgtctcacagtaccaacgaatgcaaagtttttagacagtagattcagttggccattgagcaaggtaaaatcaaatttgatgattcaaagaagccgatgaaaattgatggtaacccttttcctgttaacatggtttacacaagtgggaagatagccgacagaaagaacaatcggcttgactctgtaagaatgattaataaatatcagaagagatatgatcgacaggaggagcaatatttcaaggatgatgacagttttgatccacattggagttgtgagtttttcatattttgctggaatgaagggatgaaattgccatcaatagaggattgcccaggttgcagtgatatagacaagagttattcagggaatcctagccgatttcatattagagaagatcagtttgtgcagaggaagttgcctgttcatcagaggttgggcccaattcatcaagattatttccaggaagaagttgctgaagaggttgcaaattcacaatggtgtccttctgggattttttctaagagtcagaagagaagggttcaaaggatgaggaatagggagcaatttcaagaaaatcaacatgatatgggtcatcggctgaaaagagcaaagacaaaacaaatctgcagtgttaaaagcaaagtggtatcagccgatgagattaaagccgatgaagcaaaaagattggctaaaggaaaggccattacttctt

SEQ ID NO: 36089 - DNA, 273 bp, Oryza sativa
aatttacatgcattttatgtcttagcttacaagggtcccgttgtcgatgtgtaggtttcgcccagttcgctatgatgcaggccgcccacttctcccaggctgcagggtcagcgtctcaggcagctgtgtcgacctcgcactcagcgcagttctggcagtacaccgggacttcgtcacaggcagccggcacgttgagtcagggtccaccactggaccatgctgggacctcgtcggaccgcttgctgccttccacctttctcttagacatcactg

SEQ ID NO: 36090 - DNA, 1501 bp, Oryza sativa
ctaatgaaactaatccatccaccaactatctcttacaaagtaaacgtatatcaatgatactctctctcacaaagtaaacgaatatcaactggtttattttttttcgtgaaactagtttactcgagtttaaattctaaacttaacacggtgttcaaatttatggttaattatacttttagtgataggcaacatatcacttgtcccatcgacagcaagacgtccgtgattacttggtcaatctcaaaatatttaagtgtttataaggataatgacttcgctaatctcaagatataccaagtgctcataagggtggtggtttcatcaatctcaacatataaaactcagtctttcgaaagtgctcacagaggatagtgtacacattcataggggtgagtttacatgcgttgtgagtatctaggttttgtcatgtgtttctaacaaagaaaaccggataactttaatttcaaaaaatagttttaaaattttaaatcattaatataaaaatgttaagccctggttaccaaggtaaccgtcccgctatcctccgttccgttccacccatgtgccgcatgtgcactgcagcctctcgctttcgtcggctccatctcacagggttcatatcctctatcatgatgacaacaccattacatgtgggttccacctttatattattccatacatcaattactataatgatacaataagcacattgtaatattgtaatgtagggacattagagcaagtttaatagtatagccaactatcatctccaaatcatttatagccaatttaatagacaattcatataatagctgcttaatatactattaatacatggtctcacctgttaggccattcccaacccaacacactagacatagttttcataaactccacatcatcaagaaactagtactagacactactcttccaatgcaaacaccactattctacttaaatttaatgctacttatctcacatgatgttttggatgttgtgtagaaaccatgtctcatgcaatacatggtttccttctctttcctcatttatttacttgtcacatcactttttatcctagatggcaacttatttaatgctatggacatcatcctacttattgggttaggaatgaccttatacatatattacgttttatagtccgtgttacagctaactatggatagactgctgattatctctttcatcttttttatcttttttaaatatatgtttatagctggctattatagctgggatgctcgaggggtagatggttggctacctcgtcccctcccccgcacgctgcacgcatcccctctcctctccccctcgccatcctcaaatcccgctcctctcctcctcctcctcctcttcctccacccgctccccacccaccaccaccacctctcacctcgtcaccgatcaccgagcgcatttcgcatggaggcgctccggctgtcgggcccggcggcgccgcccttcgtccccgcggcgagggtgg

SEQ ID NO: 36091 - DNA, 256 bp, Oryza sativa
cctgcagccctgggtacttcctttggacttggcaataattctcttgtagtcttattagactcttacccaaaagaatgcaattgtggctatatccaaatgtatagacagaactacgctcttgttttgcactaatttgcaatcaggtttagttgcttgctggttcagcagtgcaatagtgcgtttccagcattcactaaaccaatatcagtcatccattacacatatcttcgctaacgttgtcttaatcatctacagg

SEQ ID NO: 36092 - DNA, 1501 bp, Oryza sativa
atggcttggagttaggacgtgtagagctttgggctagcctgggccggcccagttcactaaaatactgtttcgggcctagtataatcatgttaacttgagagaataaactattttgcgtccttcaactcttgtttcttgttgaatcgcatcccttgaccgtaaaaccgggtataatgtatccctcgtctttaaaaaccggtgtatatcgcctcttttggcggttcgggaggttgttttctgatgtggcagctttgacctcgttgaatgcctgagttatcttgtagaccccatctgtcagtgacctactccatcatatcttcttcctcacctttcccctctctcacctcacagctgcatgcagggaggagctcgccggtcagccacaatgtgcgcacaggaaggagattgccgatagtgccgctagcgggccgcgggggaggtgttgccggctgcccgtgcgcggggaggagctcgctgtgtcctccaccaccttctcgcgagaacagatccgcggtgccgccgccgtgtccgcaaactccctatcttcctccctcaccttttacgtcgaggcctagtcaccaccgagcgttgcctcctcacgcaagtcagctcgcgggacgaccatcgacacatctacgtgaatggcacgcacgtagggcagagaggcacatgaactcagctgcgaacgttggattgctgttgtcgagcagctactcgtgaaaggtaactggctgtacatttttttcccatgtgtcactgacatgctgggcccattgtatacggtttcccatatcgcactgatatgtgggtcctatctgcaaaaaccacttttcaaaccaccgaaggattctatttatatcggttttgaaagataggggatgcgttataccggtttttatggctgagggatgcaatttcaacctagaacaagagatgagggaggtaaaatagacttattccaaatgactaatattgtatgaaagcactttcaactataacttttttttagcataacaagaactaagggcatcaccaatatatatggcaaagtgatccatatagatgaaacccacataaatagtttttatctatgacaatctccacaatgtatatggaaacgaggtatcattaggagaagagagaggagtagagatagataatataatttattccatatgggtagtccatatgcatatagataccttttgttattttttctatatggactagttgcacaatggtaataggtggctgaatggaatattctattgcttatgaactacttttacaccatattgtggatgccctaaatacattcataattttacttccaccgatcaaaatccataaagtttacatatatatacaccatataaaaacagcagaaagaaagaaatgtgtgttaatataattaagtaatcaatactattattataagttgataaaaatcggtgcaattttccgacacgtgcgaaagacctaaaaccctcgtcctcccact

SEQ ID NO: 36093 - DNA, 240 bp, Oryza sativa
attttttttagtggtttttttagcagttttctcaaggctctgtaggttcttgtttcatttgatgaaaaccggtgaagacagatcatttgttgacttttgtgttgcaagacaaaccatactgttcttattagtgcttgatgcttttaaatgccatttgttgcttttgaatctgttgcgcatcttaatcaactaattataaatctatgatagccatatgcactaatcaggttaaacttggat

SEQ ID NO: 36094 - DNA, 1501 bp, Oryza sativa
attacaagaaagacgtacggacgcacattgttctcacatcacccattatttttaaaaaggggtacacagtacttagatcgattaaaccagcaatctttctgataattaagcagtaattaacaacgcacatatgttcattgcctaattattcatcgttcatgctcatccaaacaagaaggcaaagcctacccaaattcatccgtcaatcactaccggccagccgactactgaaactgaaaggcaacgggattttttgtaaaaaaaaaaaagaaagaaagaaactgaaaggcaatagacaaactgagattccaacgtggtcaaaatggaatgcgaaacctaacctagctaatactctacaatatctggtcaaacccaattgcgctccaaattcctaattcgctttctttgctagaaactgcaagcctgcctgccagaaaacgagattgattaatttgaaaaatacatgactaactgaaccgtaaattataatagtactgtagtgaattaaagatatctatgggtgtcatcatatttttcttgggaccaacatagctctattatttgattagattagatcagattataactccatattgtacagggtagctaggaacagaatttgcagaggtaggttgtatagatgatagtaccacattgcagcccatatgcattgtatctgtatgcatgaatccaagatagatagataaacttagcaggttaaattactgtgtctatggcggcacaagtggttaattatcacttggtacttatccttactcttcttgattctactaccaatcagggttggaaatttcggtatatcactgacttccgatcaaatcggttaaaccgaaaaagtaaacctgctgccaattactctacacatgcatagaaacaaatcttctgacacaccttttattctgactttcaatctatgataatcttgacatgtggacttgtttgataaatgatttacatatatcagtgacccgtgtttgaggaaagtaagtcgtaggatcttaatcctacatacatgcacttaacctgtatttaattatcctagatagcttaattagttacatgcatatgctttaggttattagcgatttccttcgtttcaggtcacgagactttttaactttagttaaagtcaaactgctttaagtttgtagataaaatggtaacatttttaatccaagataaatttattatgaaaatatattcaattattgtcttgataaaactaatttagtattataaatattattatatttgtctataaacttaatcaaacttaaaatagtttgacttatatgcggctagcttgcatgtcttaccatcttgttaggttgtacatgccacctagctcacatccatgcatggaagctatatatatcactcgccattgctgcccctgcaatcaacggaagcttagctgagttgggtttggtctcgccgctggccggagtagagcggtccatgtgctgtaccggcgacgagg

SEQ ID NO: 36095 - DNA, 474 bp, Oryza sativa
agggttgtttgggatctgtgtgacttgccttgctggccttggaactcttcaaactcttctgctgcgaaaacggactcttcggaaacgacagaatctaaacagaaaagagcaaaatcaccaaaacagcacataaacaagcatgaacagtacatgtggatatttttaacatgtagatctcaattttataaaaatttagagacttgaaccaactaaatccgagctaagatgaattagttatgaatttttgaagatttaatcggattaaaacacttatattgattttaattgaattatgacgcaataatgaattatttttgaaaaggaaaaagggatttattgcgtcagcggctagggtttcacggtggaccgggcgcacggcgacggttcacgcgaacggacggccgagatcgatccatccaaaacggacggccgagatcgatcggtccacgaccggctcacgggagacggggacga

SEQ ID NO: 36096 - DNA, 207 bp, Oryza sativa
ttttgaaactcttatgggcttttcagttggcaaggcgtaatattttcttgggccatccatctttggatgggccttgtaatcgagaagtgagagagaagacaatatctgggcctcctctccgagagacggatattgcagcgtacgcgaacagaacaagcgtgtacactttggcgcttgcgctcaagcagcaatgcgggtttgagaaca

SEQ ID NO: 36097 - DNA, 684 bp, Oryza sativa
ccaaccgggactataaagatgatctttagtcccggttggtgacaccaaccgggattaaagatcctcggccccctgacatcctactgacagggaatgaatcgggactaaagatgatttttagtcccggttggtgttaccaaccgggattaaaaattataaaatagctgtgggtttttaaacagggacggttctttttggaaccgggactattgtgattttgggtcgacccagcaaagatcgtttctctagtagtgaatgaattcattttgaaataagttttagatgtaaaaatacttattttaagaggggggattagttgcctaatgatattcttattcctcttgtagtcataccagttgacctaaagatgctatggaacattgacaacgtaatgtcaaaattacataaatctagaaaagaaatgtcatatttgcatatcttctttcttatgcctgagttgactttaaatacaacagacttataatttctttagcaaatactccctccgtactcgtaaaggaagtcgtttaggacaatgttttagtcaaaccttgggaatataaatcatgaataactctcgagttgttgggtttgaaaatttagaaattatatgaatagatttgtcttgaaaaatattttcataaaaatatacatatatcacttttcaataaatatttttataga

SEQ ID NO: 36098 - DNA, 435 bp, Oryza sativa
atgcgtggggagaaggaattaattgtttgcaggggtttgatattcctcttgtagacgaggcggcctgtcttcgaacagctgatcgaacaaattgatcaacaatgaacaagttcttttttttaaaaaaaaacaaacaaacaaactgatcaggaatgaaaaggacggcgtctgctgctcgcatgtatgttccggagtagacaaacgtctgctcatacagatgtacggtacgtgaactgacgttattccagcttatggtcgatattccaacacagtttgaagctgacctcgacaagcctgcccatggggctcatctattgccccacaatttattgtcagtctaaaattcatccttaaaccgcaataggacgtaccattttttttttaaccgaacattcattggtatcagtctcacgggtttttttatatactttaagt

SEQ ID NO: 36099 - DNA, 1501 bp, Oryza sativa
ttgccgtttcggagtgccaaaagagttcatcactgacaacggcaagcagttcgactctaacaagttcagagaaatgtgcgaagggcttaatctggaaatcaggttcgcgtcggtcgcgcacccacagtcaaatggggcagccgagcgcacaaatggtaagatcctagaagcactaaagaaaaggcttgagggggcagcgaagggcaaatggccggatgaaatgctgtctgttctctgggcccttcggacgacccccacaaggccaaccaagttcagcccattcatgctcctctatggcgatgaggcaatgaccacgacagagctaggggctaattcatcaaaggtgatattctctgggagcgaagaggggcgcgaggtatcgctcgaactcttggagggggtaagagtcaaagcactcgaacacatgcgcaagtatgccacaggcacttcggcaacttacaacaaaaaagttcgaccgatggagctgttgcctggccatcttgtcctaaggaagaaggcgaacccggtagccgttggcaagcctgaatcgaagtgggaaggaccgtacctcatcaaacacatgtctaggacgggatcctttcgactggcgacactcgaaggcgaagagttcgaccattcctagaacactgcatctctcaagcgtttctttgtctagaacgggtggcacccaaatcgccaacttgtaaaaatgtacataccattatgtaagcctttcggcactatgtaagcctttcggcacaaaaatacaaaaaaaaagaggaaaatgaaaaaagaaaaaaaaactggatgtagggctattatccatcccggaggcctgaaccagtataaaatctttgtgtctttcgcctttttatttgtgtaattgattatttgtggaaaaaccctaagacaaacgcctgatcagcgaaaataccggggggggggggggggcgaaacgaatcggccgaagcatcgctcgccgaatgttgaaaccgtaacagcttgtttcgggaaacaactaaccgaacaccattgcactcgatcaaaatgaaagcacgaagtgcttcctccaacgtagaataaaatggatcgaaaatggaagccgaaagctgaaaagtcaaaaacatatttcgctaatatacgcaaaggggtcgacacgttccggcccaacgaaagcacgcgaagtgacaatgcaaaaatagcgaaaaggaaataaaacacatctttattgacttcgaataaaaatatatcggagaatacaaacccaacaacatggtacaagtaaaagaaaaagcaatagctttacagcccagcttatagataaattacatcttcgcccccacaatcactctccctttctaaggaagggtcgggcgaactgggttcgtcgtcactactaatatcatacacgactctaagaggagaagggggcgaaacacagactagactgtaacgacgctgggagatcgcctcctgccgatcaatcttcatttgccctaga

SEQ ID NO: 36100 - DNA, 415 bp, Oryza sativa
atcgacgaatctatacacaactacgtgcgtatagagacactcgtcctacttagtactcctgccgtacgtatttattgtacgtactcccttcagttggattaatttcatgagaaaagcgagagtccgatccgaatatattcatgtgggttgatatataagtttttcatttagcaactgaagacatgcttggaagtttgaaagcgcgcagggagtttcgcagcaaagttcactgcaaatgattagatcctaattcccagacaggaactaatttcaatttgtctgctacaacggatatgtcatgagtatacacggttgaaaaaatatttcaagattattattcgtgtagtacatgcagctagcatatacttatacttttgtgcatgcatggcaggcaaaactttttcttgcccgcagg

SEQ ID NO: 36101 - DNA, 1501 bp, Oryza sativa
aaaaagcgagcaggctgtctatatatggacaattagttgcattaatatagtagtttataattgcaagcatggcactacatcacaacaccaaaaagacatgccgtgattctagaacagccattgaataaattagaaagaaaggttgtggttaatttgttaacgaccaatcgagcctactagtataaattgtacctcgttgttatgaagtaattcatcctgcagtagcgaaacaagcagagagatagagagagaatatacagaaatgagcaggtcgagctcgagcatggccaccgtcctcgtggtgttgatggtcgtcagcaccggcggtttatccccaccatgtgcggccgcagcgaaggaggagaagccagtggtggtgctgccaccagcggcggcgccaggggaggcgcccttcgcggaggcggcagcgttcgtccgctcctgctgcgaaaccgccctgccggccgagcgcgacgcctccagcttttgctacgacgagctgctcccatacgctgactccttcggaggcaaccaggtgaaggtcaccgaggtggccgccaccatcctgagcaacaacctctcggcctacctcgacgagttgcgcaaggtccaggacggggccggcaagggggaccagaacctgatggcctgcgtcgatggctttaccgatgccaccaacgtgaacatcaccaaggaggcgctggacagcctcggccgtcttgccgccgccggagatggcaagcgcagcaaggaggatctggagaatgtgcagaagtggatcaaaggggtggacaaacactacgtcggagggaacgcggctgggtccgattgcgagacaggttacctgtacacttataatgatgatctccccgctcaggaaacccttggaaattgtctctacactgccagctccctcatcaatcacataaagctttaataaatcaagctatatttatagccttccatgcatgctctctagctacctactaagtagaagtacattattttattaattatacttgttaattaccatgatcgattagtggtgttatccaagatttttggtaacatttttttttctcaattttccatttcatatattcccaactctcaattctacattatatatcattttttcattcgacttcatccatactaatataaaaagcactagttcatcaaacacctccctctcgtgactcttagatctattcatgcaactgtttatattaaaattcaaccctagattcccacgtcggtaaacagcggttagtgaaagtaagtgaaaataaaaagaaaagaatccaccgccgccgaaaaagaaaaaaaaaagaaaacctatcctcctgcgatgcgccgcccgccgctagaggtggccaaacgggccgggccaaacgggcggcccggggcacggccgaacctgtagcaggcacggcccggcacggcctgctacagtaacgggccgtgccggcacggcacgagtagccgtgccgtgcttggg

SEQ ID NO: 36102 - DNA, 255 bp, Oryza sativa
cccaatctacacgcgaagggcccgaaggcagatccagcttcaccgtcacaccctccctgccatggccctccttgtcacgtgtggaactcatcgttggtgccttcccatctcgtccgaactgcgacagatggctattgtggccggcatcctccccatcccatgccacctcgtgatgtctaggctagtggtcggcaggagaggagcaaggcagcgatgacaatttctagagtagctcccggttgatcctaccccagc

SEQ ID NO: 36103 - DNA, 447 bp, Oryza sativa
gactatgtcactgtactcctctatgactcgtctgctgcctcccttctttattgtcattgagattttaaaatcaaacatgactatcattagggtttatttttttttactttttagaagccgaaacctttaaaattggacaatatagtttttagagtttattgtctcgttgggtttcattttttataattttttgaaatcccgtcaaatattgccactatactcctctactacatgttcgtcgcctactctttattgtcattgggattataaaatcgaacataactatcattggaattcattttttactttttaaaagtcccaccagccatcggccgctctgccattgtactcatgtatgacctgcccactacctctcatttttattgtcattgagattttaaaaatcaaatataattatcattcaggtttattttttttactttctaa

SEQ ID NO: 36104 - DNA, 1501 bp, Oryza sativa
agcccgcacctccttgacccgctgacgtgttgggcccacctgtcggcgtcggcgccccttgctgacgtcagcgaatgccatttcctttgagaaaatatttaataattgcgcaataaatcgtgtttaattctagaaattcatttaaatgacccaaaacttctaaaattcatatctaattcattcgaactacgaattgagccattcaacttgcaaaattcatctaaaattgagctctacatgtttgttgagtttttatgtactgtttccttggtttttattagagtttttcctcattttgcgtgccagcgtgtagtttccgtcgtttcggaagtccgcggtcgcaaggaaaagagttcggaagatcaaagtgaagaagcaaggcaagtcacacattcccctttagcattttgatcctaatttacaaatgttttactgtttgcaaataaatatgcatgttttgctaattacacgggatcagggttttacctatctgctcgcttgtgccatgtttacttgatatctatcctttgtcaaccttgggtaataaatcgactagctcatgttacttatgtgacttagccagaactatatgcttagccatgcttatttaccactagctcagttgatgggataattacaatattagacctttttagtatcagagtgagctgcgtgctcgagacatctggccatgcttcatggtcgtaattatccaactacaatgcgactgaatggtgggctgtgggtgcatggttttgctggtcgcacccatggcagttaaggaccggttcgcgggatgccctggaagaacttatcgtacttaccacaagccagcgtgggcaacggctgggcttgtagtgtagctttcctctagccgacgcatccaggcaagggtgggcgtgatggagcgggacgggccctgcgacggcctctgtcgcttccggattcacctaggcacgagaggggactgcccgctgccttgcgaggagtgggggtgaaacctgaggtgtggtgtgcttggttagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcgaccagattcaccgtgattagtcccaccttaataaatcgactcaatgcactgtagttctggtgggttggctgggcctgttcaacgtagtgtagcgttgatcagtggagatttaatgttactctaaatactcaacagttttactgttttgctcaataaaatgttttacaaccggcgttatgcaaatagccacaaaccatccttgtatccccttgcacgtctgcatcgttggagtggcttgctgagtacggtggttgtactcagtcttgctattattcccccttttcagaagtgtagtgcttctgagctgaagat

SEQ ID NO: 36105 - DNA, 151 bp, Oryza sativa
cccgatggcaagcccggccttgtcgtcgttgccagcgccaatcatgcatttgtcgccaacgtgcaagtttggagccgccggctgttaaaaaagaacgtgcttggcgtcgccgccggctgctgataacctcgcgttcatcgtcacggctaga

SEQ ID NO: 36106 - DNA, 1501 bp, Oryza sativa
accgacgagctccggccgccgctcctcgccgctccagccactgccaagccgcgccctaccaccgtcggcttcgctgcatcgcgtggtaccccggccgctcttccaccttcgttggagaccgccgaatcaccgccgtcgtcttcgccccgtggagtgctaccgcctccctctgctcgagccccatcagccgcctccttcgccgccatgcccctcggtgagctccgccgcctcccttttcgcctcctccgctcgttttcgccgctccccggccgccccctcgctcgtcgggccgacgccgccatcaccgttgtcgtcgtcgtccttcccgcgtcggtgagcatctccctcctcctcccctccctttctttttctctctttgcccgccggccgccgcatgcgtgtcgccgtcgcgccgcgccgcgccgccgccggtgtcgccgccggtggacgtccggccgcgcgccgccgtctggtcgggttggtcggcgagccaacccacccctccgccttacacctctaccgtggactcggtccacggtgggctagatccttttgcccgctgacgcgtggggcccgctcatttggtggacccggtccaagcccgcacctccttgacccgctgacgtgttgggcccacctgtcggcgtcggcgccccttgctgacgtcagcgaatgccatttcctttgagaaaatatttaataattgcgcaataaatcgtgtttaattctagaaattcatttaaatgacccaaaacttctaaaattcatatctaattcattcgaactacgaattgagccattcaacttgcaaaattcatctaaaattgagctctacatgtttgttgagtttttatgtactgtttccttggtttttattagagtttttcctcattttgcgtgccagcgtgtagtttccgtcgtttcggaagtccgcggtcgcaaggaaaagagttcggaagatcaaagtgaagaagcaaggcaagtcacacattcccctttagcattttgatcctaatttacaaatgttttactgtttgcaaataaatatgcatgttttgctaattacacgggatcagggttttacctatctgctcgcttgtgccatgtttacttgatatctatcctttgtcaaccttgggtaataaatcgactagctcatgttacttatgtgacttagccagaactatatgcttagccatgcttatttaccactagctcagttgatgggataattacaatattagacctttttagtatcagagtgagctgcgtgctcgagacatctggccatgcttcatggtcgtaattatccaactacaatgcgactgaatggtgggctgtgggtgcatggttttgctggtcgcacccatggcagttaaggaccggttcgcgggatgccctggaagaacttatcgtacttaccacaagccagcgtgggcaacggctgggcttgtagtgtagctttcctctagccgacgcatccaggcaagggtgggcgtga

SEQ ID NO: 36107 - DNA, 512 bp, Oryza sativa
caagctagcaagcaagccatttgacggaattgttgtgaaaaatactttcaccggtggacatctgattctggaacatcagaaaggcattattcccagtgtttagagtttagacctggtaattcgtttgagctgaattttcattttttttccctatacaaacattagtattgtacccgtgctttgctttgcaatctcaaaactcaaatatataatatatacaactattctgagttaaaaaaataactataatctactctaaattaggtcagaaggtattagtttgtgactagggttgtgtttagttccacaccaaaattaaaagtttgaagaagttgaaacgatgtggtggaaaagctggaagtttgtgtgtgtaggaaagttcgatgtgacggaaaagttagaagtttaaagaaaaaagatggaatctaaacagggcctaaattatagtgactgcaaacacacgcatggcctaaaatttgtgacgccatggtgatgcctgtttctggacgtga

SEQ ID NO: 36108 - DNA, 168 bp, Oryza sativa
cttagttcttgctatttgattctacaagtggtatcagagccttgttttcttctttggattttaaccgatatagagctttagccatagctaacaagtttactactacgccccatgttttcgatggttcggattttgcttattgatgtgataagatgcaatcatacatta

SEQ ID NO: 36109 - DNA, 696 bp, Oryza sativa
ttgctcaaacatgtcagttttattttttttatcttgataaggtgagaattaaatgttaatagctaataagtataggttttaaatgaaccaacagaggtgatacctattttgtagtagtggcaattcgaggatgtcgtcgcctgctacccttacgctaactgactggaagcagtatgagtgcacgactagctagatggtatagctgcccacatgcgaagcggccccacgggctatatgggcttgtttagtttggtgtcaaaatcaaccttactaaaatttagcttcgtcaaaaagttggcatattttgacgttaacaaatttttggtagcattggatgtgtttaatttgttgtcaaaccaattcttggattgtttgtatgagtttctagaaataccaaattttggtaaggtatcaatggcaataaaatatttagtttgttagcttacaatgttttcgtaatacgaaaaactgctaaggtggaaagtggtaccaaactgaacaaccctacacagcctgcgagcaatgccacagtagcgtagccggctacttagtgaagaagtgaaagttgaatccaccatgatctgtgcgggaggtgaccaaaacagcggaatgggctatcctccggttgttaaaagggctgtgattctaacacgggttaggccttggaatacaagaattttctccggtaccttcagt

SEQ ID NO: 36110 - DNA, 211 bp, Oryza sativa
ttgctcaaacatgtcagttttattttttttatcttgataaggtgagaattaaatgttaatagctaataagtataggttttaaatgaaccaacagaggtgatacctattttgtagtagtggcaattcgaggatgtcgtcgcctgctacccttacgctaactgactggaagcagtatgagtgcacgactagctagatggtatagctgcccaca

SEQ ID NO: 36111 - DNA, 1501 bp, Oryza sativa
atggcatagtagggtttcatttgcaaaagcagcatttagcaaacatttcagaatttaataaaacagttaagtaataattaaacaatattaatccaacgctatacaacataccctgttgtataggcccaaccattctgaacaaccaccccggctgcacagttttaactccaaaccaggaatataccattccaaaccaggagctaatcaaattattaccaattatagcatcttctattatggtgagaagggtgagactaatcacgaaagacattgttagacccgtccataaccgcgggcacggctattcgaatagttttactctgatcagaggtgtaccactgtacccacaagacacaaccccacatcatgttaccatgtgcctcaataccaccacggtacctaggaaaggagttgtgacaataccccttgtataacacaatccattacagcgcacctttcctggatcataatcacccccttataaacaaggcatggactccccagcgacccccgtgggcttatctccgccacttctcagtctggtgctccgcaatgaaccatgctatataaaagataaagccgttgcccacgctggcttgtggctggcacggttaatgtttcacaaccgaaactcgtgaaccagtccttaattgtcatgagcacgaccatcaaaaccatgtgctcacaacccaccattatcaggttttagttggcacattaattaactaatcacgattgaccatcgtgaactatcattaagccatcattaaataatagtgagtcataagttatcccaatagtgtgctaatgtttctaagcagggctaggtaatcacatctaatatctagctgaaccaatatatatagcccaactagtcaagttataataacccaaggtatcaaagaagaaagtaatcaagaacaagagggctataataaagaataggttaattccacccaatgacattcgaaaataaatgcaatagttgaatagaaacaatagctttaaataggatcaacatgctcaaagggttgtttgggatctgtgtgacttgccttgctggccttggaactcttcaaactcttctgctgcgaaaacggactctccggaaacgtcagaatctaaacagaaaagagcaaaatcaccaaaacagcacataaacaagcatgaacagtacatgtggatatttttaacatgtagatctcaattttataaaaatttagagacttgaaccaactaaatccgagctaagatgaattagttatgaatttttgaagatttaatcggattaaaacacttatattgattttaattgaattatgacgcaataatgaattatttttgaaaaggaaaaagggatttattgcgtcagcggctagggtttcacggtggaccgggcgcacggcgacggttcacgcgaacggacggccgagatcgatccatccaaaacggacggtcgagatcgatcggtccacgaccggctcacgggagagggcgacga

SEQ ID NO: 36112 - DNA, 1501 bp, Oryza sativa
ggattttattttttttctttttattttaattggttaaatgatcttcgtgactttaaaactatttctcgagctccgaaaattcacggaaaattccggagagtacattagggcacaaagaatattacaaaatatttccggccaatgatttttaagggaaaattttaattctcccattattttacttgattaaattgatttaacttttatttaatttctagaaaatgtattattaattgatttttattcccgaacgaaaatcggggcgtcacaaatctaccccccttacaggaatctcgtcccgagattctgggatggctagaaagaaagctggcattggcgggcggtctgactgatctacacattgcacttccacattctgcttcgaactgactgattaattgagtgatcaaacctgcacgactgaactgattggattcgacttttctgttcctttgctttgccaagactggattgactggttttttcttaaactgacccagaccaggactgtggatgctcatggaacttacttatcttggactgaagtgttgatgctgacaattcaccatgctggctggaagaggatgaagttgttcctgaaacttgcatctgacatttgtaaatcattgactctacatccgcttgaactggtcttgactcgaatgacaagtaaattccaggaaacctgcttgacctgtctttcgtctgaactgcaactgtcctcgctgttgcttctctaagctgaactgttgacatgcttcacaggtgtaccttagaattgaacctgtcgacctgagattggggtgactctgctaatggttcgcaactgactcctttaattactaaccaatttgctgcactgggttgaacctacaactgaaacgacaacgaggttagccaaaactcatctctgagacctaccccccttacagtgggtagtcatactttcgcctaactggaaacacttgaactgctatccttgaaaaacaaccattacttctcggatttacaaaagaccctgactttggaaactggcacttcatcgatcaatcaaaatggagcaatgacgatgcactttcatccaggtcaagacttggaacttaacccttagttgctgataggaaattccacataaagaaattctcatttagctcgtgatcttactaactcttgactacttccccgaccagttctaactgctggtacaactgtcttggttctgacttgatttttgttgtcatatacctaaacagattgcatagttgaccttccttgaaacaagcactgatcacttaacagatcgaactcaagaggtccttcccatggcatgacatttcacttcttcgaccatcctttgctgactcttcctgggttgacggaccatagatcctgcaaccgttttccggaggctattgcaatctgaacaactatcggaaactggcttcgatgctgccaagagtttctgctctttgatcataacaacttcgctttcatatttttg

SEQ ID NO: 36113 - DNA, 725 bp, Oryza sativa
ggctcaaccccatcctcatcggcgccgcaccaagtcgcgccacattgctgtcatcggccaccagacgaggagcaaagtgagagagagagaggaagggagagaagaggggaaagagattgtcctacgtggcatcctgacatgtgggacccacgtgggtcacacgctgactcagccgccacataggacaaatccgacgtcaatactgtcctgggatctcgggtgaccggttttgtatagttaagggaccccgcatatctggttttgcggttcgaggacatttttgtatctttgtgacaagttgagggaccttccgtgtactttttccccagaattagccatttcttaacatcttgggctttactatttgggcttatactattcgagcccactgcacgaagaaaaattagacctccaaaaatcccattgggttgtgactgaagaaaccttttcgtttatcttttatagagagaaactgaagaaacaagctgcagacttgcagagtctctcctccatagcgaggagcaaacacatcatgatttgctgaaaatctttccaacaccgatgtaccttgattcagaagcagtatgatttcttgggttacagcacatgcgcacagatcaattgcatttccgcaccaccatgatctaatcctaacggattagagcgctgctggtttgtagtagcttgttgcgatccattctcgcacaaacctgcactgttgcagc

SEQ ID NO: 36114 - DNA, 717 bp, Oryza sativa
tccctctccctctccctctccctcccagatccagtgtcggtgtgcccggagggaaggtctccggcggcgccggtggcatggcacgggcgggtggtggcaatttttatagatattaaaataaatgcataccttcatcatctccacatcctcaacgtaaatagactaaacaagcgataagactcaaacaaaacattagcctcacatacatatatgtcaatcacatgaaaatattatatatgaatatatcaatatgtgctcggagagaaaaagtgatacatatagcttgatgtccatgcatttcatccttgtgatttaggtacaccattaatgaatgtttctatctcaactcatatgaagtctgggaatctagtaaagaagaaataaagtttctcctaaaaagattcagtagccatggcatgaaaaaactttgtattttcacctccaaatttagcccatctattgtacatcttttctgtcaataagactgcttgtatttcaaataagctaaaagcttagtcctaattaagactctaaatctccattccaacaaagtgagatctctatacttctcaatagagtccaggaattgaatcatagcattacagttttgaattagtttctgcaacttagaaaggtttttactccaaattctcaaaccctttctcaaattaaagctttcaatttagcagaaatatttctagctgcattagggtcatt

SEQ ID NO: 36115 - DNA, 1501 bp, Oryza sativa
acagtacactaggaagtccttgcgagtatccggtaagattaacactggcgaggaaaccagcttttctttgagagtttggaatgccttctcgcattgcgggctccacacaaatttttcctccttcttcagcaactgtgtcatgggtcgagctattttggagaagttctcgatgaatcttcggtagtatcctgccaaacccaaaaaactgcggacttgagtgactgccttcaccggtagcagcacttctcctggtcgtcaccatctgaaaaccccacaaagaaccagcaaacagagagagatgacaattaaaactagccacccatgactaccacaattcttgaatttattactgctattaaattggttcattaaagttcaagttgcttaggcaaataaaataaagacaggctccgacacagttataccacacaccggcataaccatgccccacacgactccaacaagaagacaaacgagaaagaacacacgcgcaagcctactaactgctcgtctaccgctgcgacgggccaggacggaaggtgagcagcagcgcatcctccgtgctaccaacgccggaggctttcccctcctgaggaaccacgggcgcgggctcggcacgaggggtctccacgaagcaggtccatgccaaggattggcgaacaagctcgggcctggaggtactcttgcaggcggtgatcttctggctgcggcagacgcggcgacgcttggggcgacagacctctccctgggcgatcttgagctgatgcagctgcgcctccactgcgtctaggtccttcttcagctgcagattctcctgacgcagctccaggatcttcatgttgttctcgaccatcccacggcgcaccatctgatggaagtcgatacgagccgcgtcgtacgcctccaccatgcgcgccaggtgcatgatggtagcggtagggcgagtgctgcaactcgtccgggtagagctggtgaagagtgccgatggcgaggagtgcggcgttctggcaagcggcggagaaggaatctccacccgcggtgaccgccaacgaagacctctcgggtgagccagtgaggatcactgcagtaacctcccgagcagcgtggggctctgcatcgtcaccctcctgctccgggagctgcttgccctggtagtccactccatgcggataccccaggacaatgcacatgccccgcagctccaaaacgaagccagtcaggtccagaccacgacggttgatgctgccggccatctacaaacaaaaacaaaaagaaatgcaacattttaaaggtcagattttggcgataaatgaagcagcaggacagagagagactagaggattttcacaaataacaaaggatttttttttatttcgaaaatattgctaaggcttgggatctaaggcttgtcctagggtcaagggggctctgataccaacttgtcacgaccggaattaacccaacgggcgttccttacgtgcgtgtattattccttgtccca

SEQ ID NO: 36116 - DNA, 971 bp, Oryza sativa
ggcaggggcagcgccctcccctctatcggatccagcgggaggggaggaagcggcagcccgatgtccctgcgacgatggcaccctccccttccggcgtcggtgtttttgtgcttgtgatgttcttgtgttgtcgttgttgttgatgaaatatgttcttgtgttcttgtaacagtgttttctctaggatttggccaaatttgattcggactcgcattaagtgtcaaatcgaattggactttctttttttttatgttattttcgcccttttttttgttattacggacgatggaagcaaattgaatcggatttttttttaaaaaattttttttcaccctttttggttattaaggatgatgacacctcttattttttttaagtagtagagattagaaaaaatgcccgtgtgttgtaacgggtgaagtctatttttaatcttattattgttatatggtttagttaagatgaagttcactctggaagtttgcttggatatatatatatatatatatatatatatatatatatatatatatatatatatatatatatagaaaatcatgagctgcagttagcaatctgatcatctcaagttagcatgtaagtttttttaaacatatttcttatatggtttcttctatatcaccaaaagtgaacgatcttaaaaactgactcaaatatggatatgtatttccaaaagcaaacgaacttaaaaaccaatttatacacggatgacgtatcaaaatatcgacaaaaacatctttaatttttataactagtagagattaaatataatcttatcgtattttcaatcggtacttgtatgcagcttgtgtggttatagccatttatctcaaagcttgatatagccggttcaactcttggcacctcaatttatgcttcttttttttttattttttttggtgtgttgcgcgagctgcttggtgacgcctgtcatcacgtcgtcttctagc

SEQ ID NO: 36117 - DNA, 1501 bp, Oryza sativa
  unsure (1)..(1501): unsure at all n locations
gcgtcacagtacactaggaagtccttgcgagtatccggtaagattaacactggcgaggaaaccagcttttctttgagagtttggaatgtcttctcgcattgcggtgtccacacaaatttttcctccttcttcagcaactgtgtcatgggttgagcgattttggagaagttctcgatgaatcttcggtagtatcctgccaaacccaaaaatctgcggacttgagtgactgtcttgggttgcttccagtcagtgacggcggtcactatttcagggtccacagcaactcctttagcggatatcacgtgccctaagaatttgacttcggacaaccagaactcacacttgctaagcttggcatacaattgatgttcccgcaactttcccaacaccagacggagatgctgctgatggtctttctctgattgtgagtataccaggatgtcgtcaatgaaaaccacaacaaacttatccaagtattccatgaacacttggctgatcccctcctcctgagatagatttcagtggttggttctggctctcccagagctccaattgaacaaggaggcatttgcttgcacacacatgcacccagttgcatcagactcgcatgaccaggaggcagaggaagccagaacaaggctcatgctcatcatgcacgcanaagccatttctctcatgctttcagctgccaagcttcacccancacggcttgcggttcactcctcccgtgcgtgcacagctcaagtgaaaccacctcatcacttccatgtgatcatcctcctcctcanctcccagaatcctaagggcataaataatctanccgtggcatctccattcgatcaccctcatcaatcgatccacccaatttggtctggccaactttcatcttctgataaatggttgcttttatacacctgaaactaaggcaattaaagcttaagtgtaagtacaatgcccctctttgttttcctacattttagcatctgtttatgaccatgatgatgatgcattgctgcttttaaggttaaggtgcacatcgaaaagatttgctacttgcttgtagacaagaatcgcataaaatgtaacaatggtttcagaaaggaaatgctcatactaacgaaagtttcatgacacaatatttcagatctttcaaggaggaataagaatcaacctgtcaagtaaaaagttttaatatttgtatgatcagaaagggcatacaccaacctaaatttgctgtgtaagaaagtagctagctgtgccaaatcattgtcacctcagtcagatctgccacaagcacgtacacatatatgtgaaaccgactagctttcttgcagctggaaaaactccaacgtacaacagtaaatgatataatctcaatatctagatataaaatatcctttttggaaacttctacaacgataatatatatcggtttgtcctaaaaactctttttttgttccaacaggtaagacttacaagtagcagaatagtttctacaata

SEQ ID NO: 36118 - DNA, 525 bp, Oryza sativa
ctgagagtaccttgtttgctagttttaagagtaacgctgtgttatgtgttcttaagtccttgatccctaatcctccttgttgtccctgatatagtctgatactctgatgtaatatcattcatgatttgtgtctattgccaaggagcaccacatgcttgtgtacgttgccagttcacggagtttctaaatccaacaatatcagaaaagagttgcatgcagcctcttcatgaataatttacaaacttatcttcaccgcatctaagcaaatctctattgaatagaagacactgcagcttaattgctgaaaagttcttttttccagcatggccctttcaagttcaggataggacaaaatcttgcatctattatattgctcagtttgacaccctgtcaatagaatcatcaatttcttctgaggtttttgcatgggtaaacagaagttgaaaaagagcttattgtttgcactgaaaccttggcactcttaataacggtttccatttactgtttaccacagatttggccttc

SEQ ID NO: 36119 - DNA, 350 bp, Oryza sativa
caatcccgcttccaaaccgcgaaggcgtaaatcctcaatttcccgtcttcgaagcgatatttccactccactccacgcaatcaccgtccacctgcctcgccgcgcgccacgcgcgggaaccggacgaacacccacctcccaccgcccaccgcccaccgccgcgccggccatggctcccctcctcctcctcctccccccactccgcctcctccccgccaccctcctccgcgccacaagccgcccggcgtcgccaaggcgcggcctctcctactcctaccccaggcgcgtcgccgccgtcctgcgacaatgccgcgccgcggcgccgcctccgcctgctcctccggatgccg

SEQ ID NO: 36120 - DNA, 335 bp, Oryza sativa
aggtaacgtgtacgacttggggccagaattaggaaaaagtacaccgaaggtccctcaacttgtcagcgaaataaaaaacatcctcaaatcacaaaaccagatatgcggggtcccttaactatacaaaaccggtcgcaataggtccctcggctgataccggttttatcctatgtggcgctttgaccacggtcatcggtggctgagtcaccgtgggactcacgtgggcctcacgtgtcagcttgtccaggtcagcctactctctctttcctctcttctctccctttctcctctctctctctatctctctcactcttctctctggggttctgggcagg

SEQ ID NO: 36121 - DNA, 1311 bp, Oryza sativa
attctttttatctaactcttacaattcaccctttcttccttaccccacatctataggcctaccagcccatgtgcaaactttgcctgtgccatgaaggttgcataaatctcagtgtggagttgacagccaaggaatatgtcaaacataagtacatataaacaaaactgttctgttgttgtaatgatttatattctttttcaattgcacaaaatacacacatgtactgtttactcgcacacctacgaatgtgtctcttctaacatacattaagatcaaattgcactttacattgggtatagtgtatctagtttcactttgcatggggtctagtgtatactttcactttatactagtgtatttggaaataagttttacttttgcactaggttatttcatataatcagagggaaatatcacaaaaacatgagcgagacataccagacttaacaaatatagatcatgtttcatgaagtttcattttgattttgtgaggtttaatgaaatttctatatgtttgatgatgtatatcatgatgctaactggaacaatgctaactggaactttgtacaatatatagcatggcgtaaagtaaatataagtgctaaacctagtaaaggccattgatacatcagtgaacctcactaaatttccaacaaaaataaggtaacaaaaacaccaacatcttagggctccttgagattgaaaggatttaagggcccctttaaaatggaggattagcaaaggaattttggaggattcattttcctaaggatttattcctatagagccctttgattcatagggagaggataagaaaacttccataggattgcattcctatgatcaattccataggaaaataagcaagagattagacctcttgtgaaactttcctttgttgagtttatcctgtggtataatcaaagggctcctctctccatttcttgtgttttcaatttctgtaggattggaaaaacatacaacttcaattcctacgtttttcctattcctgtgtttttcctatcctgcgtttcaaaggggccctaaaagaaaatctgaaggatttcatttcttgggaaatatttgtataaggtcatttaaaacaaagaaatggactgtgcaaaatcctatagattggctatcgtacatgaatgttaatatatttctataatcctgcatttcaaatgtgcccttaaaaataatctcatatttttctttcagttctatatcagttctcggtggccacataatagtggagaggcagactttcctttactaccatattggtgaggattatctctacccaatagt

SEQ ID NO: 36122 - DNA, 402 bp, Oryza sativa
agtagttgcaaaattttttctttgttcttaggaaaaaaaaaggatgttggtttctcctgtcttgtgttagtaataaattagtgattctgaaaatgatcaaagctggtagtatcttttaattcgtagcatattcgttcagagaagaaccttgatcaagtaatttatgggaaaaaaaatcgatttaaacttcattttagcattgctgactgtgtcagtgaaaaggatggagcagattgcaaatcttgcatcacttgataatctagtagattactactactaattagttcccagtttcttgacttttcaaccaactcaaaaataacatcaaatagtttcttgggggaaaaaaaacaagaacaatctttgaactggctaacgatcttgattcctcttcctctgcag

SEQ ID NO: 36123 - DNA, 1501 bp, Oryza sativa
cagtttataaaattatgttgatttaaattattgcattatcgctttatttaaattcccgcgttatcactgttttatctagccatgcctatttacctttgttatgaccttattattgtattgttattattaccttgttcaccctagaataaacaaaaccccaactagtggacactctactcatggtatcacttgtatgattttagttagatgcttcgctttttaattaggtaacattaggtggtttttcaactctagactttgggaatattcatatcacctggatactatggaatggtttggttattgtggaattggcttcacaccgctccttctattcaaaatccccaaaatggttttaggctgggctcggggtgcatggttttgatagtagcacctcggccatataaggaccggtcttcgggcctccgttgcatagcactaccgtacttccacatgtctagtgggtaaggcttagtttgtggctcagtctggttataaacaaaagtacacggatggagatggaagaagtcgggggtcgatggacatctccagggcaaatgaaggctacacgagctgcggcccagtagtcgagatgtcatggcacagggccggtgtcctgctgctaggggctcagtcctgcctgcctgtcccgggggttccggccgtaggtgggattgggtcggtactcttgtctatggctaggatgggttggaaactatgtcacgtcttctgtctgtataccgtggtggtatgtggcacgtggttacacgtgaggaagatgtgtcttgtgggtaaagatgtacacctctgatcagagtataatttattcgaatagccgcgccctcggttatgggcaagccgagcaatgtacccaagttagtgttttaattcttaaaacctgcttaacaactaaaatgtggaatggttagcctgggttggcttgggacgagctgggacccagggtcgggttgccagttcggtctgaatcatcgtaggccttgggttaaggcaggttcgtgtgggttcacggccttgataaataatattgtttagttctagaatcgtgtttaccaaatagctttgagcaactaaagatctttaaatgctgtttactgcaaccctaaccctttatagtgtaactcctttgtactcccttgcatttattctgcacttgtgggtgtgtcttgttgagtacggtggttgtactcagtcttgctcaatttttcccaaacccagaagaggagcccctagaagatgaaggctttggtgtctagctcgtgcctgccgtcaagcgcctgtggtcgtcgccctagtcttccgctgtttctcgattgtctttgtgtgtgctgggccttcgctgcccatgtaataaattaactatttacgctaccgcttgttaaactctgaattgtatcaacttctggtgtaccttgcctcctgggacaaggaataatacacgcacgtaaggaacgcccgttgggttatttccggtcgtgacagc

SEQ ID NO: 36124 - DNA, 812 bp, Oryza sativa
agttgagggacggaatcgcaaaaaatacatctcgtgtgtgggacccggagaaagcggttggtggagaagtccagccgagctcccccaaaacgaggagagagagagagaggagaagagaaaacgaggagagagaagagaagagaagagaagagagaagcgcacgcacgcgcgcgcggagaggagaggaggagaagcgcgcgcccgccgccgccgccgccgccgccgacgggaatctcgccggggccgtcgttccgccccgatctcggtccgtctctccatctttaccttccgtcctcgtgtgatgtatgtgcttcggtttcgccggcgctttgcattgctcgaacgagggagaatccgtaatttatttatttatttattttttttgggttgggggagcggcggcgcctctcattgaatctcgcgccttttgttcttgggagcacgcggaatttgtgctattatgaatatatgcctttttttaaagaaaaaatgattttgattctctttgatagatagtataggtttggtggttggttcgcgggcggatgggacggcgtttgatgtctcaattgtttgcggggattccgatggggggagggatttgaaacatgtctcccaaaatttgtgcttgttttgtttgtttggattgccagttcactcttttagaatctgtttcgttgttaagttggttgctcatagttgactggtgtgcaaaaaaaaaaaaagttgagctttggcgtgagcaatcggaaccgatttcttctctcgttttgttaattttttttactagtaactagtacttgtctaaacta

SEQ ID NO: 36125 - DNA, 217 bp, Oryza sativa
gtatagttaagagcaggtgagccattctcactgcattattgtcccgtgacatgagctgcagtgtttttcttgtggatccactttgtgcattcaaatcccatgccatgtagcctcaggtgcacatggatctcaacaatcctctgttttgtgtagaagcctgctgctgcgtcccgtaattaagctcagattgaattattgatctcctctaccgccaaaa

SEQ ID NO: 36126 - DNA, 475 bp, Oryza sativa
tccagaatggggctggttagcgtgtggtttcatcacgcatgatttgttttgggttgtcacagccacaaaatgatgctagtgcgtcacctgggaaccaacttatatgtcaaaataaacgagtttgtgggttagtttagtctataagtgggttttcacggatagccgcttgaaccctcagccacaagcatgtaaatccggtctttacttaaagaaactacagccaacatatttattttatacttttacatatcttcgatgtaataattattttaaaataaacgataaaagaaaaaaataaacatattctaagatggagaggacagaactgaacaacaaataagcacgctaataaactaaacgaaagcctttcgaaaaggaaagggtgttgggggagtattggaaaagatgatcatgccatctgcaccaccatggttttgtttttttgtttttcttttttttttaaaaaaaaacacca

SEQ ID NO: 36127 - DNA, 1465 bp, Oryza sativa
tcaaccgagcatcatgtgtgtgtgctccctttctactccctagtagcttgacttgagacctaaaaaaagcacagttcctacctcgcatatgttcctagatatgctcaccgcatcaataccggtaaagaagaacgatacgtgtacgtgcgaaatctcgcgacagacagataagtgcggtcatacgcaagagagacgacctgcaggcaacgaaaagctgctgcaattttttttttcgtctgtatatttactgttcagtaaacgcgcacggcctgagctggctcgtagcaggtcaatccaacgaccgcgacgaggccctgagatttcagttcacaccacggtgccagctactttacgcctcggccggctatgcagcctccctccggcaactgcaaggatgtacagtacgtgcgctgctagattgcgccttcgtctcgtttcataccggccggtgacgcggcagcgcgagcggccatggcgctctgcatgcgcaaggggaggacggtacagttgtatgggccaaaccagagtaccagacacgcgccggctgtcgcgtggcgtgtttccgcggaaatcgtagtagtaggtgtgcgtgttcggctgttcggttttggcggcttgccgtcgacagtgatgtgcccatgcactgcgcgacgcgcctggtgttttcagatgtattttctgtcctccgtttttttggcctctcgtggcgtcgtctatcacgtaaactaggctcgcgcgttacgtcgtgagttgttacttgttagcttcgcgtttgtagagttcaacgagaggacaacacgaacttgcaagcagttaaggcagaccaaaaagaaggataggcatgcgggcagtcgggcacgcacaccagtcgggagtatttatcaagtatcatggcaaatgaaaaggaggtatatgcttcgtcagagccaggtgagcccggtcaggtagaaaggagattagcactttaactactgtgataggattggacgaatgtaaaagaataattaaagggataccctctccgttgtaggttacaacacgctttgactttgattaaaatcaaactactttaaattcgactaaatttataaataagtagtttcattaaatcgataattaaatatatttttataataaatttatcttaggttgaaaatattttttttacaagtttagtcaagcttgaatcagtttgactttaactaaagttaaaacatcttataacctgaaatagaggtagtaattatttacatgatgaaaaatttaaaagtaatccatagttacagtttagagtgttgtttcggtccttctttttgtaccacgtggtactagtaccatgagatactaaaatcctgaccgttgttggtcattggtgtggttagcgcgagagagccacggtggaagggtataatcgtaaatggagggatttttggatcggtgcaaggtttggctgagttggggaagc

SEQ ID NO: 36128 - DNA, 1501 bp, Oryza sativa
tgcgtaatcgagtactagtccgttccgatccgtgggcccgatggtgtgtggcgcttcgggctcggtcggtttgcttgattcggctcatgatgcggtccggccgtgtgaggctgacatggtgggccccacaaacccggtgcgcgcgccatgccaagttgccacgagcccccacgagcttttaatccgtgcggaaaaaagtggttggttgacgcgaaaaggcgccgtgtaatcgccaggtcgcatgcgcggtggccgccactgacgtgtgggccctgcccgtcctttttttcattcttaacctttttttcatttactttcgtagctaaaccatggttaagttgttaattatactaccaataatctcgagtcagtcaaggtggagtctttttggttctttttattttccttcgatgtgcatgcgtggtaggttagggttcatgataaaaatgtgtaaaagcatcctggtggagttatatatggctgcagcttttgacaagaactcggttcgtttacgatacgttcccccacgcaattatttcgccatgattcttctgtgttaagaaagggcgagatctttgggttagaatacaagaaagtcgtgtgaaaattgtgggcgattaaatcttcccctttcgcaaagcttgtcttaagcactcatctttcgctttaaatcgcaatcttttctttcagatcaaagcaaatactaggagaactagctaggtagcccgcgcaattgctagcacccatataaaattatatattttttaatatgattttacttaaaatttatttaatagttatctcgttgtcttgagatttgaaagatcaaatcttatcatcctcgtgtttctaattttataatttttctaatagtataagagttttaatttcagtttttctttaattgtgagaactgcgtcgcatgggccagtctgtttagttgagatgtaacatgcagaatcgaatgctgtagctcacaacagtatacattagttttagtattcaatccacttgttgatttcatccacttttcctttcggttgttctcattcactctccaccaaccttgccaccattctgtccagtcaaaacttgaatttgttaaaccaagcattgataatttgtcagaaaattccgggaattttgaataggactttttgtacccagcacgtcgtttttattctttgtcacgagcatttacttctccggaattcacatttcgatccagagaagaacatcgggctggggcactgtagcagctcatctcagtggggcgaatggttagcggtagctttccaagatcagatttttgattcgttttttaagtaggattccttgcccatgtctgcttctagcttcttctcggctgattgctcttttttcccagatttgtctgcttcgttcttggctgaactgagagtgagcactaatctactccatactccgaacactgcagatcacgaggtgcggtgttgtagcttcgaccgaggaatgagcttgc

SEQ ID NO: 36129 - DNA, 673 bp, Oryza sativa
ttttatgctttagaactatgatgagaaatggcacttgtgaaatccaatagaaaattaagatcggatgaagggtggtgacctgtgcagttcagggggaaaatgaaccaaggccaaaaaatgaaaattcagagttgaaagtgaactttgtcttaattttctattggatttcacaagtgccgtttctcatcatagttatttaagcacaaaaaataacataaaggatatgttgtactatgggtaacttgtgggcaaaattgccaggtccatcaatagtgaatggaggaaattcttcttccactaataccagtgctagttgtaaacagctcttggtatatattttttctcccaaagaaaaaaaaaaagtgctcgacagtggtgatcactaagcctttcaagataactttaccgaacacagacagcggatagtactttactatctgttgaaaaaggaaataatgcagcaaaaagatctgctcatttcgtctcttagcctattgacctgcttctgattcgcattttgcagggaaagtggacaactactgctatgctttgataagagacaactactagtctactactgctcatgcccttatatattgaaattgttattatgatggtagctggtcggcattggaaataattatttgaaatttttgtatgaattacgataaca

SEQ ID NO: 36130 - DNA, 256 bp, Oryza sativa
tcaaccgagcatcatgtgtgtgtgctccctttctactccctagtagcttgacttgagacctaaaaaaagcacagttcctacctcgcatatgttcctagatatgctcaccgcatcaataccggtaaagaagaacgatacgtgtacgtgcgaaatctcgcgacagacagataagtgcggtcatacgcaagagagacgacctgcaggcaacgaaaagctgctgcaattttttttttcgtctgtatatttactgttcagt

SEQ ID NO: 36131 - DNA, 1478 bp, Oryza sativa
caagctctttatgggcggccaaaattgcaattagccccttgccgccagggcctaatcgcaattttggccgacggcggcagacggcgcggtcgacccaccgtctgccacgttagcttgccgcccaccattagggcggcaggggctatttctgcaatttttttttggtcgatagattatttctgtaaatattaaaaaaaaatctaaaaacgaaaaaaattcggtcgcccacattctccggctcgagacgacgcaatcggcggccagcgtcggcggcgcgcaccgccggccggtgcgccggcaggccgtcttctcctcctcctcctcctcctgcactaacgcctgcagcttacttgcaagccgccccagaagcagtcaggtacgggccgccgcctagtcgtagctgcggtttggtcaccaagctctctggctcctttgctgtcttggtgttcttgattaatttcgtaagtggtagtagctcgttggttggtgtcgttgtgaaatgttgttagcgagggacgtcaggtgcggattgatgtacaatggtctcactgctaaaaatcaatggcaagagagaacaatgatctccttgacctagggattgttgatttcgatccgtggataaactatatattattaaattaagtctgtattccgtgatgcgatttgtggagtctatgaattcttccaggtctatctatttggcggtgtatatatttttttgttcttggaagttggccatgatgtattttcagaatatgttatccgaactgtcgtttcctttccttttctgcccatcttttcagatctatgtgaccatcaagttcattgtagtataatgcactgattgtgccgacattgttaaaggaatggtcatgctatataaggacatgaatcatcttcagatctgcttatggataaattctaaactatttagttgggcgataaattctaaactactgttctgtattgcagggcaatgctgttctcagaagaactgcagttacagtaaatttgtctgtgtactcaggcacgtacataaaactggagctaaccttctccacttcgtatgtactaactcgcttctagttcttaaaatgcctacctatttttccttgctcatattctgcataataatataccaaggataaaggatgcatgttctgcatacatggtctgtgctgctgtgccaaggctaaaactagaccttataagatcgcatagtgggatttcctacaggaactcagggagaactcctgtaattgttgactgagtttcctgcagtcacaaaaagaactaaaaactagaatattgttgaaaatgtcttattacataggccatggattgtttccttaggaatgtccaagttgttgccaccagttcttttcaatcttttgctttgcttgctgtgcaaaatttagtgctgttgtatgtaaacattctctccaactatgagcaaatagtaacgtctttcttctacc

SEQ ID NO: 36132 - DNA, 174 bp, Oryza sativa
acactcctctgtatcctttgtaaaattctcgaagaaactatgatatttcggggcactccttctggagcttcccttactcgccaacatactaaaattgaaactacaagtgagttgtactctacttgagctcaagagttgtgtgttgaagtgtgtgaggcctcctccttttatagc

SEQ ID NO: 36133 - DNA, 229 bp, Oryza sativa
atatatatatatatatatatatatatatatatatatatatatatatatatatatatatttaggaaagtatttcagattttaatgctttatctgtcttgtactttcaataattgagtggagatgaaggaacatagttacttgtttgaacaaatatactgtgtttattaggcaaatacatctattggttccatgttaattgctaatatttgtaactgataccgatatattt

SEQ ID NO: 36134 - DNA, 185 bp, Oryza sativa
cctgcagcccccataaaacatacagaaatataaaactagctgcaaccatgtcattaaactcatctcttcaattccagaagtaaccaataccaaaacacagcttgaaaacgtaatattacaggaaaacacatcaagattgattacagtccaatgactccattataaaatgcctccaatactacagg

SEQ ID NO: 36135 - DNA, 188 bp, Oryza sativa
aaggctctcgtccccgtgacattagacctcgtcgccggcaactatgctcgatgtcattctagatgatttctctcactatgtatggaccttcccacttcgttttaaatccgatacctttgccaccttatcacgcttttttgcctttgtgaagactcaatttgcagctagcatccggaacatccagtgtg

SEQ ID NO: 36136 - DNA, 224 bp, Oryza sativa
caactccttgagctaaatttagtagttggagctctaaaaaaagcccatagtaagcaaaatgagcttcataattccatataaacacatgcatatcagcagcagtctcctcactgaaccaagaaggacactaaagcagtagtctagtctcccggccaagcaagaaccaaaaagcaattaagatcgaactcgagcaaacatgtcgtcgactaacaacagttcaggcg

SEQ ID NO: 36137 - DNA, 752 bp, Oryza sativa
gatcagtcagcaccacagtgccactgccacccacaaatcaccacaaccttgagatccatcaccaagatgctaaacttttcccgtcgccgttacccaatacaaaaatggccactagccacagcagttcacgttctcaccacacagcctttttagtgccctgattatataatcttcctcgttaatcacagtttctaaatcttagttaccgaatgctaattccacttacaatcatttttatttctttacaaaatgctaattgcgacacgcactcccgaatccccgccgctagtctcgcccacagaagattcgaacacatacagaattacacggaccacaatcgtttggttaccactaatcacatattctaattgatcctgttcctgatcatgtaccgaacacctgccatgccatgccacgtacgtggagtggccaccaaaccccgcgccgctcgttgccgccggcgcgagtggctgtgccggtacacggaagacgcggcttccgtgcgcgccccgatgcgggggtggcggaaaggaggacaagcgttggcagctagctgcgcgcctccacgttgttccggaacgttccatcgcatcgttaactgaaacgagaggcagtattaatcccctagttaaactctggctaagtatagcagagacgccggccgagaggagtggggggagagggaggaggaggaggagagtggctactagtactagctatctttggagtgggcgtttcttggccggcggcga

SEQ ID NO: 36138 - DNA, 153 bp, Oryza sativa
atttttttatttttaattttttttattaaaagttttacaaaaataatttttcattttgaaaattgacggatgtagtcgcctaccgccctctgggagggcgatttttaaaaatcgccatcccagagggcggcgaaaatgacgtggcagacggcc

SEQ ID NO: 36139 - DNA, 430 bp, Oryza sativa
tgtatatattaacgtgtgatatatcactacacatatatacaagttcaaacttaacttctacatttcgcaacgaaaaaaataaattggctgagaatatacgttaactagttgtatttaatttgttttctttgttgcgagctgtagaagttgaattgatcgtgtttttggagtgatatatcatatgttaaaacaacgaggggacgacatcccctcgagagggatcaaaatagtttctgtttcccctactcaggtcaatgtgtgtgcgcacaattatataacggtgtgttctcacgtcagagttgggcgcactaacacaataagccctcacacattttgagcagacatcatatccaaacttactaaaccatttcggctacgatcgagaaagtgcaagcgacggctggcacctggttctggttgtggtgatcca

SEQ ID NO: 36140 - DNA, 1501 bp, Oryza sativa
aagaagaggacggcgcgaatggggatcgatacgatggggagccccttggctgagctgcttgctgctggtcgttgggcggtggcggtggcggaagcatccacagaatggaacgttgggagtggataagacacgggaaggggacgcccgttccgttccacggatggcgccatgttgctgggctacgtaactagtaccgtattggctgttgggcccatttgtccgaccctacctttggcccagagatatctttctctctctctctcttctttttttaacatcctatataaactgtactccgtcaaaaaaaaaaactcaagcaaatatgtgacatctcctaatacaataaatctggacagccctttatctagatttgttgtaccagaaaatgtcacatcccctcctaggtttactttttttgagacggagggagtactttgattatttgacatcctgacttaccgtcgtagactcgagaaggtcccacgtggtcattgccacaagtgttaatacaatcaaattatcaaattttataactttggcctgaccttctattgtaagtttgcgacatcgctacgagggccttgctacctactgtatctcctatctcaaaacatatattatatattgtgttacacaaaattcttaaagaaaaaaactcttgtcgacaaaattgtcgaccatttcattaaccggatgggagttctacgaaacctaaattcaataacaggttacaaaaattgtaaatttaatcatagtgcactacctcaaccaaagacggagcgtcctatatgacatagtggaacacgtgacccaactttgctgtccagaacccaacatcttcccttcaaaaaataacctcttattttataatccagtcaaagccaaatgcacttttaatataattttaagatcttcttgttctattttttaaagtctctttttctctttcacttatttagctagaacaagcttgttttttctcggctacagctacctcaaagaactaaagctcatgatgatgatgtgaatgtgcattccaggcagtaaaggttccactatatttgttcgcttagtaaggagaactgaatcactgctttatgatatgataattcttcttagttcctacttagtcatgatcatcaccatcgttgtcagttagtaagttcctttggtatagctctagttgacgttgatcacatgaaattcatgcaatttttctatatttatatagattgaagtaaaatgtactctgtttatttagtatttgttaaatagaaacctctttttttgtcttttgacacgggctgaaaatcttagcaatggtctaagcatcagggcggcaccaatccaccatgtactgtcactgatcagccatgacctagtggcaagtggctaacgtgtttgatccacctaaactttgaggtgtgctatgttatcgacctcagcggtgttaaagttctatagcttatagtttttcctatcatgaaatattatgtgatga

SEQ ID NO: 36141 - DNA, 255 bp, Oryza sativa
ttctgaaataaggaggatgctcgatacccatttaatccattgtgttgcatacgctggtacttcattttttaagtctaaacttctcaaccacaactaacttttttcatttcattttctcagcatgtccttgtaaacgcatggtaacacttaatttgatggagctgtttcctccatgaagaagctgttattttcctatgaatatctcatcaggttaacaggtttcttgcaagttcagaacaagaaagttgcctgaga

SEQ ID NO: 36142 - DNA, 215 bp, Oryza sativa
taaatatgcatgttttactaattacataggatcggggtttacttatctgtttgcttgtgccatattaattgatacatgtcctttctcaaccttgggtgataaatcgactagcttgtgttactttgatgatcgagctagaactatatgcttagccatgcttaattacaactagctcagttgatgggataattacagtattagacatcttagtatca

SEQ ID NO: 36143 - DNA, 1501 bp, Oryza sativa
tttctcagtttatgctttctacagatggttgaagagttggagtgttgtaggtgtaatggtattcagaaatgctgtgagttgtgatcattgtgtaaaaaaatgtggaatggcgcataatattataatgcgattataaaaatagatgcctaagaggttccttttcttttctttttactaaaagaggatctacggtatgccactaggtaaactagatgaaacctgacgcgttgttgcgtgagttttataggataatagtacaaataacatgcagatagctacacggtataactttatatgtttttcatctgtgatcaaccatgggaaaaaatataaacaattaaaataatatggtttctaacaatttaaattatatataaatatattattcgaaagcaaaactaaggtgatatgcctcaatgacagaaggaaaataaaacgaaaaaaaagacgatatagattaatcattcaaagagaaaacaaatatgatgtgacttcgtaggagaaagaaaggagggacataatttcgaccataaatcaatcgttcaagggctagaaacaattaaggtgatgtggctcaaacagataatagagaaatagcattcactacacgtagtggggatgactttatagatttataggatgagccagctggttactttatctggtatgcatagaagaaaaacgataatgcaaaattacccataagaaaaggtaatactctataatcagtaatcacaacaaatcagcggtaggcaggtgatttccgccagtttgggcccaaactggccttgggctggtctgaagctggctacccccatcatgggcctaggctttttttcggttttagattttttttttaatatttacagaaataatctatcgaccaaaaaaattgcagaaatagcccctgccgcccacctctgaggcggcaagctgacgtggcaaacgggggaggaacgggcggtgacggagggagggttttttgcaggaaaacccttgccgccctctggtggggcggcaaggggcccgaatgcaaaaaagccagtcggggccggttattttgcaggcggccccttgccgccctctggccgggcggcaggcctcgctgcctataaaaggcctgctgcccagcccccagccctcattcttctctcctcaattccagtgaaaaaaaaagaagagaggggaggagaagagaagaaggggcgaagccctgccggattcagacgctgatttcaggtaatattcatagatcctatatgtgactattgagttaaatagtgtgtattctttaaaaatttgtttgaataaatgcattatatttttagggttttagttgtactaacctagaagtgcgtattgtagatattggtaactacgtagatctgctagttcggaattaatacattaccgttgcatttggcttacacaagaagatattacgttgtagatgtttattgcatgaaagagtaatatgatctagttatttcgttgacagata

SEQ ID NO: 36144 - DNA, 838 bp, Oryza sativa
  unsure (1)..(838): unsure at all n locations
aacgacagtagcggaaaaggtgatcctagggggggcttcagctctactccacaggcaaaactcaactggggtctgagccttggtcctctaacttcgtcttcagctcggaagcactacacttctgaaaagggggaaccatagtaaggctcaatataaccaccatactcagcaagccataccaatgatgcagacgtgcaaggagacacaagagaggtttgtggctatttgcataaatgcggttgcaaaacatttattgagcaaaacagtaaaactgtagagtaattaaggtaatattaaatatccactgatcaatgctacaccacattgaacaggcccaaccaacccacctgagctaaccaatgcattcagtcgatttattaagggtgagacaaatcacggtgaatctggtcgatcgcccataaccgcgggcacggctattcgaataattttactctggccagaggtgcagaactgtacccacaagacacaatccaccggcatgtcaccgtgccatgcatgacatgtcaccatgtcgagtgattttgacaagacccttcatataaccccctctgaccaagcacaccacacctcaggtttcacccccactcctcaacaggcagcgggcagtcccttctcgtgctagatgaatccagaagcgacanaggttgtcgcaggggccatcccgctccatcacacccactcttgcttggatgcttgatgccttccagggtttcccgtgaaccggtccttatttgttataggtgcgaccagcaaaatcatgcatccatagcccaccattaagtcgcattttaattggataattacgaccaatgaaaca

SEQ ID NO: 36145 - DNA, 1501 bp, Oryza sativa
ttatggtatcttagagtttgttagagataagagtcatgtccgatatggacatagtttgtaattttcgggtataaatagatcctgaaccccatgtaatcaattaacacacatgttcaatacaatttcggcgcatcgccacccttttgctttagttttatttcgacgagttcttgctttcgggttgagctgcatcggtttcgatcttcaacaagaggtaaaacttgttatgacggcttgcgttctcgggattagtgcttccatctttatgatactctaatcttgtttatgtaattcgtcgagttattatatatcttacataatctctggcaatatcgctatctaacctacaatcggctaatatctatcggtagagggcagccgattaggttagacatcggtgttgatttagattatataagatatctaccaccctgtgaaacttccagcgacttgattgtctagatattgctcttcttttcatacttaatgttgcatcagttgagtttgatctattaagtcgtgcttagaatatcaatctctagcctgccttctggttgctgattagggtagcatcggagtgtcagccgatcttatctggtttaattatatttgctctatatgcttcgttgacatgttaaatctgccttttatattaagatcttattgcatctaagtatattaagtttctgtctggtatattctgcttgttttaatatcttaacatagagttgtatcggagtattagccgatacatgctagatctatttgatcggctatgctatgaacatatatagttttgttgttaatatatatttcgatctaagtgatttatactgtctcagcacggtgaccgatctatcccaatcacttgatttaagtatatatcgacaccaggattatatatttttaatatctacagccgatcgaatagatttagttctttattatctatttataactgccgatcgatttacatatgacatcggctcgaagataaatgatatatcatcggcacttagccgatcggctatcatttatggatttaaccacggtttctttgtctttatttcttgttgattgcaagatcaaatcaactggcatgctagcataccggaaggcgagttttggacttgcactggagttaagcagatctcccaggcctcgtgttatacgtcaacacggttgtagaggagaagatggggtttgtcttggtggtcttgcgcaggcaagagctctgctccggcggcaaaaaaaactattcctaattaatagataacttgacatgccgcatcctccttgaattcggactcttctagataaattttctttaattgatccgattccatcaagaacacaactggtggcgacttgacaactcccatcggccgattctaagactctgaagccgatactgactctaggccgatgatgacttcgggcttaccaaattttggcgttaacagcatcgtggagggttcaaatttctatttctacactaagg

SEQ ID NO: 36146 - DNA, 597 bp, Oryza sativa
ggacgtggagagcatcggcgagaaggtgttccgcgctctggtgaacaccacagtctcactgctcaacattctgagcacaagcttctgatgaattcccaaccaaacatcactagaaacgcaaactcgatcgaattttgctactttgaaagacatctgtacataaaaatggggcccttttttaggcttttgataatcatagtactggcatgtttagagagctccatttcctttgtttcatcatcatcatcatcgtactactagcatactgctagtattcacatgggagccaaagcattagcttcaggataaagaatcaaagatcgttcagatactaacaaagagtggatctttttggtatactgctcaatcaccggtgattttcatactgttctacctgcgaaggatacggctgccgttatagtcgtcgctggctagctgttgcgcggttgaggcggctggctcccgatcgttggttgggttgggtcaggtcacgtggagtcgctgtagagccgtagaggtggagggatcgtggatttcgtggtggatgagatgagatcgggagacggggatctgcacttctgcaggcttttttccagc

SEQ ID NO: 36147 - DNA, 1501 bp, Oryza sativa
atgtccatgcaatggtgcaagttatagcttttcattccatgaagtttcgtttctggaaatcacaagcctagaagttgtgtcccataggccatagcctacccaacttatgggttcactgctctcctattattaccaactggggggaaatagatgatgagcatgaggcaacaataccatcttttataggattcctggtaaaagaacacatgtactataatgcggttccccatgggtatcgggtaaccacgaatgtagaggtgatttgacagcaaaattaaaaaaaaactctaaaagggttccagtgagccaaagctctcctaagcataacatgagcatgggcatccatacatgacagattctgagaaaacggtaagccttcagacataaattcagtcagctagcagtaggaccataactgtaatatttcggcctgaaataacacacacattccaccacaactgtaaatctgtaaccagtacaatgctggttgctcacctcattaatctcctcgggcaattcagcgggcgatgccatcggcggcatcggcaccggaacatgtggcatcatcgggaggaagggcatgtgcggcagcgggatgggcggcatcggcggtggtggcggcggcggaagcggaagcggaggggcgaagcctggaccggccgtggcgaggaaattgcggagtttggagaggtctacggcgaggtcgacgtcgcactgggggcagcggaagcgagcgaggccatggggcacattgaggatggccttgcagcgcgcgcacggcagctggatcttcgtggggtccacgccctgcgctcgcggcgcggagcggcgggaagggggagggagaggagcaggaagaggcggcggctgaagctgaggatgaggctgtggctgaggcggcggagtaggggaggccttgggcggggaagggggcatgagctcgggggggaggcgctgcgccatgcggcacttggggcagatgaactcggtcatgccgggggccacggcgaggacgccgcggcatccggcgcagcgcacctgcacgggggccgccgaggcggctaccggcgagggggagccgccgccgccgccgccgccggccatcggggagacgcggcgagggtttgcgcccgggggtaaaatgggaaatctgggattctagatgggtttggtcgttttggatattctagatgggaaatcctcctatatatttttcccaggattactactacaacaagaattattattactgtactagcaaatatacccgtgcattgcaccgggtgaatataaatattgatagataagattgcttgtgtacttataacacatgtgcataaaaacattgaatttgtatatacctcgcaaatatctccaaattttatacatatgagttgtgtaaatcgtgtgaattccatattgtcgtgttgatatggagcattactgatgagcccatctatggtgataattttggagggtgtagctcaacgaatttgcattt

SEQ ID NO: 36148 - DNA, 299 bp, Oryza sativa
tggcttgtttggggaattgggcacgtaaaagtatgttcacaaggcgcaatataactgtgcaaacctggcaaaaatgcagggtcacttttagtgacgagatcaagtgggtgatcaccctaagcaagagcgactgatcgatgcttcggtttttctgcttctcttacttggaagcgttgcattggcgatatgtatatttttcttgtccttgcgtgccgtgcatgcgagtataaaacgtagacccggagttttggcatgcaaattaaccgtgtttctcttaagctgtcgatttggtagagacg

SEQ ID NO: 36149 - DNA, 473 bp, Oryza sativa
atataatacacggctaaaatccctagtaattaaatccgaatttctaccgtgaaccgatgacttttagagattaccaaaaataatctataataatctataagaattcatctaattgtttagttattaattatatctaaattactaccaattttaatctaatctgatcaagaaacatatttttataattaactcggaatttcgaccgaaatactattacgctcgaggaatttccaaaaataatctacgattaaccccgaccatttttatttcctaaatcctcctaatttctaccccaatttcccttctattttctccttttcttcttttctattttccctctttttctctcctctctttctttttctctcttttctcttttcttttctttctctcctcccggctccttcctcctttcctctcttttctttttctctgctccctcccagcttctttctatctctctctctctcagc

SEQ ID NO: 36150 - DNA, 1501 bp, Oryza sativa
gttgtcgcgccgctgcgccgccaccttcgaagccgccgcgccgtcgccccggagccgccgcgccgtgcgtcgccgccttgcgccgccgtcgccgtcgtcgccgccaccgccgccgccggtgagccgtctcccccccctctcacctcgcgcccaccgccgtcgccgctcggggaagcaaagagccgagagagagagagatagaaagaagccgggagggagcagagaaaaagaaaagagaggaaaggaggaaggagccgggaggagagaaagaaaagaaaagagaaaagagagaaaaagaaagagaggagagaaaaagagggaaaattccttgagcgtaatagtatttcggtcgaaattccgagttaattataaaaatatatttcttgatcagattagattaaaattggtagtaatttagatataattaataactaaacaattagatgaattcttatagattattatagattatttttggtaatctctaaaagtcatcggttcacggtagaaattcggatttaattactagggattttagccgtgtattatatttaatcatttagtcatagactaaattaaatcatataatatttctaggatttcgtccgatatttagctcgcgatagaaatctctaacctattatatggatataatgctcgggtagattaaattaaaaacttatgacaacaaaatatttatacccgcaaaatagtttaagtcgaaattgggtttgccgtagttcgcagatagtaaagttaataaaaaggaatcgactttcacattcgactttcatttggatttatttggatttttatttgaattctaaccgaattcaaatcaatttttgcacgtaactatagagcccgagggagttgcggatccaagcgaaggccaagacccgcaagactctgagcaaggcaagtcatcactattccttgaacatgttgatcccaattgcgaaattgttttgtttacaaataaaattgcatgcaatgacgaacatcctacttgtgattatgccatgccttgattattgtttacccttaaatctttgtaaccatgtttacgtatgagtccctagtcaactatgacaattgcttagaaatgctattctagaatcatgcatactcatatttatcaaatgctatatgcttgggcaattacctttgggaaggtaattgagatgcggcatgtggagacatgagcgccacattgccatgatgttgatgacatgatttgtgaaaggagaaataaaattaaataactgttttcgactggggcggacggaggatttgggtggtatctggaaaaggctagtaccgtccccggtcaattaaggaccgagccatgaagttaagcatgaaacaacccccgtacaaccgcacttctcgtatgggtatagacctagcggattagatagccgagcggaggcagtatccctgcatagatggttcacccctgagtgaggcaggtgcgctacgatgggacagccgttgaggt

SEQ ID NO: 36151 - DNA, 1501 bp, Oryza sativa
ctccagcactcttcaagccgaaagtcatcacaacccactcaaataagctgattgcaccaggacatctaaaagcagtcttatgaatgtcttcttttgccataaaaatctgattgtaaccagcattgccatccataaaacttataattttgtgacctgaagtagcatcaatcaattgatcggcaatcggcattgggtactcatccttaggggtagccttatttaagtctcgaaaatcaatgcacaccctaagtttgccttttttttcttgatcattggaactatattggaaactcactcgacatatcggcacggttgaataaaaccagcatcatataatcgagtaatcttagccttgatagcatcatacatttgggccttacatctccttagaggctgctgatgtggtttatatcctagcttaataggaagccgatgttcgacaatcgatcggctgaatcctggcatctcataatattctcaagcaaagcaatttctatattctttcaatagctctattaacttggttctgaattctgcatataaattcttactgataaatgtcggccttggtctatccctggaccaatgtcaacttcttccaaatcatcggccgacatgaaaccctgtccttgcttgtcatcgagatcatctactgtgtccttagtgtagaaatagaaatttgaaccctccacgatgctgttaacgccaaaatttggtaagcccgaagtcatcatcggcctagagtcagtatcggcttcagagtcttagaatcggccgatgggagttgtcaagtcgccaccagttgtgttcttgatggaatcggatcaattaaagaaaatttatctagaagagtccgaattcaaggaggatgcggcatgtcaagttatctattaattaggaatagttttttttgccgccggagcagagctcttgcctgcgcaagaccaccaagacaaaccccatcttctcctctacaaccgtgttgacgtataacacgaggcctgggagatctgcttaactccagtgcaagtccaaaactcgccttccggtatgctagcatgccagttgatttgatcttgcaatcaacaagaaataaagacaaagaaaccgtggttaaatccataaatgatagccgatcggctaagtgccgatgatatatcatttatcttcgagccgatgtcatatgtaaatcgatcggcagttataaatagataataaagaactaaatctattcgatcggctgtagatattaaaaatatataatcctggtgtcgatatatacttaaatcaagtgattgggatagatcggtcaccgtgctgagacagtataaatcacttagatcgaaatatatattaacaacaaaactatatatgttcatagcatagccgatcaaatagatctagcatgtatcggctaatactccgatacaactctatgttaagatattaaaacaagcagaatataccagacagaaacttaatatacttagatgcaataaga

SEQ ID NO: 36152 - DNA, 284 bp, Oryza sativa
aagcaaacagggccctgactgagatttttaatatttttggcacgatatttttatgagttccaggagatcatatggagggaaaggtgaggggttcgaaagataatgtgatttccaaaatttgaaccagggttttaggagagaggttttggtggtaaatttataaggagaggaattttatggaattttgaatactaggagatatggatgattttggagggacaattcgaatagcagaatttgaattctgagattcaaatttggataggaattttgttatggtcaga

SEQ ID NO: 36153 - DNA, 1501 bp, Oryza sativa
aaggattactggtgtggtggccctgttctctttttttttttgagcttcttttcgttaaattcatttttctctcttagatgtgacatgactaaatacagcgctgctgtaaataaaaaataaacatcttctgttttcattgttttaataggtaaatataaagatttttaagtaatatttaaaaatagtgctgatcaacgacattgtcactttattaaaagttttagtttgttttttctccttttgagtttgggcatataccaatattgagataggtaggctaaagttaattatgttctatttttaatggattgggtttgtaatatcttgcatgcactcatatttgtatgttttgccttgtgagagaaatctatacagtttttgtgtgcgtggatgctgggaatgactagaaattcatagcggaaggtttcaatgaaatgaaagaaaaaaaagcagtgtaggaaacaacgcggaaggcatggacttctagttgtagattgggtctttgtgaataaacctggactcctaacctgctctggacggacctggactccagatggacatgggcacaatgaaggaatgtacatgtaaatttttttcctattaaagagctccgattatgaaaattaaatcaaactgataattttctgttcgtcacatcggtatttcatccgtaaatccaatccagcgatgccctagcctccgttctcgtacgcactttgtccctaccattggtgattgctttccctgcggaaaagaaaaacgcatccgcacggtgcaggattgaattcctgatcgactaggatcgggactgaatggatcgtgttagctcctcaccgtcaccggtgtgcctcgcgtcgttctgcatagagatggccactttgcatagcgatggcctccctggtgggccagcttgttcgtcgggagcacctccgcgacgccgcacgccaagccttgagtgtcgtggccttgagctggggatgaccctggacaggcaaatagccccgtgacactcatctcggcggcctgcactgacgccatgttggcggggtcgacatgcttggatccgcggaaaggttgccgatggttgtagtggtaacttatcaacgttgagatacatagcaaatgcaaattcgttgagctacaccctccaaaattatcaccatagatgggctcatcagtaatgctccatatcaacacgacaatatggaattcacacgatttacacaactcatatgtataaaatttggagatatttgcgaggtatatacaaattcaatgtttttatgcacatgtgttataagtacacaagcaatcttatctatcaatatttatattcacccggtgcaatgcacgggtatatttgctagtacagtaataataattcttgttgtagtagtaatcctgggaaaaatatataggaggatttcccatctagaatatccaaaacgaccaaacccatctagaatcccagatttcccattttacccccgggcgcaaaccc

SEQ ID NO: 36154 - DNA, 295 bp, Oryza sativa
ccatcgacaagcgcaacttcctaaaaatgtcatcgtacaagcctatttctcccagaaataccataatagtcaaacggttgttaacaactcttcgttaagttgtatgaaaagacattcttaccctccagacaaccatttgctcacacaatatcattttgtattgtttgctcacacaatattattttgcattgatccatatttatgttagcttccaaattcacggacatcattattttgctatcaatcaaattatttcataatgcccctgtgtcgttgcctgccacctcctcgcagc

SEQ ID NO: 36155 - DNA, 1320 bp, Oryza sativa
catagaaaatcagctactctagccaaatgacgcttgaatgcatctgaattgggattttcaatccaccagcacaacatgaataatgcctgttcaaaataatgttcactcacatgctagagcttaaaattcaggtcaaaagaaatgcatagaaaaagaaattatgttcagcaggctcattattatggaatgagtgcactgtgcagtgttcaattaatgaaaatacatggtaaaattggtgctagagttttaccatgtattttcagaagtaaatgatgctagaattttaccacgcattttcagaagtgcactcattctgtaaaaacaagtctgctgaacatagtgtctttcactatgcatgtataaggaagcctgaaatttacctttaagcactttctgagaataaacatttagctaaaccttatatatatgctaaatgtgtattcgatttaacaatctgtgtaagattttgcatctccatgaaaattgattaattttaaatatcaaagtcttattttgttttgcatttgtctgcgctctgcacatgcatattcagtctcgaccttttttttaaagatatgcagttttaactttcaaccaagttctctgtactatgtacttcttgtttcatggggatgcttgtaaagcaaatgaatgcagttgatgcaggatttgcaggctcatgagaaacttttggacaaaaatactagttggtaattcagcttctcaatctgttaaaaggaaactgagaataagaagctattactgcttttttttcttctgagatttctagggtaagtatgagtctcattttgacaaggaagaactcctaccttctgtgcagcaccaatgcagatatactgagaattttcatcttcatacttcaagaactcagcaatttggtatagagctctttttctcatgtaggaaattggccaacgtgtaagaaacggctcaccaaaactataaaggcagtcagataggcactcttgtagccacatatgtggattataggcatcttcctacatttgaattcacaatgaaagaaaattactgcagttgattcaagctatacggactttgaatcttctgataaacaatctgatatttaactacaacaagcatgcgaatattgcaagcattggagcacatcttagctctatttcatagtagctgataatatgatgttagtaattcctgacatatctagatgtctatacatagaccataatattagttggcattatatctaaatattcctgaggtggcctagcgagcacctgttgctgagtacctcgctaaatttctcgtgcgaggcagaaa

SEQ ID NO: 36156 - DNA, 521 bp, Oryza sativa
ttcctgcagcccttagtctcggttggtaatactaaccgggactaaagaccaaaaagtacctttgagcttttaaaccgggactaaatagtcccggtttttaatacaaccgggactattgtgaaatctggccgaccgaccaaagatgatttctttaccagtgttatgtccaagcatacctttttcatgagcttcacccaaaaatggccttagagaatcggctcgttggttaatgtaaagtacatgactacattttcactcggaatagctctatttttttccctcatttttgttgttgattaaatcttctctctcaatcatacaatcgaatataatacatccctgtcttcaaaaactggtgcaaactgattggattgggaagtactttttgctgaagtaacaaactaaccgtgattgacccattgagtcaacatggggcaggtgtctagcttggatttgccgctcttagaaaaatataaaaaccgtagcgtcggttgaggaggagctctagcaggtgctagtca

SEQ ID NO: 36157 - DNA, 312 bp, Oryza sativa
cgataacctcgcattggcagtacccgctccgtgaacttaaatcctcatgcactctaggcgtccatgtttctagcagtgagaggagttctggcgctcccgggaaagagaagtctcacacgcatattaaattatggttcaagttaagttctctctctcacacactcatggcagtcctaccaatggcgacaccgatgtagggcacgcttctcggccctacctcaacggctgtcccatcgtagcgcacctgcctcactcaggggtgaaccatctatgcagggatactgcctccgctcggctatctaatccgctagg

SEQ ID NO: 36158 - DNA, 200 bp, Oryza sativa
aaaaaattgtggattcttgtagtgaatatattttccacaagtttattctttagaacgtgaaagtattctttagttatgcttctgcgaatttataattcatacatcagtttcttttagagcaatatatatcaagttaaggctacagagattcttataattgaacccataacctaacttctatttcactcttttcttctaga

SEQ ID NO: 36159 - DNA, 1501 bp, Oryza sativa
gcgtcacagtacactaggaagtccttgcgagtatccggtaagattaacactggcgaggaaaccagcttttctttgagagtttggaatgtcttctcgcattgcggtgtccacacaaatttttcctccttcttcagcaactgtgtcatgggttgagcgattttggagaagttctcgatgaatcttcggtagtatcctgccaaacccaaaaatctgcggacttgagtgactgtcttgggttgcttccagtcagtgacggcggtcactatttcagggtccacagcaactcctttagcggatatcacgtgccctaagaatttgacttcggacaaccagaactcacacttgctaagcttggcatacaattgatgttcccgcaactttcccaacaccagacggagatgctgctgatggtctttctctgattgtgagtataccaggatgtcgtcaatgaaaaccacaacaaacttatccaagtattccatgaacacttggctgatcccctcctcctgagatagatttcagtggttggttctggctctcccagagctccaattgaacaaggaggcatttgcttgcacacacatgcacccagttgcatcagactcgcatgaccaggaggcagaggaagccagaacaaggctcatgctcatcatgcacgcagaagccatttctctcatgctttcagctgccaagcttcacccagcacggcttgcggttcgctcctcccgtgcgtgcacagctcaagtgaaaccgcctcatcacttccatgtgatcatcctcctcctcagctcccagaatcctaggggcataaataatctagccgtggcatctccattcgatcaccctcatcgatcgatccgcccgatttggtctggccagctttcgtcttctgatagatggttgcttttatacacctgaaactaaggcaattaaagcttaagtgtaagtacaatgcccctctttgttttcctacattttagcatctgtttatgaccatgatgatgatgcattgctgcttttaaggttaaggtgcacatcgaaaagatttgctacttgcttgtagacaagaatcgcataaaatgtaacaatggtttcagaaaggaaatgctcatactaacgaaagtttcatgacacaatatttcagatctttcaaggaggaataagaatcaacctgtcaagtaaaaagttttaatatttgtatgatcagaaagggcatacaccaacctaaatttgctgtgtaagaaagtagctagctgtgccaaatcattgtcacctcagtcagatctgccacaagcacgtacacatatatgtgaaaccgactagctttcttgcagctggaaaaactccaacgtacaacagtaaatgatataatctcaatatctagatataaaatatcctttttggaaacttctacaacgataatatatatcggtttgtcctaaaaactctttttttgttccaacaggtaagacttacaagtagcagaatagtttctacaata

SEQ ID NO: 36160 - DNA, 471 bp, Oryza sativa
ccactacttcgaacctgatgctacggtatttttagtggcttctcattcatatcgttcatatacaggctagttagggatagctggtgctggcgtgcggcgctccatattgcatacatcaagagacaagattagattgcactaattttcgttcagactagctacagatttccataacctggcaagtacactgtattgttgttactgcatattaaggtaggtaactccaacataattgttcactcaaggaaattaaaggtttaatctcagttgtttgctatctgtttttttttttgcagatggaggcaataaatagattggatgtgcgagataactcagatatttattcaaatgatgatataacttctccagtaatagaggatgacaacaccagtacaccaaaaaaaatatcaagaattccactcaatgtaagtacactggcaatttaaaaattatgactgaggtgctttaaaa

SEQ ID NO: 36161 - DNA, 217 bp, Oryza sativa
ttttgttcgctatttggcaatcggcaagtgcaactaaatgtagtaaatgtaaaaggccaaactcctagagatatatcacatgatcaaattcctccagggctacataataatcaggtaatttaaattcttcttttagaagtactactttcgagataaacgataattgaatactgatttcacttcctaacaaaattgattagtttccttatttttcaga

SEQ ID NO: 36162 - DNA, 1501 bp, Oryza sativa
ggatttttatttcgaaaatattgctaaggcttgggacctacggctcgtcctagggttaagggtggctctgataccaacttgtcacgaccggaaataacccaacgggcgttccttacgtgcgtgtattattccttgtcccaggaggcaaggtacaccagaagttgatacaattcagagtttaacaagcggaagcgtaaatagttaatttattacatgggcagcgaaggcccagcacacacaaagacaaccgagaaacagcggaagactagggcgacgaccacaggcgcttgacggcaggcacgagctagacaccaaagccttcatcttctaggggctcctcttctaggtttgggaaaaattgagcaagactgagtacaaccaccgtactcaacaagacacacccacaaaggagttacactataaaggattagggttacagtaaacagcatttaaagatctttagttgctcaaagctatttggtaaacacgattctagaactaaacaatattatttatcaaggccgtgaacccacacgaacctgccttaacccaaggcctacgatgattcagaccgaactggcaacccgaccctgggtcccagctcgtcccaagccaacccaggctaaccattccacattttagttgttaagcaggttttaagaattaaaacactaacttgggtacattgctcggcttgcccataaccgagggcgcggctattcgaataaattatactctgatcagaggtgtacatctttacccacaagacacatcttcctcacgtgtaaccacgtgccacataccaccacggtatacagacagaagacgtgacatagtttccaacccatcctagccatagacaagagtaccgacccaatcccacctacggccggaacccccgggacaggcaggcaggactgagcccctagcagcaggacaccggccctgtgccatgacatctcgactaccgggccgcagctcgtgtagccttcatttgccctggagatgtccatcgacccccgacttcgtccatccccatccgtgtacttttgtttataaccagactgagccagaaactaagccttacccactagacatgtggaagtacggtagtgctttgcaacagaggcccgaagaccggtccatatatggccgaggtgctaccatcaaaaccatgcaccccgagcccagcctaaaaccattttgagggttttgaatagagggggaggtgtgaatccaattccgcaataatccaaccattccataatgtccaggtgatatgaatattcccaaagtctaaagttgtaaaaccacctaatgttgcctaattaaccagcgaagcatctacctaaattcatactagtagcaccatgagtggagtgcccactagttggggttttgtttagtctagggtgaacaaggtaataataataacaatagccataataataaggtcataacaaaggtaaataggcatggctgaataaaacagtgataacgc

SEQ ID NO: 36163 - DNA, 1153 bp, Oryza sativa
atgctgttgatttttttaaatagactgctcgttttattcaaaaattttaagtaattattaattctttttctatcatttaattcattgttaaatatacttatatttatacatatatagtttttaaataagacgaacggtcgaacatgtgctaaaaaatcaacggtgtcaaatatttaggaatggagagagtatcaattttttattctaatttgtgatgctacgaccaactttacctttcatacgtataatcactcttaacaaccaccgttttttgacaatttggtactttaagaaaacttatttcaaaactaaccctcgtcaaaaacttcaactaaaaatagaccgtggacttagcgtcaatcccgttggtgctatggtccaacgtctcagcgccagtacgacgctaaaatttgccacgctagcagagttgattgtggacgtggtacataataagtagacagtgtgctattcattaccaggatctattgatagtgcagtggttgaaatgcttgtttggttttcaccagattttaagttcgatcccccatgtctgcactcttttttggtatttctctgttgcccatataaatgcgaaaaaaaaggtgcaaagctcaagtttcgaacccaggtcaccaactagccaagggatgggcttcaccactgcgctacacattactacttgatttgaaaatatactacacatagttaagagctatacggaggtcagcgccaatgcatactacacatacttaagagctatacggaggtcagtgccaaatgcattggcgctgaccctacgccacgtcggcaatcggatcgactggtgatccacgtgggcaagggttcagcgccaaagtcactggcgctgacccgttggaactcagcgccaacggaactggcgctgagcccacagtctatttttggttgaagtttttggcgagggttagttttcaaaataagttttttaaaaggaccaaattgtcaaaaaaaaaaaacggtaacaacctcaggtccacggcatatgatccatatccatgttccagctcttggtcagcacatacactgtttaaacgcttgcacaatcacggccaatccataacaacaaacgctagcactacgcttgagctcgcactggtagttcacagcatggagt

SEQ ID NO: 36164 - DNA, 306 bp, Oryza sativa
ccacttgcatgcccctatcgcctggcttgctggctttgccagttcgcgccccctccctcttcttccttccccctttcttctctttgcccctctcttctctcccacatggccacgtgcatcacgtgctccatgaaacgaccagcgaaaaagatatcaagcattccccacttcccttccgcgcccggccatccattactacgaaactgatttttgcgtatggtcaaaacttattttcgcatgcagtttctctagccgtatgcacgaaaaggtatgagaaaaatcaaacttttgcattgcggctaaagg

SEQ ID NO: 36165 - DNA, 1501 bp, Oryza sativa
ggaaaatcatatctaaataaccgtagatccgtttcaggtggttcaagttgctaaatttttctaaaataaagatctacatattaaaattgtccataaattgaattaaatttatttaattctttttaaatgggctttaattagatttaatcttgtaaaattcataataaattcttttgaagtcagaataaggctgttcaagtctcataattcatctaaaattatgatctacatgtttgtttattttatatgtattgtttatttggtttttattagtctttttcttcgttttgcgtgttagcttgtcgtttccgtcgttgcgaaggttcgtgagtgcgtcggaagtgatcaagaagattaattgaagatcgattgttgcaaggcaagtcacacagattctaaacacaatcctttgagcatgttgatcctatatttaaattctctatttatttcaactgtgcatttattttcgaatgtcaccgggtggtgtgaacctattcctttgttatggccaatttgcattgaatgccctattccttgataccttgggtaataaattgattagcttgaaccttatgtattggtttggttcagctgaatgttatatatataattgcttagcaatgcttagagacattagctcactaatgggatgaatcatttatactacattattatttatggttatatttaatggtagctcacgatggttaatcgtgttatgataattaattggtaattaaaatatgattagtggtgggttgtgagcacatggttttgaaggtcgtgctcatggcaattaaggaccggttcgcgagctactgttgtgagacatttatcgtgccaaccacaagccagcgtgggcaacggctttatcttttgtatagcgtgattcattatagtgcgccagactgagaagtggcgagaagtccacgggggtcgctggggagtccatgccttgtttataagggggtgattatgatccaggaaaggtgcgctataatgggttatgttgtgcaaggggtattgtcacaactcctttccgaggtaccgtggtggtactgaggcacatggtgacatgatgtggggttgtgtcttgtgggtacagtggtacacctctggccagagtaaaactattcgaatagccgtgcccgcggttatgggcgggttgagcaatgtttttcgtgattagtctcacacctttcacaataattatggatgttataattggtaataatttgcttagctcctggtttggagttagatctgtacagccgggtatggttgttcaggatggttgggcctgtacagcatgggtgtgttgttcagtgttgattaaaattgatgattaattactctactgttttacttatcttaactctttgctaaatgctgcttttgcaaatgagcctatattatgccattcctttggaatccttgtgcacttgcatatttgctgtgtggcttgttgagtatgtcatatactcattcttgcaataatcaa

SEQ ID NO: 36166 - DNA, 1201 bp, Oryza sativa
cctgcagcccgaagcagcacgacgccggcgccgctactcgcggtgatggagatcggcgcgacggcgtaggcggcgggcgaaggagacggaacgggtgctggaggaggggaggccaggggacagggggctgggtcgcaacgcaaggaggcaagaggcctattacgctgctgggtcagtggggtgttgttacaggtttgggctttttggtggctcggtctccatctgttccatctcctcccaaccccagcccggttgaaacaaaaaaacaactagggtgtgtttggaactttggggagaatactaccaatcgaacgtccgatatatcaaaaaaaacatcggtcggtcaaaatgttgcagctgaccaacaagtgaaacattaatttatatatggtgaaacaaaaaaacagcaactaaaacatttaaaaaatttatgaaacacagtgaagatacacgttgaaacatattgctatcacttatgaaacaataagagttaatagattgaaacatatatttttctttcatcaaaatttaatcgtgtgatattttattataaagatttaattacaacgaatacaacggtgtaatcgaatcatagattggataagtagtttagaagaaaaatcattttaaagaccgataaaatgcatgcatgcaagcattgatggagggtagtagcaattatttttgataattttatgaaacacaataaaaacaggtgctgaaacatatggatataacgtatgaaacatgaagtattaatagtttgaaacttatatttttctttaatcagaatataataatgtgatatcttgttataacgatttaattccaacaaatataatggtgtaatcggattttagatcggataaatagtttaggagaaaaaatcatttgaattttgaagacaaaccccgatacgtctctctcattctaaatgacctttccatgggtctcacaccccatgcacacttggaaacacatgcttgcatgaagcgggttcgatttttctcttttgctcggacgacacatgggaagcaatttccgaactttggataatgggatggtaaaatcttttcccaccttctaaaatggtaatttttaatcttaaccatccattcttcatatctcatctcaaccccccactcatatccctatcccaatctcacccctcttactccattatctaaggctgcaggtaaaa

SEQ ID NO: 36167 - DNA, 199 bp, Oryza sativa
tttttattttgtccactaagatgtcacgccagcgaaaccaagacatctatactgccatgggatataaattgaacggttttgtatatttaggggtgaagatttgtggtattgaggataagggatgacaaacaaactcggtgtaaagttgagggacatcaggtgaacttattccaactataaggcaacgcatcacggccca

SEQ ID NO: 36168 - DNA, 1501 bp, Oryza sativa
agtttgcattgcatgcttgttgtagaggcttctgctcttgccgatcagcagtgtcacgaccagaaataacccaacgggcgttccttacgtgcgtgcattattccttgtcccaggaggcaaggcacaccaaaagtcgatacaattcagagtttaacaagcagaagcgtaaataattaatttattacatgggcgtcgaaggcccagcacacacaaagacaaatgtgaaacagcggaagactagggcgacgaccacaggcgcttgacggcaggcacaagctaaacactaaagccttcatcttctaggaactcctcttctgggtttgggaaaaattgagcaagactgagtacaaccaccgtactcaacaagacacacccacaagtgcagaataaatgtaagggagtacaagcgggttatcatataaggggttagggtttgcagtaaacagcattaaaagacacttagttgctcaaagctattttgtaaatacgatcctagagctatacaagattattaatcaaggccgtgaacccacacgaacctgccttaacccaaggcctacgatgattcaaaccaaactggcaacccgaccctgggtcccagctcgtcccaagccaacccaggccaaccattccacattttagttgttaagcaggttataaggattaaaatattaacttgggtacattgctcggcttgcccataaccgagggcgcggctattcgaatagattatactctgatcaaaggtgtacatctttacccacaagacacatcttcctcacgtgtaaccacgtgccacataccaccacggcatacggacgaaagacgtgacatagtttccaacccatcctagccatagacaagagtaccgacccaaccccacctacggccggaaccttcgggacaggtgggcaggactgagcccctagcagcaggacaccagccctgtgccatgacatctcgactaccgggccgcagctcgtgtagccttcatttgccctagagatgtccatcgactcccgacttcgtccatccccatccgtgtacttttgtttataaccagactgagccagaaactaagccttacccactagacatgtggaagtacggtagtgctttgcaacagaggcccgaagaccggtccatatatggccgaggtgctaccatcaaaaccatgcaccccgagcccagcctaaaaccattttgagggttttgaatagagggggaggtgtgaatccaattccgcaataatccaaccattccataatgtccaggtgatatgaatattcccaaagtctaaagttgtaaaaccacctaatgttgcctaattaaccagcgaagcatctacctaaattcatactagtagcaccatgagtggagtgcccactagttggggttttgtttagtctagggtgaacaaggtaataataataacaatagccataataataaggtcataacaaaggtaaataggcatggctgaataaaacagtgataacgc

SEQ ID NO: 36169 - DNA, 507 bp, Oryza sativa
ctctttcttatatcaggggcagtgtgcgatgcatatccaatcgccatgtttggagggggaagtaacatggggagagagcgatggattggccgctagctagctctcgtagcagccatttctttgggtgcaaaccactgcataaacaaataagcaataattaataacacaaaccatactaaacaatgccttgaaccaattgatatcaaatgtaccatcgtacatagctttcttcacatggacaaagctagatcttgcgctgtatttcgcgtgcggttgctggccagggttggccaccccgggcccacatgccagccacagttatttaggaaaggctaattagtttataaaatgatgcttgattagtaacctaaagtacgagccatgggcagattagttggatcttaattcgtccgttgcaatgctgccaccttggaggttgcttcaaggaaggctcctgaccacaagcaaatactactactacagtactactatactacgctgttgaaa

SEQ ID NO: 36170 - DNA, 1501 bp, Oryza sativa
gaataaataatccaaccaaccgagtggttttgataattgtaatcaaccaagtgacttgatatcaatatatagcatatgcggtgtgaatcccccaaataacatgatccaagtgatataccgactgcttggtaaaaattgatgtgagcaacctaaagttgactacatcattgaaaattcacatagcaaaacagctataaaaaaaacttgaatgctgtgaataaagaaattttgaaagtattgggcatacgccatgcgcacactgctttaacagatgtacttaactctctaaaagacacatggtttcaccacacccggaaatatacggcatatatggtgcaaaatccgagtaaataaactcataaaggatttaccaaccgcttggaaaatgaccaagatatataatcagcctaagccataatattggtcaaataaaaatgcacacttacgtggcaaaaagcaacaatattgtattcaatcaattgcttaaaaacccaaacagcaccttcacttatataaaaaagtcagcggggcagctatataaagctttactgtttgacaccttttaagatgcattgtaccaactcctaaaaagttgagtaactgcggtataaaaggattttaaggtattgggcacttgatcacgtgcactttggcctaagcaaaaagtatctaagtccctaaaagaacgtgacaggctacacctgaaaatataggctgcagacatattaggcctaggctaaaaaatatgccttcgacaccctttaaaggatgacgcatgtaacatgctcccgagtaataaatcttccgggtgatatagaccaagtgtagcttatatgaatagcttctgatcagagtgattatcccttatgggatactccaaaatagatataataattgaatcctgacttgcgcaagtattcgattgataacccttacggggaataataaatagtccagtctttgagcatagaaaatagactcatgatcatgaattcatgttgcatgtatccggaacaagtccaaattgaaggtatgatacttgtgtttgagctagtaagcccctgatcatatagcttgtccttctgccgtagtcgcaatggtccattgatggtagctgatgcagttggcatagaaacaaggcgaccaatatagagataatattgctcaccagaggtggcaaaaatattggtggtagtgaagatagtgataccaatcaaaagtgatgaagttgcacaaccgtggaggcgaagaatccagtcggcagcagtcaggtcaaccagcaatgaagatgaaggtgcccagcgataaagttgtgtagccatggtagcgaaataatcagtcgatgacagacgaggcagctggtgaagaagatgaaaatgcccattagcggcgacataattagccatccgtgaaggtgaggataccagtcggtggtgacgaaagcaagccgacggtgaagatgtagacacgcatcaaaggcgatgacgaaatccaccaatca

SEQ ID NO: 36171 - DNA, 437 bp, Oryza sativa
gcatgcttcctaaactaccaaagatgcggcttttattaaaaagatttatatatatgaatctcttagaaaatcgtttcaactttataatagttaattcattcggttgtatccttggataattgtcacgaaccaatcggtcactcagcatttagctcaaaagaatagacacttagattgtcaatatattactggcagaaacctgttaattctcaattcccttgttattaccctcatatctaactacgtaagagaagtttcttttaaaaaaatacagtctctctgtaccttctcaagagccttaaattaatcgtactccctctatttttatcaacatgacgttggttagttcaattttaaacatcaaataaaaacagaaggatttcggtaataatttccacaaaattgagggggaggatatagatgtgtttacctgcagg

SEQ ID NO: 36172 - DNA, 1501 bp, Oryza sativa
gttcaaaactacttgcgaaaagctaaggcttcttttggtttctttattttcagtagtgttgctaaaatggttactgatcttttctccctctttcaaaattgtagatggcagtgaacgccagcttcagttcccacggttttggtgagggtcaccacgtcgctcagcttcgtgacctcgcccgcttccttggcttctcatgtcccgagtacacggggtactccgtggaccgtgttccccctcgctgtgagctctctgtgtacctttaccctcgtggaggtatacacggagctggccttcgcccacaccacttcactatggccaggcccactctccagatcgcgtaccaggacctctcctggactgcgctttgtcgtttggcccacgactacagccaccgtcttgggggctctgccttccggcagctcccacaccttccttctagccacgcagacgccaggtacccttgtccgtacaacgagtctcagccagtgctgactcgcatggttgagctttcggaggctcaggccactcagcacaacctactcctcgaggcttactgctcccttgcccgccgctacgccgctctggaggcccatctggccgaggagggtgtcacctcagttgacactgtctcttgggactcaggccgcctctgccacgccagccacctgtcctcccacagctctcgcggctctgcccgcactcccagtggcccgcgctcccccagctcgcgtgcgccgtactcacaagtgtactccccctacccacacccagttagcccctcctacacccccggacacaccccagttgcttcctcccgccgtggcccacgctttatccgcactgcgcggaagcgtgttgttggttcttccaccgtgttctgcttcgactacccagctcccccaccgctagcggcccgtgctgttgggggccctcgacaggttccgccggtcccttcgcgtcagccgatcgacgtttcttcgactgaggagccgactacaggaggcagccaggcagacgaggagtagaggaggcagtcttcagcagccgtccgtgtgttaggcccttttgttccgccgccaactcttttggagtcgtggcgaggtagtgcgtgcgtgtgtttgatgtgggtgttgtttggtagtctggttcttctaggtggtgtgcgtacagtcaagctcggcgtagctctgtgacttgtccacacccgttgtatcaggtgtttttatgatttgaaaaatccagtttatgcctagtgcgtgctatctgagttgttatttactttgctccttgccctcctaagtgcttatctaattcttacctcgccctcttctgggagtttagatggctagccacccccaccgtgctgctcgtacaccagcctgcttcggttttgaggaaggtagagttgagccagaagcaaatcatgagtcagctaatgagcagtctcaccagagcaaccgttcgcaccgtactgcttcccgcaatgcagaagttgagc

SEQ ID NO: 36173 - DNA, 721 bp, Oryza sativa
taattcccatggcttgctgagtactcccgtactcacccttgctctatataaataatcccccccagttgctgaagaagatgaagcggatcccgctgacgaggagttcttccaagagcaagccggctacgatgagttttagggtttcggcctagttcccaagtcgcgcctgtgatgtttggtccaagtcttggcttccgcttcccttttgaaatgcagttgtgagctcgggatctgtccgcagcccaacatgactgtactcctactctataataaagatacctctgtttgctgtgatattctgtcttcctgtgataccagcactgtttcctgggactggtatcgattaacaggttaatttggagcgtcacgggctagttccgctcgggactagttcggggcgtgacaagagatggtatcagagcacaggcttggccctagggcgaaacccgacgtttaggacgaccctaaggatactaagttcaaaactacttgcgaaaagctaaggcttcttttggtttctttattttcagtagtgttgctaaaatggttactgatcttttctccctctttcaaaattgtagatggcagtgaacgccagcttcagttcccacggttttggtgagggtcaccacgtcgctcagcttcgtgacctcgcccgcttccttggcttctcatgtcccgagtacacggggtactccgtggaccgtgttccccctcgctg

SEQ ID NO: 36174 - DNA, 1501 bp, Oryza sativa
tccccccacttttctctctctctccctcggatttgttcggaaacgtttccccctaaacctcgccggcgcatcaatggcggccggatcttccgcggccgattccccctcatccggccgctctctccccctcccaaccctatataaacactccccgtgcctccctccaccgtttccgccactcgccgctctctctctccgccggaatcgagctcgcgccgtcgctctctctctccgccgtcaccgccgagctccggtccgccgccgtagtcgccccggaccttctcccgcttcggcgtcgccttctccgggttcgccgcaacctcgccgacctcgtccacccctccgtttcgcccgccaaccgccggaacgccgccgtccccgtcgacccgagccgcgccgccgccttcctccgctccggtcgccgttcccgtcgtcgctgtcgacccggggtgagccgtggaccgccgtttcgcttcccccttccctcatctctctcgggcgccgctccgccgcgctggtggtcgccggcggcgaccatcggggcgcgggtgcgccacctcccgtcggctgtgccggcgtggccgccttcgggcgcgccccgcggctgccatgtggggcccggtcgtcagccgcccgcgccctcgggtgcggctgacgcgtgggacccacggcgccggccggtgtgagccgggtgcacccggtccaccgtggaccgtgaggctgccgcgtaggccccactcccgtggacccggtccgcgcgctcctcccctcggctgacgcaataaatccgattttaaattaaaatttaaataaagaaattcgcaaatatccatttaaagagcatataaacttcaaatggccataacttgaccatttgaactcggaattggaccgttcaagtctctaatttctccttaagaagtcaagaacccatttttgtgctttgtttctgcttgttatatggagtttattagagtataagccttttcttttccgttggtcgtgtagacgctgcagcttcggaagatccgctcttcgtggaggttgaagccgacgtttgggaaagcgagcaaggcaagtcacatcatccttgaacatattgaatcccagtttataaaattatgttgatttaaattattgcattatcgctttatttaaattcccgcgttatcactgttttatctagccatgcctatttacctttgttatgaccttattattgtattgttattattaccttgttcaccctagaataaacaaaaccccaactagtggacactctactcatggtatcactagtatgattttagttagatgcttcgctttttaattaggtaacattaggtggtttttcaactctagactttgggaatatttatatcacccggatactatggaatggtttggttattgtggaattggcttcacaccgctccttctattcaaaatccccaaaatggttttaggctgggctcggggtgcatggttttgatagtagcac

SEQ ID NO: 36175 - DNA, 1501 bp, Oryza sativa
agctgatcggagtgcggttccattctaggtctcgggctagatattattttgttttccgctgttgttctctgatagttgttggcctacctggccctaatgtaagcatttaactctcttagcctggattcattcgtgatatgttgtgattcggctatgtatgtgtgtaccaactactgattcagggattggtactgataaacacataagatttccgatttataaaatcggaggtcgacagcccgccccatcatatctagccccaaagaactactatcgaatacccgggtatcataaaccccacaagatcctactgcaaatcaaagggctgccaatttgccaaatcatattctcacgccctacctaagggctgccaatttgccaaatcatattctcacgccctacctttttctcgtctcttgtgtctatttgctgttggatccgctatcactggcccactgctagttaccgactactcggctatggcaattttgccgccagcccattccactacctaaccatctctttaaggttggcgaattccctcctcctaccccgatcttaatatgggatcctaacttaagtcgccactatctcgctggctttcaaggagaaagagtgacaaggatctaatggtgaaggattcatcagatattcaactcaaatttgtgtcaaatgaaggttagcaattctgctaaatatcccatattataaacaagcgtttctcaaaagaaaattgaaaaataagtacaataataggcaaatggatctaatattcttttttcattggaatggatctaatattataatcttgaccccgcaaaaaaaattctaatcttgagaaactcaaaatgtttttgaacactgatgaaatttgaaacgaggtgccagtgtgccacaaaacatgtatattgccgcgatatgcgccatgcggccatgccgccatgtgctcctcccctgatgcatgggttcccagatgacagtcgaccagtcgcccagccaggagcagccttcctccaggcctcgtctcgtccttccacaccacgtccaggtcatttccgcctccttttttaatagaggaagagcggaagacatggcgaagcacgtcgctggaaggacatgatctacgcacacaagccattatagctcggggaagagactcacagagaggaagtgctcccggtgcttccctgctcgtttggctgctcgccggccgcgtccgccatggggaattgcttcggctccgatgacggcgaggtggaggccgtcaaggtgatggcccgtcatgcgctgccacaaggtacatatatgaatatcgacatcccgatgctctgcttacaatatcactacgttttctttgtattcgtgagatttattttgttcatcgggatctggaaccaacaaagccattttgtcatggttttggtgctgcgtctctagttctgacgcacttcgtgtgctgggttttgctcttttgcagcggcaatggcgagaccggtcatgg

SEQ ID NO: 36176 - DNA, 1501 bp, Oryza sativa
gttggtattgcttgtcaaactataaattgtcaccactgaaaattaagctaaagctatacaactgattaataattataaaaataagatatttattgtgaaccctataaatatttacgcacaacacaacaaagccatacaaagagaaggttaattactaatttaatttataggccaaatattaaatattggaaccatgtgacaggtgtcatgacatctaagtaaccatgaaataatcgccactatgacgaccctatatataaaggagtgttgcactggaataattaaattaatatttacaatgttcatcaagtctctcaggggatagattcactcatgtaaaataatttgtcatgtaaataaattgagttctatatataaaaaagagcttatgggagtattcgattcaatgtttaagaccaatattgcaccaaatctcataataccttcatagaataaaacttaaataaattaaacctatgtatgtaaaatatattgctatacaaataaattcgaccaatgtgctattgtattattaaatgtcacaatagaatatttaattagtttttaagaaatatcaaagcctagaagttgaattggataatttttggataatctaatggaaagcaaactcatttgggaactaatgaataactaaataaatattcaaatcaaacatttgaattctcaaaaccagaatgtatagatttcatttcatttcaaatccaatcccattcacttttgcagattagcccttccccctttctctttttccttttcccccattccttttctttttcagtcggcactgttcatcgcccatgaaccgttcgatctgggcccaagccgctcacatgctgcgagtccgctccttcccggtcactactgagccgcgcacgtgatcaatcgcgccatctccgcatctcgtgtcgcccccgtgcaccgcatcgtgtccgtgccggtgcgccatcccctccgtgccgcaccagaaccgcgccaaacctagccgcctccccgccagcgcgtccggattccctccaggaaacatggcgcctcgcgtcttgtcgcgccgtcgccatcgccatcacccatcacctcgccaccgatggataacggccagaacgccaatccgcgtcatccctagccctagccaactaccttaggacgggaaaaccgccccagcaagccgccgctccgccacagctcccatgtgcgcgcgttccgtcgcccccattcgcgcccaatgaataaaacggagcctcctgccacagctagagttagaacgcacagactttaggctttaggtacgatgatggagccacataaccttaatggaggaggagatcaaaccttatccgcgtcatccacctcattgctcttatccgatcaccattagtactccagctcgcctaggcatgtgctggtgatcttatccccatagtttgcttgcatcctaagcgaagccctcaacaaaatcctcatccctctcagccttcttctcgta

SEQ ID NO: 36177 - DNA, 1501 bp, Oryza sativa
aaaataaaaatgaatttgtaggtaaaacttttatatatgtgttctcggtgatataaaagccaatgctgaaaaagaaactacgttaaaaaaatatcttaaaatcaatcttaattttgaaaattcaaaatttggctttttctttggcttaataggctatccgatgggagaaaaaaaaatctacttggctcatactctcagaccatcactcatatccctctcgtacaataggtttatctccgattactatataagttggcttgttagccacaaccaaagtctaaatattaaatttaaactaagtcttgcaaaaacaaaaatgtattaggttaattttggatttttaaattacagcatctataaattatttttggttgttctatttattttcttaaaataattcaagctttcaactgtagctcaaccaagatatttaaagtgaaaaacaaagttaatcttgcccattttgctaccacccacactcggagaagacgaataccggcattggcaacctcgccggcgaccagccggacgccggtgctctacgccagcgaagccaaaggggaaaggaaaaaaaaccgccgctggccgctgcggtttgacctagctgacgtcgccgccgctcaccgcccaccgcaccccccacccaccgcgtgaggccgaagaagctgtgcggagccaaaaacccgagggcgtcactgcaggccgcccctctcgtcgtcttcctgccacgcggcggtgctcggtgatctgacgcgtccgtcttgaacgggaggggggcaaaggaagcggtgggttttggtgcgtgtcctggactttgcttgtttgttaaggttaattttgagcttagatccactccaatccccacaggtggattggattgattgcaatgtagggcttgcagccgtcttcatctggcatccatttatgtgattagttccgtgagtctgattttaccaggatcttaaatcttaaatcatgctaggttttactgattaatgtattgtaatgtggggttcttttctttttaattaaaaaaaagtaatagtattatgacatcagatttcctctcatggatgtttgttttgatgctcttgctatcgtgcagttgccaagcaaaatatggctgaggtgcatctatcgagttttgcaatctccgttcttggaaaagcggccttttgtgctgccagcgagattaaatcagcgtggaatttcaagaaagaagtgaggaagttggaaagatctctgaagtccatctgtggtgttcttaaagatgcagagcgcaagcagtctacttcttgtgctcttaaagtgtggctggaagatttaaaggatgtcgtctacgacattgatgatgttctggatgatgtggccaccaaagatttggagcaaaaggttcataatggtttctatgctggggtcagtcggcagcttgtttacccattcgaattgagccataagataacagtagttcgtcaaaagcttgatgagatagcagctaaca

SEQ ID NO: 36178 - DNA, 1501 bp, Oryza sativa
gcgatgaacagtgccgactgaaaaagaaaaggaatgggggaaaaggaaaaagagaaagggggaagggctaatctgcaaaagtgaatgggattggatttgaaatgaaatgaaatctatacattctggttttgagaattcaaatgtttgatttgaatatttatttagttattcattagttcccaaatgagtttgctttccattagattatccaaaaattatccaattcaacttctaggctttgatatttcttaaaaactaattaaatattctattgtgacatttaataatacaatagcacattggtcgaatttatttgtatagcaatatattttacatacataggtttaatttatttaagttttattctatgaaggtattatgagatttggtgcaatattggtcttaaacattgaatcgaatactcccataagctcttttttatatatagaactcaatttatttacatgacaaattattttacatgagtgaatctatcccctgagagacttgatgaacattgtaaatattaatttaattattccagtgcaacactcctttatatatagggtcgtcatagtggcgattatttcatggttacttagatgtcatgacacctgtcacatggttccaatatttaatatttggcctataaattaaattagtaattaaccttctctttgtatggctttgttgtgttgtgcgtaaatatttatagggttcacaataaatatcttatttttataattattaatcagttgtatagctttagcttaattttcagtggtgacaatttatagtttgacaagcaataccaaccataacatccagcatgatgcaaaagttttaaaaagttcaaaattttagtgatttttattgtcggggattttcaggatgttacacgggccaagtgccctagactcatccaacttacttctattataagaaaggaattagagataaggcaatggatcttatctcatgtaaataggaggcatgtaccggattataagagatatcacgcatgtcttagctggctccctgatgactatataagggggtcggctaaccctaattcgggtgatcgctacaagctactctcaacgtcgtattgcgaaattctgcacagatccaatctcatacgactgaactagggtattacctctcttcgagtgcctgaactagcataatcactgtgtcaccatctttcctacgtctagtgcacccgataaatattattgccgatctagaaaatcgacatatctcttgttacatgttgtaatggtcttttaggcttctttggcaaatgggatcgggaaatgatatcccatccatcgaagggtaatatcgtatcctagccatctattcttctcatctatatcttcacatctcatttagtcctagccattcatccatttccctttgacaatcctgaatctcataacacatttgcaacaggttctttgatttaggcttttttctgtgttttatcggtgacataagg

SEQ ID NO: 36179 - DNA, 1501 bp, Oryza sativa
cctcctctcctgcgcgtgccttgggccaccttctcgggccggccggcccattaagctcggccgagccgcccctttctctcgagccgcgccctagccgcccgaaggaagtatgtttcccctccctcttttctctttttcaaaagggtttaattaaatcatttttcctttagaccaaaaatccaataatcttagaaattcaatatcttctcaatcgtatgtccgtttgactccgttcaacttccaaaattcctcaaatctcgagatctgtttaatggcacgtttagaggtcaataatagggctttatttttgccgtttgttgagtagtcccatttcgcgtgtagtttcggagcccgaagacccgcagtgcgaggatttcgaggatcaagcaaaagatctcgagcaaggcaagtcacctttgatcatcttgcacctataatttaaatctaagtatttcttttccgcaaatattgcatgaataggatttacacaagtaattcggccgcggcttgcgagatagctgtcacgccccgaactagtcccgagcggaactagcccgtgacgctccaaattaacctgttaatcgataccagtcccaggaaacagcgctggtatcacaggaagacagaatatcacagcaacagaggtatctttattatagagtaggagtatagtcatgttaggctgcggacagatcccgagctcacaactgcatttcaaaagggaagcggaagccaagacttggaccaaacatcacaggcgtgacttgggaactaggccgaaaccctaaaactcatcgtagccggcttgctcttggaagaactcctcgtcagcgggatccgcttcatcttcttcagcaactgggggggggattatttatatagagcaagggtgagtacgggagtactcagcaagccatgggaattaagtgtttaatgcaggcttcaaggaaaggctgttgtttttgcaattgattttatttaaactcttttctgaaacaactaagtgagtgcttctcagacgacacggatgagacagtgcgtctcgtccggtcagagtatgtgcaatgtatcagtcttttgaattgatcaggattggcacccggccaacagctttcaaacggccacccgggcctggctgatcccatcagccgcagattttccaaacatcaatcccaaaccacatcagtaaattcacaaagcagtagtcaaacaaaactacgctaggaatcaccttacatccgcccatgaccgtgggcacagctgttcgaacagtttaataacctttgcagagggggtacactttacccacacgacattactaacccggatcatccagcccgtgcagaacggccacgactagagaccttaaggctttcatgacaaggcatttcgaaagccgacacaggttcaccatatgctgatgagaggggtcccagaccaacaacaggttaggtcccagaccatactgtgccaggaagcccaggggtcctccccgacacca

SEQ ID NO: 36180 - DNA, 229 bp, Oryza sativa
tagtggaagtttaacgtacagaaacttggacctttttaatatggcaaaacctttgctatgcttgtacttaaaaagtattaatacttattttccttttgctaagttcttggttatcagtttttatggttaatatggcttgaaataagacctttttttttcttcccatgtatttggacaaacattttcagattagtgatgcctttctcatatccccccaaaatgtttcagg

SEQ ID NO: 36181 - DNA, 1501 bp, Oryza sativa
ttcctcctcttattcctcagtcatcactatttgaagtcggcatttcgattctcatcctcagtctctccggtcatcatcatcggccgcacagcaaaaccaccgtatcatgaccttgcaggcgccatgtccaaccggtcagaagagagagggggttctcttccatcatagccgatatgggagacgattttgttcagattcttcaaggcatcctcgaacgcttcgcggatctcgtgttcgcttcctactcttctccgacgagctaccgattgtgctgggcttctttgccgatcatgatcgacactgctgctacaaaaattcaaaaaggtaaaattccattttctaaaaaaaatagtagatgaacacctattcttttatgagcattagctacaacttacacctatcacaaaacaactcgttgcaaaaaggggagagaccaaaacttgattgctcaatgcaagagggaaggattgcaatgctcccatttgtacgtaatcctaataaaaataagaaaacacaagaaaggaaattttcaagttctccttttctttttctttggagcaatataattctctctctctctctctctttttttggcaccgctttctacctcctctactcctcttctttttagcgaagcaaaccctcacctcttctctactctctctctctctctctctctctcaagctcggcggaggcggaggcaagcaaagccttctcccctcgcctcacctcgcaatccaccttgggcgggccgtccggcgagctgagcgcggcggcgccctccttactcctccctccccacgtgcggccccgtcggagcacggcggcgacgaagaaccaggggggtgggggggcgaggaggagggcatcattccaccggctgattcattcttcttggctcgagtcgaattggagaggtatatcggctcttctctcgtaccgccgcgccactggagatggatggatgggcgctttgcatggctcggattagggatccgttcggacatggcttcatttctttcccaaattgacccgtccagttaattccgtcccggtttccttcttttttttttctttttttctttttttgatgtgtgggtggtgggtgcagcagtggtagctgtttttgtttccaaaaggtgattttttttttgggtggggggtgttgttcagatgaacacccaaatgccccgcgtttgggcgagcgagttgtagtgcttgttggaaccaaatctgtgatctttgcggtttatgctggtactatgtttggtgtgatctcagaaaatcgaattttatttgggttgcttttatggttggtaccgatgattttggcgaagaatcgtggtgtgattgtaggaatgggaagctttgatccgttcggtttgctgtaggagcatgcatgcttatgatctctcttggggttcctcctttgcaggtaattgcttgccttctgaggaactgcgggagggagcgaggagtcgtggagcgactcttgaagga

SEQ ID NO: 36182 - DNA, 224 bp, Oryza sativa
gttcgaagtagtggaatgattcgtctcttgatggtgtagaatgattcgaagtagtcacaaggttcggatgaacagaagacatctgagagcaaaacaacgatccccttcgcctcgatgaaatattttgccggcggcgcgccgcgcatggaaccacaagaggagctgaagaggcgtagcatatcagcgccgtgattaacgagatcagctgaagaggcggtaccaga

SEQ ID NO: 36183 - DNA, 1501 bp, Oryza sativa
gttggttctaatggtattgttggattagtgccaccagtttggtgttggttaattaaaataaatcacatggtgggctgtgggtgcatggttttgctggtcgcacccatggcagttaaggaccggttcgtgggatgccctggaagaacttatcgtacttaccacaagccagcgtgggcaacggctggggttgtagcgtagctttcctctagccgacgcatccaggcaagggtgggcgtgatggagtttggatgggccctgcgacggcctatgcggcttccggattcacctaggcacgagaggggactgcccgctgccttgcgaggagtgggggtgaaacctgaggtatggtgtgcttggttagagggggttgtgcgaagggtcctgtcacggcctctttccggtatgtcgtggtggcatgtcggcgcacggaaacgtgtcgtggggctgtgtcttgtgggtacagttgtacacctctgatcggagtaaaactattcgaatagccgtgcccgcggttatgggcggtcaaccagattcaccgtgattagtctcaccctagtgtaatcttttgaatttggatagtttaggtggatggttgggcctgttgcaacgtgggataacgttggacagtggatagttaatattaattaattattacaactgtttaattctttcaacttctgtttataagtgctcgctttatgcaaatgaaccactttagctctcctttgataattccctgcatcatacccctattccggtatgacttgctgagtacagtgggtagtactcagtcttgctctatttttttcccccaaccccagagtacgagtatgtgtcagatggaggtttctccgaggagtaggcttcgtccgtgccgtcgaggatgcctgtggagtggtgttcccactgcagttctagtcaaggcttagctcctgttgtctttcttttttccgctgcatttatgtaagacttttatgatgtttgtaagacgtggatctgaatgtcaacattgtcgtttgtgtaccccggccggtcctggacggggattttaatgcacattctgcttggaattctattcgggaatttctgggcgtgacatcatggtaccactagtatgattttaggtagatgcttcgctggttaattaggcaacattaggtggttttacaactctagactttgggaatattcatatcacctggacactatggaatggatggattattgtggaattggattcacccctccccctctattcaaaaccctcaaaatggttttaggctgggcttggggtgcatggttttgatagtagcacctcggccatataaggatcggtcttcgggcctctgttgcaaagcactaccgtacttccacatgtctagtgggtaaggcttagtttgtggctcagtctggttataaacaaaagtacacggatggagatggacgaagtcgggggtcgatggacatctctagggcaaatgaaggctacacgagctgcggc

SEQ ID NO: 36184 - DNA, 1501 bp, Oryza sativa
ccaagatcaagattgtttcagaaacagagcaagaatcggctggaatccaaatcggctacgactaggatcggcagagttcgagtcagacagggttagccgattgagccgatcccgacaatacaactcagtgtacgtcatcggattgaattaatgtgcttcgcatggatcaccacacttggattgagtcctgaataggcaattgtatctattaattaggatattttatgtaatttccttagagataagtgtgggcaaatgtctgccgcaaagatttatggtatgttagagtttgttagagataagagtcgtgtccgacaaggacatattgtgtaatctcgggtataaatagaccccgagccccatgtaatacaacaacagacgttcaacaacaatctcggcgcatcgccacccttttactttcattttgtttcgacgagttcttgctttcaggttgagctgcatcggtttcgatcttcaactagaggtaaaacttgttatggcggcttgcgttctcgggattagtgcttccatctttatgatactctaatcttgtttatgtaagttgtcgagttatcatgtatcttatataatctccgacaatatcgttatctaacctccaatcggctaatatctatcgttaggaagcagccgattaggttaaatatcgacgttggcttagattatataggatatctaccactctatgaagcttccaatagcttgattgtctagatattgtctttctttttatacttatggctgcattagttgagtttgatctcataagtcgtgtttagaactatagtctcaagcctgcttcttggttgctgattagagtagcatcgagctttcagccgatcttacctgatttacctttatgtcttatatgctcaattgttatgctaaatatgccctttatgttaagatcctattgcatttaggtttattaagctctatgtttggtatattttacttgctttaatatcttaatatagagtagtatcagagtattagccgatacacgctagatctatctgatgggctatgctatgagcatctataatctcattgttaatatttatttcgatctaagtgatttatactgcctcggtatggtgatcgatctatcccaatcacttgatttaagcatatatcaacataaaaattatgtactgttaacatctacagctgatcgaatagatttagttttaacttactcattcacaactgccgatcgactcacatatgacattggctcaagaataaatgatatgtcatcggtgactggccgatcggctatcatttatggatttaactgcggtttctttgtctttatttcttgttgattgcaggatcaaatcaactggcacgctcacgaacctaaaaggcatgattttgtacctgcactggagttaagcagatctcccagacctcatgtttttcgcatcaacacgtttttggcacgcctggtgggacaatagtttcaacgacttcttcccga

SEQ ID NO: 36185 - DNA, 1501 bp, Oryza sativa
actaaagctgtgttggttgctggtggttaccatccggaacagtgcgcgttagtgcgtgtggaaaacggaacagtccattagtgcgtgattaattaaggattagttaattttttttcaaaaatggatcaatataatttttttaagcaactttcatatagaaactttttgtaaaaaaaagcatcgtttaacagtttaaaaaacgtgcgcgcgaaaaacgagaggggagtgttgggaacttgctcttgcaaacacagcctaaggcttcatcctttctttttccttttcatatatatagttttatactagtaacagacccacattacaattagggatgagctagagggtgattgaagataaagcattggatcatcacgcgatgggaggaggagatggaaggaggcgactgagcttttaccatagtagagatatcatgccaaactcctttgtatgattgtgtgatctctgcggctctgccacacgttgctccactgtggatacaacttcatctcctcttagagcaagtataatagtaggctataagccggctaaatactgaggtggaggagagaagaaaggagagagaggagaagccggctgtaaacttacagtcggcttggacacaagaaccaagaagctctgtgagagagacaagtggaccatgtattaattgtaaagagctaactattatatgggtagcctaagggcacccacaatggttatctataggctctctacaagagatccatgtcagcatattttcctacttggaatgtattaaatgaagagagagagcaaagctatctactaacttagagatagtctatagagaaaaacgaggcaatgcatgagagagctatagataccaatgtagacatactattaaggtggtttactattaatcgagtctattgctgagatgtacatgttttatagatagcaccttactttaccattgcgggtgctctaagagaaggctactaataaccttaccaacaggtcggttgtattattagccttgctcttaagctatccatacttccatagccttttttttttgttttgtttctcctacacctggcaagcctctcctcctggaaatgctggtgatgagtcaactgtccattacttattgctgtgatcttcctgtaggttactactacctactaacctggcactcacctgatctcaacctagggcatgtaagtacacccctgctgttcatctctgcaatttttaatactagtagtcacctggtttcccccttttttgaggattcttgcttgcagcacaacctccacttgtggtgacctattaatgcctcctcctcctcctgtccctgtcatgtcatgctcttgttcctgtgaggctgtgatcagtgcagacagcttcttctgctaccccccacaagcttcctcaaagaagagatcggccaccattttgtggtctcatttctgagctccctttttgtttcctgattgctggtgtttgattcctgtttttt

SEQ ID NO: 36186 - DNA, 1280 bp, Oryza sativa
gtattcttcactttctccttttcctcggattgatttctttaggggatttcccagggattgtttcttgggatgctggttgttgggatgggatctcgggttggatgatctgaatttcatcaaaaaaaattgatcttggtggttatttctgggttcccctgatctctaggactctaggttggtgggttcagtggggaattgacaaaagcactgtctttcctttttgctatatatgatgacctatggcttattgggacctttggatgggtgttctggttgcaaatgttgattcttgttaggtctccaaatcggcattttggtactctcgggtttagctttgattaaaatccgatatcaacatttgctccaaatgttcaacattgtttttctgttagttgcacatggggattctgggattttgatttacagtctacatttgatcaacatccattcttttttcctttttttttttgcggggaagcctcatctccttaagctttctggtgtggttgctctgtgatttcttctctgctgcatatccttatcttcttggttgctgtatcagaaattctacttcattgtgttcatagggacaatttacaggcacttcccccaatagtgctgcaatttctgtgctatctgcttcactgaggcactgttgactttcagtttaacagaaaatagacttatgatcctgcaagttggaaaaacataatcacttcttgcagtttgctgcattgtttaagcaatttggagcccttttttttattgcatgcaactgtgcagtagatctggtctcctggtcctgtttacctcttgctgtaatcaacttgcccatgtatgtactttttttacagtatttttaagtagaataccattttataattgctaggaatcgccaacgctcgtttccagtagttctcttgttagtttgtgattatagctttcctaaacgtatttcagcaggattagctctctttcatccaaccatctctgtgaatgctcaaaattcaatatgaaaaaaaagcttgccttttatcttatatgtataagaatttatggtaaccttaattcgtttttaccttgactattttttctttcttgttgttgaaatgtcatcttctcagttcagcagctccacttgctacaacatcctgtcaagaaggaaaatactatacgtacgatcttttgttacgatccaagtacgatctaacgccgtgtcatctgtgtatgttttttcgcgtgggaccgaaacttgcaatcgtcaacagagagtagtagag

SEQ ID NO: 36187 - DNA, 825 bp, Oryza sativa
atgaccaaaaatgaaaaaaaaaaggttctagtgtgaaactttcatacttctatttattgcggttgaaaagcaagttaaatgataaaaagtgaaaaagaaaacgcaaactagttcaaagttttaatctgggatttatatttaaaatcagggcagctcatcagccaatattgctatttgcgacggcttggatacccgacactgtacggcacaaactataaattgtgacaaaaatcgtgtaatttgctgttattccattcacatcaggtcgcgttcgagagcgacacgaaacattacaaacggatacccacgtgctgcacacgagacactgcgagttagcagcgtcttagcgaataaataaagcaatgatgggactgtaacgttccgattttcgttcgggattaaaaatcaattaataatgcatttcaagaaattatattaaaagttaaatcaatttattcaagtgaattaatgggagaattaaaattttcccttaaaaatcattggccgggaatattttgcaatattctttgtgccctaaaatactctctgaaatttcccgtgaattttcggagctcaagaaataattttaatagcacaaatttcatttaaatcaattaaaataaaaagaaaacaaataaaatttcccctctttgtctttgggccgctttcggcccaagatcttttccccctccttggcccgctcgcccctctctccttcccttctccctctcgggccgacccctcccttctcggcccgatcaatttcccctcgcgcaaagtctaaataaccccctggctctcctccctcactccctccccgacagg

SEQ ID NO: 36188 - DNA, 752 bp, Oryza sativa
aaatgcagaggagttgattgaacgaggaacgccaaaggcaagattcatctgtatctttgttaaacctagtaatggagccaatgacattgttgagtacggacgtacaactaatagcatttttcggtggttggccacttttttatagcatacataccataggcagcactcggcagtgcaactgttagtggcagagctcaagttacagcctgatctgctcaggagttggttaaaccccataattcaaacaaataaaaatttacgtcagccgaactagctagcatagcatatgttagttgtcactactataagaaataaatatatcgtctttaacattcagatatgctattttttcataaacttttctacaatacaattgtatgcaaatcaagttgcattttggaaaccatatcaatgtaaaagcgtcacttgtgatttaagggagtgattttaagcttttctactcctataaaaaaaaggaaccagtagttacctcatgattaaacatgtgggcatccatctttcaagccgatcagacagattgccagcgattattgtagataaatcatccctagatggatgcatagctagttagctacatgtcgacatagctaattaaccagtctgatagatccacgccaaaaaaactcttcgctggaggcttttaggccctccaattttgtgagttatgaggtgcatgcttagccacaacacaagctaaagctgacctgcattttattttatttttgttcagt

SEQ ID NO: 36189 - DNA, 236 bp, Oryza sativa
attcctgcagccctgttgctgccatgcctttttaggttcccttgtagcataacaggacaatattatattttgttttcatatcattatcaccctacgtgtaaactaataatcctatgaggaacccatcaatgaagaattactgctctacattggggaaatcatgttgtttgcttgagctcacccttggtagtctctattccgtattgaatgttttggtgctgttttcctcttccagg

SEQ ID NO: 36190 - DNA, 1501 bp, Oryza sativa
tatggatttgatgaaaccaaattaaagggaaattgtgtttattttttctgcaaaaaaagagagagagaatcattggagctggcgctgttttttttagtaaatttcacaaaactacaggtgctttgtttaaattattccaaaactacagatttaaggtgatgtatcacagaactacagatttaacaataaatttatcacaaaactataggtttaagactaagtatcgcaaaactacatatttaataataaaattatcacaaaactacagattttagggcttaaatccttagtactaatgttatgttggacatataattgttcaagtaatgtgattaaattatcaataaacctgtagttttgtgataactttgttactaaatatgtagttttgtgatattacatcttaaatctatagttttgtgataaatttagcattaaacctgtagttttgtgataaattgatcaaaatacctgtagttttatgaaatttactctctttttttttgcctgtggaaacttttattattctagaagattagttgcactgttgttattgtcacatttcttgatatgcaagctctgtagggatgaacaccaaaagctttattgttatcaccatcacaatttttttcaattctttttggtacaacaaaatcggatcatgacttgggaggatgtttcttttccatgtttccccttttagtgatacaatactgtttggccatgatataagccatgcatgcatgatagtacagccacttatttcttgtctcagcagaaataggaaatatggtaagctcaaaatgaaatcttattaaaatgttatactagatttctaagatagagagagacaattgtagtaaatccatttaaactaagaggaactgtatatcaacaagcttttcttgttctcatttatcccttgaacaaaactacaaacttttctgcttctactaccaacaaagtacattgtctaatcttacacaaataagagaatataaaataaggctccttggatcaaaagatttttgaaggaattttattggaaaagaatcctatgaaaaacttgccaacaaaaggaatgccttagaaatagccaaaatcaggattagtaacatgaggttcaacctcatgaaaatatttgtgtctatctgtatccctctcttgtgctccatccaaatgactactcgtgtaacttttccgtgctttatcattcataagatgtgaagtgctaagacattctactcctgtattttttttattccctgttttgagaatcctatgttctaaaatgtgccataagagcatgctgcctatctttgcacacacaaaaatcttatcaaaataacaataaaaaaagaacaagttggcatgaaaatgggagattgaggaaatgtgcttcatgctagcttgtagaaggagcattataagaggaaggaccacagacagaaaaagataagatggtgggcatcggctaatatctgtccatgcaaatatgcaa

SEQ ID NO: 36191 - DNA, 1501 bp, Oryza sativa
cattatcaaattatggagcaattaggcttaaaagattcgtctcgtaaattacttgtaatctgtgtaattagttattttttagcctatattaaatattttatgtaggtgtttatacgttcgatgtgatatggtgaaaaatttgaggtgagatctgaacggggcctagtgagcgagtgcatgtatggatggtggatttgtggtggcatgatgagattagttgactttttgccagtatcaagaacagtaggagtatatatgtgtttgtgtgtgatgctttcagggcaatgcagcagaatgatgcttttgattgacatacagaaagtgcaagctacctattggcattttagctgtagtaatcttggccggtgattttttttctttttgattaataaatcgacacagatggcatagtttggaaaaaaatatcctctaagggaaatgaaaatcggttgccgaaggtggcctatacgagtatacaacttccccaggccggtgatattttggttgggttcgaaactcatgacgataaagataaagttaaaacgagaaaaagttatgaacttattattaattaagttttaattattataaatagatatatttgatattttaaaataactttttttatagaaagttttcgcacgaaatataccgtttagtagtaatggaaaccgaggtaaaatcttaatctttatgagaaaataacaggaccaaagtttatggctaaactagtggattagactagttaatttttcttggaagagaatcgatcgtggtagatttgccgttgagacgtagggaaataattattccttagttcgttgtgctagaaaacaagcgtgctttccacatgtgagtatagttgatttgatcacaagcgaataagagacttggggttggttgggccatgtactacagtaaagagtcatgccgtaccatgtgcttaataattattaatttttaaactaattttagcgctaaattacatctcattctacgcatatgtaaaaacaacacctaccgcaggattgcgaatttttttattgagtatcatattttacaataaagttataagccactaaattctaaaactcaaaataccacatcataattcattaacaattattatattttaaacattatacaagcatgatatattatttataattctataatttgttaaatttcagagctttaaaatacaagcatgttaaatcatcatcacacataattcacacaatatgtcaatatatcttttcattatcacttagttaatgatatttctctcttctcccattaaaccatatcatattaattatttttagcccttagatgattaatctatggtccaaattatctctcttttttcttctcttattaagacatatcatctcaattgttttagcccttaaataattaatctgtggtctaaattatcttcatcattttctcatctcataaaaccatatcatcacaattatttttagctcttagatgatta

SEQ ID NO: 36192 - DNA, 894 bp, Oryza sativa
tacttattcttgagaagaaaagaaaccttgccttagaggagagcctagctaaagaatgtgctaaaaatgaacaactagctaatgagcttaatttggctaatggttctctagctagccttagggatgtcaatgaaactcttaaagagaaatttgctagtttagacaaaagtcataaagatcttgaagttcaatttgacactctttggaatagcacttctcaaccaaatgtggtttctaattcttctaatccatctactagcaatggttgtgctaggtgttacaatattgatttgaactcttatgctactaatgttgatgctatgcaagctcttaagaaagagaatgaaaggttgggcacattggagaaatatggatgcatgaagacataccattcaaaagaccatcaccgctcatcctaacaaggatggacacgggctcggattttctggtggaagtcctgtgtctaagcgtgtgatggtaaatgggaaagaatgcttgatgtttgtaagagaaggaaaagctccacaagcaagtgaagtgacttgtcccctcactggtcagacacccggaagttccgggcaaaatgaccggaagttcctgccctgtaagacaggaagttccggacattttgtcaagaagttccgggcttctgataggccgaagtggctggccagaagttccgttataatgccagaaagttccggccagagggtctttactatgattcatatgtaatttccaaaaattcagagggcaaagtggttgcttattttaatgggaattacaatgatgagtaccgcacttgtgtgtgggtgccaaaggctttggtgactaatatcaagggacccaaacttagacaagtttgggttcctaaatcccaagcttgatttcttt

SEQ ID NO: 36193 - DNA, 1501 bp, Oryza sativa
agtggtttgaaagggtttcattgcctagccgatacaaggtgccagacttctcaaaattctcagggcaagacaatgtttcaacttatgaacatgtcagccgattcttggctcaatgtggtgaggcatcggctgttgacaccttgagggttagattgtttcctttgtctttgtctggatcggtgttcacatggttttcttctctgccatataattctgtcaatagttgggccgatctggaaaaacagtttcatagctatttctacagtgggattcatgaaatgaaattgttcgatttgacagcaatcaagcgaaggcatgatgagtctgtgcaagattacattcagaggttcagggagatgaggaatatgtgttacagcttgtctttgacagattcccagctagccgatttaacttttcaagggttgataacaccacttaaggaaaagttttcatctcaggactttgaaagcctatcacatcttgcacagaaggtgactttacatgagcaaagatttgctgaagttaagaagaatttcaagaagatcaatcatgtatatccttatatgtatgattctgaagaggatgatgactccgaagtagcagcagccgaatgggtcaggagcaagaaagtcataccatgccaatggctgaggagctctggaaaagaggagaggtttgactttgatattaccaaggctgacaagatcttcaatttgttgcttcgggagaaacagattcaacttcctgctggtcatgtgattccatcggctgaagagttaggcaaaaggaggtggttctcattctactaacgactgcaaagattttaggcagcaaatccaggcggccattgaagggggaaagatcaagttcgatgattcaaaaaagccgatgaaggctgatggtaatcctttccctgttaacatggtacacacttctgggaggacagccgatgggggaaaaaatcgaaatatccagatgaattcggctaaaattatcaacaaatatcagaagaggcatgacaagcagcaggaaaaatattatgaagaagatgatggtggttttgatcctcattgggaatgtgagttcttcagattttgttggaatgaaggtatgaggcttgcatcaattgaggattgtcttggatgcaacaatgattcagggagttcaagccgatccagcaatagaggtaatcggctgagtcagaagagggtagctgttcatcagaggttgggccctgtgaatcaagattatcgccatgatgaagatgaaaataggaatacacagtggtgtcctacaggcattttcaccaagaatcagaagagaaggatgcaaaggatgaggaacagggagcattttcaggaggtgcaacaggagattaatcatcggctgaggaaaacaaagaccaagcaagagtgacgtgttaagagcacggttgcaacagctgatgagatcgaaggtgacaagacaaaaaggttgcttaagggcaaagctggtacatctg

SEQ ID NO: 36194 - DNA, 1501 bp, Oryza sativa
gggttagttactttgtattgatttctttgaataatagtggtttatgtgacccaactgttaacgataaaatttgattttttccatcaacaccaacataaaccacttctccttctgtaccaaaatataaacaattttaaatgaatgtgacacatctactgtgaatctggataaattttatatctatatccgtagtattagaatatgtcacatttatccgaaatcttttataatttgggatggatggagtattattgaataacagttgtttgtgtgatctcctagaagtaatacacggttcatgtgttattttttaagagcggttttctcttggtgcataacggtataatgcattttgatgtgttccatagagctgctagctctacaatgatcgtttggtgaaaaaggttttgtcatttgatgaatttatagcaagttttcgttcaaaagaaaaggagaagtttcatagctaagtccgaccacagatttccacatcgttttcacgagcgagcaattgattaaattaattaatgggaaaatttgaaccatgccacataaattttgcaaaatttgattaattcgtgtagtttaacactacctccatttctaaatatttgataccattaactttttaacacatgtttgactgctcatcttatttaaatttttttataaaatatgtaaaactatatgtatgcatataagtatatttaacaataaatcaaatgataggaaaataattaataattacttaaattttttgaataagacaaacggttaaacatatttaaaaaagtcaacggcgtcaaatactccctccgtattttaatgtatgatgccattgacttttcaaccaacgtttgaccattcgttttatttaaaatttttgtgcaaatatgaaaatatttatgtcgtgcttaaagaatatttaataacgaatcaagtcacaataaaataaatgataattacataaattttttaaataagacgaacggtcaaacgttggacaaaaagtcaacggcgtcattaaaatatagaggtagtatttagaaacggcgggagtataatgtaatgacagattaagcaaattaagaatcgtccactgctccgtcgtcaatccacatgcgaaaaaccagtgtttttacagcgattccctgactaattcacagcctctgctggttacacctacctttttttttcctttactttaatagctaaatggttttgtgataattattggaggctacaaacaaattcattgactattataaagttgaaaaaattgatttaaaacagtttgtaaaggaatttgtttatagaaagtttttgcatgacaaggatgaatagcaacagctctgaaacaaacactgcagaggaacagatctccttccacactgcatgcctgttatgcaaagcatcaccattcagcatctctcctcatctctttgtttttttttcacaaatctatcacacatttacctgtgctgcatgatgagaacagaga

SEQ ID NO: 36195 - DNA, 388 bp, Oryza sativa
aattcctgcagcccctagttattaggtatatgttaaagtagaaaatatgactgaaagtaaaggaaaaaaacaatttgattgattgtgttagctcgagtatatgtatacatcaatttgtgtaatcaaacaggctcactcttttcagtatagtaacagtacacgtaaaacgcacgttattaggtactataaatttagtctagtatactgcaactgtgagaatatactcattgcagaatatcatcagaagcaggagcacacattttcttttttttaaaaataactttttaagtcagttgaattaatccatcagaagcaggagcacaaattttctttgttaaaaaataacttttcaagtcagttgaattaaccaaatatcttttttaacaga

SEQ ID NO: 36196 - DNA, 1247 bp, Oryza sativa
tgggcgcgggcgacgcggcgtgggctcggggaaaggggggaggtggggcgcggcggcggcggtttcgggggtggtgcccggcgcgggcggcgggaggttggggaaggacccgacaggtgggccccacctgtcggcgaccccgtgagaggagggaggcggagcggcctggctgggcctcggcctgcggccggcccagcggggaggagggggagaaaaaggagagaatgggccggcggcccattcggaaagggaagggaaaaagaaaaagaaaaaggagaaaaagattttccgtggaattaaaatattgcatgcttgattttaaatggttaaaattatttcgagagctctgaaaattccactaaaaatcctgttagtgaatttcaacatgtagaactcaagaaaaattccacatgccaattctgattattatttgcattgattcaatagggtttactcttgctttgcaccggtattttcttagggtctcttattaattcaattttaggcttaggaggagaacttcagggtgtgacacatgagtagagtgtccactagttggggttttgtttattctagggtgaacaaggtagtaataacaataacaataataaggtcataacaaaggtaaataggcatggctagataaaacagtgataacgcgggaatttaaataaagggataatgcaataatttaaatcaaaataattttataaactgagattcaatatgttcaaggataatgtgacttgccttgctcactttcccaaacgtcggcttcaacctccacgaagagcagatcttccgaagctgcaacgtctacacgaccaacggaaaataaaagggcttttactctaataaactccatataacaagcagtaacaaagcacaaaaatgggttcttgacttcttaaggaaaaaaaagagacttgaacggtccaattccgagttcaaatgaccaagttatggccatttgaagtttatatcctctttaaatgaatatttgcgaatttcttcatttaaattttaatttaaaaagggtttattgcgtcagccgatgggagtgagcgcgcggaccgggtccacgggagtggggcccacgtggcagcctcacggtccacggtggaccgggcgcacccgggctcgcaccggccggcgccgtgggccccacgcgtcagccgcacccgagggagcgggcggctgacggccgggccccacgcagcggccactcggcgcgcccgaaggcggcc

SEQ ID NO: 36197 - DNA, 1501 bp, Oryza sativa
ctgtttctgaaaatatggaaaaactctgaaacccagcttctccagtttctggcttcttaatttattcttcagaatatgtaactacagattctcaaaagctatagactgtttgggacagcttctaacagaagcagcttttgagaaaagctgcagctgggacaagctcccccggaatggtcttttgtagcgagagtgatgtggagtgaagcatacagggcaaaacatccgtgaaacggacgaactagtgtactgggtacaggagagataaggttaggttaaggttgaagtttatatgcaatgcatcaattaacgtctcgttcttttctaatctaattaagacaaattttatctcagttttcgtttacatacttttttaaactgctaaatggtttataaaaaatacagaataacaacatccgctcctcaaatcttaaatagacaccaccacagatgcttggactaaatccccccatcatgtgagaaagggcctatagcctagtggttataagagtctcagtaacaccataggtcttgggttcaactccacatgggagcaaatttttcaggatttaacggctttgtgctttcaatggtaggcgatgtacccgtcgacagcgaggcgcctatgatgacttcgttaatctccaggatggatttgccgacccagtattcaaagatgctcataggggtagcgtttgcgtgcgtgcgttcataggggtgagtgcgcgtatgttgtgagtgtctgcgttgtattgtataattctcaaaaaaaaaatccccccatcatgtagttcaccgctattttactccaaccttatcaagtgtcggcctacggtgacttcatcaatctccaggatgatttgctggcccagtcttcgaagatgctcataggggtagggtttacgtgcgtacgttcataggggtgagtgcgcgtatgttgtgagtgtctacgttgtactgtgtaattctccaaaaaaaaaaatccccccatcatgtagttcaccgctaatttactcctaccttatcaagtgtcgtaccagtacgaggtagtactactatctctctgcagctgctcctcctcaagaggcgcgcgtggcaattgcaacagcggcgacaacagtcatgcatggaggaggtggtagacatagacgagcacgacgaggaggcgatcgtcgtgggcgccagcgtggcgcagctgcctggaccgtgacggttgtgtcggctcgctgtggtggcgccgcgcctacgaccgcctccgtgtccacctccccaagcagtaccgcacgggtgatggtgtccgctcccgcctccgccgcaaggtccgggaggtgcggttcgacgccgtcgaccttgccaccagtaagtaacttagagcggtatgtggcgaggtaccgccgccgccagtgagaacgatgagcaggtggtccccatgaccgggatcgatggagacgttctcggggaagacgatgcacaccgccgactacatattttggttgtgtgt

SEQ ID NO: 36198 - DNA, 665 bp, Oryza sativa
tctcttctttcttctccgataacaccatgcattatttttaggctcaaaattcacaagtatcaatttgttagttttaataatcatattacatcttatttgtacatactatacaacttaatttcccacattaatgcggcggggtatttatctagttaactatattgtgaagctccactactagttgaactcagtgcacaaaaagcttctatattgttcacttccataaattaaatccgtaatgatatacagtacttatccccactaattagcaccaagaaaaggtactactggagaaactatttttgatcggtcggccaaatttcacaatagtcctggttctaataaaaacctgagtcccggtttaaaagctcaggggtactttttgatctttagtctcgattggtaacatcaaccgggactaaagatcatttttagtcccggttcaaaaaacggcagccagtgtcagacccttatattttctttataaagatctatttgtagtgggaaaaaagatcggcatatacggagatcgaggcgtgcgcgcgaatccgatcgaggaggcatgcgcgtgtggtttctatctcctcctctcctcactagccctatctcttcctctccttctccttccccctccccctcccccctgctcccacttctctggcagg

SEQ ID NO: 36199 - DNA, 370 bp, Oryza sativa
tttccatactctacacgcaaagaagtagagcccaaggtttcttatatattttgcctgttctacaagaggattgagatgtttagtgtaatcctttgtgactcatggacaaaaccatgtaggtccttgttgatatatatggtgatccagaactccttgttgcatatggtattgttttttcttttcctttgtgcacacttagtttgtgaggcagttgattttgaccttcctttccatagaaaaaatatttccttttatgttgttttaaattccatgtgctaactcagatttattgtgattagttgttgttgtgctaatcttcaaatgtttagtatattttgtgcattttgatgctctattgctctgcaaacca

SEQ ID NO: 36200 - DNA, 1501 bp, Oryza sativa
tgacaaagttttgactaaagcaaaagaacattgtatattagtttcaaaagaagtattgaatccatttttagaggcaaaataatatctactctatagctaaaaataatgaatctctttctgcagaaattcttgagggatacagcacctgctcaagatccactactaaatatcatgctcctacaaaaacacttgaagttaccaataccatattcaataaattttgtaattttacattctgtagacctaccaaaccaaaagtacttttgaacccccaaaaatgaaatgatctacacagaaagcctgaatcatacatctgtgctagcaaaagccaagaagctttgcacatgggtccttcgatagaatgtatgtcctggctgcttgtattggacagtccatctaagcaaggaaaaaacatataattgggcatcagttaactcggtggaaatactacagatgataaactgaagcaaagaaatagccgttggcacataatagtaattccaatagtagtttgatcactcccaacccaaaaggtgaaggtgaattgtttaacactctagaaaaacgagtagtattcttctgctaccaaaagtaattgtgggtagtgccagacattatctctctttttttttcttctttttttttgggaaaatgagggctagtgctgtgccagactgatccagtgaagtgagccagcgacgatggccaccaaattcatcacaatgaaaagttctaaactagtcgtaccaaatatcatcaatatatggaacagctgatgctaaattcactcgaattgcagagcagttggaacaaaccaacaactgacagcgaatgattttcttgtgtactaaccaccacaacaatctccccaacttactggacaaacgaacgtagcatcacggagcacctttaccttcgaaccatgaattatgcatcggaaaaaaaaaagagatagaaatgggtggccaagaacacgagcaagaaggcaagcgcggatcaatggggacaccatatgaaagaaacgcttgcctggacgtggacggagccgaggacacatgccccgtggagaggaacggagacgaagaggaagcagcagcagatggaggaggaggagtagccgacgccgagaggaacacacgcggagagcacgccattcttgcttcccaccaccgcctctctctcctcccctctttctatggactcgagaagccgtcgtcttccacctctagtttttctctcctctttcttcattttttttttctcctcggtgtcgtggttatccaagtcgccgtggtcgtttgggcctacgtgggcttaggccggcccacgaaaaaaatacttggaagaaaagatctcctcgcgtgagccgacgccgcgagcgaagcccgcggcgacaccaccacccaccaacgttagcttctgcgtgtggccgtgggcgcgcgctccgcccgcgccatgacgaccgccaccgccatcgtcgccggccacggcctcgcgctgc

SEQ ID NO: 36201 - DNA, 1501 bp, Oryza sativa
ttgtgcaaatataaaaaacgaaaagttgtgcttaaagtactttagataataaagtaagtcacaaataaaataaataataattttaaatttttttaataagatgaatggtcaaacagagtaagtaaaatgttaaaatctcttatattagaggacggagagagtagttagttatattagaaaaaaagtaggtcatgaactcatgatggtttgttactttgtttggtcaatcgtatattgagatggattgctcagtctcagattatcccttaatctccatcatgttactttgttatcaccttgacgtgtcagcgtcattgtagtcgtctatcggacaaatcaccctctcttttttcttcatctctgattagaaaaacaaatcatacactttgaccaaataagcttttgagaccatgcgtgatgtgaaatcgttctagaaaatggtaattacggcactgatgggaacgaccgcacatttattgtcttgcacacgagaaactcttaaattccggtttgcccctggaaagtaagttcagtgatatctgcatccttaaaatagacgaaagggtacacatccaaatgaattcagatagaccaatgatggtgaaaggggtctttagtttatatgggataaaatgacgaaattgtaaagtgagatgattctcaaattttatgaaatatacatatatttttcgatatattaacgtttatccgctcatacatagatgttggcgtgtttttgtctcgatgtattatcgtacatcttagatcggagaaacactttcctttctaccagtttgtagaagacaaacaacctatcgctagcatgcgagatttctctagcttcaccaatactttatcaattgattcaaaatgtggacgcttcattgctttttaagtgattaagccatgtggctttatttctgcctcaccctacttttttgtcatgtccataaaccacataggcacaggcccaaccaaaacaggttgttagctagtcaagtttgtaagatcaagagtggcctccaagaggttcagtcaaaattagaaatagccagtttatccagggatgtgaatgcaattctcacctgaattaaattagacccctaatttaattctcaattaaccaggtactgtcctaataattttctcccaacatccccatcgatcctgactttgtctgatccccactgttttttcttttccttttggccactctttgatttcttttttcaattctattgcgggtggagactttttggtttggccgcaatccaccaccccattcctatccatcctccttcagcttcttctttcttctcctcctcctccttgactgtcctaacaaaaaaatcgattttttgttctcctcttgatggttgctgcgaccttcgatgtccctatgcggaatgaaatctcctgctggggcggctaaaaatcggagattttctgtctttttgatccgtctttagtggagctttttgagcctgatttatgcgatggg

SEQ ID NO: 36202 - DNA, 352 bp, Oryza sativa
aaataaggagcccagtgcattttcgagtatgggtttacctgtgaaaatatggagggtattactgaaagtgcatggttttttaactagctccaacaatgcgagttgttgcgttacttgctgaacaatttaatttagcaatgttagattccaccatagctgctatacctagtcttttcacttgtgaaccccgagcccgaagattcaaccacggatgatgcatcaatcttccaaattccgatccaaaacaaaatcctaccaacctcgcaggatagatcttcaatatttttttccagcaactatggagatttttccaacaacatcaagaacgcaacataaaatgcaatcgacgaga

SEQ ID NO: 36203 - DNA, 509 bp, Oryza sativa
taatctaagtttaatactcctaaatagtaagattccggagggctatttaatagacctccggatccaaacagggcctatattgatgtaccacatgttagaacaggatccctgccccttgctagctccggagtactactagccacgcgtgcttgcgagggtggatttcgtactagtaggcgttgaagataaagctaatcattagcacatgtgggttactatagtacttatggctaattatagactaattaggctcaaaagattcgtctcacgattttttccctaactgtgtaattggtttttcttttaatctatattaatgatacatgcatgcaggtatccaaagattcgatgtgatgtttttgaaaaaaaacttttagggaactaaacggggccaaaatgatgtgaaacagagattagcatgagcctatgaatgtgagcgtgactgggctctattttctttgatttgatcccctctgttgccggctggtggaggacggaataacaaaaca

SEQ ID NO: 36204 - DNA, 240 bp, Oryza sativa
  unsure (1)..(240): unsure at all n locations
tcttggtcagcatatacatacatgcaaagaaacgattangtagattaatctgttatcaagcataaaagcatgtatatagncatatgtatatatcaatgtatggctcagagctccttgtaatcggctgctcttatatgcccctggtaatcagcaatgcttctcgcgtgaagactgccggttaacctatgctggcgtgtagatcggtacagagcgcgaacggaattacatcagcaggacaca

SEQ ID NO: 36205 - DNA, 1501 bp, Oryza sativa
tctatgtacaccctctgtaacaatagggttttgtttagttgaattttgccaggtgtcattcaccttggagagaatcccttatttgccaccggaaattggtctggtcccttgtatgccattgaaaattggctcttcccttatatgccattgttccaaatttacgcaccctctcatgccactcccgtctgttgactgcgtgttggtagttaactctcaagtaaaaaagacatgtttgcccttctgagttgttaggcatgtcctaaacttagaagggcaaatatatcttttttacttgagagttaacggtcaacaggcgagagtggcatgagagggtgcataaatttggaccagtggcatataggggaagagccatttttcagtggcatacaagagatccgaccaattttcagtggtatataagagattctctcttcatgttgtctctagtcctcattagttggcgactattgattcagagcccccaatagttggcgtgttgatttgccggttcctcactcgattagtcagcgattattaattcagagccccaatagttggtgtgttgatttgttggttcgattagatctaccacttcaatcacaactatttctctgtgcttaatcacttttccgcaatatttagattgaatcttatcttattcttgcaatgttcactcgtttgcattgcagggatcatcaaccatatgtcacggttagtatgacatcgtttgtggtgtaccgatttgcacggcgtcctcgacttgctctggttgatagctacgtcacaaacgtcacactgatcaaagtgagagttatcctctcaccagaagatcaggccatgagagagagcgtcatcataaataaacaaacacaaccttagtacagatagcttatgctaccatctactacctccgtcccaaaatataagcatttttagctaagaacctgtgcttatattttaggacggagggagtactatcaatatcagttctatctcaagatatactggtttagtttttcggacgtgtttatatgatagctgtgagtgtatgccctgttcttttctccaacaacttttggattaaattttggatactcgtggcacgcttttcaaactgttaaacgatacgtttcgtgtgaaaaggttgttctaaaatatcaaatcaatccgttttttaagtttgtaataattaaaacttaattaatcacacattattaccactccattttgtgtgaaacacttaattttaatcttcatcttcatcttcaggagattcaaacaccacctttattttcttaaaaaaacccagttctatctaaccgacattttacgcccagatagaaatgggcctatcccacactattcatccgttggcccaatacaaatgggcccagcccacagcgccgcatttgtttcgaccgcttcaagccttggatgctctgctctgcccttgcattcgggcacaagaggggtggcatctctgagcgggagccacgcgcaa

SEQ ID NO: 36206 - DNA, 280 bp, Oryza sativa
tttattttatttttattctgaattttgattaatttcgtattaggttgctatatggacttttctttcaatattgcttacttttaattccgaatttcagctatttttagattgtatttctacttggactcttttttccttttctccgattaatgtgggaatttttagtccccacagtgaacgtggtgtctcctttcaaagctgttttaataatataatagatagatagatagtatgctactgaggatgccacttgtaaagaaacagaaaatattggagccta

SEQ ID NO: 36207 - DNA, 171 bp, Oryza sativa
  unsure (1)..(171): unsure at all n locations
cgtgatttacaccatatggtacagtagctcatcaatggagcggcctaaagtcctgagttgataatattgtaaaatagatttaggaaaccgataccgtattggttaaggtttctatcttgtaatcttgccccccatcctgtataangtgggcaggaggccctggtgggggca

SEQ ID NO: 36208 - DNA, 1501 bp, Oryza sativa
ctagtacgcgctagttccacattttggatagggctcctatacttacaaatgtcgattatgtttttttttcttcaaaaaatcagaagcgccacttggataaaagacaaagcattgtgcatttcaagctgcttaatttaaaatgtgtttacgtacgattatactataactaaacaaacttatcatcacagactatggagtaattaatttgttgcagggtaattaagcaagttaagaagcagcgagtaggtaaatcgagtagagcatccgacacagatgggtgttgtaggcttcttaaacgacaaagaaggtcgacgtcgtttcttttgatgcgagagccgagagttagcaactttgtcagccgccgtgcccggcatatacttattgtacatgcaaacaacgtcaataacttagctataactgtaagtatcatgcaacactggttcagcagcgagtgacaacgcgatgaggtgaacagtgcgacatgttcctacttttcccctcttcttttcagaatcggcatcagatttagtccttacagtaagtaggagtaatttgttctgtggtgacatgtgaagaataagacatgttcttaataattggcagcagatttactcatgtcgtacaagatgtaagaacagtctacatatatacggaggactccactccgtagcttagcaagtttaaacatgaccgaaggctcggagcctcggaggctgagtcttttatagctggcgtacgcaagtctagacgtcgatgagaaagtaagcatgcatgaccatgacgaagacaagtagacaaaccgtccgtccttcggtccttgtgtcactggatctaaacagcaggtcttcactatgcacctgcacattgtagctcgattaccgcgagtccgctaggatcatccagccggccgcccggtcgccaaccaaccatggattcgtggagtcgtggttgcacgagcggcggtgcccggctcggtacacggcgactcaactaggacgaaattaaagccgccacagggccccggtgcatgtgtgtctaacgtaaccatgcatcattgagcattttaacagagaaaccggccggtatgcggattgctatccgccgtagcagtcactaatcaggaaaccacaactcgcagattcgcagcagcttaagaatgaagatcccattcgaaatcaacacaaccgcatccgattccatggcccaaccgcgcgcgcgcacgaacgtacgccacgactcgtgcgcgacgcgcgcgctaacacgacactttgcgctcaaatgcagccggaccgtcacgttgcttgcgctgttggctgttgcgcacctaagctatgtcaagtgtcaacttgcttgcgttgctccactcttctgtctgctcctcgtttataacagctggagtgttggttggctctggctgcatcgacgcgcgcaggcggttgggttttgctacgacgaagaaggcgtagccgcacacccgtgcgcgcggtttcgttcgcgatgg

SEQ ID NO: 36209 - DNA, 475 bp, Oryza sativa
acgccactgtatgttaacagcgactttgtatgtttatattagttatatgatgcttcatggttcttttgtggcgagtttcatggtttctgctttctccattgtaatatgtgttgattattttgattttggagaataaaaccgcccgttctttttatttatttgtgcaacacatttgtacatgcgtagaggcatttttgcagacgtatccagccatcggggcttctctattcttaatcctaaagcttaacatgtaaagatgttacatcatcatccactaataattattatatttaaacatcatacaagcatgctatattatctacaatttaataatttattaaattttagagaattaaaatgtaagtatgtcaaatcattccacataattcacataatattttaatatagtccatcctcacttagttcatgctatttttcttctctcattaaaccatgtcatctctttttttctagc

SEQ ID NO: 36210 - DNA, 962 bp, Oryza sativa
tgttattttattttaccaacaagttgtgatttgatttcagattttgtcaagtgaagccaaaaacggcagtgatgacacaggatctacggcaagtcgaaggcgacgccgcgatccatgggcatagtgttttctaggaaccggcagcggtgatccttcgcagacgtgggtactgcgatagatcccgtcggcaagcctgtgtgcagatgcaccaccaccaagcctgacgtttgatctctttccattttctttgcgcatctctcacagatcttcctcttgttagatcagtttctattgcttaccgatgatgatcaattctacatcaatttctttgtgcatgcagatgcgatgccaggacgcatgcatggtgactgacggacgacggcagaccagcgtcagctgaagcacatggtgcataggtagctgccaaaaatcagaggcgactgttgagtttgttattacagctgtggccccaacgtgttcctggtgattgcagttgcaacggttgaaggaataaatctgtgtttgttagcagatgcgaatgatgcggtgatcgagtcagaagaagaccgcgtcggtagcattcgtgtgcgtgagtttagcgtgggtgcgtgagtcgtcgaattcagagaaaagcggatcgtgggatggcacgatttgagcctcggattctttcttttgtgtgcagtataagtaggagtttttgtactgttattcgagttgcatgttactctgttcagtgaatgaaaaccacagaaatttagccccacaaatttcctatctgctattgttctctgaaacttctcaatttcctgtgttcttgttctgctctgtattcctctgaatctcgttcgttgccgtgccggattgctgcagtacgcatgcaaggtgttcgatcgagggtctagcgctaacaagtggtatcagagcacccaggtttgagggctggtctgacaccatggcgt

SEQ ID NO: 36211 - DNA, 1501 bp, Oryza sativa
ttcaatactccttctatccacaagagcttgatagcctcttcaatttctttagtactctctctacatgtaagatttagacatatttcatattttagtttttccaaataagttgttcgtatttgcagtctctatgcatccaaaacttaaatggcgagataaattaaatgtttgaactaaacttgaggagtcatcttaatactgattggttgcatgtgtgcatatactccttgatctttgttacatatatgcaagatgatttaatttctccttagtattggtgataaagtaataagtgtaactttttgtggaaggagggagtacttcgcttcttgtattttataagttattttggcttgataccttttcaattgtggtcctcttagacatcatatagggtatgtgacttcaacaaatttgatgttgttattttgttggttgtaagtgtgatctatatcaagtggctagtgacttagtgttgcaggggatgctcacttgagagttttttttctttgatgaactaaaatatgctatagttcttcctaggatatctaataccctatatctgaagttctagtactctctccatttgactatacaaggcgtaacttctttggatgcaaaaaccaaggaagctcctataattaccgcagaattaggggtctttaaaacaaccaaagcaaactaacgaatagtgtttactgcatgcatgcgcggatgagaattacgggattcaaagagatgccgatgcaactgccttcaatgcatgcatgtgcgtggacgagactaacggagtggtgctgctgcatctgccgccctatattatagaacttttgaaaaaaaaaacagttatgccttgtataatggaatggatggagtattcattttgagtttgaattaatgcctcttaactgtccattggtgtggcctctcatttgaagttgcgctatccttcttcactgcttgttattttttttatataaacttttgtttagttgtcacgccattgatgtggtgttgcctcctagactcccaataattgtgtgcaacatagctttctagtttgttctcaggactatttgtgctcgtgtttctttctcaaagtttcatctaaatgtatgctctcgttgttcttctaaacatagatattaactttgaagattttatttttgcattcaacatttgtaaattgtgactattattttcatcgttgacaaatctagctaaaagctcatttgatttcattcatttttgtgttgttgttatagtaattattttgtctattttccttgttttgctagtaattttcttgatgtgttttacctatataatgtactgccttcgtcctataatatgaaaaattctagttatgaatctgaactagtgttcgtctagaatcatagctaaaagttgttatattttaggatagagtgagtattggagtagaaatttatattgaacttaattaagttttacatgtccttaatttggtgcttgttctaag

SEQ ID NO: 36212 - DNA, 1375 bp, Oryza sativa
cagtctgggccaagtgtgcttctcctttcttcttctttgggtgcggacactggttggaatagtgaccatactcctcgcagttgaagcatttgatgtggctcttgtcacggccaccgccgcctgagccacttgcagagttgccgcgagcggcgccaccgcgcccacctgcgccacggcctcgcccgcgtccgcgaccgctttggccgcctttagctccctctccggaagctttccctttctggggcgacgatgactccccgccatccttcttgaaccgcgcctcccactcagcctgagtgagaagaacctgcccgtcggtggtgactccgccggccgctgccttcttcttacgcacccgttcctcgtaagccttaagccggcccacagcttcttcgaatggcatgtcatcaacattataaaactgctcaatacctgtgacaaggttgacgaatttctccggcaccgtgtcgaacaacttcttcaccatcgcggcatcactcaacgtcgagcccaacgccgagtggcgcacgctcatcgtggtgatgcggcctgcgtactgatccagggtttcccccggctccatcaccatggcgccgaattcgcccttcagcgtctacagccgcgcgtcacgcagtcgatcagcacccacgaatcttgtcttgagacaatcccatacttccttcgccaatcgtttctttgccacctgcatgaggagatcctctggcagcgactgcagcaggtgcgacttcgctttcttgtccttctgagggtcgacggccgccccggccgccggttcaatcacctcccacacaccctggtcctccatcatcgcctggacacggatcacccaactagtgtagttggtggccgtgagttgtggatacaagaaagcgctccccgagctccccctcgccggatccgacgttgccggaaccaacgccatggtgtcagaccagccctcaaacctgggtgctctgataccacttgttagcgctagaccctcgatcgaacaccttgcatgcgtactgcagcaatccggcacggcaacgaacgagattcagaggaatacagagcagaacaagaacacaggaaattgagaagtttcagagaacaatagcagataggaaatttgtggggctaaatttctgtggttttcattcactgaacagagtaacatgcaactcgaataacagtacaaaaactcctacttatactgcacacaaaagaaagaatccgaggctcaaatcgtgccatcccacgatccgcttttctctgaattcgacgactcacgcacccacgctaaactcacgcacacgaatgctaccgacgcggtcttcttctgactcgatcaccgcatcattcgcatctgctaaca

SEQ ID NO: 36213 - DNA, 1501 bp, Oryza sativa
tcctccgccgcagcccggcgacacagcaccggcgcgcggggcagccgcggaagcggacggcgggtgtcggcggcgtggcgagcgaggtgggaaaaatattcggtgcggcggcgactagtaaaacaaaacgtgggggagcagcgagcacgaacccaacagtagtcaggctcgggcaggcagaagaatcctgccagttttgacaaggggaaatccaaaaccaaaagataaaaaaaaaaatcgcggacgctgaggcggaggcgcggtggccgtggtggtggtggcggaccaaaccgaaaggcttgcctccctccgccgcgatccgcgcgcgccccaaaccggcagcgattcgctgtcgtctactcgtctccgcgcgcggccgcgagggaaactgttggttttattttcgaggtttggtttcgcggcaggcgggagacggaggagaggagaggagagggcgccgtgctgcggtggacttgtggcgagtggtgacgaggagacgtttctggttgatgttgtgcgggggagtagcggcgcgtgagaattgttgaatttgttgttgttcggtagggtctcacctcagcgaccatactactgtagttaggtgggagagactggccagccaggcaggccaggccgctggtggtggtggccgcgtgggggcttttttcctgtccttttttggggacagcggcaatcagtgagattactatggcccccggagctatagttagctatggctatactttgattacctccagccatctcatgcttgcgactttgcgagtggcaacagcagaaacaatggtcgcttgtaattgaccgacgttttaccagtgtacaaaccctgatgaatttaaaaagtatattagcttatggtttggacaggacgatttggcatccctaaaacttctagcttactgtttgtagtcattatagtcagtagtcatacgtctcgcagaatggatcaccattagaaaatcccatgttagaaaatgtcatcacacgtcaaaaatgagctaacgttgattaatcatttaacattttcatttgaacttgtcaagaccatggagtctccacgaagcaaggccaggtagcctacttccctctacagtgtattgtttcacctcgtgcatattgtggcctagcccttttccctaaactagtgtaatgcgtagctgtacttttctccaagtgtggcatggcacttttatgtgctagcaatatcggttgaagtatttatactagcaataatgtgatttatttgtctgttttaaatcacgtgggcatctccaaggataatttgcactgaactgttttgctgggatccactgtaaaaaatgattggttgattcaatgtatggttcgtttgtggatcatggtagtagaatgtttttactggcagtagaatttataaatctggtcatttctactgtcgtttgatagtacagtattactggcatagagcattataaagatacccttgaatcataagaaaaggtta

SEQ ID NO: 36214 - DNA, 374 bp, Oryza sativa
tgcaaaatgatatatcacttggcatttattataaactttaaaaagtacatgactggtgttcctacgaatatatgccattgcatcataaaatctatttttttccaattgtaattaacatagtaatgtaatataagccaatacatcataatatctaagtttatgagtatatatactttttccaattgtaattaacatggtaatgtaatctgaccaagttgaccacggtaaaaagctaattttgagatttgataatagcacttgacatatgaaatcgaatagatctattgcaaatttgataatagctctagagcaactaactagcaatatttgctcacttaaatatacaaataaatttgtaaaattaattttccaga

SEQ ID NO: 36215 - DNA, 434 bp, Oryza sativa
actcttccgaagactccgaggactgaagattctattctatttctattctatttctattccactgaagcttcttgcttgaggcgtatcttgaaatggagagagcgagggccttttatagcttaagtatgacggttggaaaggtcggtaataccctccaaccatcatagggagtctatctgagccatctagccaaaacctgggtcaaactgcgccacggttggttcggccgaacccagggttcagccgaaccctaggctggctcaaccggcccacaatttggtcggcagcctcctcttctgttgctcacttcagacttttaaattttggcccagttggtcatgtcatttctgagtttttggcccatctatccataagtggcttggcgacgaggttgggaagcggcggcggcgctccaatcctccctccctcccaga

SEQ ID NO: 36216 - DNA, 164 bp, Oryza sativa
ttttctaggcggaacccctttattttaacaagcagacctcttaagggatccgcctagaaaaatatgatgttcgcaaaccgaactttacgtggtttgcctgcaaaaattcctccaccatcgccaccactcatttccctccctctcctctctctctctcatctagc

SEQ ID NO: 36217 - DNA, 1501 bp, Oryza sativa
aaactatttcaattttagaattattatactaaattgcataattgcgtccattttattgagacgactctctgaatttggtcttcggctagcttagaatcatctagaaagtatctatgttgattacttggttgtacctgtgtacctcgaagagtcaactacattatacaatgctacatcaatgtcaatacaaaatggatttattaatgttagctacaacaaaatgagcttgcaatttttttcgtccaatatttatcggtctgatctgtaccatggtaaattggtactaggcaatacacttggtactaaatgtattttgctccctctgaaccctgtcaagtagacatatctatagataagtgtcttataagcatagtggcatatgattttagcagcattatcagaaatatcagattgattatcatctgctgaatcctatatgttcacgtggcacatcagctaacatgatctatgctatttcagtttttaagaatcttgaatctcttgaagtctgcggtgggttaattactgatgctggagtgaagaatatcaaggatctcaaagctctgaagcaactcaatctttctcagaacgttaacctgacagacaaaaccctggagctgatttctggtattattcctccgtgtcaaatatgacgtccctatgtgcccactctattgttgtctatctgtgctgttatcacatgacaatatgacatgattgcccggtttgcaggcttaactgctttagtctcgctgaacgtctccaacactcgtgtatccaatgccggcctccgccacctgaaggatctgcagaacctgcgctcgctgtcgcttgattcctgcagggtcacgacaagtgaggtgaagaagctgcaggcgacggtgctccccaacctgataagcgttcgacccgagtagctggacactacatgatcacctgtaaataatcatctggatggcttcatgtagatagctttgcaagggcctggattgaagccagattaataagtaaagtctatggtagcatttgttggcctaaaaccgggagacgttggcccaaccgggagaaagcctttctacaccccaaaagctagctcatgaggtgagggacccctccccttttaagttggtgccactccccctaaactttcaatgtgggactattctcaacagcatttactaggtccttcctgctccgtttatcgggatcttttcgttttcaagtactgaaaaaattacttgtatttccttcactccgtgtaccctccaaggcgtgacgggaaggaacaaaattgtaaatattgcgcttcctcgccattgtgggatgcttatgtgtagtgtggtgtacagtgccgcattttctgtggcagtttgtgatgtcattgtgcttgggtttcttctttcttccgcattggctctctgtctctcatttgctctgttttactgcaggtttattagactaatagcatgcagggtggaactgaaggaataaattggacaac

SEQ ID NO: 36218 - DNA, 1501 bp, Oryza sativa
tctaattttagcgtgaacggatgagagcccgtagtttcccactcgatcggaagttcaatctcgctgcgtgtctccaaagtttgttggaacgtttaaatcggatttcctctatccgaaagattacaacttctgacagggaaaatctacagctttttttcgaattaactgaaaatccccaccttgaaagttcgttttgctcatgtgaagtaacaagcgcatagcagtaaaatacgccaaacaaaaatctaaaaatagatgatggccgagttagtgatctctaaatatttcaagaatccccaaacaaaagcttcgaaaactcaaaaaagaacaaataaaattggagcaaacagaactctctctcagtctcactgaactactgaagaacgagtaatactgcatgatctgaaaagccggcatactgacaaagttcaacctatctaattattatttattcatcattgatcagtacacattttaccaattaaaccatgaactaaaattaagcacgtgtaagagttcatttccattaattcctgtaaagcacagcattacaaacacacaatcacctcaagaacacactcacaccaaaagtccattttattctccactgctactgaaggcaaattcatactatagctatacatcgtcgtcctctgatccatccatcggccgctgagaatttctcgatcatttgccgaagagcgacttgaaccaccacgtccccttggtgtcggtgggcgcggcgtcgctctccggcggcgggtcgtcctgcggcgtcttgcgcagcttctcgacgtcgtacccttcctccttggccttctccagcagccgcccgtacacctcgtcgtccatgctcgtctgccggcacaggatccacaggtccttgcgccgcggctcgccgacgagcgcgtactggtagtcgtcgtcgacgtagagcacccagtagtcgccgacgacggggatgacggggaggaaggggggcaggtagaacttgaccttgagcttggcctcgtcgctggccgggtcggccttgtaggcggtgcccttgatgtagtcgcgcttcccgctgctggtccacgtctcgttcagcacgtccaccgtcgcgccgtcgggccgcagcgcgtacgtcgcccgcgtgtcccggccgtcccggggctggaagaagttgggcagcgacgcgatctcgtaccaccggcccatgtacctcgccacgtccagcccccgcaccaccgtcatctcgctcccgctcttcttctccaccgccgccgccgccatcgtcgtcgtggtgattgtgttgctgtgacgatcgatctagctgcgaactactgatgttatctgtttgatatgaattgccaacttgagctgagttgagctaattgcaaggatgagtgtggctatataggagagggttttggcctcttgggggggttgggtttggagaagaactgaagaagctagagaggttagtatagaggataagattactacgtggagggctctg

SEQ ID NO: 36219 - DNA, 1501 bp, Oryza sativa
acatcaaatttgttgaagtcacataccctatatgatgtctaagaggaccacaattgaaaaggtatcaagccaaaataacttataaaatacaagaagcgaagtactccctccttccacaaaaagttacacttattactttatcaccaatactaaggagaaattaaatcatcttgcatatatgtaacaaagatcaaggagtatatgcacacatgcaaccaatcagtattaagatgactcctcaagtttagttcaaacatttaatttatctcgccatttaagttttggatgcatagagactgcaaatacgaacaacttatttggaaaaactaaaatatgaaatatgtctaaatcttacatgtagagagagtactaaagaaattgaagaggctatcaagctcttgtggatagaaggagtattgaagaaaccgaagattttataaaaaatgcattgttttccggtttgaaaagtacacataagatatataataaaaaacaaaggggacctcaatagaaataatcgaggagttcttgttattatggtatagtacttctaacatggcatataaacccatacattcaaggcaaaattatagtagacttttaggctttagcaaaaacaaggaaaataatcccagtgcccttatccaggacgtttgtatttccagttctccacgctccaaatgaaaaaggaacaatttgtcttttgcgtgtatggttcccactttcccaggtccactacaaaaccggggcaagtccgcgtctcacgaccaatggaaacgcccattaatggcaagcttagccccccgcgctaatcgcctcctcctactaattccttgcgtctcgcttcggccaccgcccaccaccacctcctctcgcctctcgcccccgcatcgccgcttcctccctcccccacctcacgagaccgttttttttcttttttttttgtgttaccgccatggccgccgcgttgacccgctcgtcgtccgtccgttccgccatccgacggctcggatcctcccgcgccttctccgcatccgccgcggcggccccgcgccgcgacgcgaggggggcggcggccgcggcggtggcggtggctgccgggtcggggctggggatctggctgctgccgccgtcgccgcggccgctggcggactccgggcaggcggggaatgaggtggcggcgttcggcgacgtcgcggaggaggaggagcgggaggagaagcgcaggttcctgttcggaggtgagggcatttgatttttgttttttttattgttcatgcgtgttgttttgggttgtaatgcgggcgatttttggcgcgtttatggcgggggagagcgactgggtttcattcccattgttttcgtcgatactaattttgcgtgaaaagcgaatttgtccagtagtattttgctactcggttattcgcctctgaaaaattttaaatccgctattttacaaacggcacgatgattttcgtcgcaatgtttcctcgaatgtaga

SEQ ID NO: 36220 - DNA, 1501 bp, Oryza sativa
tgaaaggttttggcacaagcaggtcaacataaactctatgcattttggaaactatgatgtgttatatgttacctaccaaggtaagagctatttgtaatttttattgtgtcattatacatattctctttgttaattcctataaaccttattggattttccgatattcgagtaaatccttaattattttgtttattattcaggtcaatcagttcacttcctctgtgtgtgtgtgtgtgtgtgtgagtgagtgagtgagtgaaaccactggcatgatattctttttagccggatcggccaaaggaagaggctgatcaaatttcattaagattgatggagaaaaaaaatagaaattgtaaaagagtacaacaacagtagtctgtcgaaactggtggcaccccagctagctgggtaaccggaaaaagaaaaagggtagggatgggctagagactagtcgccatctcctttcaaaattcctgctgtcctccagacagagatttcatctctaatttcattgacatagtttgttttttagaaagggtcttgatatggttactttcacttattcatacaggtcttcctccgtcgccaccaacagctcccaggatgaacaatggtcttagcaatgttaatgatccaaggttgcatccacttgctgttgatgtgggaaaccacagagaaacaaaaagcaggggcataattgttataattgttctttcaagtgtctttgcttttattttatgttctggagctgcgttggtaatttgtttcaagattagaaaccgcaaccatttaactgaagagtcacctatgccaccgaagcctgcaggtaacaagacattcaatccatgcagtgttgctgtatttatctttattagtcacatattagaaaaggtgtagcaaatgcaatctggtgaaacaatcattgtcattctttccatgactatgggtgagttcgctactggaggtttccaaccgggaacagtgcgcgcggaaaacggagcggttcattagcgcgtgattaattaagtattagcttttttttcaaaaatggatcaatatgattttttaaagcaactttcgtatagaaactttttgcaaaaaacacaccgtttaacagtttaaaaagcgtgcgcgaagaaaacgagaggggaaagttgggaaccggcagtgccgaacacaccctatatccattctgaggccttgttaggattgtttgattattttgtagaaaaccaatccacataaaatgatcattcgttttctagctttcaagaactgagaagttatgtttcatatttgtatggttgaaaagtaatattaccttgaaataatcaaagaacaagagttatatttcatgcttaagtagtgaaagtacttggaacagctttgaccaaatctgaaaggattatatttttgcaaaagttaaaaactgatgctaaattattttcttccatcaatgattgcattggaaatgtaggtcctgggtctgcagttgttggga

SEQ ID NO: 36221 - DNA, 1501 bp, Oryza sativa
gttcttacacgcagatagcaaacacaatactaaccaaagcaggcgccgaccaagagaacagcctcccagataatgccaaagagacgcaatccaccggtgtccctacaataacaataatcgcaatgagatagaaacaccaactctcactgtataccagcaacagtgcgacccaaatggatcgaggaaaggatgtagaacactcacctgatatctcgaaagctttcgcccctttgaaatccaccgatgttgctgtaatggtctcgcggatggtaatggaatagccgcaagcaggcttgtcccttcacatcatcatcaagaaaacaatacagattatttacagctgggaccaatggattagttggttggtagaattcgcaacaaatccagacaaaacaaggtattttcccgaggtcaaagagaatatcgtaaggaggaatcgaggattggggggcgcatacgattcgggcgcgcatacgtggacgtcgcatcggccgccggcgacgagggagtcgacgagggccgcgagacccggcgcccggatcccgccggcgcaggtcaggagtacggccggcttcgcgggaccttcatcggccacgggagcagcgccggaggactccgccgcctccggtgccggggcctcggcgccggcctcctccgcggccggcggcggcggccggcgcgccgcgaggacggactgcaggttggacacgagcgcggacgggagcggattgggcctcggcgcgtcgtcgccggagctcgcggccatcgggcttcccttcgcttcgcctcgccggagaggtgtttgggcgtggaggagagagagagagagagagagagatgtacggacgaatgaagggaagagagagaggaggggttggaacgcgaggggggaagagagagagagagagagagagagagagaggaaatggactgaaatgggctgggcgcgccatcgcatagttaatggatttctagaccggggcccgctttacgtgtagagggaggcaggtctctgttttgacctgcacagatacgtgggaaagcgttatctactcgacgactactcccaacttgcctcagcaaagcgtggcaagaatccgtgattctcccgttccgataccaaatccactatcatcaaccaaaataatagttttactggtattattgtgaccaacatgcgggcatgaacacggaactctgtggctagtatggggtggaatcttttcttaacatggattacaaaattttacatatttttttaccaacaatggtacagcctattttaaatgaaaaaaacaaatacaccaaaaatagtaaatctagagataaaatactccatctgttctaaaatataggaacttttagctggttgggacatatcctagtactacgaatctggacaggagtagatatgtcccatccacccaaagttgctatattttgagacggagggagtagttgtaaaatctaattttgatgcagtaactgagtgtagctataa

SEQ ID NO: 36222 - DNA, 725 bp, Oryza sativa
agcatataaatttcaaatggccataacttggccatttgaactcggaattggaccgttcaagtctctaatttttccttaagaagtcaagaacccatttttgtgctttgtttctgcttgttatatggagtttagtagagtaaaagccttttcttttccgttggtcgtgtagacgctgcagcttcggaagatcctctcttcatggaagttgaagccggcgtttgggaaagcgagcaaggcaagtcacatcatccttgagcatattgaatcccagtttataaaattattttgatttaaattaatgcattaccgctttatttaaattcccgcgttatcactgttttatttagccatgcctatttacctttgttaagacattattattgctattgttattattaccttgttcaccctaggaaaataaaaccccaactagtgggtactctattcatggttccactggtatgaatttaggtagatgcttcgctggttaattaggcaacattaggtggttttataactttagactttgggaattctcatatcatttggacactatggaatggttggcttatggtggaattggacatacccctctcttcctctttcaaagcccctaaaatctgttttccggtggggtttgggtgcatgccagttgtgggaagtagcaccccggccactataaggattaagctcgggcctctgttgcaaagcactaccgtacttcc

SEQ ID NO: 36223 - DNA, 1501 bp, Oryza sativa
gagctagagcatgagcaatcctatttgcttccctcttgatcttgtaaacctgcacactttgtgttctgctaatgcttctaaggtaatattggaacagcatttcggtcgctgcacctaattaattatccctatgtgtacattcatatgttggaaatacatacttttactctatttatcaataagaatagcgctatctatgcacattaggaagcacatatacatatatagtatagtaaatcagaagttcaactgcaactgatacctcacccattatatacgtacttaattaccacttaccagtcctacacatttatatgaaaaatataaaaatgtatctacatgtaacttatgtgaaacatatataccctaagatacatgttattttataaattaagatctatatatatatttgaaacttaattaagacgagaacgagtttataaacccgtgtgttacgcaagcaccgaccagaatacccccgaacatgcatgcataattgcatattcagggaatccagtgaggttgcatggcggtgttcgccgagaagctgtcgacggatgaagcactggccgccgacgtcgtcgacgaccccaggatggcgtccatgaagtccatcaccggacccatggccggatcggccaagaaagcgccgccgccgccgcccttctgttcgacaaacgccgggaggcaactccgggccacgacgccctctggagccaagagatgatcacttggcttgcactgacccccgacgatgccagcggcgccgttctccagctggtacgcctccgctgctcggcacagcctgatgaactccccgtcgacggcggcggcgtactgaaggtcgccgccgccgcagccgtggacgccgtggccggggagaaagattggctggtgggagctgaagctggcccatgccgcggagttgtacacggaagacggcggcgattgagtgacaccgtgagctgcattctccaccgcgttcagtgacgcagctgcgatgctctgtcctgctccgtccagaatgttgtagtacaaatctagatcaatgcaacaaacatcgagtcgatcagtaattattcagtattcagtacactattacatgtttgtcgtgagtaaattatattcgtactgatccatgtgtaaactaacaagaacgaaaggtatgaaaattcatatgagaagcagcattttttcagaaagaagtgaaaaatgtagcacaggttttacctgcagaggaagggtgcagactacccacggcctgggagatgagcttcttcttgatggtggagttccagaagttcttgacctcattgtctgttctaccaggtaggtgcttggcaatctgagcccacctgcatgcaatgcagtgaatcacagtgacacagcatatgttagccagctcaaatctcgatcgattgccacatttgcgccccgtcctttgtctcagatcaagttaatgcgattgtgcattactcaaatataggccaaagcgtgcaaa

SEQ ID NO: 36224 - DNA, 1274 bp, Oryza sativa
tgtggcgagggccatgggagattagagctagtagaagccttctaggtaatgcctggaacctgtgctttggttttttacgagtatatggctagttctataggtagtataaacacatgatgtctagccatagaataggtggatcagtgtctagtaaatgcactagaagaaaatatatatattagtgaaaagactagtacttttaatggctagcagcagttacatgcatgctcgactaacatgcaagcacctgctactacatgttaggttctctttctttagtatagtcacatcaactagctacctagtagtatgttagtagttatcatgcatgaaaatctagatattaattaatatcaaagatttgcatatttgactaggtgggacgcgctggtagaacggcagaaactaggcaagactgcgcccatcaactattttacttaatcatctctaactaaatttgcttacctgtattatattgagatggtgatgctaacaatctaacagtaaatattattcacccgaataatggattgatgattttatcagtgagaataataacgtgattgtgacacactgatacttagcctgagacagtcgatacctgaaacaacgatatcgggtcggctgatatcagtgtgagatgagaaatgcctcacacaagtagggaatttggcggcgtgatctcagacgagggtatcactacttgcggaaaaaatggattgaaggaacgagattgtgacggttattttaatacctctgcagaatgtatttaactcactatgtttagtgtcttttactatttatcggctgttaatatctatgggtagtagtatttttctttaaaaatatatatgtagatatatgtactaatcttgctgagtatgtacaacatactcatatattcttactatttgatgtgcgcagaaactagtcaagatgagatgtcagagggaaatggtgacatgcagacctagtggggagtgtggtctacttagtctttagagtcatacaagaggacatatacctgcatgctaggtacagggaatcgtcctggtgataataagttggtcagtaaaccaaccgatgtattaagaaatgtagctggtgaaaaataaatggaaccattactgtaggtgtccaagcttcagttgtgatagttagacattacatcttgccttgtatccttatggacatatatataagtatttagtatatatgctatataaggatacggcagactgtaaaaaaaatacaattttttgggtcatgacagc

SEQ ID NO: 36225 - DNA, 1501 bp, Oryza sativa
ggcattggaaaagaagattagattgaagcaaagtcggaggcggagatcgagttcggaaacagagcagggatcggctggagtccagatcggctacgataagatcggctgagtctgagtcggactaggtaagccgatgtagccgatcctagcaatacaacttgatgtgtgatgtcgggttagattgaggtgcttcaaggtgattgccgcacatggatagagtcctgaggaggcaattgtatctattaattaggatgttttatgtaatttccttagagatatgattaggcaaaagtctgccgcaaagacttatagtatcttagagtttgttagaaatggtagtcgtgtccgttatggacatatcttgtaattctcgggtataaatagaccggagccctatgtaacttttaacacacgttcaatacaatctcggcgcatcgccccccttttactttagttttgttttgacgagttcttgctttcgagttgagctgcatcggtttcgatcttcaacaagaggtaaaacttgttatgacgacttgtgttttcgggattagtatttccatctttatgatactctgatctcgtttatataattcgccgagctatcatatatcttacataatcttcggcaataccgctatctaatctacaatcggctaacatctgtcggtagaaggcagccgaccaggttaaatagcgacgttgacctaaattatataagatatttaccactttatgaaactttcagtggtttgattgtctagatattgttcttcttttcatacttaatactgcatcagttaagtttgatctattaaatcgtgcttagaatatcaacctctagcctgccttctggttaccgattagggtagcatcggagtttcagccgatcttatctgatttaactatatttgctctatatgctttattgacatgttaaatctgccctttatgccaagatattgatgtatttgaatatattaggcttttgcttgatattctatacctgttttaatatcctgatataaagtagtatcggagtattagccgatacatgctagatctatctgatcggctatgctgtaaacatatatagtcctgttattaatatatatttcggtctaagtgatttatactgtctcggcatggcgaccgatctatcccaatcacttgatttaattatatatcgatataaggagtatatatcgttaacatctacagccgatcaagtagatttagttctttcttacttattcaagattgccgatcaaatacacatatgacatcggctcaaagataaatgatatatcatcggcacttagccgatcaactatcatttatagatttaaccgcgatttctttgcttctacttcttgttgattacaggatcaaatcaactggcacactagcacacccgaaggcgagctttggacctgcactggagttaaacagatctcccaggcctcatgttttctgtcaacactaacacagctaggaccta

SEQ ID NO: 36226 - DNA, 167 bp, Oryza sativa
tcgatcgcactttggcaattcagcccctgcagatctacggaatacaaacatcagaattcagaacagggggttcgcccgcccctcctcgactcgagccctttataaggagggggccgcgggcacagatggaggccggagcagggcgccacgaggcgagcagagaagtg

SEQ ID NO: 36227 - DNA, 1501 bp, Oryza sativa
tctttcacacaagattggctaattgagcatcgtgaaatgtaaatattaatgaatcgcttgtttacgaggaatgactagtagcatgtttaaatggatgataagtagaattactattatacttgctctaaggcaagatgaaatattggtctgtgtgccaagatgaaatatgactatcaaaagtagatggagggagtagctcactattatacttgctgtaaggcataagtaatggtgtgacgttatcatcttaaagaaaataccaacatgatttttaatggcgtaaaagattgggaaagagaaaagagaatggtgccattctttttaacatactgataggcaacataatactacaatcataaagataatgctccctgtctccctccgtcccaaaatatagcaatttaagatcggatgtgacgtatcttagtactatgaatctgaacatgccccctatccagatttatagtactaggatgcttctaatccggttctaggttgtatattctgggacgaagggagtatattatattaggaattatcaatatatatctatatatctatgtatgacgtgtaaagtttgttgcaatagattaaaacatgatctctacattcgatatggacatacatcatgctctaaagttcttgcaatggtcttttgtcgcccaatgccaaacctgccgcctgctagtggttgtgcaacagtattatgtggttttgtaacgttagatgagtactcccttcgttcaataaaaaaaagaatctaatatagaatgtgacacattttattttagatttgttttttatagaacataagtactcttgtgatttgtgaagtaaaattttcactttgtaaaaaatccagagttatagccaaacgtagttttacctaaaggtctgcacgtgtcgagacgatctaagatctaaaacttggtagtctcgaaaaaaaatgtacgttcatatgtgtataataagaaattaaaagtcttgtttgccataaagcctgaaactatatggatctactaggctgaaactacattaatccactagacagaaactatatgattctactaagggaattgacagaaactatatgattctactaaggaaattgagacaatgcacatttcaaacaaagattagccgtatgcatctgttccagatgtagaggccggttttttcttaaaagaaaaaaaaaactgctaccgtctgcattacgccgtaacaacatttgcctctagtcactcgtgacctcatcttttcatttatacttatcagtcaaaatttaaattttcaaccttaaatttagagctaattttgagattttttttcattgaagtctatttttcaacatttgctttattcataaactactttcgtttacaaatatatcgtttggcttatttcataaataagcgaaacaatgaggccatcagattcatgacacgcaagagcgcgaaatgcaaacagtacgaattcccatatcctacctcacagcctcaga

SEQ ID NO: 36228 - DNA, 1501 bp, Oryza sativa
ggaggcggtggaggtagggcagggcgagcctgcgcttcgatcgcacgatggaggtggccgccatgtgctcgcgccgccgcccgccgccgccgccgaggaggaggggggtttgggtttctcctcccgattattcttgcggcgggggaagggggcgaagggcggaaagctagcggaggaaaatatcaaagtctcgatgggtttagaaggaacggagtttctttttttaaaaaaaataaaataaaaagtaataataaaagaagcagagtcgaaaacatagtttgtgctttactgctttggttcggcaaagctgtttttaagcaaagaatcgtcgattcgtcgtaggctacatataccaaaatactataagaaagatgaaacaaaatataaataaggtatctcgttcgtaagtaagacttaagaacgatgttcaaaatcgacttcattagaaactacaacctccttgcccatatttttgctgacctttagacgacttgggacctctattttaaccaatacttgacgacttaggatttataggttggtgccatatattttctctggtttcacatataaggtttaaccatttatcttactagaaaaaaatactcgtgcattgcaacgggtgaagtcactgcgggagtttgtttggatatatatatttttagaaaattataagctgcagtccaattatctcaagttagcatgcgagttttttttaaacagatttcttatataattctttctgtattaccaaaagtgaacgatcttaaaaaccctactcaaatacagatatatattttcaaaaacaaacaaacttgaaaaccgactcatacatggatgacgtaccgaagcaaaagaagggaaggaacaaagctaataagaagtctgcattcttctccatctttccatccatttgtcactgattcctggtactgctagcttgtgtgtgtgcaaactccatcgtaagtatgtgtgattcgcccatgatttgcttgttcttgcttatgttctgttgtgtgtgtgtttccttcatttgttccacgcggagcagtatgccgtatgcttgcagaattattgtaagcttccttttctattttcaaaagcaagcaaacttaaaaactgacttatacacagatgacgtaccaaaatacgacaaaaacaacttcaatttttataatagtagagaagagatagagatatagaagagaagagatatagattaaaaccaaaacataaaattaaaactgactcaaacacatataacgaaccacgaaaacaccttcaatttttataaccgactcaaacacggatgacagatcgcggaaacatcttcaatttttataatatcagatattaaaaaaatacataaatatcattttattttaatgacttttttatcactagaaaaaatgcccgtgcgttgcaacgggtgaagtctattttaatcttattattgttgtatggtttagttaaaatgaaattcactgtgggagttcgcttg

SEQ ID NO: 36229 - DNA, 369 bp, Oryza sativa
cttcctggctctcgtccctagccggagctggcgtgctaactcctggagttggtatgtcagtcccggtcagatccattctaggcttcagcgcaagtatggcaaggaagtcgctggccattaaatgaaggttgaaatgggcgtccaccgggaaagcaggtgagcagggcaggaggcgtgtgctctgcttgtcagaggtcacttccggctgtaactagccctgattgtaaaaagcatgtttcccttcttaggcagctagaggcccatgtggtgacccctgaccagataaaaaggaggcccaggcctagaaaaaaaggagagagaggaaagaaggggagtggggactctggcgaagggtttctacagcctgaa

SEQ ID NO: 36230 - DNA, 276 bp, Oryza sativa
taatatatttgcctacctatttatcatatgtctctgttaatctagtcttagcatatcaatttagctctatcggctgcttctcgttttagggcttctgccggtatcggctaaatcgatttgctagattatattagcttagacatctaccaccctgaaaactcagtcaatagcttgattgtctattgtctagatattatgtttctcttcatacttagtgctgcatcagttaagtttgatctactaagtggtgcttagaaccataatctctagctgcgt

SEQ ID NO: 36231 - DNA, 1501 bp, Oryza sativa
ccgtatttgagtcggtttttaagatcgttcacttttggtaatacaaaaagaatcatataagaaatctgtttaaaaaaaactcacatgctaacttgagacgatcggactcctaactgcagctcatgattttatatatatatatatatatatatatatatatatatatatatatatatatccaagcgaactcccacagtgaatttcattttaactaaaccatacaacaataataagattaaaatagacttcacccgttgcaacgcacgggcattttttctagtgataaaaaagtcattaaaataaaatgatatttatgtatttttttaatatctgatattataaaaattgaagatgtttccgcgatctgtcatccgtgtttgagtcggttataaaaattgaaggtgttttcgtggttcgttatatgtgtttgagtcagttttaattttatgttttggttttaatctatatctcttctcttctatatctctatctcttctctactattataaaaattgaagttgtttttgtcgtattttggtacgtcatctgtgtataagtcagtttttaagtttgcttgcttttgaaaatagaaaaggaagcttacaataattctgcaagcatacggcatactgctccgcgtggaacaaatgaaggaaacacacacacaacagaacataagcaagaacaagcaaatcatgggcgaatcacacatacttacgatggagtttgcacacacacaagctagcagtaccaggaatcagtgacaaatggatggaaagatggagaagaatgcagacttcttattagctttgttccttcccttcttttgcttcggtacgtcatccatgtatgagtcggttttcaagtttgtttgtttttgaaaatatatatctgtatttgagtagggtttttaagatcgttcacttttggtaatacagaaagaattatataagaaatctgtttaaaaaaaactcgcatgctaacttgagataattggactgcagcttataattttctaaaaatatatatatccaaacaaactcccgcagtgacttcacccgttgcaatgcacgagtatttttttctagtaagataaatggttaaaccttatatgtgaaaccagagaaaatatatggcaccaacctataaatcctaagtcgtcaagtattggttaaaatagaggtcccaagtcgtctaaaggtcagcaaaaatatgggcaaggaggttgtagtttctaatgaagtcgattttgaacatcgttcttaagtcttacttacgaacgagataccttatttatattttgtttcatctttcttatagtattttggtatatgtagcctacgacgaatcgacgattctttgcttaaaaacagctttgccgaaccaaagcagtaaagcacaaactatgttttcgactctgcttcttttattattactttttattttattttttttaaaaaaagaaactccgttccttctaaacccatcgagactttgatat

SEQ ID NO: 36232 - DNA, 1501 bp, Oryza sativa
ctttttttaagaacggagcgagtagtcatagtcgcgtgaaatgcatgatataatgtactagtattgtatattgaatattaagctatttctctctctacaggtttatgggaatggtatctgtctaagggcccctttgaatcgtagaatgaaaaaaacggaggaataggaaaaacataggattctaataggaatgtaaatgtaaaacagatgattgcaaaacataggaatgatcgtttgattggaccacaggaaaaacacaggaatcggatgagagagatatactcaaagaatttttaccaagaggttggacctctcgctaagtttcctttaaaacctatatgcaacaagccattccataggaattttgtaggatttgaaaaactcaaatcctttaaatcaaagggctacatagtaaaatttcctgtagcatttcaatcctatgaaattcctttataattcctttgactgaagggcccttaatatttgtgcatgccctgaaggctgaagctgctgctcactgcaggaagccaggaaggcccccagctgaaggccagaccaatgagaccagtgagccaacatatggtgacagaaaaaaattactccttttccccaagtaaattaaatatacatggggcagaggcgcagagccatgcagcagcagcatcgcccggccgcccggccatgttctgctcgctcgttcagactgacgctcggataagcaaaacaagcaccgatcacccacacccatctcccggccatttctgctcgctctctcagatactacacgcaaaacaagcaccaataacccagtaggaaacagggtttacgttactgtctcgcgtcgtttctacggttaccagcttactacgggtacgataatataaatactacggtaacctccttaaattcaaataaattaaaaaaataatttaaatttttaataaattttatacggtttttcatggttaccgcggttaacacgtggtaaccgtacttaccgtcgggacgcggtaaccccggtcccggcggtttgggaaacctgactaggaaacgctgaagaattaggtttgcttcgttgctgcaattaatggcagaaaagacacgagcgctaccggctttaagcagaaccatccgtacgcgactccggtgaaggaaactgtgaatgcgtgaaatcctttggctcccgtgaaaaccaagcacgggccggtgcgcacgggtgcgcaaatgggctcacgccgcacgcgacgcgctccgtctcctctcccctctcccgcagtctcttccccacgcagccacgcgcgcgcccattaatcgctcacgcacttgcacgttgcaccatcaactcctctgctcccagcttccttgctggatacacgaacaaagtcccgtttgcttctgggtagaacacaacaatggcgctgcgttcttctgctgcatactactacatgaactaatttgcttctcccttacgttccgtttgcatcatctgccttgcacacac

SEQ ID NO: 36233 - DNA, 762 bp, Oryza sativa
gagttttctctttcgcgccccgagaagggttgttcccgaactatggctataatgttaggatggagttcatagccagatgaacggataagttttgtagaaaatggtgcctcacagaactcagcccttggagcataaagattttgaatagaaaggtgctccattgttggtaagaagacaaaggaacaagagaaaagaaaagatacgaggacgaatcaggttcgaacatgatacaacatccattcctcagcaaagatgccataaataattgttagtatttgatgtggcacgtggtaacacatgaggaaggtgtgtcttgtgggtaaagatgtgcacctttaatcagagtataatctattcgaatagccgcgccctcagttatgagcaagcctagcaatgtaccaaagttagtggtttaattcctaaaacttgcttaacaactaaaatgtggaatggttggcttgggttggcttgggacgagctgggaccggtttaggttgctagttcggtctaactcgttatagtccttgggttaaggtaggttcatgtgggttcacggccttcattaataatattgtgtagttctaggatcgtgtttaccaaaataactttgggcaactaagtgttttaaatattgttttctgcaaaacataacccatatgattactcctttgtactcacttggcatttattgtgcatttatcggtgtgacttgttgagtactgtggttgcactcaatcttgctctatttttccccaaaccaga

SEQ ID NO: 36234 - DNA, 223 bp, Oryza sativa
ttctttcggaggaaaacaagttgcccaaaacaacatacgaagcaaagaatatagtctgccctctaggacttgaggataccaaacgattgtatcctctatcgcggtgaggagtacgagaacctagaagcatgcccggtctgtaatgcactatgatacaacattagaagagacgatccaggtgatgttgacggacagccttcgaggaagagaattcctgctaagg

SEQ ID NO: 36235 - DNA, 217 bp, Oryza sativa
ccagtccggaatgttctcgtcttctacttcatcttcttccattcgaaccccttgctccccgtgcgaggtccaaacattatagctcggcatgaagcccgtctcaaacaagtgaatatgaatagttctaactgtagaatactctctctggtttttgcacttagtgcttggacaacggataaaaccattattctgcttgttagcttctgccactttcaga

SEQ ID NO: 36236 - DNA, 1501 bp, Oryza sativa
tgtgcttggcaatcaataacaaaattcatcattaattgaattttactaccggtagtattgcacgttggattatttatgaatcgtgtgaccatgtttgcaaaataaattaatatagcatataacttcattgcgaacactccatacgacacatgttttatatgatttacacccccaaaacaagatgagtgatttgtttgagcattttacaatatgggtgactaaattacacccaccttgcaagttatggtaataacggcgcatttcactctaatttaaacctaccgcgacctggcagtatagttatttattttttttctcttcaattaacgtgtatggtgatttcgttttagctatatttagatagatttttttttccaaaaagcataacccatgttgtgacaatggccatatcatgtacgttgctttcttatggtctggcaaaaattctgaagcaattaggagtcagattctcgtctcgagttagcatgcataaaaagcgtggttgaatttcaaaaccaaaattcagtttggttttgaagtttcttattgcctaagagcaagttcaatagtatagcctactactagctccaatttatttatagccgatctaatagccaattcatacaatagttgcgtactatattattaacatatggtcctacctgtcatacacacattacgtcttgaagtccgtactgcagctggctacatatttgtagcccgctgcttttctctctcatcttttatctcatgaaaatatgtttatagctggctaatagcccgctattgtacatgctctaaagactcctttaaaacacataaattgaaaaaacacacgacttagtaacaaggattgttaattcttatagaaagacaaaaggaaattttaaaataggtgttgttgtatcgcaagaaaaattgtaagaaaaaaattgaaaacatgagctatgacaattcgttattttcatataaaatcactttaggattgtttattccatagaaatttcaaacaaaacagtagaattcaatatttttcctttaataaagggttgtatgataggagatttttctctatgattacaatccttaaaatttctcgtaccaatcctcccattcaagagggcctaaaatttaacggaattaccccaaacttagagtaaatctcgtgaaatcggagaaaattattcatctccttcctccgactttcaactcacatcgctcctcccgtcctcccctacctggaggctgcagctcctggcctcccgggcaactagggttcggcaaatcccccgcaaggagggtgaaacccttccccaaaactccccaatccccacccgaccttcttcgaaatcggaggcaaaaccctaatcgcaaacagctcgtcctcgcgcggccgccgctccgcagcaatggcgtccctcttcaaggtacggattccccccccccccctccgaaaccctagctacccgagctcgtcgattccccctcctctcgcccttcc

SEQ ID NO: 36237 - DNA, 1501 bp, Oryza sativa
gttacgcggtaggaaaaaaaatccgaaaaaaaatcgcaccgatgcgctgtaccgtgcgtacgcgtgggctgtgggcttgaagtgtgcgccggcgacgcgtatgcgcgaattaggaattctgctcactggaggctgatactagtcaatgctgatgaaggtgctccaagcgtggtacataaatagtagtggtgtacgaggaacgagggtaaaaaggaaaaccttacattgagatggatgatggaaatgtcagttgtagttacggtgacaggtagtccataattgattgccattagtttttaaggcttgctttgcaagcttttaggtcagatttttgaatgacaaatgaaatttaaaactgaaatatattgtttatgacaattttagaatttttgatgaaaggatgtattcaaaatcgtaaagttgaacaacaataaactgtatgccaaagcccattttgttaagaggagaaaaaaactcagctatgagtctctgcatatttcaaaagagtaaagtaaagtaagttgagtcattagtacatgattgattgaatattaattatgcaaaattttataaatggattagtctggttttcgaaaataattttctatataaatttttgcaagacacaccatttagaagtttagaaatagcgcacgtgaaaaacgagagaaatattctaccaatcggccggagccaaacgtggccttactgtaaaatcaaagtgttttttattcttactgtacaatcggcatcggacattattgtttttgatatttggagattattaacgaagtggttttggagatgattgatttgcaggtgatgaacagggttgttgtttttgtcaagaccagtcagatcgggctgtgcttgctggtcagaccagagttatgtgcgcggtcagaccggccagcccacggtctgactagccgactctgtgtcggtttcggttttgggttgtttgtttgtatatctgtgattgtttcatatttatggcttctagatggatactatgcatatgtaatactgttgtttgctaacaatgagtcaagttggagatagcttggtctcgaaatatggtttctttgtttggctcatgtgtaggtgatggatcgggagtcgacctggggataaggcgacgtccgtgacggtcagatatcgtgcgggatacttaagatagagttcaatgcacgtggttggtgaagattccatatggcatacgatggaggtattgtgtacgtatgggatgcggagtcgaattagggaggagttcaaatttggtatgattggagtttgtaaagtttgtttcttgtatgagaaggtttcctaggtggattaggacttctagtatgagttttcttcatggctttaggctgcctaccctaccctcatgtataaatagagagggagcgtgaggcttcctagtatcgcttttgagagcattgagttgtgaataagttagggtttcgagtgtagtcaacattttcatgaggagtgttgt

SEQ ID NO: 36238 - DNA, 1501 bp, Oryza sativa
tttcctcatgtatacaaaataaaatacatatcattggatcggaaaaatagtacatatgatttgaaagagacaataaagctttcgtcttaggaacgataaaaaagataaagccgggtgtaaaaactaaagccaaaaaaaatacgtacatagtatcatccaaaaaaatcaaaaatataattttctgccatatacgagaaagaaaacaacccatacgtacatagaaccattggaagaaaaattaacgatctttaaaatataattttctacaatatagagataaaatatattattccactaatacacattgttaaactagatctatataatcggtctataaacattcacattttaaaatattttaaaattatgtatctaattagtgatctttgttgtattcctttaattaaatgaatattataagacttataatatgtcataaatacatcacgacacgtggggccgacaaataataattagtgctatgatgcgtttttttaataatttcacgttatattttggtgtaaaaaatccttaacaaatatataacgctaatttaaatctacatatgtaaaaaaacataaaaaacaacaaaaaatagttttttcaactatctttaatttaattttgatttatttgagattaagattctcaaagttttttttgaattttttataactacttgattggtatttgagaagtgagcagcacatgatacatatatataaaaaaatattttcatccaatgatcttgatataatagaacaccttaatccatcatgagtatgatcatatatgtatgttttattctctttgccaaatagttttgataacaaatcaagtaatatgtgcaacatactactaatcatgctatatttttttatagttgaggaattccatcatgttatatgtttttatagttgaggaattccaacatatgagacataattgatggatgtatatcagacataattgatggatgtatgcgatatatcccaccgacgtgactataagtattatctcacaaattagttatatattgtaaataagttttgaaaaaaaataaatacattatccaaatgattaaaggtgtctcatgtgattatcaacgataggtgttgaaaagaaaccaaacgctaaactatagatatttgttaaaatttaaataataagatagtgctttgaagattatcttggtggtatgtcttcttagctataattttttagtaccaccgaatgaacctcggtcattttttaaagagaatattttgtttatatcatacttatttatgaagtaatagttaacaccataaataaatggtgtttactctataccataaatctactcgaaaattaaaacaaaaacactattctgatcacattcatcttctctttgtcctttactgaagggcaccaagcatagacaacagagtttgctacgctaacataagtatagcaagggcaaacatatggctaagttgaagtgtgctagacttactattta

SEQ ID NO: 36239 - DNA, 228 bp, Oryza sativa
aaaaagttcaaaaatcaccaaaacatgatttttgaacatattggagtgcgttgggtgctttcgcggctaaaaatcacttcgtgattcgcgcggcgaacttttgtcaattgatgccaacattggcatatattggcacacgtgggtgcgatgttttagaccggaatgaaaaagtttaaaaagcaccaaaacaagatttttggacatattggagtgtattgggtgcgttca

SEQ ID NO: 36240 - DNA, 1501 bp, Oryza sativa
ttgcatatagtgcattagagacattatcaggatttatggcactagactctcctcttacatattatttgttgaaggctgtttttcagaaaggagagagggatgttcttcagctgcacattatcaattttttttggtattctgtttaaaacattgttttatttatgatctgctatgtgcccgtttgatgcatgacatgtatccattctactctgttataatcggaactatttcatttcttcaaatgtgcttcttgatttattttacttttgctctttgtaaattactcaccacagctctcttctgaaatgacaggactgtgtggtctttatgaaaggaaaattagggacataaacccaatggtaccaaacataacatatgatatcactgacctctataacttcattgatggcctagctgacatcagtgcactagtgtgagtaaaataacttttaaagaattggatcagaatcgtgcaatgttaatttatgtgtatagttttcaaagtaaaaaacaatcagctactatttttttctgcatttgcagttatgatcactcaattcaggcatttctgccatatgatcgacagtggataaagcaaaagttgttccaacacttgaagaagctagctcagcggtagtgagtggtttcagttcgatatctctcaccagcgagaagagatgtggccatggttgtcagaggtgttacctgtaaaacaatgagagtttcacattgtgtgctcatattctgacaaaacttaaatttcaatgggttgcctctggtacccaatatatcagttaaacttatctgctgtgtctctttgtgaataaaagaaggatttggctgtatactccttttcaaaatataagacattttgtttcgttaggataaatatttgaccaaaaaatactttattaggatataagttttgtgacatgaatttattatattagtcttcaaaagttcgtacttatgcttatgcttcatttatcgcataaatgatgtccgagtagagcgattgttattcaaaccttaccctaacggaacaaaatacgtcatatatttttgaaatggagggagttttgcttttatctgtccgttgccttattgctcttgttcaaacatagcagtagttccttttgtgcctatcatggtttacgattgtacttcccacaatcccacgtccacacaacttgacctaatgtattatatttcaaaaatgaatgttgattcaaagtgtggtgcgcctgtctaatctctctattctacgaatcctttgctcaagatttacaccgcgtttttttacacggatttacatcgtgtttgctccaatactacctaccataagaacagaataaatatatacatagacaggctgatacgggatggaatgctcataacttagcgcattagtgcatctgcaccaatttgacagtgtgatataatttcattgttcattaaaatgtaaacatttatttggtgacaaatgcctatgacaggtaag

SEQ ID NO: 36241 - DNA, 1501 bp, Oryza sativa
tcatcatgtaggcaaccatcataccagcaacgcaacgatcatctggttcatgtccagaactcctcatctgctcaaacagggtatatgcttggccaacgtgaccaccccgtccatatgcttctataagtgatgtgtataactctggcgtgagctggaatccagcaagtaacatcgatgttttcaccctttcggctccatctatcatgccacgctgagcaaatgccaggattacatccatgaatagttcctttgtgggtttgatcgatctctccatttcacgtaacaaattttctgcttgttttggttctccagacttaagatgagctctgatcattgacgtgaaaagcttcatatctggtgggaagccttcccccttaaggaattgaaatgcctgattggcttgttcaagattccccaccttgcaatacatgtggactaaagtgatggatgtgacgacatcaggtgcaataccattctctttcattttacctagaatcctttctgcgtcttccacatgatttgctttagagtgaagatcgattaacttagagtaatcacgaatggttgcaccaaaggattcatcagccagcagaatttcagcaacctgtaaattacaacacagcatacatgtgaaactacaaaagagatttcaatgtaagtggatggctgaaggctttctaaactcagtggcagttggccaactttacaaaatgcaaagtactccctcaatttaaaaataatggatttaaatgccaattgtccacaaattgaagtttcatttccatgtgaactagcctgaccacgttaaatacagctgaaatagtcataggttacagagaaaagttggtgcagaacaactatctcaatcatgggaaagctggacatgtaatagcagtctatctgattatgctagtagctaaaacttaggatttcaatgggagacgaatgcaacatttgcactattcctaaataggcaacaatcatgaacaaatatcagataacacatcttattgtttaaaatcttcaacaaaacgctgaacaaaattagtggtcagaagatgcattttggagagggtgaaagtgagctatatctgatacagaaagactattacatatattgatggttcctttatcgtcaaatactataagtcaacaagtaatgtgatgcaaatggcacagttcatactggtcaacctaagaaagcataatcaggccattttagtgcagcagcaaaagcacacttcaaactgatcaaaccaagaaatcacataatcagggtattttagcggttagcgcagcagcaaaagcacctaaaactagaagatgtgccatgaaagaacaaggaattttacaacctgaaagtaatctacttgactagcatgacatacataaggcacaatagtagagccttcaagtaaaggatatatcaccttgagatacaactcaacattgcgggctttaagacgctcgagcagcgccatccagtcggcacgtttcggca

SEQ ID NO: 36242 - DNA, 1501 bp, Oryza sativa
ccaccactatggctgcaacagtcatggtcgtcccttgggagcaggaacagctgggccctgccgacggcgccagcaccccttgcagcggccaagcctgcagtaccagccgatgcccttgccagcacaggaggaccatgcaagcagcccatatttgtggagttggacggtacaacagctccctgcagtcctgcacctagggacgaacatggagttgagcaagctgactaattatgtttcaattaagcccgagcaaaactataaaacaaaaccacactgcaatatgaaaaaaactacggagtaaagcgtagaagtatccagcagtgtgcctatgttatgtttccagggatcctttgggaccctgggtaaattattaaattctagctaaattacgccatgttaactagtataccggtaaatagttacataattcgtatgtattggactcttggtatttttttgttctgggttcatcactggaaatatctattagcacaatgcaagcacatgggaaacagtcggtagtacatgacgaccaacatccatagtactaagtgaaagcatcataatacagaggagaagatcagaagaggcacctttggtctcctcgacaatattatgaagtttctttctcttggccatctcttcatagtacttcagtttaagatcttcacactgcacaactgcagcaaaaaaaaatgcttacaaactttttcatcaaatactctaaaacctttacaataatgcaactgatggatataacctaatgcttgaacagctcctaccatcttactcggttcaggaacagcgtttgcatggccatcttgcttcaagagatagcaatgtttgctcttgtttcatgacctgaaaattaaaaagtgatataattagtaaaacatagcacctcatgtatttatcaattcagtaaatctgcttttaccttgattttattttccaagttagatatggcagctgcccataatttattggcatattcgtacttttgggaaacacttctcagttgatcagcttgtctatcaaggacttgttctgtcaggaatgtaaaacagtggtgagcatacagaaacatcttatctgaaaattagaccttgaaggagtaagttgaatctaatatattgtgtcttacctgctattgctaccgtttttcgaatacaaatggcacaaaccatgggacttccccttactcctttgaagtttatgacaaaggcaccgtcactctcaactgttaccctaatatcacgcatatgaaggggtctgttacctccaaccactgcatacacatcaaattcagacaaaatctgtgcatcaatcaaaagtcaaattgtttagctaaacctgacaataaattgtgatacaaaattaagagcctcatgaatactgtgtttgcattttcttctagcacaaggacatcaaatgctctaattccttctggcccgtaagtgttcattatctcagcaaatgcagatcaaagaaatagtctcca

SEQ ID NO: 36243 - DNA, 1501 bp, Oryza sativa
tagactttggtgtgcgtattggaatatagggtcgctacttgtttggggtctatacgaattggtgagttcagcatttccggcacttgaagtgactatgatctaatccactgcaaccaagtcctcggtaggatttggtcgtcaatggcatcttgtgtgagaggttgagcttttgaagcaacccagtgtgtgtgaggaggaagcctagccacttaaaaggcataaacaacaaaatacatgtcaataatgaaatactggggaaaagagagttttttcccctcatattattcaatggctacaaaactcgtaatctcgccctgtacattgtaaattgttaatatatttgttataggagtcttcctacagtatttttccctaaaaattactgggaaatctaccaaacgagcctcaatgacaaatacggcaagtattattgaagtttaacacttttattaggattaaaataaacattttgtgaggctcatggattttatttaagtgtcagtttcttaagcatgcacccaggggcacacacttggtggtgtccgcatgtgtcttttccgtataatcgaaaaggtcatattaatgaagtttggctcttttatatgggctgttagacaattggctacattttattgttctataatagactatcttattcaacattcttaagaaatatcctaaagggaatgtttacatgaaggccacaaattgccacacccaaatgttaggcgtgtcatagtttactgggttagttagttactacttatatttggttggttgttgttgcgatcgtggagagtcacactttgttaattcacacattcggatcacatgtgtactcaatttctaggcaaacattgttaaacctgtactacagttaataaggtgtctacctcactttgtatggcatcatcttacttctggcaaagttaggcgtcagcctaattggcttggagtagccttgcatgcatctcaacagtcaagagtctgcttctcaactgttagatttaattgggtaattgatccatttaaatcaattaaatcaaataaattccaagcctcattatgctaggaattcatgtgtattcattctcttatgggatatcaatgggatgaggagttttgagaattaatccatttgattagggaattggtaacttatatcaattactcctatttgatggatggttgatggttgtatagtggaggatggttcatggctagttgatgacaattaattgctctattcctcttcctattccattggtaacctacatcaattactcctaattgatggttggttgatggttgtgtagtggaggatggttcatggctaattgatgagaattagttactatattcctcttcctattccatgatttttactcttcatcttccattcctcatataaaatgagaatggatttgatctcctaaaagagaagagagacacactttcatccattttcaacgctgttgctgctacagtaatcccatcccga

SEQ ID NO: 36244 - DNA, 1501 bp, Oryza sativa
tggcggtctattctcaggatgtaagctacatcctaactgggaggcatagcaaactgataatgcaagagagttctcctgctctattaacatatacaaggcaaagtttttgccctccttttaaggactgcaagaaaattgtgttaacatacaaccaccaatagtgaaaatttttattgacattggacagtacactatccaaagaccataggaacaaaatgcattgctgtggttggccaacaactatagctagcagctactccctcatacaaggcacattacaatcaagttaatatgtgtccctcttaaaatgatcaacggatgttaggtctcacaagcactctaaaaggtctcctgcatggctgcatagatcattgacacgaataaaagtctcctgcgagagcattgacacaatctcctgtacgcaaatgactaatctgtacaggtcctccacctaataagcgtgatctgatcaaacatcaaagcaataactgttaagaccctacacaaacgcccacaataaccaactacctccatacaccaaccctacgcatacaccaaacacatgctcgaaatctagagccgtccttggcagcttgtcctgaatctgtcgaaagcccacagctcaacaagcagatttggaccattctgacaagcgacaactttgcacacgacacatctttcagacagaacagaagatgtacccgctaaaatttatgaactgaaactggaattccctcaaacaggtggtggtggtcagatcagttgcattgcatacccacccggggatgatttcagcacagaaaccatcactctctcttcactcaatgccgtggaaattggaagtcatctaccacgcgaggagcaaatccccagacgtaattgcaaatgcgacaaaattaactagacaccaacagcaataactagaaaggggagaaaaaaaatacgaaacgcacaagcacgttcaagcgtgacatccctaatcggcatttgatcaagcaactcatctgcaaactttgagggaggattcgaccggcgccgttagcctcacaaccgtcgccgtcgcacgcctaccccgtccctccgcgtagccgcctccgccttcgtctccgccgccggagacgtcgagccggggcggcgcatcaacggcggcgactcggcgagcgccggcgcagcggaggatggctttgtgagagagatcagatggccacgactccccacgagcccacgagaggcgagaggggtaaggcccaacgcatctagaaaatgggccaaagtgggcccaatcgccacagaattattcctcttattcggcccggcccatttaagagctctcgcccacttctatatgcggaccagcgcctcgaatttcttccccttccacttgtctgacgggccctcgccttcccttcgcttcctccccatctccgcctccgcctccgccgccgcgccgccgccggcgacgactccgacgagcgacccctccgcgggcaccgggtcgcca

SEQ ID NO: 36245 - DNA, 1501 bp, Oryza sativa
ggatcgatcgatcacctcgctgctgtttaatttggcgtttattccggcagcgaccagcggcagctagtgatcgagttggaagctcactcgcacgctcgtaggcttcgcagctgctgcaaagaggcgtagctcggtgtagccaccatcaggtatataggttctgtttggggagctttagattctaagaaacagctgtttggtagccagcttctgagaatctggaaaagctgtgaaatctagcttcttagttcatttctcagaatctgtaactacatattctcagaaactgtggactgtttggagcagcttccccaaaagagggccataaacagcttcatcgccgcactgtgacggtgtccacgtgcttcttcaccggcgacggcgaccgctgaccccagcttgacttgctgtcacgccttacagcattaggcgttggctatgacaatcttgctttaactacgaagccatcacgctttcagtggaacaagagacggccaacttgcaaattaacggactgaagaactgatgagccaccgaacctttccctccaacaagatacgaccaacttgcaaattaagaggcatttgaattactgtgtatctaggtttgccagatttcaaataaatttatccaatttgtaccacccaaattgctaccatcctcagatgataaagactgttaatatcatccgtgacagcacatgcagttgggcaatgtagatactgaatgactgtggaaaggtcgccgattgaatttgggagacccgcgtagcagattacttatagctagtgactgtatattatactctatctgtagaaagctacagttcgttaacggatcaaagaatctccaccttctgctttctttaatagaggttggcactctgtaggaaattgtacagaagggaacaaacttggccgctaatccaccattgctgtgaggacctttgacctccaaaacttcttttccaagaagatagtctaagagttgcaaggaccttgacgcccaagacttctttttcaaaaagatagtctaagagtaggatcaagatttaggttgtgttggccactgggaaccctttctcctcagcacgcaaaacagagcagcgaattaacacacaattaattaaatattagctaaaaacttgaaaaatagattaatatgaattttaaaacaactttcctatagattttttttaaaaaaacacacactgtttagcaatttgaaaacgcgcacgtgaaaaatgagaaagcagaaattgaaaagtgtagtatagaacgttgagtattagtacatgttggtgcggttaacaacgagcaagagccagaacaaggaatttatctatgttttaagagatttacaaaaataaactattgttttaaaagttttgcaaaaatatacttctcctgtcctatcaatctattatagggcagggtgtataaatcgccctacggtagagcaggctatgagcacgtcatatagtgggaggggcacgccatgg

SEQ ID NO: 36246 - DNA, 1501 bp, Oryza sativa
atataaaatttttatgtatgttctctctagccttagcttgtctacatgtacccttgttggggtccatcaagtgttgtgtagtactgctccatctgccttgggtgggaagcaagccctgggattcacctctctctctctctctctctctctctctctctctctctctagtctccaacatcacagactctcatgccgaaaaggatcatcattcgagcacaaggcctcctccatatgcccatgtgagaactcttatcacctgctccgtatatcttctttctactgcaatttgcaaaccccattattgtgcattggaaagaaatatccttttccatcattccgcgaaagcgaatgtgtgaaagaagtgtttcttcccagctgcatgcccaatacctcacatgattattttgttcacatcgtaattaatttagcactttctcctgtactggcaatctggatttaaagattttcttgttgagtatcaggatttcttttgtttgtttaacagcttgatgaagtgcatggcaatgcaacctttgatgagtcgatcgactagcacctagctcgccctccactcgtaggagctttatgctgcgtgtgagtgagtgcagtgcagtgcagtgtgtggaatctgcagtaacagctgtgatgtggtgaggcagcagttcttcttgccttttgctttttagttgtaggactggccagtctctcttaagctctctaaattaataaatatacatgaatcagctagctagcggtaaacgtctaagccaaaggtgcttggtgaggcgtcgggggtgtttggatccccgccaaacattgcctcgccaaacatgcggctgccacaacagtttggctgatgtttggttaatacgtgagttgtggcagccatactttttgctagttcatttgcatgcttatttccgccacagtgtggcgattatttctctcgccacaatctctggcggcgccacaatcttacagtcagttcaatttagcatagatgaaaggggtttgtgtgtcttgtgctatgcttaaattaacgatggagagagaaacagagaagcgatggagagagagtgagtgagagagatggagaggctaaggaggaggggccctttaacttttcctctataagaggtgtggcttcagttaaagtaggcaggaattctgctctctctctctctcttgtattaaacttgtgaaagcagcaggctgcctgcctcgattttttttttatatgtacacctctcccacactccttgctctctcgtttgctcttctactgctcatcctcctcctctactactcgtcctctttggtttgcttccggcctcttcttcctgcatagcttctgttattcgatttcgatgatcttgtcttctccttgaattgtgtgtgtattaattaactgtatgtttgtttgatcccttgcagctctattcacagctagcaacaagaaggaggcttacacatgcatgtgcacggtctctgccggacgcat

SEQ ID NO: 36247 - DNA, 1501 bp, Oryza sativa
tgtaaaattaccacgacgcaccccatgcatcaccaaactattgctaatgtcacaaaactaaatcatcctacgggaggttgagaagggtccgcctacaaaattgccatagcacacccctcccaccttatggtacgtcacatagcccgcgtctacctaggacgatgtatatgccccaccctacgatagggctggaggtgtatatttttttacaaaactttaaaacggtaatttatttttaaaaatattttaattaatccggttaattttttcgtccgtcattaaaggatgggcccacgcgattttcgccggtaatgcgaatcgcgacgcgtgacggcgattttgacgctccacaaataaaaagagaaactgaaaaaaaagagagaaagctagcaagcagcccaactaaagcagcagcaggccggcccaacaaaaagcaaacgaagcctagcagtcagcccacatagcaaagcagcagcccagtacagtactgtgcgatactgtagcaaccgggaataagttcacttgaggtcccttaatttatcgccgaatatgaaatccatccctaaataaaaatgccaggtaacctcatcctttaacttacaataccttgtcaatttcgatccctcggcagtatcgtggccagttttaactaacatggcaagtgggccccacacgggtcacatgtcagtgcacaaataataccacattttgcctagcttgggcagcactagcttaaatagaaggcttgcctgaggctactacaccaaaaaaaaaggttggatccacgtctaccaagaatcatataaaaataacgagcaattttattaatttaaaaataaaaaatcacatgtattttttttaaaaaaacatgtgatcaccaacaaaatgaattatttatgacaaaataaattatttttagaaaatagaaaacaatcacatgtcttttttttaaaaaaatgtaatcaccaacagaatgaatcgtgtttacatccaatttttttctattcattgtatgatttccgtctaattttttgagtgaaaacgattatgcgattggagtgcaatgaggttgatctgatagatagcgagaaacatttcttatattattgctactctttacaatatgtaaaaaaaaggtgtttatcaatatcaagtaccaaaaaataaccatgtattgcaaccaactcataataatacatgacaaaagtaaatactttttgggtttcaaactttagtctataatacataattttattttaaagtggtaataatacttttcctataatcattcatgtcaatggatttagatcaacaaataattatgtcatgttagcatcttacttacaccggaaagattcgatttgctcctacacacccattactattgtttttgggactatctagagaactgtcgaaagttttttatggagaaaactttcaaatctaactataatataattacaatataatttcactatagctataatgtaactcatatata

SEQ ID NO: 36248 - DNA, 181 bp, Oryza sativa
ctcatagtggtagtagaaacgtggaggggtatatttgtccatagataataattcatataagggtattatcgtaaattattattcagtaactctaaaccttcgccattgtcaagcgcctgaccccatccatcgttgacttcgtcgcttgtccatctccctctccgcctccatcatttccagc

SEQ ID NO: 36249 - DNA, 1501 bp, Oryza sativa
cacgacgcagtggatgttgccggctgagtagcagaggagtactaacgccgcaaacaaagctacgagcatggcgagctacctgcacagtggtaaagcaagaaatacttagtacaggataaagcttttaaaaagctaccagtagcagctatattaaaaaggttatgaggatatcagcaccggcctgcacggctgcagttggtctcggttggaatctgactgtggatatgatctccgaacctctcgtgctacattttcgaaggaatcgtcgtcgcttcgtcagttgatttttctcgggctggcaccgtcgcgcacggcatggcggtctttctcgccgccttcatggcttgaccgccattgcagcggagacgaccttgaccccacaaaattttgagaaaatctcctgtaccctcgaaaattcgtttaatccccttacgtgcccataaattttatcccgttccccttgtgtgcccataaatcttgtcccgttccttatatacccctaagttcttactttgatcttctctatatccatttcgttaaatgtttttgaaattgactatattatctctctcttatacttatgtgctagtttagtgataaaaacacaattcttatatgaaaaagatctatttgtaaaaaaacaaagggaatataattatttgacaataaattttaaaaacaaatctaaaattttaaataaatttaaattaacttttatgaaactggtacactgttttcatcaaaatttgaatctaataaataaataattttggttcataatttctagctaaaactcatatggatttgtaaaaaaatgttcaacaatttaaattttcttttacatattttacaaaaaaaataattatgccccatttgattttatcatgaattacaattttttcacattgtgaattatggagtagatagcatgtaagtatgggaaatgggcgacatgatcattttagaaaaatctaacagtcaactaacggaatagggatagaagagatcaaaataaaaactcaagggcatatagagttttgagacaaaatttaggggtatagaagagattatgaaacttttcaggggtatgtagggaattttcaccaaaattttccctagcttcttccaaaattcatttctaaaccgaattaccagatataagaagtccctcaatttacaaaatcagatcacccgatgtcctaggcagtattgtgaccgattttaggtgtcttggcaagctgagtcactacgagacccatgtggaccccatatgtcattagctatcactttctttctctcccctctcccttctcttctccttgtctgtccagaacttgatccagcgtcgggccttcccggttgctaggttgcacagtccaggctcctgtgggtgtgggtggtggacgacgacgtgggagacggcaccggtgaggccatcgacgcggagagctagtgttggaggagtgcgcagtggagcggctccgctatgaaggcgtggagg

SEQ ID NO: 36250 - DNA, 1501 bp, Oryza sativa
gggatagaagagatcaaaataaaaactcaagggcatatagagttttgagacaaaatttaggggtatagaagagattatgaaacttttcaggggtatgtagggaattttcaccaaaattttccctagcttcttccaaaattcatttctaaaccgaattaccagatataagaagtccctcaatttacaaaatcagatcacccgatgtcctaggcagtattgtgaccgattttaggtgtcttggcaagctgagtcactacgagacccatgtggaccccatatgtcattagctatcactttctttctctcccctctcccttctcttctccttgtctgtccagaacttgatccagcgtcgggccttcccggttgctaggttgcacagtccaggctcctgtgggtgtgggtggtggacgacgacgtgggagacggcaccggtgaggccatcgacgcggagagctagtgttggaggagtgcgcagtggagcggctccgctatgaaggcgtggaggaggaacatcatgatgttcgcaccgtcgacggtgacgtcggatcactacactgggtacccaaaagtactggaggactatagtgattcaaactggatatctgatactaataagataaaggccacaagtggatatgtattcacacttggatatggcgctgttttctggaagtcttgaaagcagacgatcttaacgaggtcaacaatgaaagtagaactcacagctttagatactgcaacagttgaggccgagtggcttcgttagatcctgatggacttgtcggtggttgaaaaactagtaccagcaatcctgatgaactgtgataatcaaacagtaattattaaagtaaacaattcgaaggacaacatgaagtcatccaggcatgtacaaagaaaactgaagtttgtcagaaagcagaaaaactccagagtgatagcattggactatgtcaagacagctaaaaatctagcagatcagttcactaagggactatcacgtaatgcgatagacagtgcatcgagggagatgggtttgagacccacttgagttgcccaatagtggtaacctgtcctttgtgattggagatcccgtgaattaggatggagaaagaaactattgggtgactgagaggagagaccctgaaatgggctcatctctatgatgtacttctctcctattctgtatggaaggatggtatatacctcaatgtgatttgagtggcttttcgtaaagcagagatacctacagaacatcttagaaggaacatacctatataagtctaactgctagtcacagtctatgagatctagttgatctttatatactcatgaaaaggcttggaatatgatttatatgctccaaacaaaggggatgtaaacggcagcctagtaccagttaagagttcgagtgaaacctgatcgcacaaaactgacaattcaatgtatagtccattgttcagttgtgatctggtgtagctcttttcctaggtggaagttt

SEQ ID NO: 36251 - DNA, 1501 bp, Oryza sativa
agcacactttttaaacagctaaatggcatgtttcgtgtgaatattttctatataaaagttgctataaaatatcaaataaattcaatttccaaatttgcaataattaaaacttaattaatcatatgctaatagctttttgtttttcatgccttacttaatattcattttcattagtatcaaacaccactcgagtccctcgcaaaccacagccctgctcaatcagttcccccgcatgtccacttacaacgcccacgttaagtggcctaggagatccgtgcggcacacctcactggtgatggtgctgctagcacgactgccatggggcatgcgatagcggcggcgtgtgagaaggataaccaagcgaaatactgcaatctgcagttgcgatggctaggggtgggcagaaaaagaccgaaccgaaaagaccgagaccgagaccgagaaattcggtcatcaattcggtcctaggtagtgaaagactgaattttgttcggtcaattcggttagtctcctcgggtaaccgaatagaccgaattatcaaaaattatctaaaaacaacctacaatccactatgtttaataggattaaactctaattttcacatccctacttcttctaggcatgcaacctaataagagtctttactcataaagtgcttacgaattttttttgtgatttttgtgttgaaaatttccattatttctttgcatatatgaaaatgttgttgaatttcggtcaggaccgagaccgaatttgttggtcttgatattttttcactgaaattcggtctttatttttcaaagaccgaaaagatcgaaagatcaaagaccgagaccgaaattttcggttagaccgaatgcccacccgtagcgatggcggtcaagttctacatggtcgaagttgtctcgacataagttatcgtacactcttgtcactcgcactcctcctgcacaatttgagcttcaatttatcgatgtctttgtggtgaaatcccgtggttctatctaatgattttatttgaatggattagggtccaatttactgacaaattaaagttttttcaccttcatgcttaagttgggaatttcagaatggtccagactgggctaccccgtccctctacacttatcgcacagatatgaccgaaaaaggactatgggagggacaattgggacaaacatcctaaggcccggtttagttctttttttttttttccaaaaacgttacattgaatcttgggacacatgcatgaagcattaaatattaataaaagaaaaaaactaattgcacagtttgcatggaaatcacgagacgaatctttttagactaattagttcatgattagctataagtactacagtaacccacatgtactaatgacggattaattaggctcaaaagattcgtctcgcggtttccaggcgagttatgaaattagtttttttattcgtgcccgaaaaccccttctgaaatcgggtcaaacgtccgatgtgacacccaa

SEQ ID NO: 36252 - DNA, 1501 bp, Oryza sativa
atatttacattctgctacagcctttgtgatagctgatcgatggagagatgcatgtgacctatctttggttgcttacaacaacttgagatgttacctttctaattagctaatcattagcagttaatgatgcgcatcttgattaacttcttgatagaccactttggcctatatcagggtcctcaaaaaccatactcctgcacagaattaattgcaaattgctggaccactattggtcgttcccatccacaagaacctggctcaccgtacatacatttttccctcttagaagaaagacggaaccacataaaaaaagacatgactacacagctagtggtagctggttctatatctatgagagactctatccacctatatttcaaataaaattttctcttaaactactcatccgatctacgatccgattacaccgttgtgttcgtaataattaaatctttataacaagatctcacatgattatattttgatgaaaaatcataaattacttttatgatatgtctaaattacttttagatttcactaagttacttcttagacatataaaagtaaattcagcaaagcctaaaggtaatttacatatattatagaagtaacttagaacaaaagaaagtaactttaatgcatgcatttttcattggacatgactacacacctagtcgtagctggtttatactccatctagtgtctcctttcaatttgaaaaatgcaatagtatgtatcttatgtgtgttgaagttatcattgaacttacttttaaaatttgttaaacctatgtgtgttgatctgtactgattaaataaagttttctatataaattcatattttatccctacaatgaatttacttctaatgtcgtgacaaagttacttccgttttattttaatttacttttataatatatataaattacttttagactttattaaatttacttttatatgtctaagaagtaatttagtcaaatctaaaagtaacttttatatatatatatatatatatatatatatatatatatatgataaaagtaacttacgtatataataaaaataatttacaaatataaatattttttcatcgtaatataatcatgtaagattttgttgtgaagatttaattgtaacgaacacaatggtgtaattggattatagatcggataagtaatttgagagaaaattttatttgaagagaaaaaaggcatacatgtctatctcagtccttcctactacgtgggtgtgtcagcctctctgcagtcaaatactagtggagaaagcgataacgtaagccgaaaataaatagataatgagatcggacggtcggaggtgcgtcgcacgattagactaaaacgagagcgcgcactgtttagattttacgtaacaaaaagaggttaaggctaaactcaagatctcgctagttgctagccgtccatttcgtaacactccaaccgaaagctttagctgatctgattagcagtagtgtcgaaaca

SEQ ID NO: 36253 - DNA, 1501 bp, Oryza sativa
gagccatgtgggctgtccacggatggcccgtttactcgttcctctctgggctgtcagtttctttttcgcctcccctatatatggatctctccgcctctactccgctgttggattggaacagtcgctctcaggctagtcgccgtcggttccaatccaataaccacgccgttccggtcgcgctgcaccgccgtccgccgcggccgccgccgcccggcgcccgcggttagcctagggtcagtttcggacagcggccagcgcgtccggcactatcatggtgagtgttgtgaaactgaaaggttttttttttctgttccaatttcaagttcggaagccacgatctcacaattgaaaatctcctttattaatctcatcaacaagatcacaacatttgatctcactgattttctcgatttcttccctgccttccccggcgccaatatatgaaatttgatttccgcattttcccctttgaccattttcaactctagacgttgccctacaaagataaattgctgagatacatcatacatgtagattaactctagttctacccagattttgctcccgtttcctccgccgtgccgtacgagaggggcatcctctccgacgagatattgtgttatggactattaattccttgtttgttgctgtgtgataatattcggctaccttgtcccttttagattctttgttcttcattgttcatagccagatactttcgtctagtatttattatggctagtcaattgaatcagttcataagtaacaattaatttgttgatcagtagcacaaataacatatacattttttaagataacgagaaaaaattcattaaaaatgaattacacgtaacctctacatcaaccagggatgcctagaaaagaaaaataataaccctaatacagacatgaacatttcgtgtcttatagtaactcacccaagtacaaccaagacaataacacaaaaaataatatactccctccatctcaaaataagttgattcacagagttcaaaatttgtttggaaagttgtattcctaaactcttcaatacctcttgtctatccaccaaccatctccgattaatgaggaacttagtcattttccctccttactaaaatcttcttgggatgaggaattattttattttgggacactgggagtagacctaagcctagttaattgttttagatatggtatttgatcaggtttataaattacactttcacaatactatatttggcgtcaggacaaacgatctgtctaagctgtatgcttagccgttaaatactgatgctggtaataaatacttgatgtttagaggtcaaaattgtgaaactttggccatcagttttatattaaaatgtgtttatgatattgtgattagtacttttcgagataaatctatgcacattattatttttacttaaaactaagcatttgaaaaattatctatggttaaagtatattttcaatatggaccaaatattttcctacacgt

SEQ ID NO: 36254 - DNA, 1215 bp, Oryza sativa
tgaaaattcacacagcaaaatagctataaagaagcttgtatgttgtgaataaagaaatttccaaagtattgggcatacgccatgcgcacactgctttaacagatgtgcttaagtccctagaagacacatggttccaccacacctggaaatatatggcatatgtggtataaaatccgagtaaataaactcataaaggatttaccaaccgcctgaaaaatgaccacaatatataatcagcctaagccataatattggtcaataaaaatgcacacttacgtggcaaaaagcaatgatattgtatccaatcaattgcttaaaaacccaaacagcaccatgactatataaaaaagccagcggggcagctatataaagctttactgtttgacaccttttaagatgcattgtaccaactcctaaaaagttgagtaactgcggtataaaaggattttaaggtattgggcacttgatcacgcgcactttggcctaagcaaaaagtgcctaagtccctaaaagaacgtgacaggccacacctgaaaatatgggctgcagacatattaggcctaggccaaaaaatatgccttcgacaccctttaaaggatgacgcatgtaacatggtcccgaataacaaatcttttggtaatataaaccaagtgtagttaatatgaatagcttctgatctgaatgattatcccttatgggatactccaaaataggtgtaacaattgaatcccgactggcgcaagtattcggttgatagcccttacggggaataataattggtccagtctttgagcatagaaaatagactcatgactatgaatccatgtggaatgtatccggaacaagtccaaattggaaatataatcctcacgcttgagttgataagcccctgagcatatagcttgtccttctgtcgtagtcacaatcgtccattgatggtagctgacgcagttggcatatagacaagacgaccaatatagagataatattgcccaccagaggtggcaacaatactggtggtagtgaagatagtgataccaatctaaagtaatgaagtcgcatagccatggaggcgaagaaaccagtcggcggcagacagataactaacaatgaagatgaaggaacccagcgataaaattgtgtagccatggcagcaaaataatcagtcggtgacagacgaggtagatcaaaggtgatgacaaaatccaccaatca

SEQ ID NO: 36255 - DNA, 1501 bp, Oryza sativa
atcagtagtggtaggctgtataaaccagatgtagagacgagggcactagttagcagcagacgagacgaccggcgatgaagatggtaaggccaatcaacactggcagaatcatgcagccatggaagtgaagaaaccagtcggcagtcatggcaaacgtaggcagcttgtgttgaagatactgatgcctattagtagtgacagcgatgtagccagccgtgaagaagatagcatcagttggcgttataacaggccatccgtgcaagcggtgacaccagtcagcggcggatgcggcggccggccggtgaagacgtagacgcccaacaacggcagcataataggccagccgtgcaggcggaagcaccagtcggcggcggacgaggcggccggtcggtgaagacgtagacgcccaacaacggcggcataaaggccagccgtgcaggcggaaacaccagtcggcggcggcgaaggcaagccggtcggtgaagacgtagacgcccaacaacggcggcataaaagccagccgtgcaggcgaggacatcggtcggcggcgacgaaggcaagccggtcggtgaagacgtaggcgcccaacaacggcggcataataggccagccgcgcaggcgaggacaccagtcggcggcgacgaaggcaagccggtcggtgaagacgtagacgcccaactacggcggcataaaggccagccgtgcaagcggaaacaccagtcggcggcggcgaaggcaagccggtcggtgaagacgtagacgcccaacaacggcggcataataggccagccgtgcaggcggaaacaccagtcggcggcggtcgaggcgagccggtggtgatgttctgactgatccattcctggagcgtaagagataagcttaaagccatgaatcccttttatgcatatctggatttggatcctgcagaacaaacatataggatgagtagtatctgatataaatataatactcgagaaaaaatcaagtattttaaaatatttataaatatgtatttctcctcttgtcaattttgatttccccgagcagatgactcattacgtttaaacactctgcccgactagtcatagccaccaagcactgggagtcggcctaagcacttcccaaacatgcatatgagtgacatgagttcgtcattaatggaacaaagtttcacggatcggagtttactactcgggtacttttgcaattattaagagcagaaaataaattatctttctctatgcttttgatttattccgaataatacttagcaccttgcgttactcggtccatccaacgagcccccgggtgctaggaatcggcccaaaggcaaccatccattggcaaaccaaacggaaagcataggaagatagaactccataactcgataggtatttttgtactcagattatgtcgcaagcaatcaagataaatattataaaaaatatgatataacatctgtagcccccgactcactactcaatggaagaccaattggtgt

SEQ ID NO: 36256 - DNA, 1501 bp, Oryza sativa; identical to SEQ ID NO: 35642

SEQ ID NO: 36257 - DNA, 169 bp, Oryza sativa
ttgcattctattagttacctactataaacatcaagattttgcccttacgataatttaattattttccccacttgttgaaaatatgtatagcaatgcacttttataacataaaaccagttgcgaagtgatggggaaaaaactaacatttttttcttctatcaatcttagg

SEQ ID NO: 36258 - DNA, 398 bp, Oryza sativa
aatagaatttcccattctcatattttactacatggactatgcagtagcaaaacaaataaaaacaacgtatacagttgtactacttttcttcaaaaaaagcaccttgagttccatttcttgtgctacagtattctgttagtggtactctggtacattcagtttcatagctttatccattcatattacaaagtgatcactccactcttgaatatcatattgcaactagaaaaccaccagtccagacttgttaaaaaaaagtcacatctgttcgtttcagcaacaattatactgcgattctccacatcccaatcctttatttattcaatggtggatcattgcttcttttcttttcgaacaagccgtacagttttattcttattttatttttattttttaga

SEQ ID NO: 36259 - DNA, 1501 bp, Oryza sativa
gcgtgctgcagtggaggcttacattgtacaataactgcaaattgtgaccgatcgggtgattttgagttctggttagtgcgatacaataagtgatattttctctattgtttgcaagtgcatttgagttagttatcggtttgcgcctagatctctcttcctcttcctctatctgggacggaaattgcaatgcatatgacccaattgtctaacccacgtacaactgaatttgatcaatagttgtaaacggttgcagtgtgtataaacatgctctcttttggttgatctatgatagcatgtttttagttgtacaactcatatgggcctctggtttctggatatccccagttggccatagtgctgtactgctgtccaaataaggcaggccaaatcgttgccggcccaggcacggctgtagcaggctggctaatgggccgggccgtgtctgggcggccacaacggcagggcgttccaaaacaagcatggcaccggcacgactcggcactgtctcgtaaaacaaacgagggtacaactaagtacagaatctttggaactggagctagctagcacgcatgggcccctaatgatcaagcgacagtgacccaaggaagcagtagcctccattccaaagcctgtgcaaggcaacatcacaaagctgatcacctccacaatgatcggcgacggcatgcagccgcagggcaagtaaccgagaaaatttgtcggtcgtcgattccctcacgcgagcgtgaaaatggatggccatgattcgcgcaatcacgcccgctaagctgatcccgtctccaagatactctcgaaagacagattttctcgagtgaaataatacgcaatcatagacaccaagacatccccacgctagctaactatagcaggttgtcccgtgtccaccctagtaccccgtctcaaattatagcgcagccccgttttaacaaaaatcaaactcggtagctattaactaataattatattaattatatctacactaagtatgttgtatcactagattaatactttaaagtactttcaaattactttcatgtgatactaattttatatttgttaaaatactagttaaagtatgttattaaaaaccgtgtaaaaaaatatagagcttataattgggggacagagtgagtacgttattactgtcccacactgggagatcggtctcatcttagccgtccgtggccgatgaacggtctggatttcatgccgggagcaacagaaatttaaggtaattgaatttttagataatggaatatagtatcccggcctaatttaaggtaatcgatgatgatgaataataggttagcgtgagagtagagatttcatgggagaggggaagtgtgtgtggtgtggccgcatgattgctcgtgatgccggcgatgcaacgcactgcggggctgcagctagcctcctcctcgtctccatctgaaacaaactcatcatcaggagcatatcatcaatccggtggagacgatgatca

SEQ ID NO: 36260 - DNA, 1501 bp, Oryza sativa
atccgacgacggaggcggcgccgcgagacgacgagccggcgaggatgaacggtgaagacgacgacggacaccggcggtgttcagggggaggggaggcgaggccgagggcgaccttgccgctgcgatgccggaggtggagacggcgacgtcggccggcacacgggcacggcggaaggggttgccgaaggaactccagcgaggcggatggaaaggccggcgcggcacgacggcgttccggcgaaaccgagggcaggccggggtggagggcgatgcggcgatgtcgagggaggatggcgacgacgacagccgctgcaccggcgaggcggcacaggcggctggaggtggtataatggcggcaacgccactggacgacggcgggaacgcgcctccggcggtcaccgcgcgaaacggagggcaggccatgggagaggaggcggctacgaggccggggaaggcgacggcacggccggccggcgcacggtcgaggagggagaggcggctggaggcgcccggcgcgggggaaagagaagggccacggtggggaggtggctagggaccacaggagatcgcgggagggggctaaaacgagagaacggggcgagggggttccattttataggagaggagagggagccggccacgggggaggtcggaacggcggcggaaaaggcggccggcgaccatggaaggtggccggagttggcgcgggcattcccggcgattgggggcacgattcaagggggaaattggggggaattgaagaggattcaatggggattaaaaccccccaattaatttggaaagagccggcttgaatggggtggatttggaggaggaacggcgctaggtttgcacgtgagagagaagaggccggctgggggaggaagacgggtccgacaggcgggacccgcctgccaggcgcggtcaacgcgcgtgggcgcgcgcgtgacaggcgcgtgcggcgcggctagggatggcaacgggtgcatacccatcgggttctcttgccccatacccacacccgtgacgtctaaatattcccacttaaatacccacacccatcacgagtagaaaatcttccccatacccacacccgtgcgggtaacgggtatccaatgggtacccatacccatatagttgacttgtagcatttatagttttgtactataattagccatattagagttgtaaaccatcaatattttctctagcaacaatctattaacattatgtcgtaggctctccggaccttccattataattgagagatgaagtgaataattcaagtcatcaaacaagcataatgaaatatccgacgcctcgagagaggaatattggagatattgctaggcctttagcctgccagtcaacttcagcctgagatgtgcccgtcaaaccactcgaaggcggcgaccagatgtgttacacattcaggagacttgacaaaaatggctaaagttctacatctcaaatattcctaactcatactcatgtgaatcta

SEQ ID NO: 36261 - DNA, 1501 bp, Oryza sativa
ataactcataacaaaataaattataattacgtaaatttttttgaataagacgaatggtcaaacatgtgagaaaaagtcaacgacgtcatctattaaagaaaagagggagtgtactccctccgtccttaaaaaaaagcaatcttagatgaggatttgacctcacctaggacaatgaatctggacaacctcatgtccaaattcgttatactaagtgatgttaaatcactaactaggttgttttttttaggacagagggagtaacgcataaccatcactaacgtaaatatcaagaaaaataatttaatcacctcctcgattaaatcatctcaatgcatataagcagtgtgattgatgttaatttgaaggtagaagatttaaaacaaatcaaaatttagaggagaaagagatctgtctagttaatgtatgtcggtatacacgttttatattatgagattcgaagaaaaaattggttgtcttatattttacgacggaaaaagtatgaggtagttaactcctaaacaatactccctccataaaaaaaaatcaacttctactgtttaaattttgtctaaaaaaatcaacttgtaccatcttatctactcccaactagtaaaatgagaatttttatcacttcaatactctttacctatctatcactcttactgtttttttaataaccaagagtattttagtcattcttcatcttcactaattttttttgttggaatgctagaagtggattttttttatcggagtacgttacaacagcgtacatccgaaacaattaggagcaggctgggcacgcgtatggttaaaattgttaaatttaacaaaacctcgatatcagcaaaatccatgattaaattgtcagggcaccatgacttaagcatgaccagtgcattgtgatattggcaccataaattttctagagctgccccaagaaatatgtaatcaaagaattggcgccgttcacccggaatatttagcctgacagcaggtgatcacgttgacatgtttaggctgtgtggtttgatcatggtcggtgcttaattaggttaatacaaacgatagtacgtactgcatgcagacgtgcagacgtgattcccggagaacgatgctcacgcgcaggagccaggaccaaaccgaccgtctgccggtgagatgcgtatatcgtacaaataattacatatggcaacgtgcttggtaggctatcgcttaaccatcctgttcatgacttacactggtggagaaatccttcgtagtcccggttcgtaacctccctttagtcccggtttccaaaccgggactaccaatccgggactaaagatcgctatctttagtcccgggtaaaataaccgggactaaagatctatctttagtcccggttgatagccccaaccgggactaaagatggctcagccgtcccggttggtgttatcaaccgggactaaagatcgagctgacctttttttttttgcatgaccctgttgctgcatggttt

SEQ ID NO: 36262 - DNA, 555 bp, Oryza sativa
ttaaaagtcacttagttgcccaaagccattttataaagacgatcctagagctacacagtattattaatcaaggccgtgaacccacacgaacctgccttaacccaaggcctacgatgattcagaccgaactggcaacccgaccctgggtcccagctcgtcccaagccaacccaggccaaccattccacattttagttattaagcaggttttaagaatttaaaacactaacttgggtacattgctaggcttgcccataaccgagggcgcggctattcgaataggttttactctgatcagaggtgtacatctttacccacaagacacgtcttcctcacgtgcaaccacgtgccacataccaccacggcatatggacggaagacatgacatagtttccaacccatcctagccatagacaagagtaccgacccaacccacctacggccggaacccccagacaggcaggcagaattgagcccctagcagcaggacaccaaccctgtgccatgacatctcgactaccgggccacagcccgtgtagccttcatttgtcctaga

SEQ ID NO: 36263 - DNA, 1205 bp, Oryza sativa
ttgaaagcaaatccgttttgaatgtgttttatgcaaataaaatttgctttatgctaaaaagaaccatactatgccttccttgattatataccttgcaagtagggtgtaggcttgtcttggtgcttgccagtacattatttctaataatgtactgactcttgctgtggaattaacttttgcttgcaggatttagacttagtctttgagtgatgcgggttatcgactgcttcttctaggacttgaacataatgggtaaacccctagtcggtgtgcttgtggattgggtagacaagtttccgctgttctattatttatttggccggtcggccaatgtaactaaagtagatgtagtttttaatcgctttcatcttatttgtgtttgctatgtataatcatgcttgagatgaaagtgtgaatctagtgcacatcctgggaactagattcacatgagtatgagttaggaatatttgagatgtagaactttagccatttttgtcaagtctcctgaatgtgtaacacatctggtcgccgccttcgagtggtttgacgggcacatctcaggctgaagttgactggcaggctaaaggcctagcaatatctccaatattcctctctcgaggcgtcggatatttcattatgcttgtttgatgacttgaattattcacttcatctctcaattataatggaaggtccggagagcctacgacataatgttaatagattgttgctagagaaaatattgatggtttacaactctaatatggctaattatagtacaaaactataaatgctacaagtcaactatatgggtatgggtacccattggatacccgttacccgcacgggtgtgggtatggggaagattttctactcgtgatgggtgtgggtatttaagtgggaatatttagacgtcacgggtgtgggtatggggcaagagaacccgatgggtatgcacccgttgccatccctagccgcgccgcacgcgcctgtcacgcgcgcgcccacgcgcgttgaccgcgcctggcaggcgggtcccgcctgtcggacccgtcttcctcccccagccggcctcttctctctcacgtgcaaacctagcgccgttcctcctccaaatccaccccattcaagccggctctttccaaattaattggggggttttaatccccattgaatcctcttcaattccccccaatttcccccttgaa

SEQ ID NO: 36264 - DNA, 1018 bp, Oryza sativa
tccagaatcgtagtactaagatgtgtcacagttatctaaaagcccttatattttgcgacttagggagtagcacttatatagaatgaatgatgccgtatcgtgtataaccatgagctaagctaatgttttgtaagaaaggagaaagaaacagagaggcgtgactgcacaacacaagctttctttgatttccaagctcttatcttttccatatccatgagaccaagagctaatcccatgctacctgctggatggaacttggaacacttgcacctgatctgaatcattgagtttagacatgtggtgtcccactgctcccgttcgctttatcgtttctatcgaatgcgacgtttttattgcttttggctcccccctagatccatccatgatagcccatggttctcggatcaggatgcgagcaccggcttagtcgggatgacatgagtgaaaaaataatccttcagattagcataggtcgtctgaagaaagttcaccatctatcatctgatctgagaagaaacagaagataaggcaaatggccctgggtccatgccaagattgtgatggtaatgttaatctactgaatcagccgcagtctgtattggagacgcatgcggatcttcgcgtgatttttttggctgcaagtagggacaagttgctgtcatgatgtagtaattctgaaaggttggatgagttctaaccggcaaccgccagccgttatgaagagacaaagcgacacgatcgggagatgcttagctcgccattgttgacattttggagaaagtggagtattatatctatgattaatagtgtgtggttgtctggtgacatcactagattatagtacagtagaaaagtttcagaactgggcggctgcttgatggagcagaggaaatttggcactctgaaagataaaattttaatatcaaagtcaaacaattgatgcacgtaacaatttagcatgaatttttatatcgtatcaggatctgctgattcaaaaaattgaaaaactttggattga

SEQ ID NO: 36265 - DNA, 1501 bp, Oryza sativa
gtcgtcttcaccgttcatcctcgccggctcgtcgtctcgcggcgccgcctccgtcgtcggattcgcagcggcgcgttccacgtcgtccccgtctccgtgcagctgccgccggctgccctcgtcgcctcctcgccggccccgggcgtcgtcgtcgtcgtcctctcgtcgttcccggtcgtcgtggcgttcgtccctccgtcgagccattctcgtccgtcgtccgcgttcgtcaagcgagccgctgcagccccgtcgtcgtcttcgtcctcggcttcgcatcgtcaagcgttgcgccggccgcgtctcgccttcgtccaaggatcgccgccgaagtcattccctcaccgtccgtctccgcctcgcccgttcgtcgttgtcgttcccacgcctcgtcgcgtggtggtaaggatccctctccctcgctgccccgtcctcgtcctttcggtgtcgcccatgcctattgtgcggttgtcggccccggtacccgtgtatcggtgtcggcagtcgttcgcttgtgcgtgtggtgaccgtgttagtgtgtccgctcagtagcagcgtggtttccacgtgtgcagcccgtgtggtgtctagtggagtccgtttgtcggccactcgcctcggttgacacacaggatccgcttccgtcgacccgtggaccgtctctgtgtactcggtctaccgcggtcctttatgttgacatgtgaggtccgcatgtcaacagcgcagccttcctgtcttttccaggttagcgcttacacatgttttgtagttgcaaaaccaaattacaataatccgtaaatctccatgtaacagcattaaacttcggatgatcatatcttggtcatacgaactctgaatcgacccgttcaagtctcctaatgtttgttataacctaaagaaccgtgtgctttctttttatgtattgttattgcttctttataggcttgtagctttgcttgtgtgcttcgcgtagcttctgtcgttccggaggttctcgaagcgtggtttgcggtcgtcgccgagggtttggaaggccgttctctctgagcaaggcaagtcacatcatccttgagcatattgaatcccagtttataaaattattttgatttaaattaatgcattatcgttttatttaaattcccgcgttatcactgttttatttagccatgcctatttacctttgttatgatattattattgctattgttattattaccttgttcaccctagaataaacaaaaccccaactagtgggcactctattcatggttccactagtatgaatttaggtagatgcttcgctaattaattaggcaacattaggtggttttataactctagactttgggaatattcatatcacttggacactatggaatggttggattattgtggaattggatgcacacctccccctctattcaaaaccctcaaaatggttttaggctgggctcggggtgcatggttttgatagtagcacctcggccacataaggaccggt

SEQ ID NO: 36266 - DNA, 1265 bp, Oryza sativa
tcactttaaagttcatatttgtcatatcaatcacatcaaatcaaaattttctccattctactctctgcctaccaaccatatattccctccgtttcataatgtaagtcattctagcatttcctacattcatattgatgttattgaatctagacatatatatctatctatattcattaacatcaatatgaatgtgggaaatgctagaatgacttatattgtgaaacggaggaagtatcatttaatagagagtattatactacctccgtttcaggttataagactttctagcattgcccgcattcatatatgtgttaatgaatctaggcacatatatgtctagattcattaatatatatatatatatatatatatatatatatatatatgaatatgggcaatactagaaagtcttataatgtgaaacggaataagtagtcatttttgctaaatagagagtattagcagagaaggatgataggtatattgggatggaggtagtagtatagtagcctcggaaatatctacagcaatctaaccttgtggaaatttatacatatgaggttccgtaacacgatgtgaattcagttatataaagaaagatttctttaaacttgtcattactcttcccatcctagatgagacgtatcctagattattatattttagaacggagttagaattattatgccacgcttacaatctcttaaaactttctaaatcaaaccttacttcaataattctttaagctatttattaactttgtcatatttgttccatttatacgactaatttttctgtctacaatttatccaattatcctgtcggaccccgtcctctgaaaacaaatcatcctagcaacaagatctacttatcaccgagcgcgaatcttaaagctttagagtatcagagtcagaaactgatcaccaggcgtgaatcttaaagcgaaagcgagccgaaaacagggatataatccgaacaataaccaaagccaccaaaaaacgtgaaaagtaattgaaaacctagtttacccgcaccgtccgatctcccgagacgactcgccgaccaccgtccgttctacctataaatccacgcggcccgagccaccgaaaaatccagccaagaggggaaaaaaaaagggaaggaatttttttcttttttttttgttcgcctccgcttcttcctcacgcagctctcgcctcgcctcgccgcccgccactagagaggagagggagaaggaggaggaggcaaatcccagcaaaagaaga

SEQ ID NO: 36267 - DNA, 157 bp, Oryza sativa
caaaattaattcgtctagtgcatggattgatgaaccgttggtgttgattcgttgtcagatttttacttctttgtcatttcgatgtttctgttcgggtaatccaatccccatgttctgctcttgccggcgaatccccttctcttcgcggattgcaggc

SEQ ID NO: 36268 - DNA, 323 bp, Oryza sativa
gcatatagcttgcccttctgtcgtggtcacaatcgtccattgatggtagctgacgcagttggcatatagacaagacgaccaatatagagataatattgcccaccagaggtggcaacaatactggtggtagtgaagatagtgataccaatctaaagtaatgaagtcgcatagccatggaggcgaagaaaccagtcggcggcagacagatcaactaacaatgaagatgaaggaacccagcgataaaattgtgtagccatggcagcaaaataatcagtcggtgacagacgaggtagatcaaaggtgatgacaaaatccaccaatca

SEQ ID NO: 36269 - DNA, 434 bp, Oryza sativa
tacaagccgggaaatatatcttaattaagttgtgaaaaaaaaaactaaaattgctagctgtgtcaatgactacgtctttttgaatattctgcacaagtctatctgttctggtattttggaattgtcaagttctttccagcaggtttatgataatattttgtggaatgtttttggagacttaaatgtatatttactgataattttgaaacacgtatatatgataacatggaaaatctggttacgtatggaatatgagcaatagattacaaacaatgccctatctaattaattagtgcaagaagaccaataccactagcccacaccttgctagtgtatatctattgtactatctaccatcagtaagggtgatggttatatcatttctgctgcacgatacatcgacatctactgatacatctaatctgatatgtgag

SEQ ID NO: 36270 - DNA, 1501 bp, Oryza sativa
ttggacattagtggctaacagatgcatgcgtgtcctgattaccaactctagtggcgcctttcgcatgcttttcttaagtgaactggaataaccggaaagcgaggtgtgcaaatgtgcagtctatttaacagccacctcatgttttcgtccattgtcgatagacagtgcatgtctttggcaagacctttataccttagaataataggaatgtgttttgttgttgtcatttgtttgagagagcgactgttcatgatttatgggcagccatatgctggttggatacgcatttgatttcagaatattgatctgagactgcctttaggctcatatactagtttttttttgcaccattctatggttatccaccattgatgtgtgtaatttgaaaaaaaataactccataagaaacgttaaaactaggtaaaagctattattagaattttttaggactattattatattatctagggaaaatatatgtttgtttttgcaatattatttgcttacggtttctattttatgcatgcagatatgtgatctcagacctcgcaacagatgtcattgtgcatgtcagcgaagtcaaattttacttacataaggttgggctcctaatatttctccacaactgcactgaagttaactcaaaagtattatatcttttctttagaatagtgacaaaggtagaaacaagcactgctgctagacatgtattacaacttacatatagtatatcctgaggcttagccgcataggtgctcaaacttaggatttcattttcatactctcagtaacagagcatattcactattcagcatttatgtttcacatctgattgttgctgcgctatcgctttccaataagctgcatactgtttcatgttaaatttttcattggcagtatctcaataaatgtttggtgtgattagtatttatttgtaaatattagaactatagtgaccttgtcatattttcgtttgcatggaaagtttctagcttaaagaaagtgatctatgctgcatgaaaagctgttgaatcaagtaaataataggctgcatggaccacttctgtacttgatcagttgatctctgtgctagcaacccttttgcaagtaattactgttgtgtgagatagctatttaagtcctgctgtgactatcagattgtttcaacaacaattatttgactgaaaatactacttaaagaaacagtaccttggaataagagggatacactgactagtgcaattctccaccttttaagaaaaaacaaactccgacattttgcattgtacaaacgttatttcttataaatgtttatgttttcttgctggtgaatggtgatgattggtattcagggaaatgtcttattgacaaacataactgaaaaaatatttttgattttgattgcttgtgcagtttccccttctgtccaagagcagcaagcttcagaggttagttattaaggccaccgaggaggggactgatgaggtccacatagatggct

SEQ ID NO: 36271 - DNA, 1501 bp, Oryza sativa
ccaacgagcacagcgggggagattggggaggtgagggccaaatggggacagcgtggcgagcacccttctcgccggcctcatcaagctcccatgtcgccgtggcctcctcgagctcctctgttgctggcatgtccaccttcctcgccacgacctccaggagatcctgccgccgccaccacaaggattaaagagagaaagagtagacaaaagttgaagatggtggttggccacttacaagtgggtcccgcatgacctttgcttttttattttattttttgctaactaggatgacatataggaaaccactctcaaatgctaccgatgaacttgatttgccctagttttagaagttggagcacgtcttgtaccaagttttgcggtcgaagaatgcaaatcaaacttgacttatattcgatcggacctaaagtgaacttattcctttatgcgctatgcaggctttgtcatatgttaccaaccaagttggctactttctttacagttctctttaagttttgagaggagtaacacaaattattcaaacttttacataaaaacaacgcatttgctattttgtagtcgcctgcaaaattttaatcgatcagtcaacttttgtgcgcgctatcgggctagtggaaaggctctttttttatatgggtcgtgcttttccatcaccttttccttgctaataagcccagagcccgcagcccacagcccacagcccacaaatagctctggaaaaatccaccacacccgtgactctctagagagcgcttctgcttctcgacgtttctgtttctcgagtaggaggcggagtcctgcgagcggaaggcgccggagattcttccaaggtaggcagtggaggggaaggggaggggggcggcgagaggtgggctgtgcaccgcgagcggccgcggacggcgccggagaagagaggcgggggagaggagttgatgcactgcaggtttttcatctctcttttttgttcaaatcctcacgccgtggcggcctgatttcctttggtccagatttctatcctgtggattgtgagctattagggctggattggctaccatttcaaggggggggaatcccgtggagtttgtttcattgcttgagttttgagttgattttgcccaatgtcgagtaaagcatcctggatctgaaaccacatggtgtgtgtgctttgatgttttgttcgatgtagtttgggaaatttttttagggttttactgcacatcgtgtatgatatagtcggcgggaggtgggctgtgcctctgcctggttctaaaccttggcactaattattttctctctaacttcatttgttagggagttttgcagtttcactagttggatctgatatatcatggaatgcacacacatggttttgctctagatttagtcgttaatcctgtagggcagtgatgacctctgtgccgtggcattttagaaaggggtttagggatttggtagcaattcgagctcaagaactaaccaatat

SEQ ID NO: 36272 - DNA, 186 bp, Oryza sativa
cctgcagccccctcaaacggcttttaagtcccagcccgtttgagatgacttctgccactgtatatatatgtctcctctcccagcgaggcccacatgaggagataaggccggccggctccctcttctccacttctcatctatctcttccacttattctctctatctctcctctctttctctgtgcca

SEQ ID NO: 36273 - DNA, 1501 bp, Oryza sativa
ggatcgtcccgttgagcaggttgctcgacaggttcatcagcgtgatgtttatcacgtcgccgatgtcggcggggatcgggccttcgatggcgttgagctccaggttgaggtgtgacatgttaggcggcagcagcgagccgagcaagctcggcagccgcccgccgatgcccagtgctccggcctcgatctccagtatgctggtgcagttcgacaccgcggcgaagaagggccccaggttggtgttgccgtcgccgctcgcgaaatggacgttgttcgacaaatgcaggtacctgaggttgcgcaagccggagatgatggaggtcggcagatcgtcggcgagcgagttattctccacgtccagcaggtagagaatagtgcagttggcgagccaccgcggaagcctcccggtgaggctgttggagtagagattaaggacggcgaacctgtcggaaaggctatccgaggcgtcgccggggatctcgccggtgatgttgttgtcgccgaggtcgaatacacccatttgcgtgcaatttgtgaagatcgtggcggggatagaacctgacaaggagttcttctcgaggctgaggtagaacaagttcttcagctgggtgaatgacgccggtatgctgccgacgaggttgttctggccgaggttgaggccttcgagcttgccgatgttggagagctcttctgggattcggcctgtgagaacattgatggacatatcaaggatctcgaggttcgtgaggttgccgaaggacggcgggatggcgccggagagctggtttttcgatatgtcgagcttccggagttgcgtgaggttgccgaaagacggcgggatggcgccggagagttgattctcggacatgtcgagcatcaggagttgcgtgaggttgctgaggaatgaggggacggcgccggagatgtggttgtcggacaggtcgaggtaccggaggtgcggcagctgggcgagcgccagcgggatggagccgttgatgctcatgttggagagctgaaggccgacgacgtgctgccgcctccggtcgcaggcgacgccggtgaagccgcacacgtcggtgttggagtcgttccaatcagcaagcagcttcggcgacagcaacgtgaggccccgcttcaaggccagcagcgtggccttctcctgcatcagagcctggagccgccgccgctgccgccacccgccgacgatcgcctcggctggccgacgcctatccaccgcggcagccgctgcggcgatgacgaacacgagatgtaggaggaggaggaggacggccgtgcgccgcacgaccatgggaggagccctcgccctcgccctctcccctaaagccatgtacttaagccagtggtggtgcccttgctggtgcgctccttgctagcagctagctagagcgctagctagcatctctgatctagtagaggcatagatgaagctcttcttcacgtacttggtagagagaaggcactgaagctgaagctggagagt

SEQ ID NO: 36274 - DNA, 1501 bp, Oryza sativa
atgacacagaccgatgcttttgcgaattgcgattactctcctctctcagtgatctactggtaatctcaaaaagattaaacataattgataggagcagagcctggagttcatttttagggaggcttatctcagattgatcactgatggaatggaagcaaaagtggcttagtatgtcacagttgagcaggagtatgtcacagttgagcaggactaccattaaaaaaaatacacagcacacaaaacaacagatagcttttgtctacaagcagaaaacacaactcctccctgtatacagtgacactgaaatcccaaaaaattgtggtatccctgtatacagtaacctctgattaaactccctgtataatctgacaatactggggacaaatgtaagaacatttgctgggatttaatgaaatattggttagttcttgagctcgaattgctaccaaatccctaaacccctttctaaaatgccacggcacagaggtcatcactgccctacaggattaacgactaaatctagagcaaaaccatgtgtgtgcattccatgatatatcagatccaactagtgaaactgcaaaactccctaacaaatgaagttagagagaaaataattagtgccaaggtttagaaccaggcagaggcacagcccacctcccgccgactatatcatacacgatgtgcagtaaaaccctaaaaaaatttcccaaactacatcgaacaaaacatcaaagcacacacaccatgtggtttcagatccaggatgctttactcgacattgggcaaaatcaactcaaaactcaagcaatgaaacaaactccacgggattccccccccttgaaatggtagccaatccagccctaatagctcacaatccacaggatagaaatctggaccaaaggaaatcaggccgccacggcgtgaggatttgaacaaaaaagagagatgaaaaacctgcagtgcatcaactcctctcccccgcctctcttctccggcgccgtccgcggccgctcgcggtgcacagcccacctctcgccgcccccctccccttcccctccactgcctaccttggaagaatctccggcgccttccgctcgcaggactccgcctcctactcgagaaacagaaacgtcgagaagcagaagcgctctctagagagtcacgggtgtggtggatttttccagagctatttgtgggctgtgggctgtgggctgcgggctctgggcttattagcaaggaaaaggtgatggaaaagcacgacccatataaaaaaagagcctttccactagcccgatagcgcgcacaaaagttgactgatcgattaaaattttgcaggcgactacaaaatagcaaatgcgttgtttttatgtaaaagtttgaataatttgtgttactcctctcaaaacttaaagagaactgtaaagaaagtagccaacttggttggtaacatatgacaaagcctgcatagcgcataaaggaataagttcactttaggtccgat

SEQ ID NO: 36275 - DNA, 455 bp, Oryza sativa
tcccacgccctctaccgagctctccacgccgatccccatcgccgccgctcgccggcgatctccagccgcccgccaccgccgctcccgtcgctgccgcgctgcgccgccaccacctatagcatcacaccaccccaccgcaccccggcatccactccatctccctcctccaccgccggaaccaccttcccatcgcgaggccgagccactaccgccacacaccgccttcagccggccgctgccgccgcgctagtcgtcgccgcacctcgccgcttgcgccgccggcaacgccgtgccaagctctaccccggcctccgctccgtttccccattccaccaccgcaaccacccttccaccgtgcatcccgagccacctccaccatacgccggctccagccgggggccaccgtcgccttagccgccgccgtgtcgctccgtcttaacctctcgcctcgcagc

SEQ ID NO: 36276 - DNA, 1501 bp, Oryza sativa
caagtgggggaaagtgggaatcggtggggcccacagcaaatagccccaattagcacccctgggggtgataattttttggggtgggctatttgcaaatggccctaaaatagctctcatgtttggatccccttgagctattttaaggctaaaaggggtgggctaaaaaaaatccataggatccaaacacccccaatgttttggtttaggcccaaagcctcaaattagctaggccatctaactggattatgctagcttaaacagttttatcaacagagatctacctggtccaaacttgcttcttatctagccagattagcctcgcaactgaacacactaaatcaatttttgcatgttgcttaacaggctccagttttggtttttatcgttttaatcacttccctgttgagaacactgtatggaatggaaaccaagttgattctgtccatgcatcctgcaggctgcctggcaaacaccacacaccactcaccggtgcaacccgcaagtgcagccgtgtgcaggtggaagacgaacagtattaggggagcttaagattttgaaaatcagttggtgagaagctcacgggtgagaatctggagactttaattcattttttgaattctaaaactataacttctcaaaatcagagtgaaaatttggactgtttggggaaagcttttggtatctgcagattccagaaaaatctctagctgcgagaagctctcccaaacaggctcaaaacccgcagttagctagcgtgcgccaagcccctcctacattccggtgcgcgcgcgccagcgcccggagcccaccgcgagtcgtcgaatgtgcgcagagccccgtccctttcgtccgatccctcggcgacttgcttccccggccggcagcctactcatcatgcacgaacccatcgccccaaaaaagagccgcgcatcgtgcgcagcataatcatagctatcgctgaaacgcctgcaccttcccctcctcctccattcgcttacctcgccattgacatcgcatcagctcttctccatctgtatctgtccgtttttctttcatccatctccgtcttttcgtgcaactctccagcttcagcttcagtgccttctctctaccaagtacgtgaagaagagcttcatctatgcctctactagatcagagatgctagctagcgctctagctagctgctagcaaggagcgcaccagcaagggcaccaccactggcttaagtacatggctttaggggagagggcgagggcgagggctcctcccatggtcgtgcggcgcacggccgtcctcctcctcctcctacatctcgtgttcgtcatcgccgcagcggctgccgcggtggataggcgtcggccagccgaggcgatcgtcggcgggtggcggcagcggcggcggctccaggctctgatgcaggagaaggccacgctgctggccttgaagcggggcctcacgttgctgtcgccgaagctgcttgctgattggaacgactccaaca

SEQ ID NO: 36277 - DNA, 1501 bp, Oryza sativa
caactccctttatgagatataaaattaacaaatcatagaggaaagccactatcatctttttctccaatgtttctcaattttatatctcataaacggaattgagtttatttttggaactttaaatggttgtctaatatcaacttagctatttgtgtgatctctttcaaaagatcagctgtttagctgggagggggtgtaggataaagctgtcctatatatgatatccaagaattaaaaaaaaaacactggctagtaaagtgtaaaaaaagaaatgtcaccaaatagaaacaacaacaaaaatattgctgtagtgtcaaacatgcctcgtccacatatatgcacaaacttcgcgccaccgcactaagctctaattattgctcggatggcgctattacttttgtacctatataagtgaggtcagcgccaagcttaatagcgctaaaccttacggatagggatttcgtgccaatgtgataatgttctaaacgctaaaaggtatgtgcgcggatacattatacttcagcgtcatcctcgacgatgttgaattgtgatttatttctaaaataatttcttggcacggttctttttgttgtaataagttaaaaaaaaccctaaattgtcaaaatttcggccactagttgggatattctgatctgatccctcatcaccgctagcagatctctgtaatctcaccactgaagcactgctgatcagcagccaccaccaccggtcacccctgcaggcctgcagctgctccaacggctttccccctccgtcacccactccctatccgcctatcccatcccaaaacctcctctcccctccccccccggcagccgccgcctccaaagttctctgctttcgtcaccgccagcctccctccaaggtaaaccacagcaccgaatgtgaatcttgcagttcgcgagctgaccagctgatctttttgtaaagaatcgtttggtcctgcacctcgctgatcgcggtctgtttcgctgttttgctatgatgcgcaggtattgttcgatccggagtagtgagtctatgcccttgtccggatccgaatggctgccctgcggatctgcacgccgggtggtggtgctccggaggccagaagaggcagtcttgctgctgccgggagcgcggttcagcatggaccggatttgatcgggttcagttcttgggtgctgccaatcagcgccggatatgccgtggaccggaggcacgcagcagctggtggagttgccgcatgccatgggctctcgtgtgctgacagtgggaggaggaagaatcatcccagggcaagtctggtgaatggtgtggtttcatctctggaggacagtagcggcggggagcctgcgctatgcgtatctgattcacctgaagacgctagctccagtggaaaagtgttgtccgatttgcgtcgggacatggtggatggtattagtggtattccaagaatttctgcgggaaagaagaaggggatgaagttcaggagaagagg

SEQ ID NO: 36278 - DNA, 376 bp, Oryza sativa
ttgaatgaaaaaggttcccaataattatctcccttgtacttgtaaaaacctcagttatgcttgaaatatgttaattccagactaaatattctcgttaccattggttcaagaattaagtggatcaaccataatacttcagggggttaattcaaccttttcctatacttttcgtggttgactacatttgtacgaagtaccttagtacttactgcaagtatattcatataaatctcaaggaagatattgtgtgttatttttgttttgtattgataattttctgtttcagtcaaactacgttactagtgttgttaatttcgatacaatgaaacatgctttctgtttcttttgagttatgttaacaaatgtgcttttcagg

SEQ ID NO: 36279 - DNA, 1501 bp, Oryza sativa
atggagagagcaggatgcgagtttgatcactatacttacaacattatgatcaatatatacgggagaaagggttggatcgaaggagttgcaaacgttcttgcggagctaaagagccgtggtggcgagccagatctgtacagttacaacaccttgataaaagcatacgggatagcaggaatgcctgaagatgctgttaaactgatgcaggagatgaggattaaaggcattgccgctgaccgagtaacctatactaaccttatagctgctctacagaggaatgagaatttcctggaagcagttaagtggtctctctggatgaagcaaactggagttgctgcaactcgaacatgatgtgcctaagaattcagagttttggttgcatgcaaattctggcatccgcacacgtttatatttcatctttcagtagagtacatacatacatgtgagtgacattgtacagagaactatttctgattgttctacacatcctatgggtaccggagattcagaaaaacctcctacctttccattctcttacaagatgaaactcaatcagtggatagcaagataggaacttttatcataccaatcatacaattgtaatttttttaccagaactggtttgaacttctgataataatgatcaaagattcattgagaaacccaagttcaatgtccattgtaccctctcatgtctgtcaatctgtcattgtaaaatctgtgcgctttctgcgatctcaattcaggcaacttttcccgcttgattttgacgtacctgaccaaatgttttcggtcagtttgtagttgtatggccttgtttagttacccaaaattttttctcaaaacatcacatcggatcttcgtatacatgcatggagcattaaatatagataaaaataaaaattaattgtacagttaggaggaaatcgcaagacaaattttttagcctaattagttcataattagccataagtgctacagtaacctatatatgctaatgacggattaattaggctcaaaagattcgactcgccgtttccaggcgagttatgaaattagttttttcatttgtgtccgaaaacccctttcaacatccagttaaacattcgatgtaacacctaaaattttttctttttacgaaagacccgatctccaaatttcaacctttcgtagtactactaaacggtcaaaaaaaagatgtgacggcaattccacttcctttgactatccatactaaaaagtcaaaaaaaaatttgccgaaaatgtcagcaacacctcgtcgcctccatgccttttagtcaacgcctcgccttgttcagatgcagcaggtgaggtgagagctccacctcccggagctcgaggcttccccggtgaacacctcctcccggacaaataaactaatccaaatgccgacctcgcttccggtgctcgagctcatcggcgaggcgtccgcacgtgcgccaagaacccctcatgagcaggtgaggtgatccttcaagaa

SEQ ID NO: 36280 - DNA, 1501 bp, Oryza sativa
tgctctattccattatctaaaaaaaagcatgtaatgtcacatagaaacgaatgtgtgatatataagacaatttgtgttgaaaattgaaggcacaaaacaagtttgaaagtacgaaattgcaacgaaaattagttgtaataaagttgtttgtcgacaaactttctgaaataaaaataacatcgaagcatgtgagggtggaaggagtattgaaattttaaagacttctatggtcccgttcgtttcttctgtaagaagtggatgaaaatttggattttcgtggcacgcttttcaaactactaaacggtatgtttcgtgcaaaaactttttatatgaaagttgttccaaaatatcagattaatcattttttaagtttgtaataattaaaacttaattaatcacatgttattaccaccttattttacgtgaaacactacaaacaccacctatatcttcaaaggagatttggataatggttttgtctagaaaacccccaaaacattttttttcatattatttggttgtggatgataacatttttcctaaatttcgaagtttcaaacttgaatgctactcttatatctttatatgtcgactcaccacaaatcctttatattgcaatattattaggacgcttggcaattaaaatactctatatcccataaaaataatccttgtataagatgtgatatattctaataccacgaaacaaaatgcgacacaaaatcatattattagaatatattatattttcgtactggttttattttttataggacgaaaaaaataacctatgggatggtgggagagataaaaccaagactctaatattctcatgttcccaaatcccacttcccacagccaaactttcatacaaacggaatcgaaaaaaaaaatccatccatttgccaactctcggtgtatcaatacacctttattgataattagatctttggttctgtcgttattcagttttttcaaccagattttaatgcttaacagtacacagtactccctctatttcatattacaagtcactatgatttttttctagtcaaaattttttaagtttaatcaagtttataagaaaatataacaacattttaatataaaacaaatatgttcaatattgtatttaatataattaatttggtattatatatgttgctattttttctacaaatttgatcgattaagagcaacttataatataaaaatattcataagaaaaacttgtacaagaagctgcttttcggtattaaagtttctgtccaaattggacagttgtgacagtcatcacctagcagaattaatcttgtctcccaaaagaaacaataatatagtagtaataaaaaaaataaacgttattcccatcgcattaatcctgctccacctttcctttccgcctataaaccccctcacgccctttctcccttctctgcacacacagaaattcacacccaagccgctgtcacaagcaaggcatccacacacacacagagag

SEQ ID NO: 36281 - DNA, 400 bp, Oryza sativa
tggacatgcatgtacagcaagctctgtccagcactgctcattttttgtacaacaaaactcatatacaacagcaattggaatgaagcaccccttgacaaatgaacaccacatacatttgtgattgtaatagtcaacaatcaaatgtacatcagcaaaacgacaatgaagttcaggagattagtcaataccgaacgattgagatactacatgatttagcttttgtggcgacgcaaggaaatgaaaacaattaagcatctacaaatgtggagtgaatagaaaacttggtatgttaagccctaatcacgtatggttgtctagcgaagtggcaggctacttaattaaggccaaatttaatattatagattttcatcttagctcaaggcatggtagctaagctaca

SEQ ID NO: 36282 - DNA, 1501 bp, Oryza sativa
aagctgctgttttcttgcgcccgtacgttgggggcgcctaatacgcaaccactctctcgagggcgcggtgggtttctccctctataagtctctcatgtatatacgtatctatatattttatatacatatgtataatacaaattagcagtttaatgcgcattgtataagcgtccatttgtaccattgcacctacagagatgtagcactttttttttcttgcgaggaatgatggcagggaaatatgaaaatggaaaagtctatacgtactaactttttcttactaaatttttactaacactgacatgtcatgctatgagtgcatctagattttttataacttccatctacttgaatcaaacggttgagatgattgttagtacaaatttagtaagaaaaatttagtacgtgtagcggtgctctatgaaaatatggagaaaccgttttaaaccatcaaggggatacccctcgtatgaaaaataaatgacaacactcatacagcatatatataaactactcacaccgtcacacatctatctatctatctattataacaccgtcaccgacaacactcagacagctttgaaaggagacaccatgttcgctgtgggggctaaaaattctcacattaatcggagaaaagaagaaaaaaaatagaccgttagatcataatagatccagattatagtggtatagattgatcaatagagttgtatataaaatacaatcatttatatggaaatttaaattaaataagagatactcctaatagatttacgggaaagcaatccgagtagaaccaagatagtgggcacaacaaatactaccgtaaatcaaatcaggtgcatgatcaataatagagcatgcgtgagcagaagtcccatttggactctatgcagtaatttcctatctcttactctctcattataataaataataaaaagaaaaagaaaaaaagaatccatatagaaatataatttaaaaataactgaaattcgtaattaaaagtaaacaatattggaagaagagtctatataagaacccaatataagattaaattaaatttgaaataaaaaataaaataaattccgaaattataaaatcaaacatagaaatatatacgatctgacttggattggactcctaaccaacgcagcttaatttgaataggacttattgtccgattgaggcaactcaacaagtgtaccctagcagcgttggttaaaataaatttcttcatagaagcacttctttttgtgtaccctagcagcgcttaaaattgacgtaagacatagacatgtatatacatgaacttatgtacagtgattattgccgccattactaccgccaagtacgtatcgtacatattaaaaacaaatgaaacacaatgcgggaataaattaaatttaaaatacaaatcaatacgaattctaaagcaaataaatttcataataaaaataaaataataatagcttagatacgttcaggagtgtgctactcttta

SEQ ID NO: 36283 - DNA, 280 bp, Oryza sativa
ggaaaaagaaaaagaaaaagaaaaaggaatttccctggaatttaaaattgcacttgctccattttaattggttaaaattatttctagagctctgaaaattccactaaaaatcctgttagtgaatttcgacatgtagaactcaagaaaaattccacatgtcaaatccgattattatttgcattgttttcttagggttttgtcctgatttcctctgcattttcttagggtcaattataaattacaattttgacttgggaggaaaactccggggtgtgacagc

SEQ ID NO: 36284 - DNA, 1501 bp, Oryza sativa
tcggagattacaccaccagacccgcctccgcggacgagaatttcccccatcaccatcagcgtgaaatgcaacggggcaacatctttcaccatcaccttctccgtgcgggtaatttatccccgtggagcctccatccccgcgagccttcatcctcggcgtcctcggtgccgccgagagaccgagacgagcggcgccgggacttggcggcgtgatggccttgcgcgagcgtgggcgcagcgagcggcagccttgcgtggatgacggcggcgctaggacctgctgaggcggcgcggcggccctgcgcggacgacggcggcggctggacctggcggcgcagcggccctgcgcgggcgcgggcgcggcggcatggggacctgctgcggtggcgccggaccctggcggcgcaacggccctgcgcggacgacggcagcgtcgggacctgctgcggtggccctgcgtgggctctggcgcgccgctagctacctatgacggcgtggggattggggacggaagggataagggattggaatggctagggttttgtaaatgctttatatactctatattttgggcctggtttttatgggccagatgggccaaatatacataataatactacatatacactattatgtcgggcctccacggagagcggggacgggggacggttaaccaaacccgcctccaccagacccaatggagggtgtttttgctccatttaatcctccgtggagacatattttataccaccctcgcctcataataggaggattcaccgtggagaatcggaggacgggaaccattgccatctctagtcctcatggaggcggtgatggccgacgcgtggaggaagcggggcggagcccgagatgtctggatcgcgaaggatggccggtacgccggtcggtgatgggcgcaagcacccggctttagcggcgaggccctccaggttgggtgccgagggcgatgacgacgtccagtgcggcgtccagcggccaccacgctcgcccacgccgtcgccttcggcttccacttctgggtcggcgccggcctcccctcccgcgtcgcaaccgccgccgcctcttcgccaccgcgctcgctcgccgacgccgcctcgctcagtctagagagaagaatgagagagagagagaggaggaaaggagaggaagggagaggctagcctattgacgtggcatcctgacatgtggggcccgcgtgggtcccatgttgactcagccatcatgtcggacaaaaccagggtcagaaccgtcgaaggacctagtttgcactggttttgtaagttcgggggtacgttgtatccggttttgtggttgggggatgatttagtaactcgaggacaagttgagggaccttcggtgtactttttccttccagcaaaccacgccaacagcccaacagtccatgaggcaacaaccgcgcgccgtggtggttggcccgacccaccgagcagaacacgatcgcggcgcccaaccccacgcat

SEQ ID NO: 36285 - DNA, 1066 bp, Oryza sativa
cttgcctccctccgcgcccacgccacgccgggacgacgacgacgccgacgaggatggacgatgccggcgacggacaaacgtcggcgcgggcggtggcggactggcgtactgacgacggtgccgccgggcggacgaaagacgacgacgctatggacggaagagacggagtggcacggaacaaaaaaattcgtctctgatggtgtattttaaaagtagcacgaattagatggcatatcctgaagcagtgcgaattcgatagcatattctgaaagttcttggcctcactccccttcgtctctccccctctcctctgtcctctctccaggcgcgagtgaggaggggcggcgcgcggtggccggcgggtgaggaggggcggcgcgcagcggccgggcgaggagggaggaggacagcgagcgggggcagggtgggaaggtcgccgccgcccggtcttccctttctgctcctcgccgcacgaacgcccgcttggaccctatctgccgtaccaacggctagcccaccaccgagaatgcggtgtacaacaatccaagtgacaccaaccccaggttcttgtcctacactagctcaatcgaaatttgacgccatggaagctagcgtgcatgtagatcagttttgagaaaatgactctgtttactactgtgttgatggtgctctgcaggttctaggcgccgtggtaggtgaagaagatgaagagcaagaccgagcttagtaggtacaggtctcggggtctgggacgtcaccgccactatgctgcgtccgtcggagaccagcaacacgacctcctccttgttgtggggccacagcgagctcggctacggcaagagcaggccatctcccatggtggccgaagagggcgccggggttggggtgattttgggaaggagttggtggtggcttggccaatgatgcgatggcctcggaggccgccacacaaccctcgtctcccgcctcccgttttgcgaaggccaacttcgcggcgcccaccagctacgcgcgaatccggctagaggtggccaaacgggccaggccaaacgggcggcccggggca

SEQ ID NO: 36286 - DNA, 1501 bp, Oryza sativa
ttaccacaagccagcgtgggcaacggctgggcttgtagtgtagctttcctctagtcgacgcatccaggcaagggtgggcgtgatggagcggggcgggccctgcgacggcctctgtcgcttccggattcacctaggcacgagaggggactgcccgtcgcccgctggggacgggggtgaaacctgaggtgtggtgtgcttggctagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcaaccagattcaccgtgattagtctcaccctagtgtaacctgttgaacttggatagtttaggtggatggttgggcctgtcgcaacgtgggttagcgttggacagcggatgtttaatactgcttaattattacaactgttttcgcattaaattcctgtttataaatgccagcatttatgcaaatgaacctgcttagctatcccttgttaaatccctgcatcatacctctattccggtatgacttgctgagtacagtgggtagtactcagtcttgctctacttttccccccaacctcagagctcgagtatgtgtccgatggcgggttctccgaggagtaggcttcgtccgtgccgtcgaggatgcctgtggagtggtgttcccgctgccgttcaagtcaaggcttagctccagtttcttttgtttttccgctgcatttctgtaagacttttatgatgtttgtaagacgtggatctgtatgtcaacattgtcgtttgtgtaccccggctggtcctggacgggggttttaatacacattctgcttggaattctattcggaaatttctgggcgtgacaagttggtatcagagccgaccttgaccgtaggacaagccaaatggaaagacctaagagccctctgaatccttttcattgcatatgttctttgcaattggattttgttccgggaaaatggggatctgttcttgtggttcaagggaaaaatcttggtcgctcgtttaaagtgagtttttcaaaacgagtcagtttagggttttagtaaaattattgggatttattcgtcagtcagttggggtttgatgggcgaaatgcattcggtcctagctcggtatcatgggttgcaaggtatttatgctttgttcgttattattattatgtatctaatttcccattattttatcgttatgtgagtctgtcttatttattcgcgctcatgtaaaatgatctatgcataaaattttgctcttatttgattcctttatttgagtctttattgctttatttaaatttggatttgagcatgcattgatcctactcctttgtcttctctagatggccggtcacccacccaaccaccgcggagaaggcatgattgatttcgtggcagagttggcacgca

SEQ ID NO: 36287 - DNA, 446 bp, Oryza sativa
gttcactctctccttcgctccagcatcagccgccagaggttcagccagcggtaccggaggttggttgtctgctactcccagtggcagcggcgagactgatccgtcagactctaggagtcgctcagagggaccaggtgacgagcaggaggacgctttcgactccaccgaccgcaggagccgttccgagcattaggctcgttttcccattagtttatcgattgtctagtctctgcttgttagtttgtgtgtttaggttgcttgtttggggtcagtcgacggtcgatgtcatgtgcctatgatatggctgtcttaataaggatatttgcttgcccttttaagtgtttttaattcagatcagaacaattgcagttttaattcctttgtaataaagcttagttcttgagcatctgtttttcttcttttccccgtccgctcttccctccaga

SEQ ID NO: 36288 - DNA, 1501 bp, Oryza sativa
cgatcgctgaggtgaggttccacgtttacttggtgcagtagttacggtttggttggcgtggagagaagctgcggtgtgtttttgattgaatccgattgagctagggggggaaggaagagggggtttggagctcgtaggctaggacgatgtttggatggtgctccgcgcctccgccgcgtgggttttgacggggatggagcatcggcgagtccggattggcttcgtcgctgttctcggatgatcctggtgcgtggtttgggtttctcgcggcggattccgtggggaactagggtgttgcggcgtgagttctgaggaatctggcttggcatggtttctattggcttgttgccttgttcgttgtctgtatctagggagagttaattttatttaactgcgaaattactttttctccgtactttgagctgttattataggtgatttcggtgcttggggtagtaaacagtgcatttttaaattatgtgctagttaaaccaatttatggcgatcgagccgtacaaatcccctgttgtgaatcctaagagccagggaatatgcctccatctatgctatatgtggttgatttgctcttgctgggtgaattcttctagctaggattatctaatttagagcccaacaatgtaagcatcatgctgttgcctttgagtgtgatattgtttttgcgtttggttagtcgatttgatcgaagaaaattcccggcaacttcaagtgaactctgccaattttatttggcactatgtccactgttatattttttctctttgtctgtattggagcatacaaaatctcaatgcatgtgcatggttcataagtggtaatcattaaaaaaggtccctgtttcccatgctgcttctgatgagaaattattaaacttttttctagcaaagagattcgtctcatctcatgcatgtggattgtcctgtctgttccaaaaccatcagaatctccgcaaacagtttgtttatttgcttcgtcctttctcgaatgctgcatgatcccatgtagcagctgtgattttacccaaaatatctttttttttatgttctgtaatggatgtgcaatgtattcataaatgccaccctcctcccttgcttccaagccactattagatcacttcccatcaccaatctgccttcgatatccctgtgagaggaattgcagcaacaatcatagctgtaaatatttttggtccttgaactggtatagcagcatctcatttctgaattcagccatctgcgatatctgcattacctttttattgcttatttatttgtatatgtgagaagtttctcttgcttacttcaagttaaatagatgattgctttttgtattcgaaaccttctgattgtttggtgttcttctttggatgtttggtagatctcagtttgccaaggggttcaagtttcatgagtcatcttgacgttgttactactgtggaagttgcaattcttcatggatgtcctcaagagtgatgtgaagaaga

SEQ ID NO: 36289 - DNA, 255 bp, Oryza sativa
atcgagctccgctcctccgaccgcgacgagctcgaagaccaccttcgcgccgacgccgccgcagcggtcagcacccccaccgcctcatccactccgaccacgaccccgtcgacctccaactacaaccccctcctgcacctcctccacccgacgtctggcgccgagccctccaagtcccaccgcatcggcctccctaccaatcccaatcccaaccccaaaccctagcctctcctctccccccttcgcccgccttga

SEQ ID NO: 36290 - DNA, 1501 bp, Oryza sativa
ggatgggaggattggccgcggcgggggaactccattggcgaatccagacgggttcggccggcggaggaagggttttagccttttaggcgagagttgtgaatgcgatgaggcgggtgggcggcgatgcagccgcgcacacgatgttttggaaagttttgaactttttggggggcgtccgcttctttttgatttgggcgtgggttccggacttccgttgtgtgatcttcagaagcgatgatttgcgagaaaaataatgtgtgggtaattttcttcaaacaacggtatcatgttgtaacaggatatcatctataagacagtatgatacctgttttggtaccagctacatggtacctgatatctgtgatacctcttacccggtacttgtgatacctaggacctaatacctgtgatactcgtacaagagaatagttaatatgtctatcccgttgcaacgggatcctgttttgtagcagtcctcaattttcttttatatcgattcgagatttataaaaataatggttgaaaaaaaactacgattaaaataatcaaaattaagatttaaaatttaaattttggttgcagctgataagctaaagagcatgatcgttttctaccgtgttagtccaaagtccaaactaggggatttttcaatgcaatcttacgtgagctgaattttatatacagctttatatattaatattaaatttaggagtgaatttcatattataaatttgatcttttgtttttatatgtacaattatacttgtatgcaactaatactgtgcatctactccatttaacggggtaatacttgtataattatacttgtatgcaactaatacttgtatgatttaagctactcaatttaacggggtaaaatttattttatttttcttaataatttctagtcttaccgaacacaatggcgaagtgtgtaattagtagctaatctagtgtgcagatcagattttcacccgacacctatcatcatcttaagaaatgcgggtgaaatgcgggtgttttgttccgtacttccgttcttatgaaaaataaattaaccgtcgtaaaaattctgcagatgatgcgggagtactcgctccgtacttataaaagaaattgttttggatagagatacggttttcaaaacacaactttgactttttttataaaaatatttattgaaaagtgatatatgtatatttttttaaaagtatttttcaagacaaatctattcatataatttttatatttttaaacttaataatttaaaagttatttatgatttatatttctaaggttaacttaaaaattgtccaaaactaatacttctctttctcgaagagaacttgtgggcttttctatctcctgttcaatgcctctcctgacttgatgcgacgtgcattcagggaacagcagtcagaaaaggcgagtgcggatatcactgggcagacggagagctgataattttttcaccctgtctcacgaaataaaatgagtgaaa

SEQ ID NO: 36291 - DNA, 1501 bp, Oryza sativa
ctcgtgctctgcccgccgtcatcatcgaggtgagggaggaagaagagagtggattttggagagagacagagaggtgaggggtaaaaaagagggtgagagactgacatgtggggcccactgatttaaaaagaaaataattgctgactggactgccacgtagaccaaaaccgcttgcaaagctgcttaggggggtttttcgtccgatatcgatagttgagggtgaaaaatgactggttttcaggtttaagggggtaattcgtactcacctaatacttcaggggggtaattcgtactttttcctatgcgaaataatgagcttatgttggcatagtcctccctagtatgtttagcccctcccgtaggcctcccgtttctgagttgagaccttttacagtgtttgcattcctaaaatggcatagatctaacggctcacgatgaaaggtaccttatgaaaggtatcagaggtagaaaggtactatggattaaaaggtaattgataacagggcaattatgtttaacaacgtatggacgtaccgaaaggtatggtgtaagtggatttgaaggtaccacaaggtaccgcgtaagtagtttttaaaggtaacgtaaaatatgatttacgtggtggggacaaaaattacattctcttctattcggtttccaatcttcggtcgttctgtttgtgtcggtttccaaactttggtccgatttacgtggtacatatcatattcgcatgatcttgataattatttccagttagtcattaatttacatagcaatttggtgatccatcttttgatgaatgtaatcaaagatcgaaaggacaacaaattgagaagatttaagaacctaacaagaacaaaacaagttcaatgaggaagatttgcgaaaaaaaactaaaccaatcgtctgacagatcgagaccgtgcggccgcttctagctccggcgaacataggcagtcctggaccacttcctccgggtcctcttcctccgccgcccctccctccaaccaccgcctccggccacaagtccaccgctggccctcaattctccacctttcaacttatcgaagaacacataaaccttacgtacgaacagaacgtatctaagaacgatgcaacgcaacaggctacaagctaattccttcgataccttctcataccttttcatatgtgtaaaagacacatttgtcattctaatatcatcatatttacattaatgccacctattacaatattttctttccataccttgcccctcgcagatcaacggctcacgtcgccccacctccttgtaactcgcaaacatcgtaaaatccctcttccgagttagaatacttgatgagggtgtatcaaagtaccagtgtattaaaatgtcaattcctttagtagtaaaaatgcaagtttacattctaaatgtcaaacagttcaacacggtaaaatatataaatataccatggtgaacttgggtagttaaaaagtcaccccaaacatagagggacaa

SEQ ID NO: 36292 - DNA, 1501 bp, Oryza sativa
ggagattcaaacaccaccaaacttttccggtttgctcactgttcgaactgccactagaatatcagtagatttcaacggactcaaaaggatttatatttaaaaactgtgcacttgtgcagcataactgcatcagcaattcagcttgagagaacatttcggtcgggacaaacagatggaccagactgttagtggcagtaggtgatctctagctgaaaaagagaagggcatccttgacggccaatccattagctcataagcaagaagaaaccatgagagccaagcaagcgaacaccactaggccacgatcgaggagaaggaaaccaaaaaacaaaagaatctagaatgacttgtgagcgtgagtgttacggtaatcgtaccttgatgatccggccatggatggcgttgtggaggtcgtcggcctcgtacaccgtcagttcgaggacgccgtggagatggtcggcggcggcgccacgagagcccatgccgtttggcttccttccttctctgccacctcctcccgcgccgctgcgacagagaactgcttttataacgagaggagtgaaagcctcaaagggaagaaaactaaaccttgatttgctctcgcatcatgcaccttttcacaccaccattccgctgattccctactaatttttatacttagccaatgcaattaacgttgtgcagtactggtacactgctaatctctccctgtaattttgattagccaatgtaattaacattgtactactgtactagtgtatggccggctaatctctcccaacgatccaagatccacacgacaatgcagcgtggaggagagagacatttccctgaattcctaggcagcactgccggccacaaaagctaattattcttcagtgccgaaatcatcaggagaactttgttgtaggagtttcaatttgtgtggatggtttggattggttaagcaggatcgtgaacaggttgaaatggagaggttaatgatgaacatggtagtggtcgtccgagcaggaacacaaggcactcaagttcaggattaccggtaaaaagacaagcaaacttaggttcctatatcgatagtgcgccatttgaaaggccaaaactaatccagataactagaggatttccaaatcaattaatccactcaaattcagcagttaggcacatgtcattttgtggctacacaacagtggtacaattttcaaaccttggattattttgcatctgttttaccgtattgaaggaatacaacacacctggagaataaaagatatatatggctttatatgaagggtgtgtaatgtcagtcatcatgacatgaaaagagtgctgctcgttatacagaagcaatacgcatcataacaacttccacatacggataataccacaccaaacgaatgaacaacactcaacagcttatttagttcgatgccgaacaacaaacgcatcataacagaggcatccacaatgacatgtctcaaagagcataagctgttacaaa

SEQ ID NO: 36293 - DNA, 1501 bp, Oryza sativa
atttcagagtagacagacaggtcaaaaagatagtaggaaatttttggtggacacctctaccatttggcctctctttgccttggttgaatttcattagtgttctcaagatgtcctacgagaagaatctcttgtttctggagctcatcgatgagcttaaaaaaaacagagagagaaaaattcgagcctttcctacgcgcggttgcattctctttttttcctggggccaagagcagctgcagagctagttttatccctacgagcctcggcaacgtctccccgtgcgagctctgtacgctatggcatttgatttcgtacgtgtccacggcacgcactcggaggagtcggaggatcatttttcttggggagggattaggaaagctcattgtgttttgtttggggtcttcaacgaagcattgttttattttggcagaaccaagtagctatcactataactcttcattactcattattatcaatttctgccgcagaaaagaaaaaataactcatactatctccatcttaaaattgaaactcagtactgcatggtctaggaggaagaattaccgaatgacatatagaaattggcattttaggatgggcaaaatataatttatctgttttaagataagttaatctagtatgatatgtgacatatcttattactatatccgtggacaaaattaacttactccatttctgaagatgaagtactccgtattgctgaatgacgggcagaaatcgggccaagtaggggtcattttcttcaggtatcagctaaaacggttggcattaaaacgggggaaaaaaaaacgatcaccctctgtcacatgggacccacatttctcaaccgggaactccctgcgtaggagtacgtcagtggcgcccacacccgtgccggagaccgcagagtggacacggtggcgtcggtggcggtgtcgcaatcatcccgcacgccccccacccccacaaccccacaccaccacaccaatccgaggaggagcaacaccaacaccaataccaacgtcccccaagtctcctcctactcccggccgccgcagcctgcgtgcgtgcgtgtgcgtgcgagagcctacgcctacgacgccaaacacggaaaccaccacgcacgccgagacaaatcccacgataccccgagaaaagcaaaagccaagcccccctctcactcccttctcctcccgccgcgccgcgccgccccgatacctcgcttcttctacaagcttccattcctcggtcggtgccggccgcttcgggcgcgcgtggaggtggttgctgctgctgctgctgctgggggcggcagaagctagtggcggtgggtgtgggatgcccgccgcgacgccgacccgctctcgcctcctcttccccgcgttgcggccgcggccggtggtggttaaagcggacgggggaagcctcgccgctgccggtgactgactggctgactgaccgactgcgccgccgcggtgcggtgggaccacgcgcgacgcca

SEQ ID NO: 36294 - DNA, 1321 bp, Oryza sativa
agaccgagcgcctggccattcgcagttcgacgcggcactagggtttgcgccaccgccaccgcgcgccacccatgttcccgccgccagcgtgctcccgtcgtcgcgagccgcgtctcccggcgctggcatgctccgacgcccgtctccccattgcccgcccccacgccacccaacgccgccccaggctgcccgatggccgacggctgtctccctgtcgctcgcccggtggccgtctccccgtcgcccacccgacgccgccccacgccgcgccgaagccacctctgctcgacgctgcttgaagacacccctgctcgacgccgcccgacgctgctccgatgcctttgccactgctctagccggtttgaaaggtgaggccgaatcgcccctgcccctgctcttgtgttgatgcatgtgttgtccctagaatattacagcaaattgatttttggcctgcaaattgattgaagaaaaatttatttggttcaagaatgggtgacaaggcagattggggtgatgattttataaggcatttgtttgatgtttgcaaagaagagatagaagctgggaatatacccatgggaattttcaccactaccggttggaaaaatgttgttttcaagtttgcagaaaaatcgggtgacaagcgaaccaaaaaaaacaattgaagaggaggatagttattttgagatatggcatcattgtatgaatgctctgtttatgtggaccatatcactttgatggatgaaaaactaatatattttgatgaaaaacttatacattttttctacaaattggccttttaaatacaaaatattgaacatattaggttaggtttgtacgagtaatttgcatataaacagtcctttcttatacaacttacagtttcacagctgctctaaccaaacgggcttctgcttttcccacagtttattttacacagctgcttttccacagcccacagatcacaacagcttttccaaaagccacaactctaccaaacacacccttaggctatgtgaaaatttttgccgcgttacatcagatatacagacacatatttaaagtattaaatatagtctaataataaaataaattacagaatccgtctataaaactacgagatgaatttattaagtctaattaatccgttattaaaaaaatatttactgtagcgttatattgctaaatcatgaagcaattagacttaaaagattcgtctcgcaatttatacgtaatctaactaattaattttttctgtatatatttaatactttatatatatatatatatatatatatatatatatatatatatatatata

SEQ ID NO: 36295 - DNA, 1501 bp, Oryza sativa
ggactctcaaaggcatagatccacagtaatgtaagatcagtgacatctgttgacaaatagaaggttaagtactatcttgtgacggcccacaagaaagcaatggtaactacctttaagagttgctgaataaactgggtaacatccttgcctgtaattggaattgatctgatgctgcttcctataacataaccatcagcaacaggaacaatgtgggtagccccatcacccacatcgactacaacacctgtcatttcacactgaaaacaaagcatgaaattcctcataaatatatctctcaacatagacgaaaggaaaaagaggggcaaataatgtagtacttcctccgtcccaaaatagttgtctctttagggtttaaaatttatcccacaatacttgtcacttaagagtactatatgtccaatcaatcacctcctattcaaatttctacacattctatcctcaacaacctcacaattccattcaaatgagaggcactttagtctttgattgctaaaccttaatttgtgctaaacaaaccagaaagacagtattgtgggatggaaggagtattgtagagcaaactaagcacaactacgaagctcaagagtccatgcatggctagaaataagatgccaacacaatgagctttcaaatgaaacagaaaaaccactatagaattaaaatttattggaaacgtaaatatttcaataatgtagtctctttcacctatcaaattaaggttaagcagaaatattgcatattgaaagcgtgtaataaaacagttcaactacaacataaacatggccttgagaacgaaattcatgttctcatctcaaggaattcttgctctactaacctttgtggtggtgtatcctgctgcgagggcaagaaccggctggcacgctatgtacagaccaggcacattgaaagtctcaaacatgatctccccggtgtactcgcgggtctcgggaggagtcagggggctctcggtgagcagaaaatagtgatcctccggatcacaccgcaggtaattgaaaatgcactgctgccagaacctctccatggtgtcccaattctcaacctgaatatctagcccatatcagcttgagtaaatgaagctccgcaaactaagatagcaacgcagagtgtcagaagaggaaattaacgctcgctcgcgcgcgcgcgcacaaacctggccattgtgaattggatagctgaggttgtaggtgttgctggagcgggagcgggccagggcgtcctccccgatgaagaagtcgagatcggccatgacgccggcgctgtgctgcgccatccagttccccttggtggtgttggccctggtctggccggcgaaggtgtcgttgacggcgacgacggtgggggtgatgaagcagggctccacgttcccggcgaaccccatcttcgtgtacctgcgcgcgcgcgccacccattctcatcacccgcctcagattcgccgcggcgcacgctctccgcgcgcaga

SEQ ID NO: 36296 - DNA, 230 bp, Oryza sativa
aatcacctagttacttatatgtttaattggtttgtttgcatttgcagtgatagccggtgttgtgctatttggtttggtccttgtgtgcttacgtaagaaatggaagcttaaagggtgctatgaccgtaatggtggccaaatgctagagaagacgagcgttaaaatctttacaaagcaggaattggacaagataactaacaacaaaagcaacaagatagggaaaggcgcct

SEQ ID NO: 36297 - DNA, 205 bp, Oryza sativa
atgttcgcctcacccaaaagcctttgacctgccaggggcctaattgcaataatgccttgtccaaaaacgcattgcgaaaacaaacattagtggaacctcacttcctgaattttctgatcttcagatcatccatgtggcagacacacttgctctaatctctctctctctctctctcttttcccccattctttcatctgcttgaaga

SEQ ID NO: 36298 - DNA, 294 bp, Oryza sativa
attggagtgcttggcaaatggcaatagagcatattaataacttctacaaaattaacagaacaaaataaaatccagaagcaagaaggcataaacatataaagaaaataaaacctacacagtattcaagctccctacacagaatgtaatataaccaagctccttagtacaaagaaaataaaagacatcaatcattcaacattcactcaaatatatagagcctacacagtaacactaacacagagtgacagaggtggaggttaaggaatgaggaataacacctgctggttgctcagt

SEQ ID NO: 36299 - DNA, 195 bp, Oryza sativa
taggtttgcagcaattagggacaagctatgaatccggtaactttttcactagttggacaacgcctcctaaacaaaagaaccgtgccaaacttttaagtgatcattctctatttgaactaattccaattcttctcaccaccctgtatatgtaacttcaatttcgggaactgagaaattgctattacactttacagg

SEQ ID NO: 36300 - DNA, 1501 bp, Oryza sativa
gctgcgccgtgtgccaggttcgaacaaccagcgagcgcaacctacgtgatcactgcggaggtcagaagcaccagtccaaagtcgcagcactggagaagacaaccaaggccatggcgagaacgacggcgaaaccttctcccggtgcagcagcaagatggggctgcagcatctgcaacatcagctgcaacggcgagtgcgatttcgatacccacctgaaggggaagaagcatcaagcgaacacccaggccttactggaacaaaacaagaagagctcagtgaatccagagtcacagggaaccaaggcggcggcagcaacactgatctgcagagtttgccaagctaagttcacctgtcagtcagacttgcagagccatctcaaggtcatgaagcaccagctgaatctccgggcaccatcttcagatggctctagcttcaccagtgcaacctcggagagtttgagtttggaattgtattcttgcaaggtttgcagcgtgaagtgcaccttcgagaggatgctcgcgtaccatctcactgggaagaagcacctgaaacaggagaatttgcagttgtcctgcgagatctgcaaactgcagtgcaacagcgagaaagtgctctctgaccatcgttatgggaagaagcaccaggcgaagctcgagaaagtgcttcaggcaaagctcaatgcgacggaatgagatgcgtctgattctgattaaagatgctggcgttttgacttttgagcaacgaacatttaaattatcgacggcactgtatgattatttcagattattaatccttgattttgggacttactgctgctgcttcttttcaattgcttctatatactagtacaaaaataatctatacggtttaaaatgccactaatactacttgtgcaaatcaatactcaaatatcgactgtactcttgctcaaagacgcgagtatgtgccctcttgaattattttacaagtgaatggtaccaacaaaaacatcgatttaattatttaaacaggacacaatcacaatgtttccaaaaggacaaaaaagcacaatctgagtgacataagcctactccctttgtcctgaaaaaaacgaatataggactagatgtgatacattctagtacaataaatctgaacagagatatgtctaaattcgtagtactagcatatgtcatattcagtactaggttggttttttatgggacggagagagtagtcaaaatctgagtggatattttatcatatcacattgttacatcgaacttgccttgaggcatgtaaaaactaaatgatatgccagtttatgcaacaggggtgtaactcgatgaatgagtatccttaactcgtatctttatgctgctctccactaatagttctatggagtatcattccatacaaacaatacaaaattctcactccatgcaaaaaatataaggtgcattaattttacttttttttttggacaagactttacccatgattactttattaaagtagagcc

SEQ ID NO: 36301 - DNA, 1202 bp, Oryza sativa
acagtagtctatcagatagatgaagactaaaaattgctaaatcaactgctcctccagaatggctggtaataccacttaaggcggatagaccgtccacccagtgccgctgcccacttctactatggctgagcttaataggagcaagagacttggtggcaacaaccagaatgatatattatttaatcgtggaaatgccatgtcaggtgcacctatcagaatcggacaaaccaattaccaaatccacctatcatcgccggctgtcgcgaccgagaaaattgcattttcccgaacgctaatgtattaatccccgtcccaggaaaagcaggggtacacccaaccaacatgatataaaagacacatctttattacatcgataatatttacattattacaaaggcgcttcaagcctgacaatcaaaaattaacagcagcggactagcgggcctacggctccatcttcacaggcgctcaactggggtataagccaagactccacctaagacttcttctccaaagcttctcttactgaagggggggagaaagatagagcaagaatgagtacaaccacagtactcagcaagccacaccggcagatgcatgattaatgcaagggggtacaaggggtaataatataggggttaagttttgcagaaaacagcatttaaaagtcacttagttgcccaaagccattttataaagacgaccctagagctacacaaaattattaatcaaggccgtgaaccctcacgaacctgccttaacccaaggcctacgatgattcagaccgaactggcaacccgaccctgggtcccagctcgtcccaagccaacccaggccaaccattccacattttagttgttgagcaaattttaagaattaaaacactaacctgggtacattgctcggcttgcccataaccgagggcgcggctattcgaatagattatactctgatcagaggtgtacatctttacccacaagacacatcttcctcacgtgcaaccacgtgccacataccaccacggtatacagacggaagacgtgacatagtttccaacccatcctagccatagacaagagtaccgacccaatcccacctacggccggaacctccgggacaggtaggcaggattgagccccctagcagcagggcaccaaccctctgccatgacatctcgactaccgggccgcagctcgtgtagc

SEQ ID NO: 36302 - DNA, 438 bp, Oryza sativa
caaggaattttctggtcgaaccaagcctagtcaaatcatgtggtgagcttagctttcacctctgatccaccaactaatcatatattaaaacaacacaaagaatatgtggaccaagttagcaatttggattcaaaaaagtttttttctgagtaaagtgtatggacggtccttaaatttatagcggtatgtcatctaggttcttaaactctcaaaatgcatatacaagttccagaacttgtcatagtgtgtcatctagatcccaaatcgccacagccccttcaggatcctacatggtgcttgtggtgctgatgtggcatgtcacacggacatgacgtggcataattttgactgacaaatgggacccatttaaaaattttcttttttcttttttttcttctcttgtattttcctttcttctcctttctctgtgacccgagc

SEQ ID NO: 36303 - DNA, 766 bp, Oryza sativa
ctctcccggctgacgcaataaatgagtttttaaattaaaatttaaatgaagaaattcgtaaatatccatttaaagagcatataaacttcaaatggccataacttggccatttgaactcggaattggaccgttcaagtctctaatttttccttaagaagtcaagacccattttgtgtgctttgtcctgcgtgttatatggagtttattagagtaaaagccttttcttttccgttggtcgtgtagacgctgcagcttcggaagatccgctcttcgtggaagtagaagccgacgtttgggaaagcgagcaaggcaagtcacatcatccttgaacatattggatcccagtttgtaaaattatgttgatttaaattattgcattatcgctttatttaaattcccgcgttatcactgttttatttagccatgcctatttacctttgttatgaccatattattattgctattgttattattaccttgttcaccctagaataaataaaaccccaactagtgggtactctattcatggttccactagtatgaatttaggtagatgcttcgctgattaattaggcaacattaggtggttttataactttagactttgggaattctcatatcatttggatactatggaatgtttggcttatggtggaattggacatacccctctcttcctctttcaaagcccctaaaacctgttttcggtggggtttgggtgcatgccagttgtgggaagtagcaccccggccactataaggattaa

SEQ ID NO: 36304 - DNA, 1501 bp, Oryza sativa
aggcaagtcacatcatccttgaacatattggatcccagtttgtaaaattatgttgatttaaattattgcattatcgctttatttaaattcccgcgttatcactgttttatttagccatgcctatttacctttgttatgaccatattattattgctattgttattattaccttgttcaccctagaataaataaaaccccaactagtgggtactctattcatggttccactagtatgaatttaggtagatgcttcgctgattaattaggcaacattaggtggttttataactttagactttgggaattctcatatcatttggatactatggaatgtttggcttatggtggaattggacatacccctctcttcctctttcaaagcccctaaaacctgttttcggtggggtttgggtgcatgccagttgtgggaagtagcaccccggccactataaggattaagctcgggcctctgttgcaaagcactaccgtacttccacatgtctagtgggtaaggcttagtttgtggctcagtctggttataaacaaaagtacacggattggagatggatgaagtcgggggtcgatggacattctccagggcaaatgaaggctacacgagctgcggcccggtagtcgagatgtcatggcagagggttggtgccctgctgctagggggctcaatcctgcctacctgtcccggaggttccggccgtaggtgggattgggtcggtactcttgtctatggctaggatgggttggaaactatgtcacgtcttccgtctgtataccgtggtggtatgtggcacgtggttgcacgtgaggaagatgtgtcttgtgggtaaagatgtacacctctgatcagagtataatctattcgaatagccgcgccctcggttatgggcaagccgagcaatgtacccaggttagtgttttaattcttaaaatttgctcaacaactaaaatgtggaatggttggcctgggttggcttgggacgagctgggacccagggtcgggttgccagttcggtctgaatcatcgtaggccttgggttaaggcaggttcgtgagggttcacggccttgattaataattttgtgtagctctagggtcgtctttataaaatggctttgggcaactaagtgacttttaaatgctgttttctgcaaaacttaacccctatattattaccccttgtacccccttgcattaatcatgcatctgccggtgtggcttgctgagtactgtggttgtactcattcttgctctatctttctcccccccttcagtaagagaagctttggagaagaagtcttaggtggagtcttggcttataccccagttgagcgcctgtgaagatggagccgtaggcccgctagtccgctgctgttaatttttgattgtcaggcttgaagcgcctttgtaataatgtaaatattatcgatgtaataaagatgtgtcttttatatcatgttggttgggtgtacccctgcttttcctggga

SEQ ID NO: 36305 - DNA, 1143 bp, Oryza sativa
acatgcatgtttgcccttcttcatgtagcatcttgcctgtaatggttgggatgaagcctggtataaatctaaccagggctaacgtgccatctctaagagataacacgctagctccggcttgagacgagtgcctagaggctttcgtcttgacgggatggggcaaggcgtgcgtcagaccgccagtcgccacctaacccgtgatctgaccggtctgtgactggtcacagaccggataaaggaacgcgctgcactgcgctgcatgcagcgtgacacgcttgaccagactgcaataaatgtggttaggtgagcactaccgtgttcacctatcccatatatgtggcgcaaacctcctcaaggggtcggggtgcctcggccctcggggccggggcaggagtaacccgacccccctcggggaaatcaggaggagagcggacacctcaccctcgggcccgacgtccccgaaggtgccaggccacgtgggtgattgtgtctgcctcaagcctcaggtcacgatactcccggtcccatatcaccgacagtagcccccggcgttatgccagggcgatcgcccttctcaagggaagcggtcgggcgtgacgccactcctaaagcctggtgacaggtgggaccggtctccatggttgggcagaaacccaacggtctcaaatcatgcacatcggtaatggtaatcttggctgtcaataatgggcggtctcttcaagactgccacatcacttgagcagcgcacgaatctgggcgagccgatttgcttcgcctggagatatggcaacgtcgcttcgatcggcgagcgtaattaacgcgcgcacgatacgatctgcctcgactgccacaaccgcatatccacctcatgcgccgcaagcgggcgaatgggattagtggaagcgtgggcacgagaaacaagggagcgagatagtgagaaacgagggagcgaaatagtgggcgcgagaaacgaggagccgggctcatcgatggcaagggtataaagataccgaggaaaagatttgctcccttcctttcgccattattccccttgccttcgccgcttgagccctaactctttctctgctgcaccttaccttcgccacacgcgctcgttctcaatcatcccttcctccggcgcca

SEQ ID NO: 36306 - DNA, 1501 bp, Oryza sativa
acaattcaaagctgactaccatatactactgtccctgctttacctgctgtccaagtaagtactaatttcgaatgcgaggttgtgtagcaaagctacaagccgaaagtcaagaatgaactgagttaactagctggtagcactgtcctacttgtctattcgttccaactattctatttgtttgcttgctggaacaagggaatatagggctgctgagctgtccaagtagaagtagctttcctactagttgttccaactaaccaacaagcaccggattgagcgcactagcgcgaaagcgttagcacgcgcatccgttttcttgctccactcataagaccaatctggtaaatcaagaaatgaagaggtattggtatatcaatgaacacactccatagagtttctgctcaaatcagagtgttggaaattaagaaacagtttcatcccgccttccactaatccccgcatttcgctcaaagctgctctctcatttcttcgcccttaggaaggtctctactgcaactgagtttgaaagcttttactcatcaaatatttttggcaagtaaagtaggtatcaatctgcttgaaagcctgcagagtccaattttgagtattttcagttagaatctagagtcagcctattcagttcttagcccttaagggtaaggcagggggtaatatggatagtctctgtccctgtattcacattccaccttcaacaaagtgttgatttcccgtaaagctaactgtagtcctttaagtaagtagatatcttaggcaagttagcaatctcgttatattaccaaggccttcccttctattgtagaaagagttctcagccatctaattgcagtgccagttgccagctatccagtttcatttgaagttgctgggggtccaaacgagctagttgcttttattcgtcctataagtccttccacaagcgagtcaatagggtgctggctagttgtagttgttggcgtgcctttcctttcatcttgaatattaataaatatttggataaattactttagaataagaagttcatgttttatagactagtaagataactaactagttaagtaatacgaatccatactaggaaaatgaaaatgtgagtcctaggcactggaattggttctcttctccctaatccctataagccagaaagggtaataggcttcagtgtaagcatttccttcaagcaagtcatctcaagtttgaaattctagagaatagctccgatcaacccattttagtttggttctgcaattcattcgcataaatgaaaaaaaaagcgagatgtgcacgaaagaagatcatagttcagctttaaaatggtggtgtccctgtgttagtaagtggttgaaatagctcatgggagtgtctgccccattcgataatggcatttatgatctagtggagtgagtgattgtgtggtgttcagtctaaggctttttgaaaagcggatttctcccttctctcatccatcgtctttgttaaagta

SEQ ID NO: 36307 - DNA, 1501 bp, Oryza sativa
tttcccttattctctattgttgttcaatcatccatcgcaaatagaaccacccgactagatctaaacctaggtgatccaataggaaacactaacaatggtatcagagccatcctagcgtttatttttggttcggggatagacatccacagagaagaaagaaatccaaagcaaagaaaagcaaacgatccaacgtatcgaaaagatcgaaaccctaaccctaatcttacctcgtcgccggccgtcgttgacgccggccacggagggggagaggggcaaagaggcaccgccgaggagccactcgacagccgcgcgcgcacccgcgggtgaacgcgcgcgccggcgagggggcccgcggcggcgccaccatctccgtcgtcgccggtctctcactcttcactcgcgtggaggggtgagacggtgggggggagaagagaaaagaatagagggcgtggcggcgcgagggcgtcggccatggcgcggcggcgcgaaggctgccggcgtcggcgacgccgctcggcacggcgcacgcccgcaagagaaagaaggagggggcgccgcggcacaaccgctcgacggcagcgcactcaccctcgagtgagtgcgcgcaccggcgatggggagtgcgacggcgccgccgtgtcgccgtgccgccgccggcgctgtgctagggtttcggcgacggcgacgccgctccgtgcaaccgcaagagaaagaagagaagaggagctagggtttcggcgccggcggccgggggcggttttgtttgcccgatccgcccgcgcgaccgtccgatcgaaaccctagcgatcggacggccgacggcggccgggccgaaagcggcccaagtggggagcgcgcggcggcggctttcccggcccaggcccaggttgcggcctgggggaggggagggggcgctcgcccgcgcgcaaggtggccatgggccgaccggcaaaggccggaaaagttcactttaggtccctccgaaggaagcattttcaatatgtttaatgattgtgcttatttctaagcaatttgaaccaacgtgaaaattgtttagagaatagataaatgtgagaaatgcttctgaacatgtattttgtatattttcatgcaaattacaaaagaattttgaattgtttttacatgttttacctctgtttaaatttgaaccaacgggagaatttttacagagagtaaacaacagagttttgttattgtttatatgaattgtatatagatcttccgctgcaaatagatgaaattgatgaaaattagtgtttctaaaattaaatttcgaaccaacgggagattttaattttaggaacattaattatgtgctatgatgttgtaatttttctgaccaacgttgataattgcaatgttatagttatggctttatgtgttatgtctattttctgcccaacggtgatgtagacttaatacataataattttaatgttaattttgttctcacaatacatgattatctcaggtggctact

SEQ ID NO: 36308 - DNA, 1501 bp, Oryza sativa
acagggattgaggtgagagtggaaacaagccaggaaagaatagaccagaactaaagacaggaccttaaaggaactaactcttctcgttgatgtgctgtttgttttacttattctgcaagttgattaagcaaacaacctagcatggttacatcacaacccaccgatgcaaaccacgcgctacacacacaagcaaaggagcacacgactaacgactctaccctagagggtggcttaggttctgcgacgggttctccaagatcttcactccggcttcacagctggcttcactgcttcctccacttcgctagcggaccctgcggtcttccggagcttcggcaaacaattggcgacatcttcttcttcgcaaaactaaccatctcgtactagttgaaatttgaagaagaaagaaagagtaaacattttgcaaatagcataggggaaaggaggaaaaaggaactttcgcaaatagtttcatttataaaatatgtccttaggttttatccacttggcttatcctacagtcgagatggctctgataccagcttgtcgcgactgggaaaatttcattttcccgaacgctagtgtattaatccccgtcccaggaaaagccggggtacaccatacaaccatgatataaaagacacatctttattatatcgataatatctacattattacaaaggcacttaaggcctgacaatcaaaaataaacagcagcggactagcgggcctacggctccatcttcacaggcgctcaactggggtataagccaagactccacctaagacttcttctccaaagcttctcttactgaagggggagaaagatagagcaagaatgagtacaaccacagtactcagcaagccacaccggagatgcgtaattaatgcaagggagtacaaggggataataatataggggttaagttttgcagtaaacagcatttaaaagtcacttagttgcccaaagccattttataaagacgatcctagagctacacagtattattaatcaaggccgtgaaccctcatgaacctgccttaacccaaggcctacaatgattcagaccgaactggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagttcccaacccatcctagccataaacaagagtaccgacccaaccccacctacggccggaacccccgggacaggtaggcaggactgagcccccagcagcaggacaccggccctgtgccatgacatctcgactaccgggccgcagctcgtgtagccttcatttgccctaga

SEQ ID NO: 36309 - DNA, 515 bp, Oryza sativa
caattcgattaagataagtcaatattttgtcattttgctgccaaatataaacaaacggtaattagtatattaagtataggctgcacataggaagaaccgaacaatcaattaccattgttgggaaaattgactctcggcatgaaaactttgaggcaattgcgcactgccgttttccacccattgccgcgtgattaacatgttttaactcatgattattaccataattatgcaatcacgtgcattgattggtagcgcccaaaaccttatgtttttggaaagcccccgattcccctcagtgcaaaataaaatgggaggccgaccctagaggaaggtgacaactttttctctcggtctcaaatctcaccaacacaaaaataacgtaatcccgatcaagcaccatcgtctcggccctcgctccacaccgttgtctccttgcgcccgacgccgctgtctccctgcacccggcgctgcctttcccgcacttcgccgcctctcacaggaccaccccgccacca

SEQ ID NO: 36310 - DNA, 195 bp, Oryza sativa
tgcgcgacggatcgctcgctcgatgtggttctcgttcttggtgatgaggcggcggcgagcgggtgtgtatataggcggcgggggcggtggaggaggagtggagaggagtctggaaagggggagaaggtggcaggaggtggaaggcgacattctagatgaagccaggatagagcccgccacgtcacgtcacgtgca

SEQ ID NO: 36311 - DNA, 1501 bp, Oryza sativa
gttcctcctcgccggctcgtcatctcgcggcgccgcctccgtcgtcggcattgcagcggcgtggaacacgccgtcctcgtctccgtgcagccgctgccggctgccctcgtcgcctcctcgccggctccggtcgtcgtcgtcgtcgtcctctcgtcgttcctggtttcgctcgttgtggcgttcgtccctctgtcaagccgttcttgtccgtcgtccgcgtccgtcaagtgtgccgctgcagccccatcgtcgtcttcgtcctcgcctccgcgtcgtcaagcctcgtgccggccgcgtctcaccttcgtccaaggatcgccgctgaagtcgttcccttgccgtctgtctccgccgcgcccgttcgtcgttgtcgttcccacgcctcgtcgcgtggtggtaaggtctcccctcttgctgccccgtcctcgtcctttcgttgtcgcccgtgctcgttgtgcggttgtcgaccccggtacccgtgtaccggtgtcggtagtcattcgcttgtgcgtgtggtgaccgtgttagtgtgcccgctcggtagccgcgtggtttccacgtgtgcagcccgtgtggtgtctagtggactccgtttgtcggccactcgcctcggttgacacacgggatccgcttccatcgacccgtggaccgtctctgtgtactcggtctaccgcggtcctttttgttgacatgtggggtccgcatgtcaacggcgcagccttcctgtcttttccaggctagcgcttacacatgttttatagttgcaaagcttaattataataatccgcaaatctccatatgacagcattaaacttcggatgaccatgtcttggtcatacgagctccgaatcgacccgttcaagtctcttaatgtttgttataacctaaagaaccctgtgctttctttttatgtattgttattgcttctttataggcttgtagctttgcttgtgtgcttcgcgtagtcttcgtcgttctggaggttcccgaagcgtggttcgtggtcgtcgccgaaggttcggaagtccgttctctctgagcaaggcaagtcacatcatccttgaacatattgaatcccagtttataaaattattctgatttaaattattgcgttatcgctctatttaaattcccgcgttatcactgttttatttagccatgcctatttacctttgttatgaccttattattattgctattgttattattaccttgttcaccctaggttaaacaaaaccccaactagtgggtactctattaatggttccactagtatgaatttaggtagatgcttcgctgattaattaggcaatattaggtggttttataactttagactttgggaattctcatatcatctggacagtatggaatggttggcttatgttggaattggacccacacctccccctctattcaaaacccccaaaatggttttaggctgggctcgaggtgcgtggtttggtttggttagtcgtacctcgggtactataaggtttaa

SEQ ID NO: 36312 - DNA, 1501 bp, Oryza sativa
tttagccatgcctatttacctttgttatgaccttattattattgctattgttattattaccttgttcaccctaggttaaacaaaaccccaactagtgggtactctattaatggttccactagtatgaatttaggtagatgcttcgctgattaattaggcaatattaggtggttttataactttagactttgggaattctcatatcatctggacagtatggaatggttggcttatgttggaattggacccacacctccccctctattcaaaacccccaaaatggttttaggctgggctcgaggtgcgtggtttggtttggttagtcgtacctcgggtactataaggtttaagctcgggcctctgttgcaaagcactaccgtacttccacatgtctagtgggtaaggcttagtttgtggctcagtctggttataaacaaaagtacacggattagagatggacgaagtcgggggtcgatggacatctctagggcaaatgaaggctacacgagctgcggcccggtagtcgagatgtcatggcacagggccggtgtcctgctgctgggggctcagtcctgcctacctgtcccgggggttccggccgtaggtggggttgggtcggtactcttgtttatggctaggatgggttgggaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcattgtaggccttgggttaaggcaggttcatgagggttcacggccttgattaataatactgtgtagctctaggatcgtctttataaaatggctttgggcaactaagtgacttttaaatgctgtttactgcaaaacttaacccctatattattatccccttgtactcccttgcattaattacgcatctccggtgtggcttgctgagtactgtggttgtactcattcttgctctatctttctcccccttcagtaagagaagctttggagaagaagtcttaggtggagtcttggcttataccccagttgagcgcctgtgaagatggagccgtaggcccgctagtccgctgctgtttatttttgattgtcaggccttaagtgcctttgtaataatgtagatattatcgatataataaagatgtgtcttttatatcatggttgtatggtgtaccccggcttttcctgggacggggattaatacactagcgttcgggaaaatgaaattttcccagtcgcgacaagctggtatcagagccatctcgactgtaggataagccaagtggataaaacctaaggacata

SEQ ID NO: 36313 - DNA, 350 bp, Oryza sativa
tgatataccagtgttttggcaaaaaaaaataaatttagatgttttcatatggaaaaaaactcaaaaagagtccatttcactcatccaaactattttaggttcattgagcattaagatatcacattggaattattaatattgagaaggcgttcttaatggatgaaaatttgatgatatactagtgttttggcaaaaaataaatttagatgtttttcatatgaaaaaaaaatcatttcgctcctccaaactattttgccacagcatttaacctcctaacaattcctcagcttagtttacaccctgaactattgaaaacagttcaacttactctctaataatattcctcaagt

SEQ ID NO: 36314 - DNA, 1501 bp, Oryza sativa
taaccaaagagacatttgtttggactaagagtttcagatgtgtcttttttggatcaaaggcaacaaccgccagtctagcttttgacgaaccacttgaaggtttctctgaaaggcagcaggctcaagtaccacatcgtcaccagaagcatccacaactctcggagtgaaaagtacttagttgacaaaggtcgaaaggtgatcaaggtcaaaggtgtaaaggaatacgttgaatgctaactgaggacaacatgaagagaatagtgggaagtaaactgaatgtaaagaaagtgaatccgagttgcttgttcatgggagctattcccagttatgaaccaagtgatatgttcgaagatagtttacagaggtcagattaaaatcacatgtaacagcgaacccgtcgcagaacctaagccaccctctagggtagagtcgttagtcgtgtgctcctttgcttgtgtgtgtagcgcgtggtttgcatcggtgggttgtgatgtaaccatgctaggttgtttgcttaatcaacttgcagaataagtaaaacaaacagcacatcaacgagaagagttagttcctttaaggtcctgtctttagttctggtctattctttcctggcttgtttccactctcacctcaatccctgtaacagatgtttaacagagaaaaaggaaagaatgtcagcgggtatgcctcaagtaactcaagttttcaactcaatccaccactggcctcaagagagttaacaagggcacacccttggtccattccgagtatgctgcttagttcacagctaccattggttcgaagtcaagaccagaatcagtgtgtgtttgatcgagcatttgccacccaggtcaatgagcctccaatgccaaaagagcatgtccccttttgtcatgattgtagagagcaaggacactatgccctgaattgtccatgggtatatgccaaagaagccccttcctttggtttaacagggcagaaatctagatgagatcaaacaaccagcaaatgaaacgatattttagaaaaaaaaaaccagtcaccagataaatctagaaatactaaatggagtgtttttttcattggtaagtgaacacgagtttttagtggtataaaagtaaacatgtaacaaatttgatattatagaatcatatttttcctttttcccaatgtgatgcattttcatggaactttagaagtaaaaccacaaacagcaaattgaaaaggacatcttcgaaagtcaaaaccaattaattaataagtagaccttttttggtatagctgttacaccaaatcgaatcgattaatatttcctttagcttcataacaaattttcacgtgattttcacaggaccagtactcttacggcaaaatggtggtagagattacagaagtagagcaagcctcaaagagagggataccactgctagttcctgttccacccgtgaaaacatgacttgttcttgtggttttgtaacttagggaagtttgagtcgtgtcc

SEQ ID NO: 36315 - DNA, 1501 bp, Oryza sativa
ccatatgtattgttcacttcaaaaaaccaaacaaacatacgtatctacagctataaagccagaaaaaaaacatactatgctgtatgctgatagaacggcggttttaaagtagaattttctatattataaaataaaatttattactccgcatatatccatgtatatgcacagtttaaacaagattaatataaagtatcaaatcaactgtctttaaatgttcatcttttaaattatttatgaaatatatatatgtaacttataatctattatattccttcaattaaataaaatattgatcacatataatagttatattgtagtgctaaatacatggtgccgtcatataatacttaatgtcataattatttttaaataatttagccaacatataataattaatgtcataatgtcatgataattttttaaataatttcacatgataaaatggatcaacttggtgtcaaatatccctcgataaatatatcgcagtggagaaataaagcctcggcgactacggtcggctttattacctgttaaagggggcattcatatttgattttaacagtgttatcttattaaccattaggaacaataattatagaatatttattcatagatttagaaacaagggttgacataaacatttatgtttgtagtagatataaatgttttatgtattaataatatattgggcttattttagtggtatagatgcagatccatttatttaaaatgcatcccgctttaaggataataaaaacaagtaagaatgataatagctgagttgacatgtaacgtggacaaaataaaaccctacctatggactaactattagtttctcaagacatatttatgaccattagatccatcgttttcttttaaaaaatagaacccatataccaacctccaccacggccccgtacatgggcgcttactcattcatccaccccactgcccacaccctcaaacacaccatacctctcttttcctcctattctcatgatacattacttagaaatcataatttattattaaaaaaatagagaacagtatcatccaaagcatatagtgaatttttgatcgacttatttttgttatattatttataactaaagttaaagacacatattcacaatattcaaacttttgaaataaatatgtttgattttggtttatattcttacacttttgcgtacattcaaacaattataaaaaaaattatgaaaaacatttaaatgttcatattttaaattatttatgaaatatatatctaacttataatctattgtattcctttatttaaataaaatattaatcacatataaaagttatattgtagtgctaaatacatggtgccgacatatgacacttaatgccatcatataataattgatgacatgaaatttttttaaataatttcacatgataaaaaggatcaacttggtgtcaaatatcgcttgacaaatatattacactaattcaaatctacatgcagggagaa

SEQ ID NO: 36316 - DNA, 1501 bp, Oryza sativa
tgaactctacttttaatttttctaatttcagattttattttattttttattctgaattctaattaatctcgtattggtttcttctatggactcttctttcaatgttggttatttataattctgaattaccgttatttttaaattatattcgtacatgaactcttcgttatttttttctaatttcgtattttagttatttttttattccgaattttaattaatttcatattgggttaattattatctggactcttattttaaattccaaatctaagttatttttaaattttatttctactttaacttttttcatttttctaatttcttattttattttatttttattctgaattttaattaatcttgtattgggttcttatatggactcttctttcaatattgcttatttttaattccaaatttcaattatttttaaattgtattcctacttggattcttctttcatttttctctgattaatgtggaaatttctagcccccaagtgaacgtgatacctcctttcaaagctattataataatataatagataaatatcattactattcgcgatatcggttagatgccactgaaatttttcaaaattgaaaccgtgccatcaccgtcacattttaaatccttccgacttcttccttcttccttctcttctcctctcctgccttctcttcgtctcttctcctccctatagttcggtcatgcctgctggtcctcgatgaacggctgccacgcctactgctcctccccccactgccctggtgcgctcaccggccgatgccgtcaccatcttcaactcctcctcatgcgagctccggggaggccgaatccaggcgtgcgtgctccctggccggcatcattgccagtgccatctgcaccacctgctccttgcacgagctctagggaagccatatccaagcgtcaccgtcatattctcttcacctcctcctcctcgtgtgagctccagggaggccagattcaggcgcgcgtgctccccggccgacatcaccgccatcttcaccacctcctccttgcacgagctctggggaggctggatccaagcgtcgcataatcaccttctcctcgtgctagcttcgaggaggccgcatctagcctccaccgtcatcagccgaatccaggcgctgctgccatcttcacctcctactccttactgtggttggagaggtgatggtggtctccgttgtcgtcacttgctgctctgccttcgtgatcttcacgggtgccagttattgccgtcatcgcttgttgctccgccgtccccgacgccatcctcaccgcgccatccttctctgtcattgactttcctcgctccttaggctttggcgctggcggcctcgcctatttcgtcggagctcgctggtcggcctctgacctctctcgctccatgggctttggcgccgccagcctcgcccgctccaccggagctcacggcttggcctctttgtagacgaccgcttgatggggagaa

SEQ ID NO: 36317 - DNA, 1501 bp, Oryza sativa
aaaacgtgggacctaccaaacggttatcacaagtgagggtagacggttggttcagatttaaaagtgagggtaaaactacaatccctaaaaaatgagggtaaaacagcaattggtttttaaagtgggggaatagatgcaatttttccttgatttaaaaaaggatcgtataggggaatcatcgggcatgccatggaagccttgtttttctaccagtacgccaaataatggaaagtactgtttcacggcttaatgactagtaatgtactgtgtacatgaggaaaacacaagggaaatatataaggccaagccatgttggtcaggatgtgccgcatgcagctggcagctggcagctggccagtgatggtgatgccctagcttcgtgtccccctacgtacgtctccatggacggatggaccaagcgtgtaccccctttcccattatacatcgacgtcattttttttttcaaatggttttctttaaagtatttggttggaatttggaagaaaaatatatacgaggggacatccccttagggattaaaatccatccccaacttaattcctatccccctaaatacttactctctccatcacaaaacaactccatttttagcatctaccccatccgtctcattttaaatgaaaccaggagtttccgtgtccaactttaaatgcttatcttatttacattttttttataattagtatttttattgttatgagatgataaattataaataatactttatgcatgacatatgtttttaatttttttcaaaatttttttaaataagacggacgatcaaagttgggcacgaaaaatcatggctgcacttaaaacgggacagagggagtaaattatatcaaaataagcttatattttaagcaactattgtacgtattggatttcataaaggttaagaacaaatatattatggctagataaagtggacatttacattggagtttgattaagtgaaaaggcatatgttttttattagagtgtgtgaaatcaatgaaaaatgaagttattttaagacggaggtactacaaccctttctaaccaaggaatatattatatgcacacaagttttccgtgcaaactctgtgcacaccaactagcaaatgtcgtaaaaaatttagataatattataaacatacttcaaataatattacacctacatgtgaaatcttattttcgaatccattatatttttgccttaaaaaggatataatcctgatagaattttactattacctgtcaaagttttcaatttttttgttacggttaaaacataattattgaatatgagactttgcatatatgtgtaatactattatgagtaaatattcaattttttatagaatttttcgtggcatttgctagttattgtgcaactgtgcacgaagtgtgcacgtgaagtttgtgtgatatgttttcttctaacccttttatattttcattgcgctgcctaacatcgatctatatacccattaacagc

SEQ ID NO: 36318 - DNA, 1501 bp, Oryza sativa
ggtcggaagagcaaagccgccgtagaagaaatgcgagaagaccacaatctcatgagtatccggagacgggaaagcctcaccgtgcgctggtcgccacccgatgatctccttggcagggagaacgccgtgcgccaccatctccttaagattctcctccgttacatcggatgacgcccattggccttcgaagctttctctctcttccgccatcggtttcactcaaatgtgctgatttgattcgagggatggcttgggagaggtgagggattgaggcggtggatcacgggaaggattttaatgcacttttcggaggtggatttggccggagtcgtgaaccctagttcgccggcgcagctttgcactgtagcagggaatggggaaaatggcggggaagacgaagcgtcgcttggatataggatttttcagttaagggtatcggaggtgctaatgggcctaggcctgaacagtacttcagcccaatacttttaacagcgtggcccattgtgttccttagggacttaggcatattttgctttggcaatattatgcgcacaacagtgttgcccaatgctgatgaaatcctttttatgcggtcatataattctttggaattattgcaatgcaaattaaaaaggtgcccgacagaaaggcgttatgctgtttttgcaagcttttttaggctacaaaagctgtttgggttaactagggatgacttgtttttattatagtcatttccttggcgtgttatatgcctgttttcatggtaaatagtcatggcctaggctatttgacttatttattaccataatctttatgatacttgatgggtaatctttagagtttgtatattcggatgcctgtcaagtgtgttcattcgtgaactttttagaatgtaaaccactcggatttcttttattgtggctaaaaagcagtcggctagcatgcctatttaggcgccgcgtatgcttttgtcatataatgcacaattgtgttattattttgtctttcaactatatgtttagtttgttaactaatcacatagttgggggctacacctaattaggtgcatctattcgatgcaccatattcttcatcttttcgccctttacagtccactcggcaggttttggcttgaagagtttgaagtactcgggttatcaactttgagaaggctacgatggtcgactgcaaaggactcgggggctactgtggagattatgggtatcccatatctacacggcgacggtattcgaactgggtaccggatacttaatgtagatagaatatcttatctgtatctcgggtttgtttcttaacttgtgtatcaaggaaacaccctgagacttagtcggttacgactgtattttacctctatcttcatattccgttaggaatatagattatcttttgtaatccggactccttcccatatataaggggggtccgggcgcctctaggggcatatgctgatttttcccgaatcatacaattaataatacac

SEQ ID NO: 36319 - DNA, 1501 bp, Oryza sativa
catacatataatatcctagtagaacatttgaagtctaagtttgaccaacacatcaaagaaaatccaaactgcaaacagtatgtgcactgtgttaattaccaccgtatttaattaatttttcttctcactttatatacatgtcaagcttagactaggatttttgtggtgtactagtagataccaatgtactgtttttttactaattccttacaagtatttgaattatattttaaaactaaaatatacacattcagttcgttgattatggccttgttccatttgttttggtcccttatccatggaaccgattaatgttggtataaaaaaccttcaaaatcatttatatttcatcgttggacccaaaaaatggtggtttttggtacattgccccctgttgcatcttactgacaaatcaaaaataaaaacaatatctacgagatggaagatatagaaaatagataaggatgacattatttatgttctattatttgcttatacgtttctctatctttctattgtttactatcgttgattaattgatgacattattgttgtctttacgtagacgtggacgtaaaaaaaattgcaacagatgacacatgaatgattttgagaaccaattgtaaaagatggaccaaaacaattgctgatggacaaaattaaactatgcttttttctttggaaataaaggtacatacacgggcagacatcctctttgagaggtagaatacacttgtttagtatcacaatatttagtatccatccgctctaaaataaactatcttcgtactagcatacgaatttagatatagagtccacttatttcgggacggatggggtacaccagagatgaacacacatacacagtcacacaggcaagaaaaatatacggagtagtaagcagaaatgtctgatgatttgatcgatcgcgtctttttccgccacactgtagtccagcgcgagacggcaccagctgctcttcactcttgagctgtttcacagtacagcgatcagtccagtcctcgagattacgattttctaatgacaattagcgcgggaaagcaatgtgtgtgagtagtttgttaattagcaatgcggagtaacgacagagactgtttggttggttagagatggttactgttgcagcttccgacagcaacgtggcgaccggctgcaacgtcgtcgtcgtcgtcgtcgtcggcgacgacgtggcgcggcggcggcgacggtggcggcggcgacctcctcctgaagcgcaccatgaggccgttcttcatgtacagcgtcgtggtcagcttcggcttcacctcctgcccgggcaccacctcgacggcgaacctggacagcaccgccgccgccgcggtcttcatctgcgtgtaggcgaaccgcttcccgatgcacagcctcgggccggcgttgaacaccgcgtacttgaacgggctctcgccgccggcgaacgcgccgccgcgcatccaccgctcgggccggaacgcggccgcgt

SEQ ID NO: 36320 - DNA, 964 bp, Oryza sativa
  unsure (1)..(964): unsure at all n locations
tgaaatagaagcttgtgtgtttgtgctcccagcaaagtgggttaagggatgtgttgtgttttgaattttgggaggggggggnggttggaaggggaagccgtcgcccatcaggttctcctcgtgggcgtgagctttcattcacatgtggtgtaccggtgtggtgtagccacagtcggagtgggtgatctccgagatagggtctgtttggttgtctgcggattgagaatgtgcatactgcagctggttgaatccgtcagataccagagcgacatgcgtgtttcagtgtttgtcttgcctttagggtttagcggttgatactgatgaaatgagagtctgatcctagagatagcatggcctgcaggaggtcatttgtagcgggttggacaccacgggcagtggacgagctgttagctttttgcaaacgtgtagtacatccgttcacggtagagccagttaggccagttaggtttagtatatagagattcacagcagtccttgatgagggctaacttcatgagttgtgaaattctacagttataataactaataaacagtggtgtgtgatggattaagatggcgtattgactggcaaatacaattatacaacagtagattatatgcctttgctatgaattgtgattcggctagtgtattcatcctgccaatgattcctcatgatacccaaaaaattagagggcatacagaatctgcactgacatgctgattgcatggtcaaaaattaagtttttctgattatttcattattgcagcaagcagcctatctgtgtttatattgtactgagcgaagtaagctgtatacatttgtttttcttgaaaaggaatgaactctataattgaaatatctagatagctagccaatatgaatcctgttctacatctaccctattgtttcggtctcttagtttggaattacattaataagatttttgagtttcaacctact

SEQ ID NO: 36321 - DNA, 193 bp, Oryza sativa
ttattaatcatacgctcatctcttgctccgtttgggaaaaaaaagagaaaagtttcataggggcccaaaaattatcaggcccactccaaataggccatcaaggccttaaaccctagaaagcaagaaagaaacattccgcccaccacctcgactcgaccagtgactcgtccgcctccacacattacagctacca

SEQ ID NO: 36322 - DNA, 1501 bp, Oryza sativa
tttggttgaaattagaacgatgtgatggaaaagttaaaagtttatgtatgtaggaaagttttgatgtgatggaaaaattggaagtttgaagaattattttggaactaaacacggtgtttatcggttttggaggttgaccgttgggtccatcgacagtttgggacgaagacttcagctaccctactccacatgtcagttgataggtgaatccgtcacatccgacttgctagcttagtggaacatcgacaagacctatcttataagttggcccccacctttgtatgtatgcatgggtactatggacgtactcctattagcatatcttatatcctataacctatatatcgggaaaatatgtatatatctatacgagtgatccatctaaacttttcgtaccgcccggtacctactatctagaccatccatcacgctaaatccaacgggtgacaatgctcagtactgccaggtaccaaaatcccctcaatggtacctccccttcgtatgcacgcgttaaacaagtggaagggcaaaattgggttttcgcatggtctattctccctgagtccaagccgctcctccctgacgcctatgcctgcgagccgtttctcccgatcccctccccttgaggcgcctcctctgcatctgtcctccatgcgcggccaagctcgccggccatccgagctagctggacacctccgccaccatccctgccccatcctaactcaactcccctgtcaggattgagaggaattctgagatttcagaaatattctaagtctgaaaacctgaagatgcagtttgaagtctgaagatgatgtgcgaacgggaggaagcagagttatgaagatccaacggtctgcagtgattccgaagaggtatcgcaggatcctaaccattcacatgttgtcgggggaccacttgagtggtaaaatggctgttttctctgaattggtgtgtgtgtgttcagtggcaaagaccactttggaatccttatgtactcctattaaaactattggcttgtggccaggagggagataagaaaaacctcattatcatttgttcttaggagtagggtaaagtagatctgggagaaacgagttcttgcggcgaccacctattttcttcccgatttactctgtttcgagcgaacaaaggagagagagaggcgtccatttccaggtgttttcagctctgatcctgacaaaggtatcagagcaaggttcaatccttggctctggaatccatcgggtgagggttggtggaaggcggcggcgagatccattgtaaaatccctaagccttggtggattttatccggtagcggaaggaaaacacagattactggagcgagggtttgtgaaccacctttcggtgtgttcctgtaaaatctccggagctcgtgatctgggttaggcggcggtagacagttctacttaggcacaaaggggagggagtcagatcctaaaccgacctaagcagtggtgtgaatggtgactactagg

SEQ ID NO: 36323 - DNA, 354 bp, Oryza sativa
ttgtcaatatattgctccactgttgttccaaattgtttcacattttggaacaactcaattgcctcatgttcactcgcagcagaaaatcgagtacagaccatgctgcaccattgtggccaagctatcacttgccatggcagaccaattcctccgaaccatttcaatgccctgccattcaaatgagccaccgctaaattcacccattgatccagaggggtacccgtaatctcaaaaaacttctcacactgcttaagccaatctattggatcttctccactgaacagagggatttctaatcttggccccttgaggacagcctcagcgtactgattcccttctcctgcctgacccaga

SEQ ID NO: 36324 - DNA, 442 bp, Oryza sativa
  unsure (1)..(442): unsure at all n locations
tgaaagtacaataacttaccattagtacacacatttgaagcaccctgaaaattttgggtttgtnnttggaantttngtaacnttttttcaacatggcaagaatcagaagatactttggttgcttatacagcccagcatgaaagcacaaaatgtaaaaaaagaaggaccaagagtttccactatcatcttttgggggtacaaataaacatcacttgaagggtaaatgaaattaatatggatatatgtgcacgtcctgttttggggtttggaaaaaaacatcattcaatagacaattcgaacgaccttagcttatatcttgatcttctaagtgaaactccattgcctgagtgggtgagcatacatgacatgctagtccagtttgagtttgtgcgcctaattgatctttgagctggttccatcttgttcttgtgattgatgcagc

SEQ ID NO: 36325 - DNA, 1501 bp, Oryza sativa
tcccattccggcgtcgatctgctccgctgtctatccgcgccgccgacctcctcgcatcgccgatccaagtcggtccaccgaatcgaatttctaccgtttttctttgcttttcggtttcgttctccgttttggttttttatcgtagttccgttctggggttttatttcgaattgccgtttgctctcagaaaaccgtacttccaaaataagcaagcgaaacctccggaaccagtgttcggcccaaggcccatctctcctctacgtccggcggcggcgcatcccggcctcgcgctccggcggcggcggccagtctgaggcggagcggcaccgcggcacgggagggcagggcgcagcggcgacggcgaggaagccaaccgggcgcggcagcaagggagaccgcgtcttgtctgcacggctccattagcggctggaggtgggactggagccgggagacccaactagcgtccaccgcctctccgccaccgccgccgccgcctcccgcaacttagggggttttgatgcgccggcgcggctccaatccgctccggggcggacctcgccggtcgacggccgccatgtgagccccccatcgccgtttccgctcgtcaccgcttggtgttcgttaatggcaggcaggctgatctctacgtcttcctcctcctcctcgcaggggcttcgcgcgcgtggagctgcggtgccctagggccctcgacccccgcccgagctggaccctcggcgacgtcctcaccgagctcgacgcgctagaggccactcgccgcaccgcgcagcccacgcccctcaagcagccgccggagtggtatctctattctccaatcccttgcgctcccttgcttatggtttcgccgataagctgcaatcgtttccctctacattgcttctatatgatttttttttggttcatttagggctagcagtggcagcgtgagggagaaggcctttgtgatgcgggttgaagaggaagatgacacggatgaggacgattacgacagtgatggggagtcccgggctcttgtggccaaggccactggagcaaggttctcatgcaatgatcttgaatccaggtgaagatttgatgctgaaatttggccactgcaattgcaatttatttgctttgaagtacggtacattatctgcaattaagtttaaatgaatggcgtattgtgtgagatatccccttcttttgttttcttcctagtgatgctgaagaatcagaggatgaaatggatggcaggattgcaccatatcacctgatggagaaacggagcctagagaagagcattctgcttgagctggaacgtgagcatcatctgaaagttcaagtgtgtattcatcaatctatactgttatatctttcttactgaatgcagtacttatgggctgatttttctttgatgtgttggcaatagaccattgaattattttcattaccattaatcctcattctagtttagggttaccatggcattaggttacactttacg

SEQ ID NO: 36326 - DNA, 1501 bp, Oryza sativa
cgggtttagattgactccttagatggttttggaagcggcttttgctgacatggcaatttgactttggtttaggtatgctgacgtggtagcccggtcatcaaaacaattgaaaatagaaatttgtcctatatgtaagtgataagaatgaaaataaaaaaatttgggacccaattgtcagctccattcctcccttcttcaatttgtatgtgcttcaagccgcactatgacacgtcaaagtgcggcggtgtggcttgcggtgtgtacagattgaagaaggaggagtggggctgacaactaccccttcccctgtttttgtttattttcatccttaccacttacatgtgagacccatttatatttttaattcttttaatgactgagataccaccttaaccaagccaaattgctacatcagcaagaaccgctttcaaaaccaccgacggaatgaaaaactggtttttgaagttgggggaggtgttatatcctgttttgtggtttaaggatgtcatttgaccaacagcaagggatgagtgaggtgaaaatagacttattcctaaatgtatgatcggacttggatgtcccattaaagaaacatttcgggcctattcagattgtagccaaaataaaccttaccaattttttttcaatttggcaatattgccaaattttgatatgatatcttatgtatttatcagagtttggtaaaaattaaattgatgcacatatttaacaactttaccaaaaaaaatggtatgatttgaaatggcatcaatcttaacaacccattcatatgatcaattgatcatgttattacaagaagcaaaacaacttaaattttgtttaaaaacacataattatatattatcccaacaaataaaacgaaagaaaaattatttttcagagataacaaaactgaagagaaaaataataatgttacgtaacatggttaatcaacaagtctcggagatcgattagccactgcatccgaagttccgaacatccgtctcgcaaagtgcatgctcccagactgacagaagaaaaattattgtatgtttagttaacatcaaaattgaaagtttggttaaaattagaacgatgtgatggaaaagttgaaagtttgtgtgtaggaaagttttaatgtgattgaaaagttgaaagtttgaaatttttttttgcaacttatcacggcgtaaggcgcaagaagtatagttaaccaacaccagtaatatcgtacagtactactccaacatgtcaccaaacttctctcggcgcgcccggggtgaactccaatctacccgggatcctaactcgccaccaaacctcctcgtcgttcttcttttaccgcggccggacacggagcaggagcacgcacgcacgtacggcgcgcgctcgcctcactgcatttctatcccggccatcggtccggccgtcacgatgcgccgccgcgtcgctctgtgcctcgtgcttttcgccttcgccggcctgcacgcggcggcggtgg

SEQ ID NO: 36327 - DNA, 281 bp, Oryza sativa
agcgcggaaaagtatatgcgacgcgaggtggttgacgtaggaaggctaccaaccaaaggcagagcaaggcaacagggcccgtttggatgggttagattcttcaatttgacggaaagaaacgttctgaatttgctaaaaactactactccgtatcagcctatcaggtttgcgttgttgacaaatgaaacgcgtttaattcgtttctgctgatccgtgtgatgtggttgtcaaaagacgctgctgtctgtacgtatcactggggattaagcaaggaattttca

SEQ ID NO: 36328 - DNA, 303 bp, Oryza sativa
ccctctccaacactttagccaccaccacattcttatttcttacaagattgtacaacgatgggtatcttttctctaaagattggtttccaagccaacagtcttcccaaaatctgatttgtaaaccatcctgaagtttaaacgagccaaaagagctaaaggtatgaaccagttttgcacccaaagaggagagcatactctctttcaacctctatggctttgccaaaacacaacaattcgctcttatgaaaattaatcttcaagccagataaccttttgaaagcacttagtacaagtttaagattt

SEQ ID NO: 36329 - DNA, 269 bp, Oryza sativa
tgcatattaaggtaggtggctccaacataattgttcactcaagggaattgaaggtttaatctcaggtgtttgctatctgtttttttttttgcagatggaggcaataaatagattggatgtgcgagataactcagatatttattcaaatgatgatataacttctccagtaatagaggatgacaacaccagtacaccaaaaaaaatatcaagaattccactcaatgtaagtacactggcaatttaaaaattatgactgaggtgctttaaaa

SEQ ID NO: 36330 - DNA, 318 bp, Oryza sativa
acgataaacagggggaactagatttatagaagtaattagtaacaggaaattgctaggatagttaaaaatatttgcatagattaaaaaggtagtccaaaggtttttccgtgcaattttaatgcaaaatgatggatagaaatcggtattctaggatacagttattttaggacatatagtttccacttttctgttattcacatgcggaaatatctatggtattattcatcatctttccccaaatttcccctgtatttctttagtcttctctgtgctccatttatctctaatcggttgattcgatgtgtgtcctcttccaga

SEQ ID NO: 36331 - DNA, 1501 bp, Oryza sativa
caagtgccagatcaccgtgtgggcggcagccgtgccgtccggcggcgggcagcagctggacccggggcagcagtgggtgatcgacgtgccggccggcacgacgggcgggcgcgtgtgggcgcgcacgggctgcagcttcgacggcagcggcaacgggcggtgccagacgggcgactgcggcggcgtgctgcggtgcgcggcgtacgggcagccgcccaacacgctggcggagttcgcgctgaaccagttcagcaacctcgacttcttcgacatctccctcatcgacggattcaacgtgcccatggacttcctccccgccggcgacggcgccgggtgcgccaagggcgggccgcggtgcgaggcggacgtggcggggcagtgcccgagcgagctgagggcgcccggcgggtgcaacaacgcgtgcacggtgttcaagcaggaccagtactgctgcaccggctcggcggcgaacaactgcggcccgaccaactactcgcagttcttcaaggggctctgcccggacgcctacagctaccccaaggacgaccagacgagcaccttcacttgcccggccggcaccaactaccaggtcgtcttctgcccatgagggacgatgacttgttagctggcatctgatcgatgtgatcttggttagatgtatacacaataaacaagcatgcatactttttatgcgagtttgtatcagaatcatgaagagaaaagttactctgtaataaagtaaaccattcaaaactgaagtggtttttcacttgtagtttggttaattacacaggcatgaacgaatccgttcaaattctattattttttccaggggggtttgacgggtagtttagcactttagcatcactacgatgtacaagtgagaactgaacaacgttttttgtatgcgtggatgacacgttctctattcgttccaaaccttatgaaccgtgcttgtgaactgtgatcgaggatttttgaacccagaatgtgatcgacgattcatcgacctagctcctttcttatcctgggttgaacggtctttgttcttggcagagctctgtattttatatcttcaggataatagcgatggataatatatagagtaaaatttgtccctaccatatttttggattttgtatcatccaagtcaagatcaattgacaattcagatataaattaagatagtacaactttatattatcacgcaaaatcttggcacgatatttgaccaaatcattcacatccatttctagacgattctgccaaattaatacaaccagctggactcctatcaaaccatcagctggtttccccaccaaactctcttgggatttcgtaacgaaattcgcacacgcaaagctgcaaaagttgaattccattattccacattatccattagccggaccgctataaaaatccacacccctagcttgcattcttgctcagctcaatttgagcaacagaaacactaacacgtcaccaataatggcgtccctcg

SEQ ID NO: 36332 - DNA, 202 bp, Oryza sativa
gtaactatataagaaatcctgccaaaattttggcaagttaccaaaattttggcatagttgccaaaattttggcaatgccaaaatttggtaaggttttttttggcagcaaagtgaacaggcccttagttctttcagctagcaaagatccctcataagggtacaagcaagcagcacatggaactgggtatgtttataccgtgca

SEQ ID NO: 36333 - DNA, 956 bp, Oryza sativa
ataaagctccattgatatgaaccatgcaatgtaatgattagtttttggctgttgcagcttggccaggtttgaggagctttgtgagcaggattgaaatttgagtagcatgttgttacatgctactcgtggaatgaccttctggtaatcagtttatcctttgctctggtctttatgttgtatggtccgattcatgcaacaaacaaatgttgaattaatcttctgttctccacaaggctcatccgccgtttggcatccttgtcagggtggccgctgcaaaatggaggtgcaatcagcttgattatcttctcttgatttactagtatacctttagccctacttttctgggcctaatttcatgttgcttatgagttacatgaaccattagcagtgaaatactcattctcctgtctcgccttaaaactgattgatcattttcatacgtgaacactagcctgccccttgaaacgaatgaaattatcctgtacatgttactttctaactgaactctcctgctacatcaatacatataaggcatttcttgcctaagttttcaaaacaagaaaaagaaaagaaaagaaaatgaatgaacgaatgaatgttacttcactagctagtagcctagtacgaagtactatttatttaactagcgtgcatatactagttactttgatagattgctacaattcgatagagaaaatgtgaaacttcttaattgatttgagagagaaacaataattttgtagtgttctatgtagtgcagcttggtgagcctaacgtattggactggaccagcgctagagctgctacataaatgtcatttcatattggccaagttttatagtcgtatctggctaactaacccgtacgttggtttcgccgtggtgtgcggctaactgttcctactatatgcgccgtgacaagtgactcaaatatgtttcttttattccatttgcagg

SEQ ID NO: 36334 - DNA, 482 bp, Oryza sativa
ctattactgcacctgcatgtccattcaaaactctattagtgaaagctttgtatctacaataattcattccaacacaacacatacgctcgttccgcgcatgcgcaagcgcaaccaccgctacccaaccgcctccatagcctccttctgagtgctggccgaggcgcaacacaaaggggcacgttttttctgagtctcttcttcttcttcttcttcttctcccacacccacgccaagaaaagccaggaaccacaccatgcacaaaacccacgacgaacacaccccaccgcctccgccaactcaagctctccgatcgatcgatcttccaaccatatatataacccagccgccgcccgcttcctcgatcgatcccagcgctcggagcaaaaaaaagaacggaattgcttagatcaagagcgagctgaacagagccgcgtttgcttgcttgctttggaaggaaatcatatcgatcgatcaggagatgt

SEQ ID NO: 36335 - DNA, 1270 bp, Oryza sativa
ttgtaaatttaattgcgactctattcttcacactgtattgttttattgcttgcctaacttcaatagcatcagagaacaacatcccaaccttaaagattggtgactccatgtccacagcagccacaaagttcttaaatttcaacttaatgccttcattatcttcatcagatgactctggaagcaacaagccttcatcatcagagtcatgttcaggaagcttaacaaccatcttgctgctagccacttcttctatctcaacacagttgtcaaaaacatcatcatcccccttgttagcctcataatcactgtcaacaaagtcaggatctacatcgatgtcatcgtcatcgtcaatgtcatgaccttctataggtataacacctgaatctttttgattcattgtaaacctctcacggctagccacgataggtatagaagcaggggtagaaagagcaacatcatcccaattgatggattcaagaatgtcttgggtgatccacatacaaaagcaatgtcctaaacctgggggctaatacaaccatgctgttagtgcttgcatcaaagttaattctccttagcccatcactgaatgtcttcccaggcaataaccaataaaccttggccttctcagacatatcatatcctagttgctcaataaaatcatcaagccataatgaagaccatgtgtcactgtcacaataatcaaaccaatccaccttttcattcaaataaattttgctactaccaactccagagaaaaaaccaccatgatgtagttcagttgtgaactgttcatcctcgcagcctatattacaagacaaaccattctgatgtgtcaaatcgtaaataattatctgatctattatacacaaaaagattatacagagtacatattcatgcttagagcaaaaattatttctaatcacaaactattcgtgaaggattacttatatgacacctagccttataaaacaccaaagcagtggcggaggcagcgccgggccaccataggcaattgcccaggctccatgcatacaacaacactgccccaatgcatatacaacatattactcattaatcatatacttaatcactttgtctcataggttataatggagattaattagatgaataaatagaaacgaggaagcaaggaccaaaccatcaaactgtagctacagagaccaaactatacaatcacaagattcaagaaaaaacagagaaacatgcaattaccggtacaaatcaatgacccctaactttatcaacaaca

SEQ ID NO: 36336 - DNA, 188 bp, Oryza sativa
ttgttttgctactaatgagtcaagttggtgatagcttggtctcggaatatggtttttttgtttgtttcatgtgtaggtgactcgatgcctcgagagagtatttgcactgatggaccgggagtcggcttggtggtaagacaatgtccgtggtggtcagatatcatgcgggatactaaggctagagttga

SEQ ID NO: 36337 - DNA, 1043 bp, Oryza sativa
tatgtacttaagtgccaagtatcaaagtgtgtgtggttttatgcaacttaaactataaaacatgtagttttgtgaaatttacttttctcaataaaaccaggaatatatataggtgagctagatggagaaaggagcaatcttcgaatagtgaaaaccaagcatatttacaaaccaagcatctcgatttatcgtctatgcaccagtactgcaccgtagctataccagcaatgctaaattaacaagaaacatgttaatgttgggaaagtccccggtacaatctttgggacggccgggagttaattatcacgcatgcttgtaacactaccactctactcgtaattaatctactatctgataacgtaatgtgatgatgcatatggctactacatatatatactacggaagtggatttttgtccatagaggagacatcccctcgttttatacatagcatttaaaaagttataaaaaaatttgtcgagatagatcaatatatgatatatttttcgcaaacatgcgagttaaaatttgacttatacaattcgaaacaaaaataacaaatttgactgtgaattacacgttttattcatagtcaaatttattatttttgtttctagttgtataagttgaatttgaatttgcacgtttgtaaaataacatatcacatattaatctatcctacgaaaatttttaattttttttatgacttttcaagtcacatgcaacgataaggagatatccttttaagggatgatttgagtttcctatatactatctagtctagagaaagcaagacactttcactactcattagtaatttttttttaccttgtgtccttgtggcaacctgagatgacatctataatcgcccactaacgggcctgtagtagtcgtagtactactcctgctagctgtgtaacttttgttccctccctaacgggttgtttccattccattccacatattccctcggttctcaccaaggtctgggccacccagccagcagccataagcagttcgcgtggttttttcactgtgtctaga

SEQ ID NO: 36338 - DNA, 209 bp, Oryza sativa
tataagaaaggagagatgtgggcctatatttattttctcactcacatgttgatcccccatattttttttctcactcacatgttgatccccttttttttctaattatgatgctacgccaatgaaattagagatctacgctgctatgggatctaaattacacggttttgtatggtttaagggtcaagatttctagtattggggattaggga

SEQ ID NO: 36339 - DNA, 1226 bp, Oryza sativa
atcagcgccacgtaggatcctagaggggatgtgtcgatttaggacctagatgatacactttgacaagttatggagcctagatatccattttaagagtttatggacctatatgacataaccctataagtttaaggaccaccaatacactttactcaaaatagattatagtgccaagatatctctgataaaatatattacagatggtaaaaacgtctcctgacccaaagatggcatatcccatcgaattagattatgcagaaatacagatatcatgtgaaacttccgccgtgaaaacgggcaatccctacctaaacctgaagccctgaaacatgatcatatatataagacggagacccctcatcctcatcagcacacaacatctacagtaataagttgttaattcatggttgacttactgtcgtccttggctctcgcatgttggcaacttggcatgttgctactatatcccacaaagccacaataccctccacaagctagtagttagcgttacatagaatgcgcaaatgtgcaatgcagaaagcagggcaaagctagtaggctactatcccgtccaaaaataagttttttctttcaccatcccatacataccaatagcatacctctattttattaaatctctaatacaattattctttattttatccactctcaatataattattttttactttcacaaagtccgatacaatagttgctctaagaataatttatttgggacaaataaaatgagctaggggtgtctagatcgagaagtgtaaagttttggcgggttacttcgaatattatatagggtgttttatagggtgttcaggcattaataaaaaaactaattacagaatctgtcagtaaaccgcgagacgaatttattaaacctaattaatccatcattagcaaatgtttagtgtagcactacattgtcaaatcatggagcaattaggcttaaaagattcgtctcgcaaattaatcgcaatctgtgtaattagttattttttagcctatatttaatacttcatacatgtgttcaaacgttcgatgtgacgaggtgaaaagttttagggtgagatctaaacagggcctagagataaatttgttaggcctcttacagtgcggtgagctggctcgtgccttacctgcgccacggaggatttcgcttaggtggagccaggaatggcgaccaagcttggcccctcgcccccaaacatagt

SEQ ID NO: 36340 - DNA, 1501 bp, Oryza sativa
tgcccctcctatggagagatatctctgggcctctcgatgttgtagattatggaagtgcatggccatgccaaaggtgattgagcagtcaatcacaagttatataatctattaacaggttcgagtgaatgattgagctattagaggatggcacatatctagccttgagcttaatcgatatcgtgaggcaatggggttcatacaagtatacactagaggttcagccgatatgatctttatatatgcccggtgggtcaatacgttctgctaggggccgctgttgacgcgtggaccgaaaaggagttctcgggttacagccgagtatacatgaacctccagggtcgcacgcttaatgggccggaataaggggattggatggagatccaatatgagcttaattcggatagggatccgaatatgagtcctacgggccttggaggcccgagtgatggattttatatattcgtgaggggtgtgaccggcggatataattgcatcacgtgagaaaccctagccgtcacttccctccccaagcaaaaccctagccgcgcgcgggtgctagcacatctgcacgtggccttcccttccctatacgtgtggataccggtagaggcgccgctggtttgcggtgctgatcggcgtgggagtacggcgaggagaacgtacgaggaggagaaggtcgagccggtgcgatcgactacttcctctacatcgacgcacgctacttcgcgagagttccttcgacttctcagcgtcttcttccgctgcgcagcacgtcaagtggtaacgatctatgatctaatacttgcatggttcctggtttacgcgataaaaaattttgatttattctatcgtagcctacgcgtatcccaacaaaatggtcttaagagattttcaaagatagagcccatcattttagtcccatcatttcaaagatatcgcactggtggtcaccagggagagagggggagaccgagagcaagaggggagatggaaagcactagctggtgatttttattcccatcggctccgctatagcttgatgaatgagctcggcttggctgctattttgtaccggtttacctaaacaaccggctgtggtgatatgacattatgttactgttagttcatttaaaaaattaggtactaattaatgaccttatatcaagtttttatatcctcgtggcatgcaggggtgtaaagtccctgtcattaccagtttttacctaacatacatcattgggacaatactaacaacgtattatgtagtagtcgtgttatttttatattatttgtatataggccacttgctattgagattcactgtgacagcagatttttttttaacgaactgtgtacgtgttatttttctatggaccacttgcgctataggttcagtgtaacagcaaacattagtctttttcttttctccaagcaagctggctacaatgcagccttcaagatctatataattgtcgatcagtaacaacgtccagagtgcagc

SEQ ID NO: 36341 - DNA, 1501 bp, Oryza sativa
acaatacttttcagcatactaggagtagtacgtacattatccaatagtaagtttcattttttcctaattgccgaacctaccttagtaccaatggaaggtattacggtatcaacaatgcatataaaaacagtccttatgatatcataaagtcatccatatatatcgtgagggtagtctatgtagaatacaattaggctagaactgcattctttatgggactgctatttagaaacaaaaaatttgctcaaagttcacatgtagtaacccatttagttaactcatttatttgtacccttggataattaacacgaaccattcatatattcagccattcaatcattcaacagaaaacaacacatgctaagagataaaatagatttttaaggctccttttggtatcatggtggattataataatcttgtttggtgcaatatgatatattaattatcaaactccgtacttcgacctatttgtaagcttccatttacatggaatttaaaaataagcacatcatagaatagcacaaccaaaaacttagccttaaaagaccttagttaacgaaacttctatgcctagtttacgattgaaattgttagaaaccttaatatctccaaataatggaaggaaacctcgacaaactatcacatgtttacccacattattctagttaaggtacaacatggaccgctctaagaaggggttaaggtacaacatgtaaccttgggatgaaatcatgtgcataaccaagtgtcactcaaatctttgtaacattgaaaggttgtgttgcttgcatggcctggccaatattgtggaaagatagactcctattgtcttttccaaagatcaacagaagaaatttagaaatctccaatgaataggaggacaagagcaataggctgctttgttggtttgttggggaagaagataaggccttagagaggacaaataggtaaagttggagtggactagactaccacttggtggtatggtgctctagatttcttattgttgcttttgcatcaaaagagtggttggaagtcctgtcaactcactactacaaaacaatttttcatagcacttcccttttattttttccaggcggactaaaaataatgccaccagtgaaaatcacatttattattaccgccagtgaaaaataatgccacatgtgcccattctctggtcctttggtggtatgtggtcatctatgtgaatttgattttgttacatacaagctatttcttgtaatgtgtcagttgatctatagttctgtactctcttcatcctaaaatttatctacctttatctgtaagctatactatggaaaggagggagtattgatttatggttgaattatcttctttagaaatagcatgcattggtgcggtagccaacagagcttaatgatgccagccatttagaggagacaacaatagcaagaggtcggtgaagggtgcccgacatatgtgtctatatatatatgtatatatgtatatatat

SEQ ID NO: 36342 - DNA, 1501 bp, Oryza sativa
tttcagatgttccaagcagccagaaggaacaattccatgaaaccatgatgggagaaagaggagcgctgggagtgtagcatttgattaaactccaatgacgtgttccaacaccatcccagcctattccaacaccctttactgaaggcgcaatcaaagaacagatgctccctggtttctcttgcattctcctggcacaacgaacaagaaatcgatgcgctcaagagagcacaatgttttctatccaacaagtctctagtattcactctgtccatgagaaacagccaaccaaaaactttaattttcatgttgactttgcaggcacttatactgataccctcgacctaactaagtcccattcgaacacgacttgatcggctagagatttatctcttaaaatgaaaaggaaaaccataaatatgcctaattacgacagctattaccaaaaacaaatctaaagctatccaaacagtctggtaacgatgctatacaaagctatcaacagcgacccccgtgggcttatctccgccacttctcagtctggtgctccgcaatgaaccatgctatacaaaaggtaaagccgttgcccacgctggcttgtggttggcacggttaatgtttcacaaccgaaaatcgtgaaccggtccttaattgtcatgagcacgactctcaaaaccatgtgctcacaacccaccattatcaagttttagttggcaagtaattaattaaccaatcacgattgaccatcgtgaactatcattaagccatcattaaataatagtgagtcataagttatcccaatagtgtgctaatgtttctatgcatggctaagcaatcatatctaatatctagctgaaccaatatataaagctcaactagtcaagttataataacccaaggtatcaaggaataaagtaatcaatgcaaacaggccataacaaaggaatagattcacaccacccagtgacattcgaaaataaatgcacaattgaaataaatagagaatttaaatataggatcaacatgctcaaaggattgtgtttaggatctgtgtgacttgccttgctggccttggaactcttcaaattcttttcctgcgaaaacgaactctccggaaacgtcggaatctaaacagaaaggagcaaaacaccaaaacaacacataaacaagcatgaacagtacatgtggatatttttaacatgtagatctcaattttagaaaaatttagagacttgaaccaactaaatccgagctaagatgaattatttatgaattttcaaagataaatcagattaaatcaattatatgggttttaattgaattatgacgcaataatgaattatttttgaaaaggaaaagggggtttattgcgtcagcggctcgggttcacggtggaccgggtgcacggcggcggctcacggaaactaacggccgagatctttccatccaaacgaacgggccgagatcgatcggtccacggccggaccacgagagacgacgacga

SEQ ID NO: 36343 - DNA, 407 bp, Oryza sativa
gtgacaatgatgcatataaaaccatctatgtaccctctatttaggggggtttgagattctgagaattaaccaatgataatcacttagtaatcaatttagcgaagctgaaaaatgcctttagtttatttttattccacagttgctgattcttcaaatctagattgtttggagtagctgtagagatttactaatacacattgtgctgcttgaatctttttcaaacatgaccatagactagatgataaataatcatgatctctctttgccggagcaatggagggactgggagaacacataggtgagagtgagtcgatcaaacgaaggacatggggtctggttacttcttgccctgaaaatcttgcctgactcagacgcaattctccgacatctaattttgtgtctgcagc

SEQ ID NO: 36344 - DNA, 208 bp, Oryza sativa
tatcagtatcataattttaaaaccctaattaaaacacagtagaaacgcatagccgtcatgccgataatgtcacgccccgaactagtcccgaccggaactagcccgtgacgctccaaattaacctgttaatcgataccagtcccaggaaacagtgctggtatcacagggagacagagtatcacagcaacataggtctcttttttataga

SEQ ID NO: 36345 - DNA, 338 bp, Oryza sativa
ttcggatccagaacgaggaggggctggcttgcactttgtagcttcttcatacacagatccatcaaaacacaggagtagggtattacgcttctcagcggcccgaacctgtatacatcgcccgtgtcttgtgtgtttccactctcgcgaactttccacagattaggagcttagaatctcacccagggtccccggccgaaccggcaaaggggggccagcgcggtctcccggtgaggagctccacgctccgtcatctggcgcgccaggtagtggcctctgcgtgtgttcttctaagctctcgcgctctttcgtgtgcgcgaagcttttcctgttcagcccaa

SEQ ID NO: 36346 - DNA, 338 bp, Oryza sativa
ccgaatgtgggccgagacagcgcagctgatcggccattccattcgtcccgctgcctcgattctattctttgccgtcgccgtcgcacgctcatcctattcccccacaccgactccccgtcagctgcccagagctactcgcctgaaatgttcctcatgtactccacgtagtttcctgcatctgggcaatttcatctcgtcagatatagtgtctggtcactggtgccctccaagaacgggcaaagctttgtcatcgctctagtctgtgggtaaattatttccgtcacaagatgctgccatggaatgctgacaaggacctcagtcctctcctcactcagcca

SEQ ID NO: 36347 - DNA, 230 bp, Oryza sativa
tccacccgtcctgccgccacgccgcaccggatccagtggaagcagcgcccagtgtcacggcctccacgctgcgttgccgcaattatgcgtcaccgcgtggggcccactcggcagtgagaccatgcaggctccgctgctgctgtcatcgcgagaaagcgattagcgggaggaggagtaacatcgaaggaaacccactaatcccggattattttgagcaattaccgctctaa

SEQ ID NO: 36348 - DNA, 1501 bp, Oryza sativa
cgaggattcatctccaaccggtggtgacaggcacagcagagcgaggtccagtcacagttccaggagccttacttacgaggattcaagcgatgatgagcgcaacttcaagaggagatggggaggcaaaagatagataggtcaccgtggacgcaacacaaggccgtgatacctgaatgaatgaagctgatgaacatcttgcatcattccatatcaaatgcttgttgatggatgtatgtgttaattgtaagctgaggagaaatctccgaaagcgattttcctcttaacggaattgtaattatgagctactattaatgtaaaatgaatgagagcaattctcatcccctctatgtaatgacaatgtcctccaaagatgagtggaacaatccttgacctttaatagtcgtttactacattttactgtcttttttatgactagaacttctgttttccacaaattctgccaggattcaactacgattccacgacttgttatattcaactacgattctacacgattaatttggcaagaccttaaaaactcatcaatcaataacggagtggacatggctcaactaattaggttttttttggtgaaattagcttacttaggtttaagtcctaatttaacacgggtatttgtatttatggttaattatgtatttatcgacaacgggatgttcgtacttcgttaattttaagatataccaatgcattctttcgaaaactgtttatagggtaggggtaaggttgtgttcatataggtgattgcacgtattgtgaacgctgacttcattaatcttaaggtatgccgattcaatcttttggaagtgtctagtaagcgttcatagggataaacaccaacacaaacacgaagtagataaacaaaactgaggttgtgtttagattaggggtgtaaagttttggcgtgtcacatcggatatacgggcacacatttgaatattaaacgtagtctaataacaaaacaaattacaaaatccgtatgtaaaccgcgagacgaatttattaagcctaattaatccgtcattagcaaatgtttactgtagcacaacatcatcaaatcatggcgtatttaggcttaaaagattcgtctcataatttacacgcaatccgtgtaattaattattttttcgtttatactctctctttcatatagatgttaatactctgtaaatatgtgacactgcgctcgaaccccctcctctcttcgagtagcgcacacgtgtgcggtgcgcggcactacacattgccgtcctctcctctcactcttcttccgcctacgccgcgctccgctctctctcctctctgctctctcgccgcgatggccacgctgcagctcaaccacgtcgcgcgggagacagacgacgtgcgccgcctcgccgccttctacgaggaggtgctcggcttcgagcgggtcgctccccgaactacccggccttccaggtcgcctggctccgcctcccggggacgcccggcgtcgcgc

SEQ ID NO: 36349 - DNA, 1501 bp, Oryza sativa
aaaacatataggtcttgttcgtttccactgcaaggagtggatgaaattttggatttttgtggcatgtttttcaaactgccaaacggtgtgtttcgtgcaaaaaaaaactttatatatgaaaattgttctaaaatatcatattaatccatttttcaagtttgtgataattaaaacttaattgatcatacgttattaccacttcattttatatgaaacacttaatcttcatcttcatcttcaggagattcaaacaccaccatagttcgctatctgagcctgcccacttgctagttaggaaaaataattgtttcgttccgtgggcttctttcactgctatcttaacgctcgctttacgagtgcaaccaacgaaaaattccaggattgctttagtattgactcaccatacacatcttctacctcatcactgtcaatggtgtagctgatgtgtcatgctaggtatctcttattggccattttttatttctagctggtagaggtatttccaaagttcatcctttatttagctcaacatgccctttatgctagttaattgttcacattgttactatcaaagagcctaatagagaagaaagagtagcttttgtagagctgggaaaatgtgccgaagagagtggtttatgcttccgggcttacagaccttgctaacttcatttggtagtatagttgtgaatttttgaactttttttgctttgcccaatagaggatcagtaactgtgtccaagtccatattcaacatccaataccatttcaagtattggagccacttctgcatttgattccaagcctatcaatggataaatggaatgagtcgtgtcaaggcaacggagtggttcacggctactgtttccgtggcgaatttgattttttagctttaaccaagtatgtagaaaaatgcaataacatttctaatatcaaaatatattcaatgctaaattttatgaaactaatttagtgttatatatgtgattaatttgaactttgacttaaaaaagtcaaacaactcccaccattttttaatttatgttgtcgttggctttttttaaaatacgtttaaccattcgttttattcagaaaatttatgtaactatcatttatcttattatgacttgatttatcaacaaatgattttgaccatgacttaatatttttatatattcacgaaaattttgaataagacgactagtcaaatatttgccaaaaagttcacagcgtcatatattaaaaaggatgtagcataagtcttgtagtaattactatgtaattatattttaattatattatagttctattttaaaatttttaaataaaatactatcaaattttgtatagttactcattaatttgttacatactggatttccaggattagctcacaactaagcctcctatcgatttgaggaactttacggaaaatattacgaaatttgagctaattcctgtaaaaaaaaaacgtgttgttggtcatccagagttggacaga

SEQ ID NO: 36350 - DNA, 1501 bp, Oryza sativa
agcagcagcagacagcgagatcgtggcgcggccggccgctgtacgcagcgtactggagtaacgatgcatgcatgctcctctcctctctcccttctcgcttccattccatttgatttttatgcaccgtcgtctcgttctcccctcaccctttgaccgatcgatcatgtcctgttgtgccacgaacaacacggagaagacggcaccaaaaaaaaaaaaaagcaatggtgggcactcatgctgattgctgctgctgctgctgctacattgagtgtttgtttggctttgtgagcgcttttcggctgggtttgtactattaatttgagcacgaaattgatcagcttttgtacaagcaaaattgtacgaaatgtgtggaacggtgattgctgtatttaccctccggtgaggtggaacgtgaagtgtggtgaatcagtcggtgcagagcgaggacgcagaggacggtgatagagcattttgtcggatggtcaccattaacaaacagcaccaaaatcccggtcaatctctatttattattatatcagtgtctgtctctaggcttaagatttgtgtagagaggtcaggcaggcgacccatcatttccagtgccctgtgagacggcgatgtcgtgctgcagtagagacagatcgatcgatcgatcgggtcggtcgacgacagcatgctgcctgcatctgcatccttacatatgcatcgaccgcggcatcttttggtccatccaacggatgggcttcgtctcctgaatcttggacggacggacggatggtctgacggatgtgggacccgagcgtcagagctttgtactgctgctgctgctgctgtattttggtccggaccaagagcatcatcgctgagcgagagaaagagagagaccgtggtgatcgatggccacttgattaacctcgtctaactttttttctctttggggagacacggctaatccatgtcagtactcagtaatcccattgttgcttctctctgcgagtagtgatgagcttcttttcttttttttttttcactttttgttcgttctcgcgaccccttgtgttgcttgcttggttctaaagaaagctgggtcggcaagtgatcaatgcgagtcggcgggcacacatatcaggtggtgattatattttggacactttgcacggcacctttgctactgtgctgcgtgtgtacagaaatggtgcatatgaatcagcagagatttggctaaacagctaagctcatgtggatccttccatagttgaggacctccagataaaagtttgtgcatctttcactattgcaggatatctctactgtcctaaaaacagaatcattctcctttcatcctgtcatcccaacacacacagcgcgtccatacgtgaaaagtaaccaccatttctccctaattatatggtatgactcgttaagtatgggctctcagtctatttctaattatatgagtctgatttattaaaatttacatacttgtaaatgtaaatagtag

SEQ ID NO: 36351 - DNA, 1501 bp, Oryza sativa
cacgtaaaatgaagtagtgtttagcgcgtgattaattaagttttagctatttttttaaaaaatagattaatataatttttaagcaacttttctatagaaattttttaaaaaaactgtatattttagcagtttaaaaagcatgcgcgccgaaaataagaaagtgctggaaactcccaccgaacacagcctatatccaacacggggaaagaggcccactttgatctgtttccggaaggaaaccagcccaccacctcgtatccttcgagataaaaagctctcttttgttttcttttcctaaatgttgcaattctcttttcctgatagcgcttcaagcattgctactgaacttaagaaagaagattaattaatcttatcaccaattatcaggttgcatccaccagcaaaaaacacttctaaaattcatgccgagctgttcaccaccagcttttcaggtccggctagcgttatcccaaattatgatgatctcgtttggtataattatgcttgaacatttaagtggttgctaaacttaacttttttaagagaaattttacgattcttgatgaggtattatgatacatcaaaaatttaatgtaaaatttagtacctaatagtatctaggtattaagagatactaaatttacaataaaaaaaagataccatagctccttgaggatgtaaaactgctccttttttaaacttatgttgtacataattgaaattgacaatatacaatgtataagggtatttgcactaaccacatctcttatctgtaaaacaaaccaaccgtttattttaatggtaaattttaaaatataagcatcacacaacataaaacgatagttattttttgctccgatagttcgacgcgatcaccctatgtgcttcctacgcgaaaatcaatttgtccacggcggtaaaaattggtggccaagccagcaaaaaaagtggacgtctggaccgtccgatctcctccgaaaataacgcgagaccatccgatcacacaaaaaagaagaaaatctcgctcgtgtggcggcctaatcccagcggccaaccgctcgcagagccagggccaaccaacgtgccggcgccagaggaaaaaaaggaaaaaaaaaattcctgcgggcgcgggccccacccacctcttggcccattccccaagaaagaatcctcgcagagataatcgcaggctcgcagtgctcgtgcgacgacagagaggcgaggaacagagagaggggggaaagcgaaacgtacaaattcaaaatcactccccaatttcccccgaataattccaccgtcgcctaaagccagtttcatcgggaacgcctcgaattttccgatccctaggcgggcgggcgggggaggtggagtgcccgcggcgcggcgcggcggtggttagggtttggggctcgtcggcgtcggcgagggcggaggggggggggatggatccggagcagacgttcctgcgggtgcacgcgcggctgtccgggatgctgtcgca

SEQ ID NO: 36352 - DNA, 437 bp, Oryza sativa
caccatcgatcgcttttgagttcagtggtagtagctgataagttgggttcttctaattccctgatcaaaatggcctcgattagagattttgccaagagatatgaagctgactgcagacacctcaaccaattcttttctggtacatatcaactgatgatatcagcaccgccatcttgtctcatgctagcatcaagaacagttcatcagtttcttttttcagagatttgaacagtttatcagaacaatctgtttacattttattctgtatcaatttctgtttcactgcactgttcaatgttcatacatgtttctgccatacgttttctttctaacacgactcaaacatggtgtcatgtcactgacatctccaaatccgtaatttaaccctttgttaacctttttttgacaaatctctgttagcttcattccttgccaga

SEQ ID NO: 36353 - DNA, 159 bp, Oryza sativa
cgaatgacacatataatatatcataggcgttaattaattaaaaagctgacaagtataatgtccactcccccctccccttcctccctccaacgatttggtccggtggtgtctaaggtgtggtcgtgtcattgtgtgtgcacatgcgtgctcatgcacagg

SEQ ID NO: 36354 - DNA, 225 bp, Oryza sativa
ttttaataattttttcggatttaatgggggactggccattcttccacacatgattggctacataggcattgagaaatgtaaatattaatgaattgtttatttacgaggaatgactagtagcatgtttaaatagatgacaagtagaattatttatccttgatctgtgtgccaagataaaatatgtagatagtagtatacattgcatttcctcgtactgatgaaaca

SEQ ID NO: 36355 - DNA, 787 bp, Oryza sativa
cggccgattttaacggtgctagttgttaaaaaaaaggacatttatatcctggatggttattgtatttttgccctatttttttcagttttgcgtgattttgctcctaatttgtgatttcagcttgtgtgatgagcattttgaccaaatataagcatctcttgtgatgttttttactttaacaaaaaagaatcacaaatataggcaattacaaaatttaaacaaaaatcccaaatactagccttcatggtcaatgctctagaccttgtgaggtgctgagagatgatagccttcatggtcaatgctctagaccttgtgaggtgctgagagatgatagccttcatggtcaatgctctagaccttgtgaggtgctgagagatgagagtcatgttaggcatcttggagtaagggtgtgtttggttgcaagctacactttgccacagtttgcaacgcctaaggttagacagatttgacaggtgtttggttgtagccacagttgtggcaagattcccctccaacaaattgggtcccacgtgtcaatggctcaaaaaagtgtggcaagattcccttagacttagtaagttgtggctaacaatttgatcacctcaccttaggtaaggtgtgacaacttttgttggcaagtaatggtaaagtgtggctgggaaccaaacagcccctaagtatcaaacagattcgtagcacccgagcttggcagcgcaaggcttgccggatccagcggacgaagagccgctcccttccaggcactaacctcaggaaatacatgtagaaa

SEQ ID NO: 36356 - DNA, 265 bp, Oryza sativa
agggtaatactttcgcatccattgattctcctgtataagctctcatccactatactgcctttgccaaaggcaaataaaccacctcggacgtcagggtgtcctgtagcatttcatattgttttgttgccacggcatataggcctaaaatgctgtccctgatcaagcacagcagtgccactgagaatggattcatctgtgttcactttaaaaagaccagctgctggtggggtcacaactcaccgcttgctttcctgatgcaaatttt

SEQ ID NO: 36357 - DNA, 457 bp, Oryza sativa
tcctgcagccccgagacggcgccgccggatccgccgccctcgccgcctgccgctgccgcccaccgatgccgtcgccgtcgctgcaaccacttaagagtttgcatgcgaaaatagatttttgcatgcgcctcattaataggaccgcatgcgaaaatagtcattaaaaattaattttaaaatatgagaacttcgaatcgaattttatggtacgctgcggcagtgctcctggtgtacctggcccacctcgccgacatggtggaccacttgaagctgtcctgaagcggttgtcacgggcgcggaggttgcagacgaacataagagaggcgctgggaggctggaggagggatggaggaaggagatgaaactgacagatgggtcccaagttcaagggtatttggtccatatgaagaatgaaaatagggatgaaaatgaagcggatagttgtttccgtccgctc

SEQ ID NO: 36358 - DNA, 1501 bp, Oryza sativa
gtctggacacatacttggttatcttaatttcactagacttgaacaaacgaactacagtcttttctcttagggcaaattttatagtaggggtaattgtcacgtctaattttattcatataagataagaggtgatatatacaatacaccacatctacaccacctctatcattgtaacctaaataattttattttatttgtttgtccaatcccctatttctttcatctcattttccttggggtttgtgtggaggttgctccttgcatgaggggtggctcaccttctctttcctcaattattactcccacctcatcatctaatcgtatatggtatttttagagagaacacatcaagcatcatagtacttgcccttaggctgtgttcgggagccccacttccttgcacggaaaacgaaccagtccactagcatgtgattaataaagtattagtttttttttaaaatgaatcaatattattttttaaagcaactttcatataaaagttttgtttgaaaaaaaacacgcaccgtttagtcgttttaaaaacgtgcgggcggaaaatgagatgagtgagttgggaacttaaagaaacgaaatcagccttaggtagtcttcttttaggcggtgattttcccccacgtttccaacttcaactatcttgtttttcacgcacatgcttcctaaactgctaaacgtgtattttttgaaaaaaatagtttttcacataaaagttgcttaaaaatcatattaatccatttttcaagcttttttttttgctaatacttaattcatcacacgctaataggtaacatcgatttccatgcccagccttaagccattgcaaatttgtcatattagaaaaatgccactactgtttacaatatcggctagatgccattagaattttgtcaaattggatctataccatagccatcacgtttttagttcgggatgaaaacggagtggacacggatagataacgctcgtaccatattcgtttttttttttttgccgaatatggattatctcgaatatgatcggacacgatcacacgaatacggaaacattttttcctcagaacacaaaaaccaattcaacttctaatataaacaaatatcaacatatataattagctcattttatataaaatataggataatttataaatagttttaaataattaaataatattaatagtgtggactagtgtcaagacataactactattaaaatctaaaaaggtatattgaaggtcatcggacatccgaattattatctgtatccgacggaaaccccgataccatattcgtattcatatctgggagaaaatatccatagctgtatctatattcgaaaggtatccatattcgtttttatctggagcggacggaaacaactatccgcttcattttcatccctattttcattcttcatatggaccaaatacccttgaacttgggacccatctgtcagtttcatctccttcctccatccctcctccagc

SEQ ID NO: 36359 - DNA, 1501 bp, Oryza sativa
atgtcactttccggttgccacacttgaggtgggacagatgtggtggactaacaaaaagtagtgatggttttaagaaaacaaccaaacagaactgcgctgttgaaatcaaaataatttagttctcctgtctaaccatgccagcaggattcttgtcattgctctcccatttccacagcttatgaacagcatttgagctgagagctaaaagtcccttcccactttttctataaagcagacagataacctataaagaaaagaaataaaacacaatgcttatcagaattgtataccgatctgaatattctagtgaactgccagaattgtataccgctctgaatacagcttataagttataccactatcgctttgaattctagtgtgctacatcacaaaaatgagaaatcacatccaatgtcaatatcaacaaatatagacgcttgtgaaatatttacatgcaaatatcaacagatactgtgatcttccttgcattaaatagaatgtaaggtcctatgtttcaggttgataacttgatatttcatggtcaacgtactaatacgaaaagatgcacgtgcaaacatcgctgaacatactttgcttgaagatgcttctgtaactggcatacgcagtgctcgaatacggccagagctaacaatgttcgccttccaggcctcatttaccaactccggggttctgctcacatgcatatatgcctgcattttcaatacaattagcaaataatattgaacagcaaacgaacaagaaagtgcagcaaactcagctggccactcatgagttcctggctataactacagtacacacattccaaatggaaccaagggcattcacaatcaggggctgcatggtaaaaaaaacagtggttatttttcctctttctcccagtttcttcatccaacggccaaccaagctcaacagcagcaacggtcttcctgtggcaggacacggcagtagatgggtgtcgaagcatctccacgtcatgaagaaatctgcagtgaaatgaattggcacagaggacagtgatggtggggagacgtcaaccagtactagagaacacagtcaagccagagatactcagagttttcaatttcggaaattgttattctgtgggagagaacaataactgaggcatcagccaagttagaaacatttgcatggtggtgtatctctgaggaatcggcccggcacccactgacagtttaaaccgatggagtcactaccaggtcaccagtgcacacttgctactgcaggctaaagtagcatacctccggtttgctcgctcatgtgtatattgattcacgagaacgtgaactcaaatcaagaaggaataagtttaaggaccattggtaacttaactcgaatataaacatggtgcaactagtagcataggccctcaagaggcctgtacctcataaagatattgtaatcaaattgaaggccaaacatgcatctaggtacgttttttgcaatatcaaatgatagacag

SEQ ID NO: 36360 - DNA, 171 bp, Oryza sativa
tcaaaccgatgaatgtttgtgagtgacatgaatagattttacagcaaaacttaattaattgtgttttcagacaatagaaacaaactatgcatgcaaattattattgcatccaaaatatatatatcctactagcatacatatgcatgttgcattatattgcctgaagttgaa

SEQ ID NO: 36361 - DNA, 287 bp, Oryza sativa
ataagagggaggtagtggtagtagtagatagccatggtcgccgaccgaggaagaagaagcagtggggggtcgcgaaacgaaggccgcgcccgcgcgggagaagagagcgtattgcattgcattgcatgcatgcagggcacgcgccacgcacgcgggacacctgcgcgccacatcgagcggggggtaggggcccaggcgtggggcccgcaggcgttacacgcggcccccaccgcagcgcgacgtggcccgacgacggccacgcgtcccgcagcgctggaccccttgca

SEQ ID NO: 36362 - DNA, 228 bp, Oryza sativa
tagggatcaaatgaaaggtggagataatccaggtgttagataaatacaatagttctcttgttaattaaatgtaggagctggtgaatgggattacaatttcccgcaggatttggcggattttattgggatttgggtgggtgtccggtactttggtacttacgtttcatgttgcgctcttcttcttcattgggcacgggcacatccaaggttacatccgtatttgaaaga

SEQ ID NO: 36363 - DNA, 1000 bp, Oryza sativa
gattcccatcacatgtaacattcattgtgaagccacgactcgcaagcgaactgcaaaagagagtccgtgtgatgtagataccaagcgaataaaactcgcagagtccatgtggatatcacgtacgttgttgcctagatcatctgattctattcgtattacacgacacgattcctggaacatgttagcatgatttcaagtcagtctccacacatgctcgtacgtactattagggatactgttacaataatccataataatccataataatcagttttacttttgaaaagaacatgccaactgaaataaaggatgatagaagttgctgattccgtccatcatcaattcctgcccgacttgaaataaagttggacgataaaataagctcgtgtttaaaggcctcattgtttggcttatcctttgaatttgactttttggtttttatcgtactttattttacaacatttgttttttggttgctaagaacatgtatataaaagatttacacacaaatagtcttttatttggcaataagtgattcggataagcacatgaatagacgaaacaataggttgtaattatttatccactgacacatatgtacaaattaaatcggctctacccgttgcaacgcatgggcatcttttctagtttaatatctatctctactattataaaaaattaaaatgtttttgtcaaaactttcgtccgtcatgccttttatgattcggaaatgataattttgtccacgatagagatagagtggtgtacgcataaaaggaataaggtcaccggaggtccctcaacttaacatcgagattttctaagatcccttgactacaaaatcagaaatgtacccctaaactcactcaaaccgttcaaaggaggtctcatggtaatattttttttccgattttgttgacgtggcatcctagtcagaaaaaaaaattaaaaaaatacgtagggcccacatgtcagccgaggctcgcggtaaaaaaattac

SEQ ID NO: 36364 - DNA, 319 bp, Oryza sativa
aaatttggtttatcaacattttgggaataaatggtttacatttgctatctgcgtcgacattttaactatttgtactagccttcatattgttttttgatatgttattactggaaccatgtgaaataaatctgtgaaacttgaggcctatgaagtcaacaagacaatttaatctgatttcaaaattatttaagttatgattgggccatcgatagtaaaaaagatagtttgatttttcagtgctattagcctttgtagtcatattttccttttgttataaggacatattttgaaataaaaaaaatggatctttgcttccaga

SEQ ID NO: 36365 - DNA, 1501 bp, Oryza sativa
taacaaaaatattagtagttgcataaccttggtaggttttagtactaacaaatttggttgtatataacttgaactaatgtgggcaaaaaatggttgcaaaccaaataatcgtttgacactgttaaaattgccaaaattttaattgggcaaaattagcttaaaaccaaacaagcccactatttagactaccaaaaccacacaagtgctatttagagtaccaaaaaattgaatgggtaaaatttggcactaaaccaaagcagtcctaaatgttgatagtactgtgaaggaacctctaggatgtatccaaatagaacatattcaaccaattgtctaacctcagtccaaactagtaccacctctatcattcaaagccaaacaattgccatatttactatttaaagttgccgtttttaaagatgattttaagttgccaaatcgtgactagcagtgcatgctatgttctcaagagaataaactccaacctggtggtggttaaatcaaaatctgaacctcaccttacggactactacgtgtcctgaatccgggcaggtggggtagcaagtatacctccactggttcttgattccgggcaggttggtgcacgaatctggcccaggcacaaggcacacgtctctggtggtaggctctccacaggtgtcacaagaaagctgcaaacacagagaacataaaaattccagataaacaggagataaacgaatcgagaattcgagggtatcaagccctacacgttaccttcaggtagtacgcggcagcaggaccgttgaaacctccacccactggctcctcaacgaaaagtccaaagaaagccatcgcgttgcgagagatgcttgaggtgagaatgagattgattcggagcttgagacgagacaggacgcagcgtagagaagaagacgagatgggaagaggagaggaaggggagcagttgggcgaccagggcgaggctacgggctaccaagtactgtactgggcttgtgttgtgtcagctttttctttttaccattcaccgcgcaatccccgcttggagccccagctgtcagtgcctcgtgtatttagataggaacactctagaacacgcagaaaaagtagagtaaacgtactagatgaaacacaaattcaaatttaaagtgctactcttatactaacttcagtagtctagtattacttgtggatgacgaggatttcatatatacgtggacgcatgcatgccatgcatgcgcatgcagcatgtacgtcatgcaaccatctaggcatctaggagtacatgtctcgattctgtgccggcgccggcacgctagctgcggtgtctggtgttcatgactcgcgttcgcgtactccgtcgcccccaatgccaggatcaggacatacgcgtgcccgcgcacacgcgcgacggcggcggcgagacatgcagctgacgctctaaggacacaacaatcacaacggagcgtgcgctgcggcgccgtcgcgacgacggcacggacaa

SEQ ID NO: 36366 - DNA, 341 bp, Oryza sativa
attccaaacttagctaaggtgttcggctggcatgtacccttgccgtgatggaacaactggtcacataaaaatccgtacacaaagtatagtgaatgaccgaatgagtgtagcaatgcattggagggaatattggattacataggatagtcaaacgaggaacctactgttctgttgaccacttgctacgcgagagaaagcagacgtcgcggccagaaaccaagtcaaacgaactgaaatttttgaaaatatttggattgttttgaccctgataacacccggctggagctgctcagctcggtctttgcttgctggcggcctaaattccatcaattcgtcccagg

SEQ ID NO: 36367 - DNA, 387 bp, Oryza sativa
tcaattaatatagaatcggagggagtatactcgtagtcgtatttgatcatccataaacgcgtccatatctttgggtaatggattttgcgacataacaaaaagtttagaccagtttttttactagagacgataacaacgtgccgagcaattttggctctcaaataatgatgttgttttttatgggaaaacggtttattttcctttgcaggttgttttcttgattatttctccagaagctcggtttatatggtattatcacttcagcttatttatatttggagcaagtggttaaggagttttatacctggcatttgggtgatgacctagttttcgagttgtaagaccttgatctcgagagtttttatgattttctctcttcttttaagg

SEQ ID NO: 36368 - DNA, 179 bp, Oryza sativa
tggttttaggctagaagtccaataaatactcgttcttggttgtagcttactcacgcaatcagtttggatgcttttggtttcgagcttgagttatctttgagtgttctcaaagttagaattttgttatctcatatgtccaaaaccttgctaacattatggatataccttttaacttgttg

SEQ ID NO: 36369 - DNA, 429 bp, Oryza sativa
cagcaacagtaccaaacttgctgttcttggtttaacgataggacatgtcatctattagaaggataacctagagaacatatcaacaatgaaggaactggatttatagcacaggtctgcaggaggcttgatgagatattttaaaaacaatgaggaaatatttgtctattttctcacttgttagttttctttcaatgttttacttatgtcctgttttcctctattctccagaattgaatttgcttagccttctagtagttatatgcatttcaaatagttgtgtatatcctaatgctgctgaaacctgcaataccagttaaaacaagtatgactggtgaccacctgataggaacccattagaaagtttacctacattagtcttgacagttattttacatgacctaactattgttttggttactttgctatctt

SEQ ID NO: 36370 - DNA, 1501 bp, Oryza sativa
ccactcctctgatacgtaatagaggcagtgtaggattaggtatttaacaactgtgaccccttcaactgacatgctgccatgtggtagtggcatgaaagatgccaaaccatcaataattaactaattatcattatcaacattttgttttgaaatttggacacaaagttttcattgcattcatgttggagtcaatttcatggttgaccactgtcatcggtcacatggtaaagaaagtttgtgtccttgtatcagaaatatgttctccaaagccatggatatggagcttcatcgagagaaacttagctttagagaattagagttataaaggatgtttccataaactgcaaatttcatttaaatcaactaaaacaattgattgaatattaggttcttctaaccaaacacaataacacctggaatcatcaagaatggctgactatttaattgtttgttaatgtttcttcccttatcttttatccttaagttcatgagtttttatgtttgctaagctgcaatgaaatgtgttctgcaggtgggtaattgagccacctttggacatagttgttcccgccaagcgcaccccatggcctgaaactaccgctgagctttcggctgaattagtagattccaaacaagatcaggagggtaggcggttgtcaagaaccgacagatcatctcggtcccgaagcaccacaaagcggaaggagaactgaagcaaaataaacacatcttgtaatgtatatcttacatctgcacaaactacaataggaaccatgtctggttaatctggtgggtattatgtttattttttttcctgatgttttgctaatgtggcagcgcttcatactcgtatgtcttctgtagaagactgtttttttattggtagctgtattatctatgttgtaatatacagtgcaatcttgaatcaaggaaatggaagctggatcctggatatcatatacgctccctgaagtagggtttcgtgctcgttttatgtgcttctgtgttggtgatctctgttactattcttgctgttggcagtggaatggtggaaaattcactttaatatagcgtttcgacaacggttctactaagtattgccgcttcattccaatcgatttggttgtgtattaacccttttgttaacagcgccaagctaataatcagtgcgcagaaagaaccttaagtatatatgatacaatttctttcgtacaaactatctcaagtttatactcactccgtttcaaaataaatcaaattaatacaagtgagatatcttaaaataaatcaaattaatacaagtgagatatcttagtaagaggcacgtttagattcgtattagagaatacattgctaccatactttttttctttttgtgtaacaaatctttggcctaaatgcttgatgggactattaaagattcctcgctcaattgacaattcaatgatgtatcgaataccagaaaatcttggagacatctgggacagaaaatacatgtacc

SEQ ID NO: 36371 - DNA, 1024 bp, Oryza sativa
aaattaaagttacctaccacataatcatccgatgctaggtgttcggatggatttgtgttgcttcgttattagattctaggtctacgcttcggtgcaaattgttgaaaattcaggcatgtcctctaagagtttgaccacaaacttttctaaaacatcaacatgtatcttttgtgttacagaaaacattcaaacctttatcatcagagggtgcgtgtacaagtacaacttaattacaaaaaaaacattcaaacctttattcagagtagtagaagcagaagccggcattaaagagggagaccataaattggtctgcaatttgcaaagtccttttcaaatagctgaaccttttttatttttaatattgccaaattgatgaatgttgacaaacctggtttgatttggagggaattttcacatatttatatagtagaaatttaaaagttcctggatgtccaattgccaatccccaaaccaaacagaggccgtgtttagtttctcctccaaaaatttttttgacgtatacgaacacacatttgaagtattaaacgtagactaataacaaaacaaattacagattccgcctgtaaactgcgagacgaatttattaagcctaattaatccgttattagcaaatatttactgtagcaccatattatcaaatcatggtgtaattaggctcaaaagattcgtctcgcaatttacatgtaaactgtgcaattaattttttttcgtccacatttaatgttccatgcatgtgttcaaacattttatgtgccggattttttcggaagtttgaagaaaactaaacacagtcagaacctgaaaagtacaattgctgaatgttctcaaatacctgaagaaaaaaaattcctcctttttctataaagcaaaagcttcacagagtccaggggcgcacctacagcaccaagtgtaaccagagcttacacaaaaaaaaggcaccacctttgctcggtgctcgtgggggagagagagagagagagacagatggcgacgcggatggctg

SEQ ID NO: 36372 - DNA, 1501 bp, Oryza sativa; identical to SEQ ID NO: 29217

SEQ ID NO: 36373 - DNA, 1501 bp, Oryza sativa; identical to SEQ ID NO: 29216

SEQ ID NO: 36374 - DNA, 1501 bp, Oryza sativa
catttattttcttgaaatatgtttgcagctggtttatagcatgctactttacctgctcttaggaagcgggtggcttccaacggtcagaatgggcaaaaaggttgggttggggaagatgagtgcgggcagaggctccggcacggggacgtgcgtgagatcgaggcatcgtcacgagctaccagcctttttctggtttgtattgtacagctactacgctagaaatgctccaaaagtctatgaaccgttggatgtatgggttgctgaggtgcgacgatgcataggaattgacaattttgttgccgattgacgcagggatgctgaaccgtaggtacatatgtacagcattcagtattttattttgtactacatctgtcaaagtatatagctgtcattctaaattgtttagtgtagattaaggtttaaggagaaacagatgatagtgtccttcattaaatggtgtatggttagttatgaaagggtggttaaagataaaataggaataaacgtggggtgatcgatggaacatgtggtaggtattctaaagtgacaactattttaaaacgaaatttgaatcctcgagagatagttattttgggacgatcgtagtactcttttcaattcaaatcaacttttatatatgagatcacgtataataaaatttgatccattttgagatgagggggaatacattgaaagcaacacatcgttatgcgtttataatacactcagtacgtgcaaaaaatggacgccattctccgacacaacaggtcaaatggctcatttagtttgaagccctatcaaaatattgtagtgtcaggcattaccaaatttgatactagttaggctaaagatgatataaattgaaatgccactaaagtactattttgaagctaccaaaatatagatagggtacaaatcatcaccaatctaaacatgtctaaaatgaactggcttacattttatcgaaatcttatacccatccatcgtataatatagcaaattaaagctaaatgggacgttacaacgaatctagacactcatccgtattacgcgacggacggagggagtataaaattttaggctttactcgctgatggctgagctgggccgaacggcaagagccggcccactgcccatgggcaacgcaatgcgtttgcagtgtgttgctagtgctgcccaaaacctctccaactaccagtctgagcttcagaaactgaaagtctgaaacctaccagctgctgatcaattcctgctctgcttcctcatcatctttttatccatccaatgcgcggacagctaccagtctttgcatcaactgaaaaaaagaaaagcattgctacttcacttctgctcgcatttcaattctgaattatcctgatccaaacggcagcggtaaaagcgaactaggagcgatcgatcgatggggagcgatgttatccaggccaagctggtgggtatgtcttaccctgaattttctgattgtttggttctttgatccttg

SEQ ID NO: 36375 - DNA, 159 bp, Oryza sativa
actagtttttgatggggaggttgggggaggtaggtgggtgaagtgcggtgcacgaaactgctggtgcggaggcgaggaggagaggaggggggaggaggagaggagaggtgaggttgggctatcaattggtcagtggaaaaggggagcgttgggttggga

SEQ ID NO: 36376 - DNA, 1501 bp, Oryza sativa
ccctccctcggcgaggagcactgggtgaaaactagtccagttctttggacggatgacgattgcgtctttcgccgttgcgaccctcgtgagggcgttgtttttgtgttttcgtgtcgtggtgatgttgttggctcggtggcgatcggtctcgcatagcgatggccggttcggtgcttggcttcctctctgtagcgtgtgtttggacggttggcacatggttcaaccgttcagggcgtgtgttctagtgcacatccttgtaaaacttttcttgtaaccttttttcttctatcttaattatattgaatgatctccttcagtcattccggcaaaagaaagatttctactttacggaggaggtttaagatacgatttttaggcggcaattaatctgctgttgcgtcctgtagcgatgatgctgctgcactggtttcccctttgattgtttggcattgattaagtttagctgcttggtcgtgtgactcatcacattgtgcaaccgtggcccgaaaggacgacagaaagcgatggcttgtcttggcttcatccactttttccattgaactaactatagtaccagcgatctccacagtaataatatcatacgaccaaactgacttgcctgtattatactactaacatttggttgacttggggcttggaaccgcggtaagatcgttgacattaaagattagcaaaagctaagctacaaactgtaacaactttccatcttttgatacacaaaagaaatactgaaaacttaacttatctgtaagtttacatttttaaatcgaaataaatacccccatatgttttatttaaccacaaaaatctgaaatagtttaattagcaggcaggcagcttagttcaggccccatttttgtccgattgagatgcatattttacattagtttcattagcacgtttgtcatcaaacagtaaaatggtcacatttcatgcaaaaaaaaattcctatatagaagttgatctaaactatcagataaatttattttttaagtttgctataagtaaaactcaactaattttatgctaatgactttcttattttatttttctaactttattttttatttttaagtagaatcgaataccacctcagcctgattaatcggagataatgagtctacgaatttgccaaacccaggagaagagaagaaaagaagagggagaagaaaagaaaagaagagaaaacgcagcagagtcacgtacgaaaacgaagagcggccaccgcaaatcccggcgggattaattcgcccttttacctacccaccccaacccaacccatcttcttcttcctcctctcctcctccacctcttctctcccttcctccacttcacccatctctccccacctccacctccatatctatccacttctcactctctcacactctcactagctaggagcactccactccaatttactactagtatctctctctctccaactaccgccattgccttcttggcaagctcggttttc

SEQ ID NO: 36377 - DNA, 387 bp, Oryza sativa
tctcaaaacagctaaagactgccaacacctttttggggctggctttctgctttctcgaacaaaaccaaaaacttgattgtaactggtattgctgctgtaatctgggctgtctagaaaactagaaataaagcttgttttgataaaaaaaattgcctaatgatcccactgatgtagttttcctggtttgccactggatggaatcctaggctcttttgcagaagcgggaggcagatcaaagaaagctgctcttgggggccaagctcataaggcaaattgcaagtgatgtgtacaattctaggtttggatggaggccgacggggagactgcagtgttgatcttttggcgggggtagagtatgctttgttgattgtgtggatgctgggttca

SEQ ID NO: 36378 - DNA, 1501 bp, Oryza sativa
acggcgcaagcatgcggccaacaactttcccttttctgccttgtcttgccctcggctgtgagaggccgcctccacgtggaagagcagcggctgccggctgtggacctcctgcgagcgggcgccggcgcacgcccgcgtggccgcggcctcctcgcgcggccgcagccgccgccgccgccgcctccgtgccgcgccgccgcccccgcgctagctagctaggatttcgacccgactcacggagacgcacgggaagaaccctatccattccctttccctcaggggtacaaatgtcattacataatttctaaaacctttttttattttgtttttatttctttaacacaaaatgtgggacccaccaaacagttgtcacaagtgggggtagaaggctacttcagatttaaaaagtgggggtaaaaatgcaaaccctaaaagtgggggcaaaacagcaattggctttcaaagtaggggcacagatgcaattgccccttaaaaaaaatagggtcaatttaatagttgggcaaaatttaactatttgccattcttgtgacatggcaattaacgatttaccatactctatcaattacatgtgggctctcatgtgtatatgacatgtgggcctagtggcaaatcgttaagcaacatttgtaagagtggcaaatagttaaaagctccttagggtcaaatagcatttgccccttgaattaatggaattatcttattatttatttatttatttatgctcatagtatgtgtattcatttattggatatgtgttctatgagtagtatatatttcgcatatctcctacagcctaggctagtcgatccatgtaacaattgttcatttagaactaactgaaattcaaaattaaaaaaataagaaaacaaagagtagagcttagagtccacgtagaaatactatttagaaatatctaaaatcaaaatttttaaaaaaggatattggaagaagatgctagaaaccttatagtaatactcctgcaataaaggaattagaaaaggaatactgtaagaagagtctatagtccatatagggatacaatttagaaataacgaaaatttagaattaaaacataacgaatattaaaaaaaattctagattccatataggaatataatttataaataaatgaaactagaaataaaaaaaagagaaatattaaaagaagagtgtagtccatatagcaatacaaataacggaaattcaaattttttttaaaaggagtgttgaaagagaagtctagagtttatatagaaatacaatttttaaataactgaaatttgaaatttaaaaataagaaatatggaaagaagggtttagagaccatataggaacaaaatttataaataaagaaaatttgaaattataaaaataagaactgttgaaagataagtaatttagagtccatacagaaatataataaaaaataattaaaattagaaatcaaaaaataattattaattatcgcctatatacaata

SEQ ID NO: 36379 - DNA, 1501 bp, Oryza sativa
cttcaccgttcatcctcgccggctcgccgtctggcggcgccgcctccgtcgtcggcatcgcagcggtgtgttccacgccatcctcgcctccgtgcagccgctgccggctgccctcgtcgtctcctcgccggccccggtcgtcgtcgtcgtcctctcgtcgttcccggtcgttgtggcgttcgtccctccgtcaagccgttctcgtccgccgcccgcgtttcgtcaagtgtgcagcagccccgtcgtcgtcttcgtcctcgcctccgcgtcgtcaagcctcgtgccggctgtgtctcgccttcgtcccaggatcgccgccgaagtcgttccctcgccgtccgccgcgcccgttcgtcgttgtcgttcccacgcctcgtcgcgtggtggtaaggatccgtcctctcgctgccccgtcctcgtccttttggtgtcgccccgtacccgttgtgcggtcgtcgaccccggtacccgtgtaccggtgtcggtagtcgttcacgtgagcgggtggtgaccgtgtagtgtccgtgttagtgtgttcgctcggtagccgcgtggtttccacgtgtgcagcccgcgtggtgtctagtggagtccgtttgtcggctactcgcctcggttgacacacggggtccgcttccgtcgacctgtggaccgtctctgtgtacctggtctaccgcggtcctttaggttgacatgtggggtccgcatgtcaacagcgcagccttcctgtcttttctaggctagcgcttccacatgttttattgttgcaaagcttaattataataatccgcaaatctccatataacagcattaaacttcggatgaacatatcttggtcatacgaactctgaatcgacccgttcaagtctcctaatgtttgttataacctaaagaactgtttgctttctttttatgtgttgttattgcttctttataggcttgtagctttgcttgtgtgcttcgcgtagctttcgtcgttccggaggttcccgaagtgtggttcgcggtcgtcgccaaaggttcggaaggccgttctctctgagcaaggcaagtcacatcatccttgagcatattgaatcccagtttataaaattattttgatttaaattaatgcattactgctttatttaaattcccgcgttatcactgttttatttagccatgcctatttatcattgttaagacattattattgctattgttattattaccttgttcaccctaggaaaataaaaccccaactagtgggtactctatttatggttccactagtgtgaacttaggtagatgcttcgctggttaattaggcaacattaggtggttttataactttagactttgggaaatctcatatcatttggacattatggaattgttggattatggtggaattggacatacccctctcttcctctttcaaagcccctaaaacctgtttttcggtggggtttgggtgcatgccagttgtgggaagtagcaccccggccactataaggattaa

SEQ ID NO: 36380 - DNA, 744 bp, Oryza sativa
actgtttaattttgattgccaggcctgaagcgcctctgtaataatgtaaatactatcgatataataagagatgtgtcttttatatcatgtttgtgtggtgtaccccgacttttcctgggacggggattaatacactagcgttcgggaaaacgtatttttctcggtcgtgacaagctggtatcagagccatctcgactgtaggataagccaagtggataaaacctaaggacatattttataaataaaactatttgcgaaagttcctctttttcttcttcccctagtgctatttgcaaaaggtttacccttttcttccttcttcaaatttcaactagtactagatggtcaggtcagtgaagaagaagacatcgtcagttgttcgccgaagctccggaagactgcaggatccgctagcgaagtggaggaagcagtgaagccagctgtgaaggagtgaagatcttggagaacccgtcgcagaacctaagccaccctatagggtagtgttgttagtcgtgtgttccttgcttgtgtgtgtagcgcgtggtttgcatcggtgggttgtgatgtaaccatgctaggttgtttgcttaatcaacttgcagaataagtgaaacaaacaacacatcaacaagaagagttagttcctttaaggtcttgtccctagttctggtccattctttccttgtctgcttcccctctcaacctctaccttgtgacagatggataacactggtaacaaaggct

SEQ ID NO: 36381 - DNA, 1139 bp, Oryza sativa
cccccgcgccggtcgcccaacgtaatgtattttcgcaagaagggcgacgagatttattttagtttttctttttttaataaaatctgagaaaggttattgttgcattaaaattatttattatgtaaaattcaagtaaaagttgtttaaatattttgaagcatgaggaattcaacaaaaatacccacacatcaatttgagttgaaacatggtaatttttaattgttgaagttaaagcccactaagtctaaaactcaacatgcaaccataacacatcatcacccactagtaataattacatatttaatctcatgtaagcatacaacatcatctacaatttatttaattttacaaatcaaaatacaagcatatctaatcatcacctctcatatcatttgcacaatattttaacaaatctatctatacttatcaatatgtttcactctaaagcacgggttccatttgactgataaatcctgatgtttcattatttttttctttttactccaaacttgattgacaaaaaaaaattaagaattgtaattcccgcagcaaagcgtggggaatcacctattttacataaataatttagacgataaaattttagggtgattttcgggcgcgacatagcaccacgaaagttgtcaacagctttagttttttagatggctacaacgacttcgacattgatagtctcagtagctacaacgacttccgaatttgagctttagtttttcttcgaagtcttcattgtcggtggcaccacagacaaagacgagcaagccggcatcacgagggatcaagaggaagcacgtgccaaagctgaggaggaacgctagtgaaggcagcaggatctgattagaagcggtcacattgcacacaacatcatccaaacccgcatagaagacagtaatgttttcgctacacctcaatagaacgctgtggtggccgtcacgttgattgacacccacatcgacaaagctccagaaaacatgactttgatgttgaataaggtcaagactatgatcgtcgccactgcagcccaacaagaaaatgatgccggagcttctcgccgaccgaaagaatccaatgctgactcccccaggactctggttggctgtcattagccctcgaatcataga

SEQ ID NO: 36382 - DNA, 1501 bp, Oryza sativa
tctagctgccagaagcttactctgttctttcttcatagcgtctctttgatcttgtgcgaataggtggagtcgttgtttgatatgctttgcgtcagtcttcacatttaatgagtgctcaatcacctctctaggaataccaagtatatcagaaggtttccaagcaaatatatctttactatcttaaagaaagatgatgagtgtgttttcctatttacaatttagctcggcaccaattatggtagtcttggagggattggcttgatcaagtgggatcttctttgtcttggcatcactttctcttgacttcagtatcttcttggcaggcaattcaccttcatgtgatgttgatgcaacgagtcagacctcttgctggtcgagtgccctcccatgagattgggtcatctcgcagctctccttgtcggaggtgacggcttgtttgacgtcgctacgcaatgagataactcgttgtgacttggcatcttcaacatcaagtaggtgtagtaggggacgacaacgaacttagctagagctggccttcccagtatggcataataagctgcctcaaaatcagcaacttcaaagcagatattctgtctggaaattattccgagtccgaaggtgactggaaggctgatctggccgagtagcattgaggatatcatagggacaaccctatgaaacggagcagaactcgacttcatcttggatcttggaatctgcatcttatccagtgtcttggtgaacaggatattgagcgcgctgccaccgtcgatgaggacacgcttcaacttaacattatgaaccactagatcttgtaccaggatgtaccactccgggtgagccactcggccaagatgatccgagcggtcgaacatcattgctacctcggaccaccataaatattggggtacttctggctagatggtgttgatctccctatcggtcgacttctgcttccttttggattcgtaggcgggtgggcctccgaagatgtggtttcactcggtcctgggatcttggaaggcccttctccgttgtttttattttgcccagaagttccttcgccattggtgatcttgagttgcgctttttgtgcttgtcgcagtcattggccacctgtgctttgagttcgggtgatttaggcattgcccattcataaccttatcgcagtggttgggacgacgttgtgattgctaattagatgttgtggccaccaagtcttcaggtttgtgcttgcgatccttctggttgttgagttattattcttctaggggcgccaatagctacccgactacttttcctcctatgatgcattgacagtgtccactgccttggcgtaggagttggtagtctcaaatagcttcatgactattcacgaaggcttgcgattgaacttgccaataagtaacttgtctcgaatgcctttttggaaagtagcggtgataacatcgtcagtgaccttcgggatcttgttgcgggcctccgagaaatgtcagatgta

SEQ ID NO: 36383 - DNA, 242 bp, Oryza sativa
ggcagtgagtctcccaatttagtccatcagttaaagaattcgattgagtgcgatttaatacgagattgaatgggatttgttaggggaattgatgcccgctacacaagaaatagatttgcaattaatttggaggcggaacgataggggagggagatcaaaggaggcgggagtgttgagtttcatgggagagagaggaatagcctggcttggaggtaggagatgctcctgacgagcgggaccca

SEQ ID NO: 36384 - DNA, 1501 bp, Oryza sativa
cttggcgactttctccttcagcgacgccgccaccagatggtccacaagtggctcgatgatatcagtcagagggagagcctacgcttcatgaagtcataatgcgatcccggaagaaaaatgcaaaaggaccgctgagtacacttacattgatggcaacgtcgtgctcggctgcccctttctcgcaaagggggacggggacgttgctcgccgttgtcgggccactgatcataagttggctgacgcggcgctcctagcctgtagatcgagaccagaatccgataagccgggaggaacacacgcataagggagtcaatttaactaaaaaggaaaataccccgaggagaaacccgggtcgcgtcctctggcccagaataatcaaaggccggatggtctcgagcctgaagcggctggatccgcctaccaatgaagtcggcagcgacttcataccccgacaacccctgttctcggaggtcgtcaacgatatcgatgaaagattggagggatggggtcaaggcgggtttggtggcccaagatggaatcttgtttggttgctcctcaggaacaacgaagaccggatccgaatcctctatctgaagatagaaccacctcccccgccatttgctgcgagatgaggggcactggaaggggatgtatcgcgacttcaggccatcccaaagtcggaaaccaacacacccggacacctttttgggttccatccagcgtaactcatagtaaaagcggaagaggtcaagaaacggctctaccccaatgtaggcctcacaaagatgcgaaaagatactcaagaaggcgatggaattggggttcaagtggagcaagaaaacaccgtagaaattcaagaccaagagaagaaattcagaaggcggaggaagaaaaccacagagaataaagtcctcgatcgcaaccatgcgacccaggacaggctggggttcagtacctcccacttctctctccgcggtcccgcgaccgggaagggcgccatcttcctgcaacttcttcagcgacgcgctggtggaggtagacttgtcaagatccatttccgccggggatcgccggagaaaggaccgagatgagctagctagggttttttgtgggagcagagaagacgagggacgtttgaaagctggtgagttttttcacaacaagcgggcttcaacttggatccccaaaactctcttaaatagacgcacctccgacggtgcgaattctaaggaaaggagagagatggccgccggaaatttctgggtccgttacgcgcggcagttttttggacttcaatttaaattcactcatgaccgttgagcttcacccggcgttgtcgatcactccttgtctctcggtccttacaccgagaacaacgacaacctcgacatcagaagtcgcgatcagtttcacgagttcatttaagcagaagtcgggggctactgttagggttacgggtaaggtataccctctacccttcgatatacgtcacatatcgata

SEQ ID NO: 36385 - DNA, 1501 bp, Oryza sativa
agtatgactcggagacatcgggcccggcacgatacaataacgacccagttctgtccgagtaggattccttccatctgtgaacttccataatgaatttccttaacttatgccgaaaacgtccgtatacgcgcaagtataccatatcgatatgtgacgtatatcgaagggtagagggtataccttacccgtaaccctaacagtagcccccgacttctgcttaaatgaactcgtgaaactgatcgcgacttctgatgtcgaggttgtcgttgttctcggtgtaaggaccgagagacaaggagtgatcgacaacgccgggtgaagctcaacggtcatgagtgaatttaaattgaagtccaaaaaactgccgcgcgtaacggacccagaaatttccggcggccatctctctcctttccttagaattcgcaccgtcggaggtgcgtctatttaagagagttttggggatccaagttgaagcccgcttgttgtgaaaaaactcaccagctttcaaacgtccctcgtcttctctgctcccacaaaaaaccctagctagctcatctcggtcctttctccggcgatccccggcggaaatggatcttgacaagtctacctccaccagcgcgtcgctgaagaagttgcaggaagatggcgcccttcccggtcgcgggaccgcggagagagaagtgggaggtactgaaccccagcctgtcctgggtcgcatggttgcgatcgaggactttattctctgtggttttcttcctccgccttctgaatttcttctcttggtcttgaatttctacggtgttttcttgctccacttgaaccccaattccatcgccttcttgagtatcttttcgcatctttgtgaggcctacattggggtagagccgtttcttgacctcttccgcttttactatgagttacgctggatggaacccaaaaaggtgtccgggtgtgttggtttccgactttgggatggcctgaagtcgcgatacatccccttccagtgcccctcatctcgcagcaaatggcgggggaggtggttctatcttcagatagaggattcggatccggtcttcgttgttcctgaggagcaaccaaacaagattccatcttgggccaccaaacccgccttgaccccatccctccaatctttcatcgatatcgttgacgacctccgagaacaggggttgtcggggtatgaagtcgctgccgacttcattggtaggcggatccagccgcttcaggctcgagaccatccggcctttgattattctgggccagaggacgcgacccgggtttctcctcggggtattttcctttttagttaaattgactcccttatgcgtgtgttcctcccggcttatcggattctggtctcgatctacaggctaggagcgccgcgtcagccaacttatgatcagtggcccgacaacggcgagcaacgtccccgtccccctttgcgagaaaggggcagccgagcacgacgttgccatcaatgtaa

SEQ ID NO: 36386 - DNA, 1501 bp, Oryza sativa
caatgaggcagataaatgtgtgtactatcgtcatggtgggcgtgagggagttattctgtgtttgtatgttgatgacatactgatatttgggacaaaccttgaggtgataaatgaggttaaatcattcttttctcaaaattttgatatgaaggatttgggagtagctgatgttatcttaaacattaagctaattagaggtgagaataggattacactcttgcagtcccattatgtggagaagatcttgaattgctttggctacattgatagtaagccttctccaacactttataatcctagcttgttgcttcgcaagaacaagagaaatggtagggatcaactggaatactccgaaatcattggctcgctgatgtacctggctagtgcaactaggcctgatatatcctttgctgcgagcaagttgagccggtttacctctaatccgggagatgatcactggtgtgcgcttgagcgagtaatgcgctatctgaaaagtactatggaattagggcttcactatactgggtatcctgcggtactggagggttatactgattctaactggatctctgatgtggatgagatcaaatccactagtggatatgtcttcacactgggtatggtgttgtttcgtggaggtcttgcaaacaaaccattttgacgaggtcaaccatggaaacagagctgacggtactagatactgctactgttgaggcagaatagctgcgtgatctattaatggatctgcctattgttgaaaaaccggtgccggctatccttatgaactgtgacaatcaaacggtaattgtcaaagtgaatagttctaaggataatatgaaatcgtctagacatgtgaaaagacgattgaagtctgtcaagaaattgagaaactccggagttataacgttggattacatccaaacagctagaaacctggaagatcccttcacgaagggactatcacgaaacgtgatagacaatgcatcgaaggagatgggtttgagacccatgtgagttatactatggtggtaacccagtctatgtgatcggagatcccgtggattagaacctgggaagaactaaccattagtaaagtagaggagagtaccaatttataccctctctaagtgaagatgcatgtactctcgttgctgcaaggcaggttggcaatgccttaatgagttctgctggctttaattagcgaaggtgctgtcctgcaaagcattcttgaaagaattcacgtttgtgagcttgactgttggtcgcagtctatggagattttgggtgaatcttctaggaagcttactaaagacctaggagtatgacttatacgctccacccgaggggtagtctacagacgatctagtaccaggtaagactctgagtgaaacttgcttgcacaagacttgcaattcaaggcgtagtccattgttcaagttgtgagtaagtgtagcttggagttctagatggatgttcaaccataattggtctccatcgaacc

SEQ ID NO: 36387 - DNA, 211 bp, Oryza sativa
aacaaagtggcaggtttggattttaaatcacctttttaattgggatgaagttgaggatttggagggtaaataacttgatttgaactacgattatgtttgttatttagagaagaaaggtgtgtccggttcctgctagtgttttcttatttttctcttatgaccctagtgtttcgatcttcttctatgatctgtatgtgcttaatgatctagt

SEQ ID NO: 36388 - DNA, 695 bp, Oryza sativa
attgcccgtcctttaaagggtattggctagaatcctaaacgggattaatgtgtcccatgaaagggtgttaaaggcccaacactattaagagttcaaagtgaattggattatttggagttaaccaactggtttatataaagaatcacatgtgtggcgcatcacgaatattctcataattgttgtatgaagttaatagcccatgcatataaatgggtgtactcaccattctattcgcaaaaggaccttgggagaatgtcaaatatgataccaatctagaaggtctcataggtccaactttgtgttttggaaaaaaccacataaccacagctgacagggttaaaattctcacaaaaagttatttccattccacacatattgaaagcattgccttcccttgggaagccaaaagcaaggttggtaaaatttttcccttttcccaaaaagttattttccatggccagatattagaagcaattgacatcaattgggaagctcaaagacatgttgcaaaagattcttcactcattgcctgcaaattatggaaaggttaaaatgtaatttgatcttttgagattaaaatgacagttcggttcatctgagattaaaatgtttgcaatatttttacgttgtgtgcagaagtagacatgtcaggttctaagattaatcaatatttaatattttggcttctccatagg

SEQ ID NO: 36389 - DNA, 992 bp, Oryza sativa
  unsure (1)..(992): unsure at all n locations
gcgcgcctttgagtgcgcatcgcattggacncnncncanattagnacacaatatcccctcgaccaattctataggcatggcctatcgcctgccttacaatagaagggtttttatgttttattgatgagaatttcacgcgatgccccaacaagtgtaatgccttcacaaaaccaatgttgttaaaatcgccaccttgaatttaaaaccataaaatcgtacaatcaagcacattttaattacaatcgtaaattcataaaatcatatgacaaaatcgagtctttgacaaccttgtacaacactccttcgttgatgcaaccattacattagcattgtgtttcatgtcattgaaggcctccacggcttcttgaaattttactaggacatttccactcatctacaggatctccttattttcggtccaattgaacattgtgctaagctggtccatgatgaaagacagttattcatgatattgactgagcatatgcactcactctttcatggcttcaccacaaatggacaatctccaagacaaaccttgtgatctccaagacaatctccaagacaagccatgcatatatatatgtttgtatatactatatacatacatatacaaattttattcataagtatgtatagcatacacatacatatatacgtacaaaagagatataggggtgatttgttgtcgtctagcgcgcaccacgcacggcgcacggttatccgcccatcagcaccccagaccgctcctcttctcgagcgaagaaccctagcgccgccgccctcttgatttccctccccgcacgtttcctccacaaattaattgccaaaattgtttccttacattgtgggcattatttcccctcttgaattgcattcgatcgagcctttaatcaccgtgggagacgcctgtttcctctctgccttcaatggctggtttcccacttcgccggtgccgatctccctgcctagcgccgttccttctccctagt

SEQ ID NO: 36390 - DNA, 1131 bp, Oryza sativa
  unsure (1)..(1131): unsure at all n locations
ccatgatgaaagacagttattcatgatattgactgagcatatgcactcactctttcatggcttcaccacaaatggacaatctccaagacaaaccttgtgatctccaagacaatctccaagacaagccatgcatatatatatgtttgtatatactatatacatacatatacaaattttattcataagtatgtatagcatacacatacatatatacgtacaaaagagatataggggtgatttgttgtcgtctagcgcgcaccacgcacggcgcacggttatccgcccatcagcaccccagaccgctcctcttctcgagcgaagaaccctagcgccgccgccctcttgatttccctccccgcacgtttcctccacaaattaattgccaaaattgtttccttacattgtgggcattatttcccctcttgaattgcattcgatcgagcctttaatcaccgtgggagacgcctgtttcctctctgccttcaatggctggtttcccacttcgccggtgccgatctccctgcctagcgccgttccttctccctagtggcttatataagcccgccggaggagtgtcctcgccagtgaccagtgaagacgccatcgtcttcttcctccaacagcgcatccaacctcaccggagtgccatcccgcaacgccgtcgctgccgccagcctcgcctcattgagatcttcctcgtccacgccttcaccaagatcagcaagcaccggacctccatcctcaccgtcaacccgagctacccacctctccttcttcgtcagccggaagtgattgtagctcaccggtggcagtgataatggcatgttgacatcagatctatgaccaatggaccggatgcaaacatggaagcactggtggagaaaccatctttggtcggtcggccgaaatccacaatagtcccggttccactaaaaactgggacatctttagtcccggatcaaaaggttagagctacttttttgatctttagtcccagttggtaacatcaaccaggactaaagatcatttttagtccccgtttaaaagacagcaagctgtgtcagacccctctgtatatttagtcacgggtggtaacacccacccgcactaaagatctatttntaggctcgg

SEQ ID NO: 36391 - DNA, 501 bp, Oryza sativa
cgcactggtgattgacattgcagctggcacattggcacatcatatacatcccacttgatttgggagaaaataaaaagaaaatggaccaaccgggactgcccctatcctctctttagtctcggttggtagcattaaccgggactaaagatccctctttttagtcccggttggttaccaactgggattaaagatcgatgtttactctcgattatttcacccgggacttaagccctgggactacaggggttataaaccgggagtaaagatgatttctctatcagtgaaggataccagtgaaggagaggatgactgttgtgaagaggagggaagctttattatttttggcatcttcacaatttttttctggattttctttcttattgaaaaattctagattcatcttattgaagaagataaaaatggattgaataagtcgaccttggaatcagggtaccttttctttaacatttatcattttcttttcgcgcggatgtttctaga

SEQ ID NO: 36392 - DNA, 1501 bp, Oryza sativa
cgcatgatgcttctgccgaagctttaggtcaatctgaaatgctgaatccactcactgtcaacttgatctcaacattctagtattattttcagtgtagcagatgttaccaagaccagttcatacaactaggtaaagcaagttattttttttattcttttatatagtgtaaccaccaagatcagtttttataactagcttatcattattgattgcgcttatgtcaacaattaagctatgcatgattaactgagggccataagcatttgaatagcatgtgaaaacccacttatactgtcacagccgtaacatacaaacaaatcgtcttaacggacttgtacaatgtaatgatatgaatagaagaaactaagaaaataattgaaaattagcacctgaagaagatccattaaaagctcatgtaagacggtgattccacgcacacgcgaatctgttagtagtatttgtttgttgctgattgcacgaacgcggtcagacatggtagttagccacgattgtgactggcttttggaaggcccaacgagaatgagattcggatcacagcccaaactggtcagctcgcagacgtcacatacgccgtcaccgtggtcgtacgagagttggacgctcgtgatcgtacttaaagcattttcctttttttcttttgggaatttgaatggtaaaaattgctctgaaaattggcacatgatggttctttttttgagcctcaaatgggagcatcgattttattcatctttagtaaaagatggagtatatatttacagctcttagttcgtttgggatggttgggaaccaaactcctccgcacggaaaacgaaacaatctattagcacgtgattaaataaatattagctattttttttcaaaaatggaacaatatgattttttaaacgactttcgtataaaaactttttacaaaatacgcaccaaaatagcagtttgaaaagcgtacgcgcggaaaacgataagggagagttgggaagcaaagtgttccctaaaaaactgatttgaagttggtgagagaacatgacaaacatacttcgacatgtgggactttgtctatagtctgtgtattacagctcatgtttttagttcatataatatcatgtatgccactatgattaggctcctttgacgcacgttgcagggacatgtgcctccaatgtgtgggaccgtgaaggtgagccccacatcttagggactcacgcccctatgtgtaagaggagctgatttcaagccattgatgaccgaattacaagcctcatctttttcttatgcctatgcttataagccagaatttaaatttttaaccttcaatttagagttgattttgggtttttttgataacatttattcagagccaagcaatacctaagttcatccaagcacgatagaccttccaatcaatacatctgaatatatgaaaggcacatagaggacggtacaatagatgccgaaacagctaaaatcggcacctatagtactt

SEQ ID NO: 36393 - DNA, 1501 bp, Oryza sativa
cattttttcccatagcgataaatacacagagaactataaaagagaacatgggcagtgcctttttaagaacaactctatctttttttgataaaggaaagaacgcataagcctctgcacctataatatcaagaaggattctccatcacgccgcaacctcattgcagccatagaagtaaaaggatgtctgaaccaattctaaaactgtttggcacgaaaataaaagccaaaggtattgcacaacaaaaaaacactgagcatgataaaataggatccaaatatagataggacgacacagagaatctccatgctctttctttcaccttgaacaatcctctgcatgcggagtaaataggaacagccaaccaacacatatataaactaacaaaacatgtctataattatctagaaaggaaatctatagcgagcgaggcaagagcattgacaatctccctctaccaaaaattgaggctctatgtatacggaatattaattgacagagaaatcaaacccatccaattaagcagaaacataaatattcccccatcacccatcaatccagatattcaggtttcatttcttatgtgctttcttacaaccagtaaacaacaagccgtggtaaacctaaatatagtagaaaactacacagaacaccacaatccaacgaagtgcaccatggcaatacaaacaaaatagaaaggaaaccggattgccccatgcctgtgcgaacatctgcctatcccctcgaataaaagaaaatatttagagcagaacaatgtatgaaccggtaggaatggaaagtaaacctgatcatttcaataagcagttaagtacacaccatgcctatcaatgactgcccacaagagctattaagactatcactgaagaaagaatcggaggtagaactgggggtgtcggcactgatccccaccttcccatacatgatgctgaacatagctggaatcagacgtgcccggtcgctgttgctgctgttgcttgcatcccacaaatcctggaagggaaacagaagcagatcaacataatggctcataacatcacagaaattcctcgacaaaaccatcatctttgccctgtcctgcaggaacccaccctgaaaaggccgtccagctccctcggcaacgcgaccatgtgtactgttctagcaccgccagcccagagataccagtgactcctccatggccgagctcaaacaaggagggaatgcacagcattcatcagcacaaacggtggaagaacaggaagaaactgccgtttacctctggcacacagacagggaaggatatgcgagcgtcggcagcagcaaggttggcgaacggtggctcccatccaaggaagaagcaatcgtcgccgcggccactacagcgatcgctaccggcatcccagctaggtagcaccacactacaaaacaaagagatcagtatgcttgtcacattttgacaaataacagaatgatcagggaacttcctgctagctaaccaaccaa

SEQ ID NO: 36394 - DNA, 1501 bp, Oryza sativa
gtgtaagcattgaaactatcagtgatgcacgggttaacttgactattacctgtaggttctttgctccatcactaactgcatggctactgagtcttgccaccagtgccagcgagggcggtcgctgccttgcctatgagagtgtgagagagagagatcggggagagagaagggaggaggcgagaattgagaatttaagaccgatagtgagagcttcccaaaaaaagtgagagaagggtgaggaataaaaggcaagagagagaactcgacttggatcagtcctgcttttatgaaaacccagtagagcagatacaatagcaggctataagccagctataaatatattttaaagagataaagatagagagagaagagcagcgggcaacaaatctgtagccagctacaacacggactccaagatgtaatgtgtgtatgataggtgggaccagatattaacagtatattaagcaactattgtataaattggttattacattggctatagatggtttggagctagcacacatcaatgcctttctaaaaagaaccgacattgataacatcagagccagttattctaatgaattggtattggtatttttgtctcatcaataccgtttttttaagctgacactggttggttgcgtggggttctgatgaacgggaaccactattggtgtaagatttagtcgaacagacactaacaagggtattagtgaaaaacatatctctatctctatctctactattataaaaattgaaaatgtttttgtcagattatttggaccatcgtcttagaatctcaatcgctcccgttcgtcgtttttcttttcagcattcgcatgcatttcctttttttcttaagtccgtaacgcatagcttagctccgtatcagtgggagagcaccgtgcaactgtgcacctggaaaggcccacgtgtgtgtagggctgcatcttctatttttaggcccactcatcctgagatgtctattattctattatataaaggaaaataaatctctactattataaaaattaaaaatattcttgccgatattttggtgcgtcatccgtgtatgagtcggttatatatatatatatatatcaagcgaactcccacagtgaatattatcttaactaaaccatataacaataataaaattaaaataaacttcacccgttgtaacgcacgggtatttttttctagtctacttaataattattcaaatttaatatttcataaccctggtgctatttgaagtttgaactaatttgcagggtagcagaaataagttgttgctgcaggagcagaagagtgaggcctggtttacactactacaaaacatcaaataggtgtcaccactataggtgccggtagtgctaaaactggcacctatagaccttttcccacctctgcgggttaaaatcgtaaaaaaccgacacctttaagtaattataggtgccggttctaaataaagtcggcacctattctattttgtgttagt

SEQ ID NO: 36395 - DNA, 1501 bp, Oryza sativa
atgccctagccgtataggtgtccaaacgggcggcacgccccggcccggcacgggcacgggtccggcacggcccgtttcggcacggcccgttaggcacggctgatgaaacgggccgtgccgtgccggcccacgtgccgagccgccggcccaagcacggcccgtggatggccgggccgtgcccgtgccggcacggcacgcctgcggcccacgggccgttcggggcacggcggcccgtgaaggcaggccggcagctgagctgcactggccgccaggccgccaggccgccagccgccaggccgccagtgcacagtgttttttaaaaaaaaaagcaaaggaaatgtataaggaaaaaaaattaaaaatggaaataaaatgtttaaaaaaaagtaatgatttactaatgttaaaaaatgaaaaaatggtatttaaaaaatggaaataaaagtttttaaaaaaagtaatgatttgctaatgttaaaaaaaagaaaaaatggtatttttttgttgtgttgaaaaatttaaaaatatagattgtgattcattattttgaaataatttaaagataaatccacacttgcgaaaatattgcaaaagaatttgttaaaaatagtaatgacctttattgatgtttatatcattacaggatacaatgatacatgctgcctcgttaaaaactttgtcatgtaaaaactcataggggaaaatgagaaaaccatgacaaagaaaagagtacagctcaaaggtcagaactacttctaacaaaattttactggggttggtctggatccaggtagagttgctcgaactgggcggccaattcttggttgtctgcagtgtattgggcatgttgtcgagcaagctcccagtctttaacgcttagtagcatttcgacgtggtcgctgcgcagagtcgtcctccggtcttcgatgattcggccgcatagactgaaggccgattcggaggacaccgtcgacacgggcaccgtcaacacatcccgtgctagttttgaaagcacaggatatgttatcttgtggtcattccaccacccgaggacgttgaaatcttgtgcttcgtggtggatggcgtcgctgtccaaataaccggacaactcttcggccacaacttgcgaagaggcgtctccacttgtagccgacgaactgccaccaccttggattgaagacgatccaccccaaatcctaccccactgtatcttcttcttacctgtagtggggataggagggggtctctgctggcgaacttcctgaaactttacttcatatcttccaaaaacctcatataatttacgacagccgtatgatccggtacctcctccacagatggtggagttggagccgatccggaggtatcgtcaaacctcgacatgtagttggggtcgaaatcacccaaggtgaacgacggcgactggtatggaaagttcggatccattctgaaaatttaaaccgacataaacaaattttcgaatatttattgaattcacaaa

SEQ ID NO: 36396 - DNA, 1501 bp, Oryza sativa
gggactagtgatggaagtagacatgattactttcagggcaaaaggtctcatcagaatcaaggtgggtatgatggatttggaagcccttcctctaaaactaattctgactacaccaaaagggctgctattccaggctcagtacactttggaggaagtggtagagcaagggtggtttagagagcaagtctttgaagaggataaggaagctgtctatactccaaccaaggtgggatagagggaggaaaaacaacatgtcaatgaggggggagaacagggaccaagtagtaacaagggtgtgtatagggctgggaagggggatgaagttgtgctagtactggaccctggattgacaactgaatctgatgtggctaagtgtgttcagttccatagggacagagatttggccatgaagttgcaagatgaggagatggaaaaacaatctgctaggattttggtccaagaaggaaatgtgattctatctaaaagcaaaggggctgggaaagggtctgagatgtctgaaattcccattgtagaagagacacgtgctggagatggggctttatctagtggtgggacaggaactttaagctgtttggaggtgatggctgagactgaattgggccctaggggagaagaaggagaaagagttaacttgggagacagtgaggatttcctagattcccaagaatctgaaggaaactttgccaagcaagttggtgtggttctgactgaagagggcatcgacagtcaagaagaagacacaaggagaagcaagagactgagagataaagaagacaaaaaaccacaagacatggcaatggaaaggaaagaggctcagaatgcctttattaacaaaggtcaggcttcaatcccttctattattgatgaaccaaatagctctctcatgaacattgctaatttgttaggagttagtcttgggtgtgccttggttgatgttgattctaatcttcatctaataaaggatatggagaatgctagagtcaatttgtttatgaaaaatcaagaagcaattttagacaaaactcaagagagcaaatcaggagattttcctgaactctctggcttgggagaattatactctttagaagatgatgtggactctgaacttgatgagatcgaaaatttgattaaaaacatacacacttccagtgggaaagggaaaagaatgaagggaaaccttgacactgttaaggtaacacccatattaggtaagagaaaagggaaaaataattctaagaaaaatgattggacttttttggaatattaggggaatggggagtcctgaaaaaataggtcacttgcaagacctaatcaaggatcatcatttagattttattggcatcattgaaactgttaagcaggaattttctgctactatgttgggtagtcttggaggtggtaggaatttggtttggaggtggatccctgctaatgggagatcaggtgggattcttgttgggatagattctgataggcatga

SEQ ID NO: 36397 - DNA, 1501 bp, Oryza sativa
ttgtcattttatgaatgaattctaaggcgtaaagatagccgagaccgaggataggtgccgatctgttttacgggcagtaagtaccgttgttcgaaaggaaaggttggcattgcctaaaccaaggataggtttgaccctagctcattcttcaacaggcacgcggtcagagatcactttccccatggttctgtttctgtgcaagcaactattgccttacttgaggatgagttttccccttgctttgcaacaaccaaattcccttttcttccaagcaagacctattccttttcaaattcgtacttctgcaaagctttagggtttagagaaagggtctttcttaccctggatttatttctattcctatttagctgggcaattctagtttttgttatgatgatctcatggatagtagtatttagttcttcttttacattcagattggtagggggaagtaagcttggagggttttaccagtgtgcggcatttaacaacatttgtatgtcgttccaactttccaaaaaacccagtctcgcagagcagcaagagcttgattgctaggcgggtcggtagaatctatggaccgaaggtcctttactgatattttaaaaattggaatccttaatcgaatgcaaaattatgcttcgcgactctgtactcataatccaaatctaatttgttttttggatgcaattttaattagtcttcgggtacaaatcgccagaatgccgccatagcatgcatccatacagcatgtgctagagcgacacgtgggagaatgagaacccaatcgtagctcaatcaaggtttctttacatactttgagttgcatcaaccctactcttgtctagaactctaaaaactaatctggaattgattaaaaataaggatagcatcggagtttcaaccgatcttacctgatacagttgaatttatcttttaacttgtttgataattgtatctaccacttatataagagaattgtctttttaaatatatcaagcatgattcaatctagctcagatcatcatatctgaggattggggcatatttggtgcatttgatttgatcaacacttttatataagtttgtattagagtaatacattgctctaaatattgggtcatcggttgatttttccaatattgattaaactacatgattaatattatagccaatgaatcatatttagggttttgctctttttaatccatcatacaagagctgattcgatctgattgcattggcttaattcttgacgatacgacatcggcttactagccgatcgactattgttcatctaactttgcttcttgtttttcttgctggctgtagaattaaaccagttggcacgctctcaacccgaaagtaattaagatttggacctgcattagagtaaagcaaatctcttagaccagtatgtgtttttttcatcaacagacacctttatatgcgccagttgctctaaatgacacatataagatatttcgcattcatcttgagc

SEQ ID NO: 36398 - DNA, 1501 bp, Oryza sativa
tttacatacccgattcaaatttgaatttatattcaaatattaatttatagacccaaagtttataggtcaaaagtttacatacccgtttcaaatttgaatttgaattcaaatattagtttatagacccaaagtttataagtaaaaagtttacatacccatttcaaatttaaattttaattcaaatttatatggtgtagcagtaagagaagaaggggaggtaaagtagtaaaggggaggtgcgggtgatcgcttggaaggggagggagcgatcacccgtccgttaggagtaccctgcagactagttcaggataaaatagtgcaggaggaaagcaaagataaaaaagacgggggaaatactacgcaaggaagataatcaagaagtcgtgggctcgtggctatatccttgccgtttacgtgaaatcaacaaggccaaacggcagagaatacgtatcgatcggggtggtgaaaaacccaacctcccccgccgtacgccctcccgaactgatcgacgccggcgccgccaaatcttttcactcctcgagtgctcgatccgccgtgatcatccccgcaattcgcctccgtgctccgcgcctccgccccgctgtccgctataggtaagccgccatctgtaaagtctcattggaagcttatacgtaattcacaaaggtatacacgttattcggtatcttcattcgtttttctccttttattttcttaataatgaataataaatccagccctacatggagatgaatgtacatgggctccttttattttcttaataatgaataatcaatccagccctacatgtctacatgtgagatgaatgtacatgggcacacatggccaatcatcatttgttggaatcgtatgctttgagtttcagaattagtgctatgttttactagaacatgcatctcatcagctgcaaatataatgcttctcgtgagggggagaaacgtttaagcttggtggctcggttcaaaattaattgctcccatgacttggttgctccgactgatctagttttctttttaaataaaaattatttaattgtgaatgaaagtcgttttcacctaggctatgctcgttagtttgttagcaaaaataatctggaatgatataaaaaataagcaaatcataaaaaagttaaatctgatgaaagctcgacaaagacctgatcaagctttttttttccccacaatgttgctactgaagactaattttctatttattcagttttaactgaacttatattgcattcatggttcaaatatcttacaattctggttgaattatacgtcttctagtccagatggttactactttatctttcgtgtcgttttggttcaagaaaagttgttctgcatgtactttattgagggggtacgttttttttcagtactaactagacaaaattgctttgtttatatatactccagcacaggaaaaagtgtcacgaactgttgatagctgatgcatggcaagttcaactccacaa

SEQ ID NO: 36399 - DNA, 1501 bp, Oryza sativa
cgattcaaatttgaatttgaattatatccgttcaaatttgaatctgaattcaaatattttctatatatagtatttctatacatctaaagtttatacacctaaagtttataaacccaaagtttataagtcaaaagtttacatacccgattcaaatttgaatttatattcaaatattaatttatagacccaaagtttataggtcaaaagtttacatacccgtttcaaatttgaatttgaattcaaatattagtttatagacccaaagtttataagtaaaaagtttacatacccatttcaaatttaaattttaattcaaatttatatggtgtagcagtaagagaagaaggggaggtaaagtagtaaaggggaggtgcgggtgatcgcttggaaggggagggagcgatcacccgtccgttaggagtaccctgcagactagttcaggataaaatagtgcaggaggaaagcaaagataaaaaagacgggggaaatactacgcaaggaagataatcaagaagtcgtgggctcgtggctatatccttgccgtttacgtgaaatcaacaaggccaaacggcagagaatacgtatcgatcggggtggtgaaaaacccaacctcccccgccgtacgccctcccgaactgatcgacgccggcgccgccaaatcttttcactcctcgagtgctcgatccgccgtgatcatccccgcaattcgcctccgtgctccgcgcctccgccccgctgtccgctataggtaagccgccatctgtaaagtctcattggaagcttatacgtaattcacaaaggtatacacgttattcggtatcttcattcgtttttctccttttattttcttaataatgaataataaatccagccctacatggagatgaatgtacatgggctccttttattttcttaataatgaataatcaatccagccctacatgtctacatgtgagatgaatgtacatgggcacacatggccaatcatcatttgttggaatcgtatgctttgagtttcagaattagtgctatgttttactagaacatgcatctcatcagctgcaaatataatgcttctcgtgagggggagaaacgtttaagcttggtggctcggttcaaaattaattgctcccatgacttggttgctccgactgatctagttttctttttaaataaaaattatttaattgtgaatgaaagtcgttttcacctaggctatgctcgttagtttgttagcaaaaataatctggaatgatataaaaaataagcaaatcataaaaaagttaaatctgatgaaagctcgacaaagacctgatcaagctttttttttccccacaatgttgctactgaagactaattttctatttattcagttttaactgaacttatattgcattcatggttcaaatatcttacaattctggttgaattatacgtcttctagtccagatggttactactttatctttcgtgtcgttttggttcaagaaaagttgttctg

SEQ ID NO: 36400 - DNA, 1501 bp, Oryza sativa
aacttatacaagcatgcaacatcatctataattcattgaattctacaaatcaacatccaatcatcttcttcacaatatttttaacacacacacacacacacatatatatatatatcatttttataataattaacatatattcatccatataatcaaagtgcgggatatcatatttcatctacaatctcatacagagtctactaaatttatttctctgttaacgtagtttgacaaaccagttttatttgttgttaataactaatataatttttactttttgctcgattattaaaaaataaaaattacttggtaatttcctcagcaaagcgtggggaattatctagtttcttagaattgggcgcttgtcaaaggcatttcttggattttctctatttattatatacatataccaaataagtttagattgcatataaaccggcaacaacaacacaaacacaccaccacacaggtgaaatggatagcacagactccagcatcatatctgcatgcatcagcctattacgatgaccagaatgcaaaagtaaaatgctaaacaatcaccaaccagttattgtaaaaatgctacaatcaagtgatcaatccatcgtgcatgtttaagaacagatcatctcaagagtcatccgttcgtgcatctagcttaagaactcaatgaaccctggagctcaagcaattaagagaattaccataatctcagttcttccaaaatcaggaagaaactacccttagttttctactatttctattaaattatctgagcataatgtaaagaaatttcgatgaagcaccatcttgatagaatggaggtgcacacatatattttcttctccacagataagatgctctgttgcatctctaaataagaaacacataagtagctgctttcataaattttgagataattaaaggatgtagatgctgagcaactagtgttggaagcacttatatggatgtgctatagtgccattccatatacttaccagttaccaacgatatggaaacttcatgtttccattgcaacagttttcgaaagagagcaaatcattatattacacgggagcaaatagtcctagttttaatattgaagcaatcaacacatagcctgacaatgaataatttaaccagatcaacatcctgagcttatcatactccacattctggatattttcttccggagaagccaagagttcatatattgatgaatcttagaaaatatcatgtctacttctgcagacaacataataaaaaaaatataaatatttattctcaaatgaaccgaactggcattttaatctcaaaagatcaaattacatttcaacctccaaatatcaaattactagatttagctctaagtttgcaggcaatgagtgaataatctttacaaacatgtctttgagctccccttgtgatgtcattgcttccaatatcttatcattggatatcactttttttgacaagttgaaatcctgcaggctttggtatt

SEQ ID NO: 36401 - DNA, 1501 bp, Oryza sativa
ctgtggcacaccccactgccacatgggagctcattggcaccagaccagtttttcactgctgcaacttgtttgttgccatctctctattgtgtctgcttaatctattaagtacttgtgcttcagtttgaacgctcaaatgtgaatatcaccagatgaaaggcactcccagtatcactatctttttaccgtctcatcacatttgtgcaaattgactcacttggtttttatttgggccaattacatatttgccattggtttgaatcggtatcgtggatttgccattataaaaaacataattgcctagttgccaccaaaaatggttggaacctataatacttgccattaaactgacagatcaaactaacaccgtgagaatgtgagttctcataaaaattaggacaaggatgccccatgcctcccgctactgcttcctgcgcctgctcaacacgaccagcctgctgctgctgccgcgagctgctacgctgctgccgcttgccgcgagcgctcgtgctgctgccgcttccgggagctgctgttgctgccttgtgctgttgccgcttgccgcgagctgctgctgccgctgccagcctacccactagttgctggctgctgcgctgtcctgagctgctgctgcttgccgcgcattgccgccgacgaagtacctaccgctaccctgtatccctttcttgcagtgagagggaggggatcggttcttatccaggagagaggaggcagcgaggggatctatttgcaattctccctgtttattttgaacttatggcaaaatccacgaccacatacatcattgttgtgggaattgggtgatattagcagcaaactagaacgagcaattaaggagatcgaaaactttctgagcggtatgaccgtgtgagcacatttcaaatatgcagtctgacaggaaaattcaatcatgtagtatgtaaaacagacaagaaagtatacgatatctgcaatttacatattaaaataaaaatttttcgtgcacttaaatgctactttttgaagcattgagttctagaattacaaacagggatatgcaaatgaaattgtgaatgagacgtgttatttattagagaaaatgccagaaataccattgacaaatgcccaagtccaagaaataccattgaagagtgcaagtttcataaaataccattgtacaagcgactttgtccataaaatgtcatcgccattaaggttccatccatcctaccctgttaaatgcactgttcatcctataacacttaactagcactgtttatcctataacacttaacggagggttactaacaaaactctaacgatgatcacacttctaggacatagtcacttatacaatgatatttcatggaactcgtacttatcaatgcgtcatatcttactataaagttataacccactaattctaaagctcaacatgcaaatatgccacctcatcatccactagcaataattacatataaaacttatgccagcatgcaac

SEQ ID NO: 36402 - DNA, 543 bp, Oryza sativa
  unsure (1)..(543): unsure at all n locations
ggaggatgantttcgataactgatgtaactattccatcagcccacagctgaccantggtctgcatttttgctagtggctgccttaaatgggctgcttgttctaacacatctacagtggaagttgtttcatttttgcagcaaatgaaaaaaaaggggtggcgctagcctaaaccatttttgaagtagtgaacgtgcaaaacttgtgcagaaattaaagaaacgtattatgtgattgttcttaacagaagagtttaattattgtcaccattcaagggagtaaatacaaggtttgtctaggagattgtctatctgtgtgaaatcatgaaagagtgagtgctattcttctgtcagtatcttgaaccactatctttgatcatggaccagcttagtacaatgttctactgggctgaaggtaaggggatcctgctgatgaggtgagatgtcctagtaaaaaattgagaagttgtgatggaggccttcaatgacatgaaaagtgatgccaaggtaatgtttccatcgatgaaagagtgttgtggacttagt

SEQ ID NO: 36403 - DNA, 1501 bp, Oryza sativa
agcaagggtgagtacaggagtactcagcaagccatgggaattaagtgtttaatgcaggcttcaaaggaaaggctgttgtttttgcaattgattttatttaaactcctttttgaaacaactaagcgagtgcttctcaaacgacacgaatgagacagtgcgtcttgtccggtcggagtatgtgcagtgtatcagtctttgaattgatcaaggttggcacccggccaacagctttcaaatggccacccaggcctagctgatcctatcagccgcagattttccaaacatcgatcccattccacaacagcaatttcacaaagtagtagtcaaacaaaactacgctaggaatcacctcacatccgcccatgaccgtgggcacggctgttcgaacaatttaataacctctgcagagggagtacactttacccacacgacgttactagccttggtcacctagcccgtgtggaacggccacgtctggagaccttgaggctttcatgacaaggcatttcgaaagccgacacaggttcaccatatgccaacgagaggggtcctagaccgacatcaggttaggtcccagaccatactgtgccaggaagcccgggggttctccccggcaccaccccgttgaatccacatgtctcttggcatcatggctcccctgattagctaattactcagccaggggcgtcccatttcacccatgtggtcgcacttgtcttatgttcggatgaaattcctagggaaacggtccttaagtgcaagaacgggaaaccgtactcccggtacgtcccccggtctgcggttttggaaattcatttagttcgcaagcaccgacccatgtgtcgggttttccaagtcttttgtaaaaccccaaattttacccatagttggatattttaaatttgaggggaggtgttctgatgcccgtgcccgaaggcccgtgcatcgaagcacaacagttgacaaaggaggttcaagtgttcaataattcacggagggtaattgcagcaattaggattggggccggcaggctatctcacaagccgcggccgaattacttgtgttaaacctattcatgcaacatttgcggaaaagaaatacttagatttaaattataggtgcaagatgatcaaaagtgacttgccttgctcgagatcttgagcttgatcctcgaaatcctcacactgcgggtcttcgggctccgaaactacacgcgaaatgggacaactcaacaaacggcgaaaacaaagccctattattgacctctaagcgtgccattagatagatcttgagatttgaggaattttggaagttgaacggagtcaatcggatgtacggttgagaagatattgaatttctaagattattggatttttgatctaaaggaaaaaggatttaattaaacccttttggaaaaagaaagaaagaggaaggggaaatagacttccctcgggcggctagggctcggcctgagagaaaagggcggctcggtcgagctaaa

SEQ ID NO: 36404 - DNA, 1501 bp, Oryza sativa
gccgaactggatctcaacacctgaagccgccgtcgtcgtcttgaaccacgcggttgaggtatgccatcaaccactgcgcgaatgagtagcaggtcctggcatcgcataggtggaggggtggtgtcgtctcgaaccgccggctaaccacgcgattaattaggaggtgggcagggagattaacgtcataggtgggaggctgggagcccatctcgtcgtacatcatgatgggtcatcgtaacgtttgtgtgcatggctgttgaatgtatccatccagatggcacttgatctagcgtcatatcacttgatcctacgactgtaaaataacgatgacgtggcttcacctcaagaagtttttaatagagtgggctctgaaatctcaatagggtagctttataggagttaatacctgtagtggtgtaacgctacgcttctgcgaaacgttaaaaaactaattcggcaaaatcctatatgcgaaaatttcgttctttgtgtgagagtctaagtcgtgccatggatctcaattctatctcccgttgttcaccctcgtcaccatcaaaatcctccacctcgacttcctccttccaattcaagtctccgaaacttaaacgtctcctttaaatcctcgccaaatacttgtcctcgttcccaaaaatatcaaaatctcattttgaatctcttccttgacttctcctcgagtctcccttgattcctccctaaaccctcgagttcgaatgtcaaatttgaattcgaatccaaaccctgaatctctccaattctctccaattcaattcctctggaaaagtctattttgcctccctttgtttttgtgggccgaattcctctcccttggcccatccctcctctcagcctgtttcccctccccttcgcacgtgctgagcacgcgcatcgtgcccgagccgagagagagcgcctccctctctctctcgctctctctgtttctctctctcgtcgagctctcccaccagcgccggtttcccgccgtcgccgtttgaatccggccgcgccctcgcatccgcgcgcgcgctcgcgcgtggccaaccacccggtcgccgccgcgtcggccccgccgcgcctgcgccccgcagccgcccatgctcggtcgctccaagccacgtgcgttcaaatcccggaggcagagcctctctctccctcctcctttctcccaaaatggcatgggcagagccccctttccttcctcccctttttcctttctccccttcccggactggcgccctgtctccaccgcgtggcacctagcgccatggacaccgagcgccagctcgcccccgcgccagcccgcgctgctcctctcactcccgcggttcgatttccaccgcccgatcgaccgcctttgccgccccttgcatcctcgtcgtctgccgctcttgcgtcgcccgtgaccgccagccaagctagcgcgaccaccatctcccgctccttgaccgcataggtcagtttcctccccaaaccgacttcacca

SEQ ID NO: 36405 - DNA, 1501 bp, Oryza sativa
cttcttcagcaactggggggggattatttatatagagcaagggtgagtacgggagtacttagcaagccatgggaaataagtgtttaatgcaggcttcaaagaaaggctgttgtttttataattgattttatttgaactcttttctaaaaacaactaagtgagtgcttctcaaacgacacggttgagacagtgcgtctcgtccggtcggagtatgtgcaatgtatcagtctttagaattgaatcaaggttggcacccggccaacagcttttcaaacggccacccgggccaacaactttcaaacggccacccgggcctagctgatcccgtcagctgctgattttttcaaacatcgaacccctttccacaacagcaatttcacaagcagtagtcaaacaaaactacgctaggaatcacctcgcatccgcccatgaccgtgggcacggctgttcgaatagtttattagcctctacagagggggtacactttacccacacgacattactaacccggatcacccagcccgtggggatcagccacgtcgggagacctccaagctttcatgacaaggcatttcgaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccttgataagctagttactcagccaggggtgtcccattccacccatgtggtcgtacttgacttatgtttggatgaaattccaaggaaacggtccttaagtgcaagagcgggaaaccgtgcacccggtacgttccccggtccgcggttttagaaattcatttagttcgcaagcaccgacccaggtgtcgggttttccaagtcttttgtaaaagccaagttttacccaagttgttatttagattttaagtttgaaggcatccgtcgatactcgcacagagtgcacgagcaccgaggcgcaactgggtggttacaagggaacatggtataacgattaacaaaggaaggatcaaatgcaacaaattaggtaggtcccgccaatctgccttgcagacgagacaaacagattaagtgcgatcctatcaatgcataatatttttcaagcaacataattaaattcaaatataggctcaagatgttcaaaggtggcttgccttgctcgagatctggagcttgatcctcgaaatcctcgcaccgcgggtcttcgggctccgaaactacacgcgaaacgggacaactcaacaaacggcgaaaataaagccctattaatgacctctaagcgtgccattagatagatctcgagatttgagaaattttggaagttgaacggagtcaaacggttttacggttgggaagatattgaatttctaagattattggatttttggtcttaaggaaaaggatttaattaaatcctttttggaaaagaaaataaaagaaag

SEQ ID NO: 36406 - DNA, 1501 bp, Oryza sativa
cgcaaacctcaggagagctcgtcgcgcgttgcgagatttcagtgcgtggagttgccggtgaaacgaccagcattgggcagaataacttctcgcgtgcataattatctcgttaggttttttttttgtcttctccagttgattctgggatttcacaaaggcagtattaataaaatgtttcaccatgtactctctccgtttcaaaatatttgacaccgttgactttttagcacatatttgaccgttcgtcttattaaaaaaatttatgaaatatgtaaaactatatgtgtacatgaaagtatatttaacaataaatcaaataatatgaaaagaataaataattattttgaataagacgaatggtcaaacacgtactaaaaagtcaacaatgtcaaacattttaaaacggagagagaataacttaattggacagtaattaaatgatttcctaagcagtgtaatgattttcttagcaccctacccttggtgcttggtctatttggattggaaggaaaggaataacatgtgttcagccgctgcacaccgtcctggcccgaggtcgtcatggccatgacgtaggagccgccagagtggtgcaggaaaccaccctctggcggcttgccagggccttgtagcctgcacttcctatgtagggtgctaggtcactaggtcatctattttgtagtgtgagaataggggtaagttcctctggtttttagtttctttttctttctcagctcttggctattgtttcctttttgtttggtcccgtttgtaaaattttattcctcctgatacaaaggtgcgttatccttttgcgtattcccgaaaaggaaactatggcgtgatatgaaactttttaccccttccccaacattcaggtaggagaagctcctccccactccctccttgactagtctagaaaaaggaaaagaagaactctgggtctattatgtcgctcgttgcctcgccagagctccggccactacctgtcgatctgcatgactagatgtaaaatcaaattgtgtttgattcttattctatgatgaacaattggcatatgagattatagtttttaatatttgaggattattggtgaagtggttttggagatgattggatttacaagtgttattcaggtgctgctgttttgtcaggtccggtcagaccgagtgggtgctgccggtcagatcggccagcctgcggtctgaccggccgactctgcgtcggtttcggtttcgggtagtttgattggatatccgtggatattttgtatttatggcttctagatagatactatacgtatgtaatactgttgtttgctaataatgagttaagttggagatagcttggtctaggaatatggtttatttgtttgattcatgtgtatgtgacttgatgcctcgcgggggagttttgccggtgatggatcaggagtcaacttggagataaggtgacgtccggacggtcagatatcatgtgggatacttaggctaacgatcaa

SEQ ID NO: 36407 - DNA, 1501 bp, Oryza sativa
aagaggcggtggcggcctggcggcggctccctccctccgtcggatctggcgaaatgtttcttaaaagatttctgtgaaatgatttgtgtgatgttcttcaatgtttcttgatgttagtgaaatgatttctgtgatttctgtgaatgagttctgtgatttgggattggggattagggaatgtttattgatattagtgaaatgatttctgtgatttctgtgaatgagttctgtgattggggattggggattagggattgtgatgcagagattgtgatgcatcaagctttttttttttgctcacgagtggtgtcaaaggtgccggtttttaaaataggattggtgccggtttactgttcagtgccgccttcgtagtgtcggttgaaaaaaccgacatagaaaggggtttcccaaccggcactattctcgtgttatgtggtagtgacctatgatttatgcttccacaaaaatgcattgaggaggctgaaaattttttttcaggtttcgtgttcaggacgagcactgaggaatccatatatagcattctgttctttcgagggatcgaagttaatggtgctcatcgatcatatttcaccatttgtctaagtgattattattgtatcaataaaataaattgtagatcaaaggtatatcatttgaaagtcagaacacgctttgtttcttgagcggggagtgcattacaagttacaacacggaaatgatgctgtacacctgaatcaaattgaagcatgagaaagccacaacatctaattttgggaagtagtagtgaccagtacagattccggaatttgtgacgggctaatgcgacctgtttaggatgattcatctctaatggataaaagatatcacgtttgagatataactaccagggatggcccgtcaccgatatggggtcaattatgatggatcatatatagctgtgatgttaaacatcacggatgacctataacaggtcacaaccgtacatcgtcgcatataacatgtcatccatgacgggtgtaatgagataacccgttaaagatgagagcactcatccgtaatggttatttgtgaagagtggtaattacaagccgtcacggatgagggaaaattcatttttttggaaaattttcaaacaaacttgaatagagacatgtcttatatgaaagttgtaaatctcgaggagatcaataactttaaaattgacaacatttgaatttgaaatagtttacatgcccgaatatgcattataaggggaacatatcctatgcacacaatcttcccgtgcacactccgtgcacaacaactaacaattgtcatagaaaattctaaaaaaaatggacacatattttcaatagtattgcacttatttgtgaaattttatcttcaaattcattatattttagccataaaaaataaaaaatctaacagttttaaggataaaaatatgtcaaaattttgtattttttgttacggctaaaatataatgaatttgaaggtaaaa

SEQ ID NO: 36408 - DNA, 1501 bp, Oryza sativa
agcgtgcgaccctataggttcatgtacactcggctataacccgaaaactctttttcggtccacgcatcaacagcggcccctagcagaacatattgagccaccgggcatacaaaaagatcatatcgactgaacctctagtgtatacttatatgaacccctttgcctcacgatatcgattaagctcaaggctagatatgtgccatcctctaatagctcaatcattcactcgaacctgttgatagattatataactcgtgattgactcctcaatcacctttggcatggccatgcatttccataatctacaacatcgaagggcccagagatatttctccatagaaggggcaaatcccatcttgattattcatattccactacatatttcatagcatacccgaaaactagttttataactacccaattacagagtagcgtttagcaatccctaagtaagctactacacatgttagctaggaaccatgataatctaaggattcaacaccaacactaaatgagatcactgatgacacaacacatatggctcttgcagtgtctcatgttggatctatccaacaacatgttcaccaacatgtgtccacattattaatttgttatctctataccatgatccatgagacatgatcattaattaacatatgtgctgatcatctaaatatatttgttccacatatgatatttgatcaggaatcctttagaaatagcaacacacaacataaagagtctcatgaaagaatcacatatttattaaccaataatgagttatctatttcaagaaataaagtcggataaatatataaacatagtatgtgatacaatcatctctatgattgcctgcagggcatatcactgacacttcggtccttccattccacggatcagctgagaattgattatttcaatcattaaactactctgaaactttacccttttttttttcttttgacaaactcacgatcggcaagttccgtggacttgtgcttgtggagtagtaaatcgcagcgacataatcttagtacttgcagattaattagggggaaggttgatgataatttaactttggcatttgtacagtacgctttctcaatatattgagctggtggcatcttaatatgtgaaagcaccaaagttatctcaaagagaatgagccacatcttctaaaatacgagtaacgtttgataaaactgataaataaaactacaccattagatcatatatgagacatatattggactaatcaggaggctcgcacaacttttatctctactctttttaatattatgtttgattaattaatcggttgataaataaaggaaaaagaataaaagtgacctcaaccttgaattcataatggagttattaatccctgtgattatcattaataatgtgatttgctgcaagattaacaagagagtttatttccctggatggagcacgtacatatgagaagtcgtatattgtatatattgatcactggacgtca

SEQ ID NO: 36409 - DNA, 1501 bp, Oryza sativa
agtgaggaagaaacattgggatagtagggcaaacaactctagtcaactcaatcctcacatcgcaacttgtctacttcccgatacccctaaaatttacaaaggaatccctagaggtgcttgagaaatagaggaaacggttcctctgggcaggggcctgatagcatcacggacgaaaaatgcaaggtcaactaggcaagaacttgtatgccaacaacttatggaggactggggatgctcaacctggaaaatttcatgagagcgctgagggtaagatggatatggcacgagtggaagtaacaaaaaaaaggcatgggtcatctagacactccatgcaaaatatcttataggctactatttacgacagcgacagcaataacaactggagatggggaagtgatcctttcctagaactcggcatagatgcaaggaagacgcccaaaagacatggcgccaaaagtctacgcgatctccaagaaaaaataggcccctccgagaggccatcgaggacaacacatggttacgggatctcaacttatctcaacttatcaactagtacggacatgacggtggaactcctagaacaaccagtcaccatctagatagcagtgcaaaacatcaaactcaactttaaggaaaagaatgagatcaaatggaagctcatatgccaaggagaatacacagctctttcaacctacgaggcacaattctttggcttagtcaatacgaattatgagatgttgatctggaaaccatgggtgctgaaaaaaatgccagattttcacctagctagttgtccagaatagagtttggactttcgacaaacttgcaacacgtgagtggccaaacaactcctactgtccactctgccgccacacgctagaaacatccttccacctcctggtggactgcagatacacaagtaaaatttgggagaccttagcaaattgcgagcagcacaagccgacagagtggagtgcaaccacaataatccatgactggtgggcagagctagcaaccaccaaatgactattgaaaaagggagtctacacctaatcctcctcacggcatgggaagtctggaaggaaagaaacaaaagagtcttccagcataaggagtttatatccatcagatccttgggagcaaagatcaaggaggaaggcaaaacttgggcctcagcgggagccaaacaccatgcgcttttaattccttaggccttttccctattgtacaattctttctttttattctacatgtaacttttacttctcctatattcaatgaaattggcacatcctgaaaaacgagcgagcatgtagtcttttatcatgtaaatatcatggcatgagcaagttgatatgtggctacagtggtagcagtgtgcacttgttagggcatgtacaataagtatatatgttataacaccgatggcagaagttcttccacatatattaagaataagagttggctcagtttataaggaagatcgggccaaaactataca

SEQ ID NO: 36410 - DNA, 478 bp, Oryza sativa
agttttcgcagaaagcctaaaatgcgtaaataattttagggcaatttcagagcccaaattaatatttctaacaaataacaaagttaaaattgtttataaaaagaaaacctctaaagagtcccctttcctcccttacatcttgggcgggttagcccatctcactccccctccctctcctctccccgcggcccatccggcctctccccgcgcgcgcgccgctgacgggcgggcccgcccgccaccctcgctgacgggtggggcccacccgtcatccccttcctcccgccgctcccgccgcctcgcccgcgccctagcgccgccgccgccgcgaatcccaccgcctccagccgtccccgcgtgcaataaagaggggaaaatcactccccgtgatcccctctccctttccccccatttttccctctctctctcgcgttcaaacgggtggatttgcccccgcaaatctcgccggcgccattga

SEQ ID NO: 36411 - DNA, 355 bp, Oryza sativa
  unsure (1)..(355): unsure at all n locations
gcgggccgccgtcagggcgcgcgcggagaagccgnnatggccgcggganagnaaagnaggggagtannatgnctganccggcccaagagganaaggaggaaagnngnactttttagagtttttctttttataaaatcattttaactttgtttatttcttaataattattatttgtgctctgaaaattgcactaaaatttatttacgcattttaggcttttaggaaatatacaaaaatcctccaagccttatttaacttttaactttgcacattttaattgttggaggctttcacacggattttaattattctaggcataatttagaggatgtattttagagtccttttgggacgt

SEQ ID NO: 36412 - DNA, 441 bp, Oryza sativa
ttaatataaaaaatagggaacttactttattcaattgttgtacaaaaaacaaagaaagaaaagaaccaatacatgtgttgggatgttcactacctagcacttgcttctgatatagcaatgaaagacatgcattgtggttacataacactgatggtcttatgagagtaggttccagctgctagtagttaaggggacacagttacatttaaaggaatatgggcacgtggaaagagagaatttgaaaattgaggcaggggattgctgaggcacccattctaggaacaattatgtgggtcaatcaagtcggtcagctaatgtaatataatccttctgacatcactttgttcgtcagtttcacaaaaactgcctggtttgactttcctcattctgaagtgaaggcaaccagatcaagcagataaagtcactttgtttttgatgagg

SEQ ID NO: 36413 - DNA, 1501 bp, Oryza sativa
agctggactcccttgcgccgcctcccctcaggacttcgccggtgagggcaaccaccgttgcttccgccgtgggtttcctgccggtgaggatgccgacgcccacgggagccacctccccgatacaggagcgtcgccgccgccccttcgccagtacctgccacctcctcgcaggagtcggcccgcgtcgaactcgccggcacctgcacgacgactacaccaagccgtgctcctaccgctcgcagttcgtcgcccaaaccccccgccgcccaagaaatcgggtacgatctcttcgttgctttggttggtttgattcgattgcaatctctgcaatcctgtggaatccctgctgcttctattttgggtaaaacttgactccgattccaaaacgaatacagtcctcgtccgtgccatgtgtattgaaatcgaaccgtgcccgactcctataccatgacctccaccaagtcaagtcctgcatgaacccagatcgggcctgctactaccagcgccgcttctgtctccgtcgccggcacgcctcaacgcaaaatcgtgcacaccaccacgaccctgacctccaagcttcacgtacgccagcaacatcctggttccagagcaaacacacacagcacgaccaccgacatcgtcaacgacttctgccgccaatatgtactgattctatgctgacgcttctctgttctaccatccatcgcatgtacgctgctaagtagcaatcctccatgcagtaccttgtcgttaacacctccaaaacagcctgtaggatccacccgctccgactttcgattgaacgccatcaatctagtcgcgaaccgaagccgacaagtcgcgtgtcgtcttcccagccgccgaatgacccgagtgctacatctagccgtctccctgtcgaacgcagctcatcgaaaggcctaggccacccgcccagagtgttcgattccaccgatcgagaacgccaatcacctccagcttcaatcaaccccgagcgtctggccagccgctccctgttgaaaatagctcaccggaaagtttgagccacccgcccgaagtgttcgacccaccaattgaattgccaatcgcttccgccgccatcaacccgagcaccacgtctagtcatctccctgttgattgcagccatcgaacggttcagaccaccgcctgaaatgtccgattccaccgatcaaattccgttgatcgccgtcgtgctccaccttgcgtccatgtccgtcctggacaccctgtgtagtcgtcgcagcgtggagcaccaccctcgtacctctaccatggatctcccgtaggctctgataccacttgttataaaagcagccacgaaatcacatcggaaaccaaatgcggaagaaatgccataggagatccaaacacgatgacgacaccgaggcacgatatttgataacggagttcagccgaggcctacatctccgtggcactgattacgggcgctccttcccgatccagcatatacagcgtatct

SEQ ID NO: 36414 - DNA, 206 bp, Oryza sativa
tagttacgtcctctggaatcgctaatcgagttaaatggagtcgcgcgctagcggcgcgtacgcgcgcgttagctttccgaatctggcctggtgtatggagtcccgaacaggcccataaattggcgttcggagcccaaaacctctcgcatttccagcccatcaagtcgcttcgtcctgggcttagcccaccacgtctctttctcagt

SEQ ID NO: 36415 - DNA, 1441 bp, Oryza sativa
cattcatgatgtgatctccgaatctatattgggtagagtctatcccttcgaagtccatctgtctgtgtacattttttgttcttagaagttgactatgtggattttcagaatatgttatccgacctgtcgttttcctttcctttttttgcccagtttttcaggatctaagtggccctcgaggtcattgtggtgtatcctgataatgcattgattttgcctacgttattaaataaacggccatgctatatttgggaggaatcgtctgcttatagagttgtgtttagttcacccccaactaccccaaacttctaactttcaatcacatcacatcacatccaaaactttcctacacacgtaaacttttaactttttttccaaacttccaacttttttcaagaactgaacacaccctagatatattgtgaagtactgttctgtaatctatattgcagggccatgccattttcagaagaactgcggctacggtaaatgtgtcattttgtgcacaggcacatatatagaactggagctaaacttttctgaccactaagtatgtaatttgcttctaatttttgaaatgtctacctgtttttcctggcaaatattctgcataataatatgccaaaaaaaaagggctgtcctgcatacatggcctgtgctaaggctaaaactatacttgttgatcgagagtcctgcagttatgcagaagaattaaatctagaatattgttcaaaatttcttattacataggataggacatggatcgtttccttagggatgaccaaattgttgtcaccagatcttttcaatggtttgctttgcttgctttgcaaaatttaatgctgctgtatgtagcatctttcctcaaactaatattagatccaaaggaatattcagttcatctctttatttgcttgtgtctatgttcttcccttagtttttttagggaattcgtttttgtgtctttcatttgaggaggaactgcgattctttaactagcataaatctagaaattatattggctagcataaatgtgattctttgagctgtggcttccatttatttccagttattcacatatgtcgtgctaagctgctcctatcatgtggcgtaatagaattgtttacttataaactaatattttaagttattatcatgaatcagactcattactctggtgacaatgatctttctgtccccttatctcaatttgtaatctttgcttgtttgttgtatgacttttgagaaagtgatatattcagcttcaccaactaggccttttactgagttcgggagaaaatatcaaatttgttcaaccatacacccttgtctatcatggagaaagaaaacaactctggtttgcctacatatatacatgtatacaaatccacaaactgatcagccaaccttcatagtgcataacaacatactccatcaatgg

SEQ ID NO: 36416 - DNA, 1501 bp, Oryza sativa
gtcatttcaaaaattcaaaaaatattttggaaatagatcacatcacttataacacatattcaaatgaaaaatattgtgaattataaagttatatatctcatcgaactctttcacttcgatataggacatgtctccatccgagatcttttgaacaaaaagtaaaatcaaaattatgtatttcaagatagatttcaccacttgtaatgcgggaacatatcctatgcacataagtttttccgtatacactccgtgcacaccaactagcaaatgtcatagaaaattctagagaaaatttgacacatacttccaatagtattacacctatatatgaaattttaccttcaaattcattatattttagccgtaacaaaaaatacaaaattttgacatatttttatccttaaaactgttagattttttattttttatggctaaaatataatgaatttgaagataaaatttcacaaataagtgcaatactattgaaaatatgtgtccattttttttagaattttctatgacaattgttagttgttgtgcacggagtgtgcacgggaagattgtgtgcataggatatgttccccttataatgcatattcgggcatgtaaactatttcaaattcaaatgttgtcaattttaaagttattgatctcctcgagatttacaactttcatataagacatgtctctattcaagtttgtttgaaaattttccaaaaaaatgaattttccctcatccgtgacggcttgtaattaccactcttcacaaataaccattacggatgagtgctctcatctttaacgggttatctcattacacccgtcatggatgacatgttatatgcgacgatgtacggttgtgacctgttataggtcatccgtgatgtttaacatcacagctatatatgatccatcataattgaccccatatcggtgacgggccatccctggtagttatatctcaaacgtgatatcttttatccattagagatgaatcatcctaaacaggtcgcattagcccgtcacaaattccggaatctgtactggtcactactacttcccaaaattagatgttgtggctttctcatgcttcaatttgattcaggtgtacagcatcatttccgtgttgtaacttgtaatgcactccccgctcaagaaacaaagcgtgttctgactttcaaatgatatacctttgatctacaatttattttattgatacaataataatcacttagacaaatggtgaaatatgatcgatgagcaccattaacttcgatccctcgaaagaacagaatgctatatatggattcctcagtgctcgtcctgaacacgaaacctgaaaaaaaattttcagcctcctcaatgcatttttgtggaagcataaatcataggtcactaccacataacacgagaatagtgccggttgggaaacccctttctatgtcggttttttcaaccgacactacgaaggcggcactgaacagtaaaccggcaccaatcc

SEQ ID NO: 36417 - DNA, 270 bp, Oryza sativa
tgtatttcagggagcttgaaaggtttgtagattttcattcaccaagaactacacaatgtcaagcctaaaaccatggtgcttaatttgtaatttaagtttatttaactacagttctaatggtatatttggtttggttttattttacccaagtttgaatattttcacatgtattttttttggaaaaaaatatgaactgtaaagtttattccatgtttgggttagaataacttatttttctaacaaaaattaactttctttaaataggtaaca

SEQ ID NO: 36418 - DNA, 232 bp, Oryza sativa
tgaagaaagtgatgaactattgaagcaacaatgatattataaaagaattaatcaaagaacttactgactgagtatattgaggtgaaatagcatagtttgcagcagccaggttattataatgaacagccttgctggacagggatgaaccgcctggcactgagttagtttcaaatacaggtaacccggttggaactccagctacagagtttgagatgtagattgggttaacaga

SEQ ID NO: 36419 - DNA, 465 bp, Oryza sativa
tattaagtgctaaatcgtattttagttgataatattaaaaaaaaatctccatacaatttcaagaaacgaaggctgcagcttgggataatcaaattacataaagggaatccaggcacggagaaaatgagtacaacattgtatcggtctttagctctgttttctttagatagtgtttcgcttggagagcgagcaaagaaaagaacgaaaatatgatccgcagaaaggctgaagacagcattggcacccaaatacaagctcaatgcttcatgtgctcacaaaatcaataacctttttttaaccttctgttgcatctacaaatccccaaatcaagcatgtatatcacgcacacaccaatctatacaacaatcagcacagcgcgtatgcacaaaactacacccattgtcaccgtgtgtgcgttaactaaccgtgaacttagctcatcttcttcttcccggtgttcacagg

SEQ ID NO: 36420 - DNA, 379 bp, Oryza sativa
taagagaaaaacatgaccaaagttaattcgaaggcagctctgactaatgattttggttactagcagttacaaccaagaaagcatactaagatttatgtcagataagagggtagttgccaaacaaatttacttactgtagacaaatagctttcaatttctgaagtaataccagctcctctttactttcacacggcaatgaaaaatacaacatgctatacccatagaaaaatcaagaacaaaatagcttcaattcacagagcattcaatagatcacagtaagagcatccagtcatattgcaactcttttctgtcactttcgtatttttttagcaaatcaaagcataagtattcttttttgtctttgttttcacatatcagt

SEQ ID NO: 36421 - DNA, 1501 bp, Oryza sativa
acattaatcgtgccaaccacaagccagcgtgggcaacagctttaccttttgtatagcatgattcattgcggagcaccagactgagaagtggcggagataagcccacaggggtcgctggggagtccatgccttgttttataagggggtgattatgatccaggaatggtgcactgtcgtgagttgtgttgtgcagagggtattgtcacagcttctattcgggtactttccagtatcgcgacgcatggtagacatgatgttgaggctgtgtcttgtggatacagtggtacacctctggccagagtaaaactattcgaatagtcgtgcccgcggttatgggcgagttgagcaatgtttttcgtgattagtctcacacctctcacaataattaatgatgttatactggtaataatttgcttagctcctggtttggagatttgatctgtacagccgggtatggttgttcaggatggttgggcctgtgcagcatgggtgtgctgttcagtgttgattaaaatttctgattaactactccactattttattcctcttaaatgttttgctaaatgctgcttttgcaaatgagcctatattatgccatcctttggtatccttgtgcacttgcatatttgttgtgtggcttgctgagtatgtcatatgctcaccttgcaataatcaatcaacctcagttgaagaaaaaggatccagaaggagaagacgtttggcttataccccagttgagctgcctgtgggagtgtagccggagcttcgctagattttattttccgctgcagttttcttcttggtgaggacttagtgcctcttaagtaagtatttatcgttttagttaatttgatgaatctgtatattaaattgtcaatttgtgtacctcggctgattcctggacgaggatttcatgcacaaataagttcggaaattactagtgaatttccgggcgtgacaagttggtatcagagccatctcgactgtaggataagccaaatggtcaaaccttaaggacaaattttccgaaaacatgatttgtgaaaatttctcctttcttccttatctagaattctttgcaaattgttttatcatcctctcccctcctgctttcaacttgagtagttctgaaactagttgttgaaacttgaagacgccaatgaggtctacttatggaggtcagtcaagtggatcgaggaaggaccgaagtgccaagtggtcaagatggaatgaagtttggatcctaccttagaaacctatgccgccaaagtgtctttgaagaatagttagtagggtagaacgtttgtttgctttgtgtgtaggtatggttgcattcccatcattggagtagttcattgatgagtgtgtaactgtactaggttgcttgcttaatcaacctgaacaatataatggtctacacacatcagatcagtgttaacctggttaaggtcttgtctttagtgtaacccctctccttctatcttctctaatatgcaacaga

SEQ ID NO: 36422 - DNA, 1340 bp, Oryza sativa
acggtgcactgctttgaattgtgttatgcagagggtattgtcaccatctctattcgggtacttgttaagtatcgcgacgcatggttgacatgatgttgaggttgtgtcttgtgggtacagtggtacacctctggccagagtaaaactattcgaatagccgtgcccgcggttttgggcgggtctaacaatgtcttttgtgattagtctcatacctctcaccgtaataaatgatgctgtaattggtaataacttgtttagctcctggtttggaatggtatattcctggtttggagatagaactgtgcagccgggaatggttgttcaggatggttgggcctatgcaacgggtatgttgtatagcgatggattaatattgtttaattaaatactttactgttttattaaattctgaagtatttattaaatgccatttatgcaaatgagactatattataccatcctttgttatgccttgcatttgcatatttgctgcgtggcttgttgagtatgtcatatactcaccttgcaatcattcatcataggagttctacagtgatgctgaaggtgtggaggattaggcgtagccctggtcaagctgcttgtggaatggagtcgcctgcgccgtttatcttattttcctaattttattgtttgagaggaactatctacctctgtaatgactttctattcgcttatttattagagtaattattgcactctattatcaatttgttattgtgtgcctcggctgattcctggacgagggtttacacacatgtaagcgtttggaattttggatagaaattccgggcgtcataagttggtatcagagccacattgaccctaggttatgccaaatggatacctatagaagccctctaaaaagattgaaaaagtagaactgttctcctctctttctcttttaattaaaccaagctaatggcacatgcagtttatagtccctttaattgttctcattcaaaatttatttattattcctgtgttgttagtactgtacatctattactatactaatggcccactttctagcagagattttacaacctttcatttatttatttatttattcaatcatgttgcaatataatttagcatgttgattttataactctcttttattttatttcttttgaaacctgttattcaaaagtgcaaaatttgtgattctgttttcaactgtttcaacttatcttgcaagattggtttactttatttatttaccttttactttgattttctaactttattcaaattaatccaaaaacttgtgctattaattggataaatgtcttaactccctcctttcacttgtctttaga

SEQ ID NO: 36423 - DNA, 1501 bp, Oryza sativa
ctaagcaaattattaccagtataacatcattaattattgtgagaggtgtgagactaatcacgaaaaacattgctcaactcgcccataaccgcgggcacgactattcgaatagttttactctggccagaggtgtaccactgtatccacaagacacagcctcaacatcatgtctaccatgcgtcgcgatactggaaagtacccgaatagaagctgtgacaataccctctgcacaacacaactcacgacagtgcaccattcctggatcataatcacccccttataaaacaaggcatggactccccagcgacccctgtgggcttatctccgccacttctcagtctggtgctccgcaatgaatcatgctatacaaaaggtaaagctgttgcccacgctggcttgtggttggcacgattaatgtttcacaatagtagctcgcgaaccggtccttaattgtcatgagcacgactctcaaaaccatgtactcacaacccaccattatcaagttttagttggcaagtaattaattaaccaatcacgattgaccatcgtgaactatcattaagccatcataataatgagtcataagttatcccaatagtgtgctaatgtttctaagcatggctaagcaatcatatctaatatctagctgaactaatatatatagctcaactagttaagttataatatcccaaggtatcaaggaatagagtaatcaatgcaaacaggccataacaaaggaatagattcacaccacccaatgacattcgaaaataaatacacagttgaaataaatagagaatttaaatataggatcaacatgctcaaaggattgtgtttaggatctgtgtgacttgccttgcaataatcggtcttcaattaatcttcttgaatacttccggcgcactcgcgaacctttgcaatgacggaaacgacaagctaacacgcaaaacgaagaaaaagactaataaaaaccaaataaacaatacatataaagtaaacaaacatgtagattataattttagatgaattatgagacttgaacggcctcattctgacttcaaatgaatttattatgaattttacaagattaaatctatttaaagcccatttaaaaagaattaaataaatttaattcaatttatggaaaattttaatatgtagatctttattttacacaatttttgcaacttgaaccacattaaactgagttcaaatgaattagttatgaatttttaaagattaaatcggattaaaacacttatatggattttaattgaattatgacgcaataatgaattatttttgaaaaggaaaaagggtttattgcgtcagcgctagggtttgcggtggaccgggcgcacggcaacggtccacgggaacggacggccgagatcaaccctatccaaaacggacggccgagatcgatcctatccaaaacggatggccgagatcgaacggtccacgacgggtctacggcagacggccacgatgacgtcagcga

SEQ ID NO: 36424 - DNA, 687 bp, Oryza sativa
ttccgctgcttagaactttattgattgagaggaactatctacctctgtaatgacattttattcgcttattaattagagtaatatttgtactctattatcaatttgttattgtgtgcctcggctgattcctggacgagggttcacacacatgtaagcgtttggaattttggatagaaattccgggcgtgacaagttggtatcagagcctctttgaccctaggttatgccaaatggttacccatagaagccctctgaaaaatattggaaaagtagaactgttctcctccctttctcttttaattaaaccaaactaatggcacatgcacttcataatctcttttaatggttctcattcaaaatttattccagtgttattagtactgtacatctattactgtactaatggctcatttaccagcaaaagttttacaatactgttttatttaatcttgctgcaataaaataaatttagtatgttgattttataactttcttttgaaaccagttattcaaaattacaaaatttgtgacctcgtttccaactgttttaatttatttcgcaaagcttggtttactttatttacttacctctttactctgattttctaactttattcaaattaatccaaaaacttgtgctattaattggataaaggtcttaactccctcctttcacttgtctttaga

SEQ ID NO: 36425 - DNA, 1501 bp, Oryza sativa
ggcgcaccccacatgggccccacttgggtaggggtcccaaacaaagttacaagcccagaggcacaagacaggtgacgcagcaccttgtttatgtgattgcggccaaacgacatggaatctggcgatgaggctagatccgttggaaagaaggctccaagagctttccatcaagtactcacgggccaaaaacgaaggtcgtatgcagattcggcggccatttgaaaacagcagtgtagctggtggccgaattggattccagcacttggaggacttgaacttaatatcgtgctgttcatccatgatgtgagcaatggttgtgtccgtagtagccatggtcacatcaatatcaatggtatataatacttccgtcgatatatacttaaatcaagtgatcgagacagtataaatcacttacatcgatatatatattaacaagaagattatagacgtttatggcatagccgatcaaatagatccagcatgcatcggctaatactcctatactattctatattaagatattaaagcaagcaaaatatatcaaacaggaagcttaatatacctaattgtgacaagatcttaacataaagagcggatttaacatgtcaatcaagcacataagatataaaagagttaaatcaggtaagatcggctgaaactccgatactaccctaatcggcaaccaaaaagtaggctagagattgagattctaatcacgacttataaggtcaaactcaactaatgcagctataagtatgaaaagaaggataatatctagacaatcaagccgttgaatgtttcatagggtggtggatatcctatataatctaggtcaacgttggtatttagcctaatcggctgccttccaatgatagatattacccgattaaaagttaaataacaatatttgtcacgccctgaatttctatccaaaattccaaacgcttacatgtgtgttaaaccctcgtccaggaatcaaccgaggcacacaatgacaatattgataatagagtacaattaaataactatttaacaatcgcaaataataaattattacagaggtagatagttcctctcaaaaaaaataacattctacgcagcggaaaaattaaactaaaacaatctacggaacagctatggcaactccactccacagacaacttaaccaggacaagcctaatcctccagaccatcaccttcactcaagtactcctcttctgatgaatgaatattgcaagaatgagcatatgacatactcaacaagccacacagcaaatatgcaagtgcacaggataacaaaggatggcataatacagttcatttgcagaaaacagcatttaataaatatttaagagaatagtaaaacagttgtataattaaccaatattaaataaacaccatacaacacacccgtgttgcataggcccaaccacatttgaacaaccaaccccagttgaacaaattaaacctcgaaaccaggaattatccattccaaaccagg

SEQ ID NO: 36426 - DNA, 1186 bp, Oryza sativa
tttttcgtgattagtctcacactacccattaatggtaataatgtggtaattaatttgatgcctagtttggaatggataattcctggtttggaggtttaatttgttcaactggggttggttgttcaaatgtggttgggcctatgcaacacgggtgtgttgtatggtgtttatttaatattggttaattatacaactgttttactattctcttaaatatttattaaatgctgttttctgcaaatgaactgtattatgccatcctttgttatcctgtgcacttgcatatttgctgtgtggcttgttgagtatgtcatatgctcattcttgcaatattcattcatcagaagaggagtacttgagtgaaggtgatggtctggaggattaggcttgtcctggttaagttgtctgtggagtggagttgccatagctgttccgtagattgttttagtttaatttttccgctgcgtagaatgttattttttttgagaggaactatctacctctgtaataatttattatttgcgattgttaaatagttatttaattgtactctattatcaatattgtcattgtgtgcctcggttgattcctggacgagggtttaacacacatgtaagcgtttggaattttggatagaaattcagggcgtgacaagttggtatcagagccaccttgaccttaggataagccaaatggtaaaccttaagtagccttcaaaatattttgaaaatagaactgctcttctctattctcttataaattaattaagttggcaacacatgcaaggttatgcacaaaatttatttaattcaacttcttttcttttaatagcaaaaagttgttcttctcaaaatatttcttttttcttattgattagtcggcactgtacatctattatggtatcgacataatcatggtagcactagtactactcatctttcttgtggtgacactgtaccgtgcttaaaatagatcataagtattttagttttgttttagttatttgtcaaaaaaaatatatttgtctctatctaaaaagttaaattctaaaaatatttataaaatagctttttatgtgtcttttcttttattttcttcctttttggtcaaaaatcagttaagtctagttggtgcagctaacttagaaaaaatatgcattaattcttctcttccatgtttctttaga

SEQ ID NO: 36427 - DNA, 874 bp, Oryza sativa
ccctcccctttactactttacctccccttcttctcttactactacaccatataaatttgaattaaaattcaaatttttaatgtgtacgtaaactttttacttataaactttgggtctataaactaatatttgaattcaaattcaaattcaaattcaaatttgaaacgggtatgtaaacttttgacctataaactttgggtctataaactaatatttgaatttaaattcaaatttgaatcgggtatgtaaacttttgatttataaactttgggtctataaactttaggtgtataaactttagatgtatagaaatactatatatagaaaatatttaattcaaattcaaatttgaacggatataattcaaattcaaatttgaatcaggtatgtaaatttttgacttataaactttgggtctataaactttaggtgtataaactttagatgcataaaaatactatatatatattttaatatttgaattcaaattcaaatttgaatcccgatataattcaaattcaaatttgaatcgggcatgtaaacttttcacttataaacattgggtctataaacttcaggtctataaactttagatgtatagaaatcctatatataaaaaaatatttgaattcaaatttgaatttgaatcggatatataaacttttgacttataaacttttggtctctaaactttagatgtgtaaacctgaggtgtataaactttaggttcataaatttactaaaataggaaagtaatacggtgccaaaaaaggaaaccaggtggagggagggagggggaagggggatcgatcgctacccttgtcgccgggcgatcgatcgcccattagcacttccgccgtcaacaatgccaaca

SEQ ID NO: 36428 - DNA, 369 bp, Oryza sativa
  unsure (1)..(369): unsure at all n locations
ccgcacaagcgccgatngacttcttcctcccgggacttgcgcggccgtgacttagcgcggtcatcacaagcaagtcaaccagtgtcctgactgctgcgatttgttaaaaacggaaacaccaagaagatgccgtagcaattcgtgtcatcaagagggtaatcgttagcaattcccattgatctcttgtgtcgtagtcaatctctatgtctatattttgatatgtggatatatattattggaaaatattaagtttgatctgataattaattttgcagattgattattgttctattcctgccatcagttccctccattgcacttcatccctgtggtaaacgctccaaccccgtggcaaacaaaaagaggaga

SEQ ID NO: 36429 - DNA, 364 bp, Oryza sativa
tgcttttgctgtttaattgatttagatcctcgatttacactgtgaacttgaattgcagcgctagaagcactatggatagttaaaatccatgactcaaatagttaaaatcttctgactcaaatatctgtttccccaaaatccatgactgtgttgatctatactgtctaatggtagtacaaaataactattcagtttaatttttctatatctgattacttcctaaacggctcggaaaagggctcggaagttctactagagaatatatgcgtgcatgatattggtgttttgtgcttcaacttgataagctaaaatcagccgcagtaccctggtcaagtttttcattgtttgcatattgtcgtccagg

SEQ ID NO: 36430 - DNA, 191 bp, Oryza sativa
tgtttttgaatcagtcaaccttctgtgcgatgtaattgaagtaatcaatgacatagtatcaaatgctagggtaaagtcagaacacgataattcaacaaaagtgacagtcaaaatagacggttttccaagattaagctgttctacttcagcagatgcatccattgtacatgaggttctacatggagacaaaa

SEQ ID NO: 36431 - DNA, 224 bp, Oryza sativa
cgcgtgacatgaatcggatactgatgacataccatagtttttacaaaaacatcttcaatttttaaatcgagggagagggcgatgcagtcttaatcggacatgcggcagtgaaaaatcacgcgcgcgaggctgttgtgggcccagttgcggcagcgtgcaaaggcgcgtgtggataatggacactgccatcgacgtcgacatcgacaccacctgagtactgtagc

SEQ ID NO: 36432 - DNA, 700 bp, Oryza sativa
cgtttgcattgcagggatcatctaccgcgcgtcacggttggtacgatatcgtttgtggtgtagcgattgcatggcgtcctggactagttctggttggtagccacgtcacaaacgtcacactcgattaaagcgagaattatcccctcactagaagatcgggccacgagagagagcgtcatcactcgttccccgtcgtgggccacgccgctgtcctcctccacatggcgggccacacgctaaaaatctatcttcaaaagtgcatattgaacgcaacttaagataacaaagctaacccaacaatcaagagaacatgtatagttaggcactgttcacttctaaataagatgtaggttttatcttagtttgcattatcacgctatttaaacggttaaacaatacatttcgtacgaaaaccttttaggcaaaagttattttaaaatatcaaataaatcgatttttaagtttaataaaataattaaaacataattaatcacacgctaaagatttttttgttctgtatgcttgtacttaatctttttttatcttcagtaaacttataaacgaaaacagaagcctctactttatataggttcagagagattcattcgccgcctcggtcggtataggctggctttatacagggccgcggtcgcgccgtcgcggccgcaccagccaccacaagcagccgtcctgggtcaca

SEQ ID NO: 36433 - DNA, 517 bp, Oryza sativa
ttattttgagacggatatagtaactcctcaaatatttattaggttgatgtagtggaggtatgaatctagaaaccgtttggcaaaccaccaaaccagtcaagtactcaagttttgaaaaatctcaagtgaaaatcaaacttcatcgtcaaatttagtctgaaactctgaattcaaccgttttccttggtaactgagcagtaatcacggttcacggttatcgaaaataccgctcacaaagtgttcatgagagtgatcggtgaaaaaacagttatgtaaggatccaggtcctctacaattaaactactaatgtagggtatgatattcagcgatagaacggttctataagagcgagtacaataattgacgataggagcaccacgtaggatttttcactgatgtggagaagagatagttgaagagagagaatgagcggggactaattagtcgctcggctccacgtgcaacccgaggttgtgggcccgctcgccacaacgatggcgcccctgcgctagccaca

SEQ ID NO: 36434 - DNA, 245 bp, Oryza sativa
ctaaccgtctttatctgtgtttaacaagaagcgcatgcgtgtatatatgcagcgctgctgcaggagcaggcagatcctcaataaggagagagaacaattatgaagagaaagcacaacaggagaggggattatataactgcttgcactgtttgattttattttctgccgttactaattcataatacggattgcttggttcaagtggccacacggtatatttgcgtacacaaatttgaccgataaca

SEQ ID NO: 36435 - DNA, 242 bp, Oryza sativa
ggagctacctaactaaattttcttcaaccgcacatcatgtgaagcgaacacaccatcaactatgtgagcggacacaacatcaactaatttttcttcacccgcaccattatgtgagcgaacacaaattttcttcaaccgcaacatatcatgtggagcgaccactaaactaaattttcttccatcgcaacatcatgtgaagcgaacacaaacatcatgtgaaatttttttcaaccgcaacatca

SEQ ID NO: 36436 - DNA, 252 bp, Oryza sativa
ttcctcaactgaaacgctctcctccggaacatcagaaactaaagcaaccaaacaaaattcaacaaaacagtacaaaaacaagcataaccagtacatgtggatatttttaacatgtagatctcgattttagaaaaatttagcaacttgaaccacttgaatcggagctatggttaattagttatgattttccgaagttttaatatatttaatctattaaaaaaaactgaaaaagaggggattatgacgtcatga

SEQ ID NO: 36437 - DNA, 222 bp, Oryza sativa
ttaaatccctgtccaggaccagccagggtacacaaaacgacaagtaatatacagttccaaacgtaaataaagcgtaaaatacttatataagaggcacttagtcctcacaccgaaagagaacgacagcagcggaaaaaggcgatcctagcggggcttcagctccactccacaggcaaaactcaactggggtctgagccttggtcctctaacttcgtcttcagc

SEQ ID NO: 36438 - DNA, 504 bp, Oryza sativa
cttagcgtggtgtggatggttaggggagggttatgcgaagggtctcgtcacaatcactcgacatggtgacgtgtgcatcatgggcacatgatgacgcggtgacatgtcggtgggttgtgtcttgtgggtacagttgtgcacctctggccagagtaaaactattcgaatagccatgcctgcggttatgggcgatcaaccagattcaccgtgattagtctcacacttaataaatcgacccaatgcactgtagttcaggtgggttggttgggcctgttcaacgtggtgtagcgttgatcagtggagatttaatattaccttaattactcaactgttttactgttttgcttaataagatgttttacaactgcctttatgcaaatagccacaaaccgtccttgtatccccttgcacgtctgcatcatcggtgtggcttgctgagtacggtggttgtactcagccttgctattattccccttttcagaagtgtagtgcttctgagctgaa

SEQ ID NO: 36439 - DNA, 472 bp, Oryza sativa
gggtggtttgggatctgtgtgacttgcctgctgggccttagaactcttcaaactcttctccggcgaaaacgaactctccgaaacgacggaatctaagcagaaaagagcaaaatcaccaaaacagcacataaccaagcatgaccagtacatgtggatatttttaacatgtagatctcaattttagaaaaatttagagacttgaaccaactaaatccgagctaagatgaattagttatgaatttttgaagattaattcggattaaaacacttatattgattttaattgaattatgacgcaataatgaattatttttgaaaaggaaaaagggaattattgcatcagtggctagggtttcgcggtggaccgggcgcacggcggcggttcacgcgaacggacggctgagatcgatccatccaaaacggacggccgagatcgatcgggtccacggcggctcacggcagacggccacga

SEQ ID NO: 36440 - DNA, 538 bp, Oryza sativa
cgtataaaggcgatcagctgatgataatatagtaataatataatctagtagaagtcaattagctaccaatgatatgatagaataagcactgatccgaatgttaaagaatacatcagctggagtcccaatgtcataaaatccacaagattagattaaacagtgaaatctttgttgcgatcggctaaatccaacttgtatgtaatccttataagctgatgcaacgtctagataactcatcggctgaaaccccgatgaaacccttattggcaatcaattagcaggctagagattatggttctaagctcgacttagtagatcaaacctaattgatgcaacactaagtatgaaaagaaacataatatctagacaacttagtagatcaagcccttgactgatttttagggtggtagatgccttagctaatctaatccagtaaaacaatttagtcgatatcagcagaaaccctaaagcgagagacaaccgatagagctaaattgagattctaagactagattaacaaagacatatgataaatagg

SEQ ID NO: 36441 - DNA, 278 bp, Oryza sativa
aagggtccgatcgatcgaggaagttgtgtgtactctagctgtagctgcactagtatcaggtattcgatcaggtggaattgggatcgatcgatcgatcacctgcgctggtgcggagaatgtttgtttgtagaggaggaggacgatgatgctatgaaggtttggctggccttagccccagccccagggcaaattaagtactatgtaggtgctcgatagctttcgttttcgcaagctgttgtccgaagtatttttttgaaacgtaactattgtccgaaagc

SEQ ID NO: 36442 - DNA, 459 bp, Oryza sativa
actttttatttatcacggcgaacttggcaactgacgcggggctgcatgggtcttcgatctccggcgaaggggtaagtccaatgttctgctggcccaggcaattgtactggctacaatagtgtcgttcaaggctgcatcagtacattcgacctctaggattgctctggtttggttgatatatttgcttgcctatttatcatatgtctttgttaatctagtcttagaatctcaatttagctctatcggttgtctctcgctttagggtttctgctgatatcgactaaattgttttactggattagattagctaaggcatctaccaccctaaaaatcagtcaagggcttgatctactaagttgtctagatattatgtttcttttcatacttagtgttgcatcaattaggtttgatctactaagtcgagcttagaaccataatctctagcctgctaattgattg

SEQ ID NO: 36443 - DNA, 362 bp, Oryza sativa
aactccaaaaacattgttcattcagtgatgagtcagagcaaggtcaatagtgcatccggttgttagctccaatatctcccatgtcatcttagagttaatactagcactagctagtacactaggttggctgttgtgttgatataccttatcaatcaaacaattaaatctgcattcagatatcaagtgttgacaatcaaaagtggctatatccatgcatgtagctagttgtgttatgatgtgagctaactgcttagaaagaaatcaccaaataacagatagtccacatattgtatcaatgtgtatgatcaattttggctcgtattttatctctgaagcaaggtggtgcttgcgcggtaccgcga

SEQ ID NO: 36444 - DNA, 210 bp, Oryza sativa
taatccaaatcgacgtatacatgacatgtcgaccacaaaccgcatattctcagtgcttaataagggcccatagtgtgagaacaacactccaacctcaaagaatacgacattgatcacatccctttttgtcctcaaatccgaaaatataaatcacaccctttttttctcccccaaacaagcacacacaccacgcctagaatccaacaacaa

SEQ ID NO: 36445 - DNA, 189 bp, Oryza sativa
acggccctggacggacgaccgagattgctgctagctagagttttgctatccaatttccggtcattggaatgaacaatttaaattggctgtttaggtttataattttcgcggttaattcgttttatcacccctggaacatcgtgcgtatcacctagttgttcggcggacgtggttaccaacagaagccct

SEQ ID NO: 36446 - DNA, 277 bp, Oryza sativa
ccaatgttttgagattctcaccaacaacttctcataatctcagactcctctaatcaggaccatgtggctagaccaacagtagatttaaccagaccgtggataaccaacagcccgtggagaacctagttagactctaattgacaatagtattgtaattcatagtctaaaataactaaaaagtacaaatgctacctgatgtcctatgcatcggggtagttctatggaggaaacttttttattgtttagactttttatttttctaaattttattaataga

SEQ ID NO: 36447 - DNA, 227 bp, Oryza sativa
tttggaggaaaagagcggatgagagagttaaatctagattagtgaaataaagactatgtatgctagatcttgatccaatggctacaaatttaagagtatgcacattagatcttgatccaactggtgcagtttgagtggccaatcattttgttgtgtgatttcgtttcaatgagatattgtgtgatcttgttttgcttttgttttgaaaaaaacttgttgtttggaga

SEQ ID NO: 36448 - DNA, 996 bp, Oryza sativa
tgttggttggcctcggagttgtactttttctagtttatctgcgaattcgaccggtgcgggggcgcgaatttcccgctgaagagagggttgtacttgtataccatgggaatttgttccttcctgtgaaggcttgagcagaaggcgtgatctagatggtgtcggagcgaaaacattgctgcaattcatacaaagctccatgttgaggtgcacttgtggcatgtattttcactatctgtctagtgctgcgaagtgcattgcgcaactagttgctgtagcttatgaggctgtggcatccttttgtagtttctaattactgtgtggggggtatcattggtgtgtgatactgtgatgcaatcgaaattcaaaacggctaagtttagactgcacatagagccaatggagttttggatgacttggctgttgggtgttggcacttgttgacatggatgatgcatgcgggatgagcgtcatttcggtgttctgactttacactggatgtttctgcacaaagtaaacgagtgacggcccaatacaagcctgtgttaggaaagaattcataccgcattaccaaacccttcttttttttcgcatatagttgccatgaatcacgctcgaaaatggaaaaagaaaggtaaacccgtgatactgactgtgtaactgaaaacagaatgaaacggatctgtcagatctacgaattggagcagttatcttgggacattggcactgctagctttgtttcttattattaaatctctccatgacattctccgttccatccactttaagaggaaaaaaaatcatctgatgcattcccttgcttagttcaatttcatttgctgaaaatattggattttggtttaatgtgttaaaaagattcgttgacgtttttttgcattacttgtttactttaagtaattgtgccttttgtttcattgaaggcaaggaggctagaagctcagttagatgaccaaatgagtgcttaccgtaaattgattt

SEQ ID NO: 36449 - DNA, 1501 bp, Oryza sativa
catttggccaaccagggttgccttttttttttaaaaaaagttgttcgatccacccacccagttcataccggatggatggttcttaaagaaaaccgatctgatgagaatgttgattatggtttcttgtgattcaatcaatagaccggtccaatttttttttagcaacgggacaatgcatcctcctccttttacaactaaattacactatccttacaaatgtcgcccaagtaaactccaaaaacattgttcattcagtgatgagtcagagcaaggtcaatagtgcatccggttgttagctccaatatctcccatgtcatcttagagttaatactagcactagctagtacactaggttggctgttgtgttgatataccttatcaatcaaacaattaaatctgcattcagatatcaagtgttgacaatcaaaagtggctatatccatgcatgtagctagttgtgttatgatgtgagctaactgcttagaaagaaatcaccaaataacagatagtccacatattgtatcaatgtgtatgatcaattttggctcgtattttatctctgaagcaaggtggtgcttgcgcggtaccgcgatgatgccgtacaacaagaagaagcacatatatccatgctgcaccattgcgaaacagcctccacgacagcgacatcatggcctcgattctacctcacccgaagtctaccttcgaggggccaaggtgtcgccatccgtgaatgcactcacgccgcggtgcacatcttgaaagccgacgagctctacttttatttttttatttttttttgcaggaaagccaacgagctcttattgattatggattcacggtagctgtgttcatcgtttgcctcccgatgagatcgttggcagttttggatggaaatttcgcgcacgtgagcgagagagactggccaacgtggaagaggatcgtgagattataggggttgcgaccattcaatctagcacggggaatgaaatttttgggacagcgaagaaggaatacgagaatcttggggacggaggcattgatctgtgagggcggcgaggttttctcgtgggcaaaagagaaaatccttgcaacggcatgtgtcgaccccgcatgcggcgggcatggaactaacactggagggggaggggaaagcagaacggggcgggagcatgggatcggatgaggttggtgtgggccccataaattgtgttttctatcgcagctagcgtggtaaaccgtgctatcgctgggtggtagattagtcactcgctttcttctctctccttgtttctctcccttccatacaggaatatgatgatatagcatattttggagcccgctgaatcaccctactgtaactgctttcatgaacttcatagggcactcacagtgcgtcctaggtttttgaggagccaaaactgccacctaaaactaataacttcgtaagaaccatcctccacaatgcatgtgacctatttttttccttcccagtgggttctac

SEQ ID NO: 36450 - DNA, 220 bp, Oryza sativa
ttgatgatgtcatcatgtcatcatcggttttttcctttttcccgtttttctaatagattaaatcttctgaaaatcataactaaataaccgtagatccgtttcaggtggttcaagttgctaaatttttctaaaatcaagatctacatgttaaaaatatccacatgtactgtttatgcttgtttttgtactgttttgttgaattttgttttttcgctttagt

SEQ ID NO: 36451 - DNA, 342 bp, Oryza sativa
cccaagacatcataacctactctcattcttcagtaaaattagcaaccagaaattaaatgtgaatcccacaaaggaatttaaccttctcacatcacaagaacgtgcatataatttcacattcaaaagttgcaaaatattatatccctatgaattaaattcattcttccaatataacaagcaagatgtacacctcagaacaagtaacaatgagtgtaactcatcaatagaggcagtttattaatagcaccgtattgggttcaggaatgatctcctcaggatcctaaggccattcccaaccaaaatgtactgctacattacctgaaacaaatggagagttggcga

SEQ ID NO: 36452 - DNA, 1501 bp, Oryza sativa
tcctcacgttgccgccactatcaccagcaccgatcatgactcccccttctgcgccgccgtcgtcaccctagcacgtcgccttttggccttgctagatggctgaaatgcgtcaacagtgccgacgagtgtccccctcttcctttccctcccctcctctccttttccgcaagccagcggcgttgagctgcccccgcgcagcggatccaccaccatagaccgctacctcctatcccgtcattctgctttgcccctaacgctagcaccgacccaccacccattctcgaccttgaggcgccgccgttgccctaccgcccgcccattccactgcctcccacgaccatccccctacaggcctatactcgccgatcttctctctcccccaacctcccttcccaccctcactctaacccgaaaccttaaaccctaactcgtcgagccatcgttgatcgctgaagctgggggaaaaggaccagggatcaccaaagcacaaatcatgaagcaaatcctaatgttagaaatttgcaagatattgacccaaatttctaccaatggacatttagcaattccattttgtatcattatttaaaatatttaacatcattccgtacaatataattaataattggtacaaaatttgttcccattgcaacacatgggcatgttttctagtataatacaatctgaactactcataaaatacgtaactttccgatcatcacacataaaattttgcaaaaaaaaaaaagagatcagagatcgaatcaaataagaaaataagagatagatttaaatgttaccatgatcggtggtaacaaactaagaattctatctggattgcccctgagccgcacaagttacaaataaaaatgtgaaaaggcattgagaagaggtgacaaaccaaaaagcaaaaccagacatcagcttcaatagtgtaacaccctgaaaatttgaccgacaaaaatctaaactctaaaaaaaatgtgggccttcgaaaactttttaaataaattgcatcataccgattttattcgatgattttattggattttgatctcggagttcatcgattacaaatagaggaaacattaattaggaattaaccttgaaattaggttggttaaagaaataaataaattataatttaaaataaagattaggtgtggattgaaataaataaaatattaccacgaccatatttgtgtcaattaaatttaaatgcgatggaataagaattaaccctaattaaaaattcaaataaattatataaaatatgggtaatattagtctcgggagaatgcattaattaagataacacaaatattgagtaaaattcatatatgcaaagattaggaattgtggaatcaaatttataaaagaaatagactaaaatgagaaaaataggaaaatgcactgttcattgcactctaggtgctcgacgcggttcccctaacccagcccctcctctgccaagctgcctcgcgccccgcgcgccgcgcgtcgc

SEQ ID NO: 36453 - DNA, 1501 bp, Oryza sativa
atattagctgaagacaatttggaactgcactgcttctgtttcgtgttgatttctcactttctgaattgctaaaagcactgcaatgtattgattgcgctatggcagtatgtaggtgttctcatacaaattttatgtgatatgaagcctaagggcatgtacaacccacagacaggggtgtgtctccaagaacctcgaagttatcatccagacagatataaatataaagacagctcatacaacccacatatagagggtctgtctgtaagctgtttaatgctttgcatgtagctttgatcaactgcaaatgcatttatgtataccattgtgtggctatatatttgattaatactatcaagcatagaataagatatatgattacaataatttttatgaaccataaatataataattatattacaatgcctttagtctatcggcaagatagtaacccatgtcatattgtgttccgtttccgttgtagtgtatcgttggagcttcctcttttattgcttgaataaacagtggcgacttgtttagaacgttgatgtcattttgagacccggcggtaccaaaaaaagcatgccatatacgaagatctttagtttccactgcttcaagaatcatagtaggaacgcctttgttaccacagtgaacatgcctgcccaacctttcgaacaattcttccatggccaatatatacaatcgatgcttccgtacattccaggaaaatcacgagcctcattttcttgtaagattttttccaattcatcggctcttggcgggcgtagatattcgtcaccaaacttttcaatcaccccttcagcaaattttcccaaacattctaaacaagtgcttggagcaatcctcaagacttcatcaagttaatcagccgcggttccataacctaacatcctgatagctgctgtacacttttgaagcggtgaaagactattcctaccagttgcatcaacttgttgggtgaaataaggagaccactcactaagttcatgtacgataagcagaaacaacggccgtctcatcctaaatctcctacgaaacatttcatcggtgtagataggatttgcggaaaagtaattagcgacaagatcatcatgacctcattctcgatttcttggtatgtatcacttgaatccttctaactgtgatcgaaaatctcgtttgtgatcataacacctgtttatattatttgtgatacgaaatgttaaattctagagtaacggcagggaaggagatcctctgacttcacacagtgaagagaggagaagcacaatgctgtgcctttagaatattttcagctgtcaaatttacagcgaactaacgatatcgatggctacagcccactacagtagcacatgaatggtacatatatacaacacttttactgtttgccattgttaccacaataaactgcaaaatcattgtttcccactttagcacaaggcacatattactatgctcgtatgcctttatcacctaaaga

SEQ ID NO: 36454 - DNA, 1065 bp, Oryza sativa
aaatgtgagacttgagaaatgtcagcaatattattctcatctaactgaaggtcagactcattaggagggccaaaaagacctttataataagtggtaacatgcgactttaaattgacatcaccatttattaattgatcaccatcctgtaattgataaattctagttttcctatgttttccatttgccactaaatgaaaatactttgtattagaatcaccctccaaaatatccttagttttagacctctaataccattttatttcttcttcccgtaggatagcagataatctattcctaaaaaaccatctaatatcaatttcctcttgagacaggagaacagtttctgcctttttatccagcgcatccaacctatctaaaatctgctttttctcttttttgtatataccgctggtatgtttagcccaacccctaagatgttgtcttctcttttttatataccgctggtatgtttaacccaacccctaagatgctatcttaagcggcgaatttccgcctgctaacgctccataggagtatttccttcatcaacactagaccaaacttcctttaccatatgaacaaaaccatcacataaaagccaaccaagttcaaacctaaaactatgttcagcattactaaaagaggaagattttttatttagaagcaaaggagtatgatccgaaatatctctattaagagcaacaacagaagataaagggtacttttgctcctattccgtcaacactaaaaccctatccagcttttcataggttggatgtgctaaattatttgcccaagtaaaattcctaccagacatttgtaactccttgaggcacaacccatcaataatagcattaaaaaaagggccatctatcattataattgtcattattgttttcattagggctacaaagtatgttgaaatcaccaccattaagaattggtaaagtctcatgactgtgcagtaattctgcaaggaattgatccttaaactcattctgtgcaggtccatacactaaaactaaggcccacttaaaattgtcagccttacttcgcaaatgaaac

SEQ ID NO: 36455 - DNA, 493 bp, Oryza sativa
aaacgggatcaacatgctcaaagggttgtttgggatctgtgtgacttgccttgctggccttggaactcttcaaattcttctcctgcgaaaacggactctccggaaacgtcggaatctaaacaaaaaggagcaaaatcaccaaacagcacataaacaagcatgaacagtacatgtggatatttttaacatgtagatctcaattttagaaaaatgtagtgacttgaaccaactaaatccgagctaagatgaattagttatgaatttttaaagattaaatcggattaaaacacttatatggattttaattgaattatgacgcaataatgaattatttttgaaaaggaaaaaggaattattgcgtcagcggctagggtttgcggtggaccgggtgcacggcggcggctcacggaaacgaacggccgagatcgatcttatccaaaacgaacggccgagatcgaacggtccacgaccgggccacggcggacggcgacga

SEQ ID NO: 36456 - DNA, 1501 bp, Oryza sativa
catagtagggtttcatttgcaaaagcagcatttagcaaatatttcagaatttaataaaacagttaagtaataattaaacaatattaatccaacgctatacaacataccctgttgcataggcccaaccactctgaacaaccatcccggccgcacagttctatctccaaaccaggaatataccattccaaaccaggagctaatcaaattattaccaattatagcatcatttactatggtgagaagggtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtacctcggaaaggagttgtgacaataccccttgcataacacaatccaccgcagcgcaccttcctggatcataatcacccccttataaacaaggcatggactccccagcgacccccgtgggcttatcaccgccacttctcagtctggtgccctgcaatgaaccatgctatacaaaagataaagccgttgcccacgctggcttgtggttggcacggttaatgtttcacaaccgaaactcgtgaaccggtccttaattgtcatgagcacgaccatcaaaaccatgtgctcacaacccaccattatcaagttttagttggcaaataattaattaaccaatcacgattgaccatcgtgaactatcattaagccatcattaaataatagtgagtcataaattatcccaatagtgagctaatgtttctaagcagggctaagcaattatatctaatatctagttgaaccaatatatataaagctcaactagtccaattatattaacccaaggtatcaaggaataaagtaatcaagaacaaaagggctataacaaagaataggttaattccacccaatgacattcgaaaataaatgcaatagttgaatagaaacaatagctttaaataggatcaacatgttcaaagggttgtttgggatctgtgtgacttgccttgctggccttagaactcttcaaactcttctccggcgaaaacggactctccggaaacgacggaatctaagcagaaaagagcaaaatcaccaaaacagcacataaacaagcatgaacagtacatgtggatatttttaacatgtagatctcaattttagaaaaatttagagacttgaaccaactaaatccgagctaagatgaattagttatgaatttttgaagattaattcggattaaaacacttatattgattttaattgaattatgacgcaataatgaattatttttgaaaaggaaaaagggaattattgcatcagtggctagggtttcgcggtggaccgggcgcacggcggcggttcacgcgaacggacggctgagatcgatccatccaaaacggacggccgagatcgatcgggtccacggcggctcacggcagacggccacga

SEQ ID NO: 36457 - DNA, 1501 bp, Oryza sativa
aagcttcaaggcataatgcaacaagcttcaagagagagtagtaaggagtagtatttgtcgaaacaagatttcggcaataataaaagggggtggctatcaagctaggaaagtggatgggtttagagacaaggaattttatacaggttcaggccttcttattcaagaagtaataccttactcctgtccggggatgattccgccgagtgtgttattgattgtatgactgggagaaaaagaatcgtcccgagaggaacccggacccatccttatataggggaagggatccgtattacaaagtacagtccatatcctaacagaacatgggattacagataaaatacaatcgtaaccgactaggatcccgggtattttcttgacatacaagtttagaatctaacccgagtcctcataaagatattctatctatatttggtaccatatatccagctggaatataaccgccatgtagatatggggtaaccataatctccacagtagcccccgagaccttcgcagttgaccaaaatagtcttctcgaaacaaaaaacaataatccgagtgcttcaattcaacttgctccggcttgccgagtgctaaaagactgtgaagggcgaaaataaaacatggtgcatcgagtagatgcacctaattaggtgtagcccccgactatgtgattagttgaaaaactaaacatatagtcaagaaccgagcgattttatatcgaagcatgcatggtactcaataaaatacccagccgactgcttctcacttgaatatatcaaggacaaaaaatatgaaaagggccgaatgataaacattcaaaaggtccaaaaatagatatatttggtaggaatccgagtaagaaactcttaaaatgatccaccaaatatgataaagatcatggtaattaagaagttcattagcctaggctataacccttactataatcaaaataagcatataacatgctaggagaatgactactaataaaccagtcatctcaaactaacccaacagctttcgtagcctaaaaaagcttacaaaaatggtataacacctttctgtcgggcaccttttcatgtgcatcataataattccaaagaattattaaatcgcgttaaaaaggattttaatagcatcgggccgcatcattgtgagcacatattgccaaagcaaaaagcgcctaagtccctagggatcacaatgagccacgctgaaaacataattgggctgaagtactatacaggcccaggcccattagtactcccgataccctaaaaacgccgaagtccaaacgtcgtttcgtcttccccgccgagactctcgtcattccccactccgtgctacagtacagaaccgcgccgacgaagctagggttcatcaatctgctccaacccaccctcaaaaacttcacgaaatttctccccgcgtccaccgctccgattccccattcctctctagccatatcccggaccaaattaaaccatccagctcacactca

SEQ ID NO: 36458 - DNA, 463 bp, Oryza sativa
acgcaccggatttttcggaacgtttccaaaacaaaaacgaatccgaatttgcagcaaaacaaaactgcaaaaggaggctgcatctgcgcaagggtgagaagccaatttttcggaccattcgacgcgtacgtcctgcccggcgaggcgaggcgaggcgagcgagcgcgcgcgtgtttcccctcttctctccaccacacatgcttcaagtggctaggagggcatcctcccttttaaggaggtccccctctcctagaataagcaaggtggtactaaactccacatgcatgccatcccatgaggtgggcttttgtgattttccaaagaattaatcttcgagtgggctaaggcccattcattatttccaacatatatgaccgaaagcactaggcggtaatgcttcatagccagctatttcgtttcttgtcacaatggctagctgcacgcagatacctgttagcaccta

SEQ ID NO: 36459 - DNA, 1501 bp, Oryza sativa
ctcagtagaaatgagcaaactcgatggcatagaatatttttttctttgaacagacactgcgatatgttttctcatccaacatttgttgtattttgtttgtggtagacattatttcttatttattttgtaataggaactccttacaaggcataaatatagtgcagctagcagagtttttctttgaaagaattatgagggggcaagttttttcaactttgatttgaaatgggttttattatttttcttacagtactagtagctaaatgtctgagctttgctatgaaaaaaaaaatcataatattgcctaaaataaataaaagtatatttttcatcaatatgttatccacctttttgctacgaggaatactcacgttgatttaattttatgaggctatctatctatttagatctagttgtttatgtactacctacaatatgtaaatatgtaattatagtttattttgttttgagttgttttatcactcaaagtacttttaagtatgatttatatcttatacaattacataattttgtgaataaaacgaatggtcaaacatttgttcaaaagtcaacgacatcatttattaaaaaccagactgagcatatattaagaagtttaagggctaatgtgtaaaatctataattggagtaggtggggtcacagatttattgccattatcattgaagtctttttaaaaaagtatagatacctgtgtgcaatatgaacaggaaataaaggcactctctctatttctaatttgacagaaaacatccaaggaaatcttgcaaatttcatactattagattgctttaagatttgtgtgataccacataagcctaacttctctcatccctcctcactccaccattgcctcgactcatgcatcgccattcaccgctgctcgattcctttactcttataccttcgccactacccggtctcaccggctagctagtaggcatgagcgaggcccttcgattgacctcctcatcctcttcccctgctttctttgtctttctcaaacaggttacgacgaggtgcctttgtcccgccggtggcttcccaccacttagacaccacctcctcaccgcaagctttggttcgccctagccaccaataccggtccatctcgcttttctcaatctccatagctttggcatcgtccacctatatccaccacttcctacatccatccctctaagcctagcttgacctcctctcttctccctcccaccccagacccaacccaggattgaattgtcgctgatgtccatacgcgcgtgaacactccacatcagccttttcgaagacgaaagcatccaggcgtgttgtttatgttctaaaaaaaaaagaaaaaaaaagaaaggcgtgttgtgtatgtatccgaagtaggatggcaccttttggcttcaacgaccctgactcaattcaagcgcatatcaaatgcacaagaaccgagcgcaggggactccgactcggactccgagtctgtcacgtata

SEQ ID NO: 36460 - DNA, 361 bp, Oryza sativa
gacgtcctgcaccgggagaaggcggcaataaggttttgggaagcgcttcgcgcgactgctccctgtttgttcgcgacggctcgccttcctcttcgctcgcgtgtttcgtgccttcgtagacacctgcgaaaagtttcgaccaagcagccggtctttccgtcacctcggtacgtgttcaatatgttgcgcatatttgatctgttcatgttatactgtgtagtttacatgtatagatctaatgatgcgttcatgctagttttcatctgtaatgtcatgatttatttatggaatagattaaatcattatatgtctataatctcaacaatcgaaaaaccttattataggcactgtgattttacta

SEQ ID NO: 36461 - DNA, 1501 bp, Oryza sativa
ccaccccaacacaaaagctaatccaaaccaaatgcaaaataataggttgaacccattctgagaccattcctagagaaaatgaaatccatactgttgccacagacaaggcaacccgacattcggtgtctcccaccgtgccccagcatggctggtttcgagaaagtgccaccgctgacagaagatgacatcactctgcaccatgtctgctggcacccacgcgacagtgacggcgaggacaataactgagacatgaagccgctgaacaaatggcgacagacagatttaaaattaaggtgctgagtgctggacaacaaatcctcaagaaatcttcaagaaatcatgcattcaatgtccccttttttttccaatttttgagatttcaaccaaagaatctcatctcttttactcccagttggttgctcgatgttgttctttgctctgctcacctcattcacttcactaccctcaggtcgatgttctaacagtcggcgcgactgtgcccagggtgggtggaggcaggacagcggtggcacctcctgcagcccgtgcacggaagatgactggggggaggggagggacagcggcgcctcctacgctcggacacccggtgcgcaaccactcgaccaggatccaaggcaatgtactggttggggtccatgggttcaatccattttaaaaccaaaaacacttcagccagatccaatccaatccaaaccgcttcacttgtagccccaaatcgatccaggccaaatcttaaatcaatccagtcggacccaaccaaagccaacccgttcttagatccaacccattcagcccacttaaatccagtccattagcacccctataaatgataatgtaaaggtgctagctaggcaccagtacatgcaaacaatgatatacaatagacatatgaaaacattttgaaacaaacataattcgtagtctagctagtgaccacttaagattttgcatttcatcagcatactacaagcagtgatataaagaagtacccactgagaaacgaaggacaaccaccacacaaacaggcatgtcaacataaaaaagaattgtcatgctgagagtattgtaccttcagaacaccatgacgaactgcctgattgcacaggcagggaacaacatcaaaaagaacgatcagatattaaatacatacttttgtatggaagcgaagcaatcgcttatttgcagtaaaattaaccagacaagctgtccaagatatctaatgcaatagtccctaaacataatttgaactatcctactatctttcgcactaattcatcatgacaagaacttgctacttgaactaaacagtgcagtcagcgataaaaattgggcaaacaatgaaagatgattgcacagcacaaagagtcaaagacaaaacaactaaagcaactcaactacaacaaatagtaacagcaaggcacaacaaactaccatggaaaccataagcaaatcatcagatcagatcagacaacatatattc

SEQ ID NO: 36462 - DNA, 1501 bp, Oryza sativa
aagtaacaataagcaactcacaagttgaatgtgaaaaacataagaaaaacaaataaaaaaaagatagtcgtaccgctggatagggttggatatggttgaatgagtaaccgagtaataagatcaaataagtaatagtaatatggcattatgtttagcttaaaaaaagtatatgtatacatttatagggtaggctcaacttggttccactggctcactgccctatctagcactttcccccctcatcttcttcattgcccctctataggctcttatcatttttctatttttcaatttttcgcgtgacctcaaataagatcataaaaatatcttagatatagaaactagagatagttggatgattcaatgaagttactttgagtatacttactaagttgaaaaaagatactgaaaaaggtgtaaagataaaataagtttaatataatagatttctaaatttcacacacaatgccaataaaatgcatgctagcatcacaattgtaccaattcaaactaatgaataatgttggatgtacggttgaatggtgggggcgaataagtaaggggtgtgcttagtatgaaagagcatccatacacgcttcaaggatgaaactttacccggttttactggctcgccgcactattaagtactcacttttccctcgttttctcctttatccctctataggctcggggtctgttttcatcttttcgattctaattgacctcgcactaaaataagccaatgataacacttggatgatgtgctgaagtaatcccgagtatataactagtttaaaatatatgcatccgaaaaaaccgtaaaagataaataacgcctaagaacatcaacaacaactttctaaatcttacttactaaatgctaacctaatattaccattgtaattgtatcaactctttttttttttgacattggccctgtttagattccaactttttcgtcacgtcgaactttcccacacacacaaactttcaacttttccgtcacatcgttacaatttcttcaaattttcaattttggcgtggaactaaacaaagccattgtaattgtatcaactctagccccgaataaggtgttaaaagaaaagagggagggaaggaaaaaaaaataaaaaaacaagtctaaccccaaatagctttagatacgcgaaatggggcaaaaacaaagcgatggccgaacacccgtacacgtctgaggggtgggcccgacccggttccgccggctcgtccccccgctttcccctcgccttcttcatccccctcctccctctccattcctggatctcctccgcctccgcctccgcctccgcctccctcgcaaggggtctcccacgcatcgccgcccgccgctgacgcgtgggagccaccccttgcccccccccccacaccacccgccgcttcccatctccgacaagcgcctacaacggcgtaagtagccctaaccctaggtcgctggatgcgccgatggccgccgccgccgcag

SEQ ID NO: 36463 - DNA, 1501 bp, Oryza sativa
tgaccattgatctcgattcttttaaatgttcctctctgtggatcggcacgtacctagcccaatgttttcccggttgctgcattaataatactcccctgtgcactgtgggacttaccagatttaactctgtgggagcctgatgtttccataacgttgactctgggagttcatttaacatcccttacctagtattacgttaatatattgaaaaacagcccaaaactctaaaaaaaaaactctaataccaggtataacacaccctcaattcttagaacctttcgatttaaccctaatggtctaaaccaacgtggtttttaactgtggtgttgacatgacaatccattcaacatcaaaacaaataaacaaagatgggagccacacgtcagcggcaaccgtacatccttctctactactgaggcctcgacattatggcctagtccaccaccaaagatagcaccctacaactaggagggatgccgactctaccagcaggctacatggttgtggacgtgctctccaccagattaactccttccttcatcatgatatcccttagagtagtgttgccctttaccgtatcaggctgatgcaagccctccatcacggatcaacgccaccatctgctcgccagatcaacgccgccgcacaatccctgccgctagatcattacccctccctctttctatgatgagatggctggtcctcaaagaggagccccgttgacagtggtggctattcgggaagaggcgaaaagcccaccaacagtaggtggtgggtgcaacgggactacgggactgtgaggagagatcgagagaaaatggaggaggtggagaaagatggtcactacaaggtgggttctgctatattttaaacttaaaggttgattgggccaccatgtcaatgccacgtaggcaaaaattactttggttgagaccgagggtgtgtgtgcgctgcaagaaggggggtggtttaaatataattgttttaaaagttaagggttttgttatatccgattttggagttaaaaggacgtttttttgttcatgcaaacgcaataagttgagtgggtaaaatggacttatccctatagagaaactacctattcattgggccatcctattatagagaacattacatttcaagaaggaattagtttattttgcctccctcaactcatgccactggttgaatcacatcctttaaccataaaaccagatataactcgtcccccaactcctaaaaccgttgcaaatcgacaccccaagcagtttcgaaggtggtttcgtccgatgtggacccacttgtcagtgccctgcacctcatcccatcttctccctctcctcccgccctctctctctttcatctcttcatcttttctcacctttcattagtatagaggcaggatggtggcgacggcacacgggggaagagcttggcagccagctggccgcgcatggaaggaggagctcgtcagccaaccgcaacgcgtgtggggaggaga

SEQ ID NO: 36464 - DNA, 1501 bp, Oryza sativa
aactttgtgaacctggcgcctatctccgatgaggtgcatgtcaccaaccatggatccatcctctccactatcctcgcttttgtcgaggaagaaggcgaccaagctgtttagtagccccgctatgtggacaccatcatgatggccaccaccattctagcgctatcgttgatgttcagagcttgacgcatatgtccattgcatcgtcgaatatgcctgagagctgctcctcatgagcatgctctagcgcttgcacctggtacacaaggtgaacaccatggacaaggtgtttgtcctggtcagaagccttgacaaccgctccctctttatcagctagatcaggagtttcgctgtggaagccgataacttgcccaccatcgaggctggttgcatctacttcgtgaagccaaacccgacaaccaatgagtatatttgtctcaccaactgatgactgtaggaaaccatactcatggttaatctactcaatgttaatgaagcagaaggctgcatcctccctctcaccctagagcaagtcatgcagaattactatatcgacaatgagaagtcaacaatgctcaacttattaggtggcgatgggtagataatagtgagtaaaatagtgggtaatccagtggtgtaggaaaaaatctcatcaataaaagaaaattatgatggtttagcatggcaacacgctgaaaatgatgcacctttgtggatggagtatggtgaggttgaaggaggtgaggggatggcagaaactaggctttaatttggaggcaaagactgagtgaaggatgttggtcctaacatttttccataatatctctcaagataaaatgtgtctaacccatttattctaaaatggtacgatggtggctatgatttgaaggaaaagagagtataaacctagattagtgaaacaggacatacgattgatctttatctagtgtctacaaattgagtagccaatcacaaaatatgccagttaaaatcaagacgcctctttaaatattagaaacgtgtagtgctgcttatacactcacctgcaacacctgtggaagtgcaaatccatacacctaaaaacaagcacctagaaaggtttagatcttgtgtgcactagccggtcaattggtagggaggtgattgtgacgacctccctattaatggtgttcacctcttggttccatgggaggtgcgttaggtgggatgatcacgagagcgatggcttgcataaggtaatggcctactttcaccaaccatgaatccatcctctccactctccttgccggtgtcgaggaagaaggtgaccatgttgttcagtagccctgctgtgtggacaccatcatgatggccccaaccattctagtgctacccctgatggcgaagcttgtcgcctatgtccaccacatcatggagtctgccagggaactgctcctcgtgagtaagctctagcgttggcacttggtacacaaggtggacaccgtggacaaagtggttgtgcctg

SEQ ID NO: 36465 - DNA, 1501 bp, Oryza sativa
atttattgtttatttgtatctttgaggattaagaaacttttccatcatgtggttgtactgttttcctggattgcacataagtttcatatcttgtagaatgtgccacaggtgcatataaaccatgttttttttaatttaatagctcaattgagtctagttctactcccatttagcactagcataggataaatatatttcagtaaagtgcatgtggtaaatatgggatatgatgtgaatattttgtcatgaagtgttcatacgggtataagtgtcaacatttgtacaactggagcaagctgaatcactgtcttggttttgtcaaaattatcttggaaacatgcttctgtagagttggattgtatctgactaatggatttttacaggatagagatactttgtcatgacataaatgtacatgttccacaccatatttctccaagaattccaagttataaccttcgtgctgcctatgattccataaaacagaactggggcaaggtacttcaatatttctcccatttttttggggtgcatttcactggtttttttttttgtatagttatttcatttctcttcccttgataccttctacttgcagtacatcaatgaagccagctggaactggcgcttgatgaagacaatactgactaaatgccatgtttacgacaaggatagatactatgttccctttgatgaggttgcgcctgaggaatcccaaccaattaaattcctcaagaaggtcatgccagattatgcatgatgaaatcaatactgttggctggtgtttgcatagagaaacaatcacaattacttagtgagtcacatcctaaattctaactagaacggcacatgcccgaaattttgactgcaaattgctttgttggattgtgttacacggcttcagagcggttgccaaaagttcatttagaagaaaggctgtcagaagttatcctataaatttaaaaatagtgcgcttccaaaccaagcgcctttttcagttgttcggtacatcaaatatgtattgtataccttggaggcttggaatataaatatgggcacgctagtgctacagccatttgctactgatgtaccagcaaccattggtttgtaccttgattaattcatgacgatggtctaattctgttgtcctctttttgcaaattctgctgaactaaccatggtaattacaattcagcatgcacagtcctacctctacggctctaccacttatggtgggttacacgatacttcaccgtgctttgtttatcgtttattctctgaaaaataatcagttgatgcagcagcgtttcatcatcaaggagaagcaaacaggaagactcatacttcaacatgcattattcttaattgtaaaagagccaacaacatacagggagaactgtggtgcaaatagcgtacaaagctcacgtggttacaaaacatttgaattctctacattgtactcatgtggttatagaaatctgatcatctatatggaacacct

SEQ ID NO: 36466 - DNA, 463 bp, Oryza sativa
atcttagtttgcattatcacgctatttaaacggttaaacaatacatttcgtgcgaaaaccttttaggcaaaagttattttaaaatatcaaataaatcgatttttaagtttaataaaataattaaaacataattaatcacacgctaaagatttttttgttctgtatgcttgtacttaatctttttttatcttcagtaaacttataaacgaaaacagaagcctctactttatataggttcagagagattcattcgccgcctcggtcggtataggctggctttatacagggccgcggtcgcgccgtcgcggccgcaccagccaccacaagcagccgtcctgggtcacacccgacctgtcccggccgaccccaccgctgcgagctgcggcgcgcgcaagcgggatttacagccacccacaccaccaaggcaccaacgcatccatccaaaccgccgcccgccgccgcc

SEQ ID NO: 36467 - DNA, 927 bp, Oryza sativa
tgtgctatacctctatgtatctaacctgtggtcaattatctccagtaaggtcttaaaacttctttatctccttcccctcgtctgtatgttgccttgatctaaagtttaagggtgtgtttagtttttagccatactttaccatcacttgacaataaatattgccagcgtagaggatgagatctcttatgcttattttacatagtgagttatttattatctacgggattcacgaatcctgtagacacaagggcctgcattggtcatgcttgatttttcccccttatctacacagtttagtagtactacttgtttatggaactagataaatatccagccgcgttgttgtagaaaattaagttgcataatatgtataaataagatgtaatttgattattaaaactaaaataatttgatacaattttgagactaaaaataattgagattagatgtttttaagagagaacaaagaagagacaatttggaccatacatctatcatccaaaagttagaaataattagggtgatgtgccttaatgagagaagagagaaataacattataaatatttggtaaggatgaactgtataagtatatagaattcaagattcactcaatcaattcttgttaatggaatctgcgaagcagatccataatatccataagaatctcctagatctgatcattgttcccttggtgaatcccttatcattctggagtctatgctcttccggcaacatggattgcagaggtgctcgtgttcttgaagacctgaggagaccaacataacagatgaatgctggtgctaacgaaaaaaaaagattgagaaatgggacttcaggttccctggggacaaaatgtaaatttgaaaagtaacgcataaagaaaacataccggagcctccttacagatatactgtgtaaaacgcaga

SEQ ID NO: 36468 - DNA, 1055 bp, Oryza sativa
ctgaaactccgatattatccttaattatgattatttccagcttagttttttggattctagacaagactagggttgatgcaactcaaagtatatagagaaacctaaagtgtaaacaatcaagtaattaatcacttttcaggatggtaaatatcttagctaatctaatctagtaaaacgacttagctgataccggtgtaaaccctaaagcaagaatcagccgatatgactaagttgagatactaagctagattaactaagatatatgataaatgatgaccacaacaaaaatactaatagtctaatacatttaaaaagatataaaagcccagatagtgcaagccatcgagacaagttacctcttgtcaagagattgtagccgatgcttcgacttaaagcaagaactcatcgaaaaagtaaaagaaaagggtcgcgatgtaccgaaagttgtattggttggattgtcgtcccttataacagtgaactggggtttatatttatacccagagtacaaaattcgtccattgtggacacgactaaaactttcctaaagataaaaacaaaatggcagactcttaccatatctctaattcaaactgacattaaaatcctaattaatacatacaattgccttaaatgagctctatctctgtatgtcaatgatggttatcttaattgaggaccaaaccgagcctcaagttgtatcggctgctttccatattgtctcactcaaaccctgactctgttgaacctagttcatggcttaccaaatttagtcgttaacagttgtcagccgatgcgtaatctattttggtaagatccaatctccttgaaatccgcttcgatatccaactccaaatccgagtctaacttgccaaatttcactgttaagacatgaattctctccaatgttttgccactggatgacagtctctttaacatcatctcatttatcttggtttggcaatagacatgatctttcaaggagggttaattgggattgaagttatcattgttgcctccttgatagtatgagcatggttgattccacccctaga

SEQ ID NO: 36469 - DNA, 1501 bp, Oryza sativa
gcaggattgagaaagcaatttcttacttagataaaatggtttatgaagaaaagcaaccaacagtaattacatatacaagtttgatagatggattctgcagtgctggaagacctgatgaagccattaagttgtggtgcgaaatgagggagaaaggttgtgctccaaacaatatagcatatactgcttttataaacgggttgcgcaaatgtggccgaatagagactgcactaacctactttgaagagatggtgacaaaaggttttgagttggatactttttccctcttatattttataaactttttgatatcaaatggatatcccatgaagggatgtgagcttttaaaagaggttctccaaaaagatacctacggcaataatttgaaaatggtaggattaataaatgaagcagttgtggagctgtcgaaagatggaataacttcctcagatatcctgaaatttgtagataaaggtttagtttcaagttctcaaactttggacaacaaagatggagacaaatgataacggttactagcataagtcaagtctttgtttgtagccagcatatactggtctcaactctgtggtgccaggctctgtagattgttcattgcttctgtctacatgtccttctgcttcgtgcaactactttcctgcagcttatactggtgtcaactctgtggtgccaggtatgttcgtgctactgctttttctggcattcttggcctttgtcctgctttcaagtaggagtacaaagtagtgctggttgctttatgacttaaataatcacattttcatgaatatgagatatggtagaatttgcgtagacttagcatggattgtttctgactggtatacacatgttcctttcaccattgagacagcagtgtattttttcgaggaaggaggcaggagttctgccattcactattagtagaaaagaaaggtctaatttttacaaagcctggatattttaccattgagacagcagtgtagtatgcacctatatgcggttatgcacttaacttcattgtaaacttcacttatcctaaatcctagtgctattatcgaattaagtttttcttattgattaaataattagtctggggactgaggtttctcctcttaatctatgctaagacacatttgaacctgcatgaagtgttgcattttttttccccatattgcataagaatgtttgcctgtcagactgaactaatatgatctaagtttacatgattggaggcttactagattgatgaaaaaaaatctgacctaatttatagtgaaggtaatctactacaaatactggaagggcttgaggcaagaggaaattggaggtgggctttatctgttactgagtgggtatacaaggagaacatttacgagcatggaaaaagcaggtatatttgtgtgagtactactttttgttattccaaactgcaagtcatctgtgagatttagcaaatgttttcaatctgcctttcatgtgcttttatgca

SEQ ID NO: 36470 - DNA, 285 bp, Oryza sativa
gacgaaatatgtaactcgtagaattttccaaaactctaccgaaaataggtgtttttcgggtgtcatttcttagaataggtttaactttctcatacgtgctcagaatcaggcaaataatatatccacggacatctacagaaaaagttacatctgattctccccgctttatcaggttcggcgatattagaatctctatttgagtttattttttctatggttggttcttgtgtgctcctaaacgtgaaaaaaatatcaaaaaaataaaataaaaataaaaattgctgg

SEQ ID NO: 36471 - DNA, 614 bp, Oryza sativa
aacatcgctcttgttaaggtaaaccaattttttttgtggaatttccagaatttttacttttcaacacacagctctatgccttatttgtatgcactccattgtagaatcagaatgatttaatcactgctgacttttattcatttctcttaagagcatcatagggaactggattcactgtcatgtaccttgtttttgtgcaccgtataactattttagacaagcttccatttgcttaagaggtgggactggtcctttctcaataagcgagagtctgatatgaattctgatgaattattgattgggcaaggttagcctgaattcattctcattgaaactaatttgaggattaagaatcctatgaattaagaaatacttgaagcagacaacagtagtgtaaagattgcatcagtggaatcagaaaaaataatatgatcaaccaatctaaagttgaatttttagaagactttgaatttgcacgatagctttccagctagaatgtaaaatggaattgctggggaattcagaatatttgattgcagataaaatgtcttcatacataacttttttttaaaaaaaagaaaacgagtaactaattgctgctgtgctgtttcaga

SEQ ID NO: 36472 - DNA, 1501 bp, Oryza sativa
aagagagagagagggtttttggccggctttcggcccaaagccaaaagaagacttttaaaaacctttttcaatttaaattattcatgaaatgcaattccatttattaaaaatacttccttagctcaaataaatcccagaaaaatctaggaattatagaattaagcaaagtatttaacaaaattttatctagcccaattttatgttgagatttagcaaattaaaattagatcttctcttctaggcttttaaaatcatttctaataattccttttaaacaacaatttataattttaaggattttaaacaagaaaagcacttaacaaatatacttagatcattaatgatcaaataattactgaactgttctttgtattatttaagaattgagctctgaaaaatccgagaaaatttcagagagtataattaaccatggagaatttaataaaaaattaaatccatccatgctttatatttaggaaattttatttcccacatttaacttcacttgtaaattaaagattttttttaatataaattctattattattttattaaataatttataaatcctgaaacgaaaattcaggatgtgacaactatacaaggcaattaacaaatacacacatgtgaaaagttacaaagcacactgcacaaatgacactagtatattactatatagtaagcaggtatgggcagacactgtaattaaacagttcaagggacgtgaatgtttcaagaatcagataacatcgcctcacctgaatcaccagagtataagtatatatcgatttttgtccatgcatgaatcgcagcttacatacgatattaattagttatgaaccaagaactccggcggcgatgagggagaccccgaccaggagagtggcgaagagaatgaagctgagcgccgggctcgcctcgccggcggccgccgcgatggcggaggaggccatgacgagcccaaggacggcgaggttgcggcggcgcagagccacagcgacgagtagagggatgccatggagcgttgcggagctgatggcgatgatgacgccggcgaggacacccagaaggctgagtactaaaccatggccgctggcgccggccgcgaagaaggcgatggcgcacccagctgtggcgatgatcttgccgccgagagaacccatcgcgaagaaagaaaataaattcaccaagaatctgtatgatttacctcgaggctccatagtgacaaatgcagatcgatcttctccccgcgataatggaaggaagtaatcggatgagctagctcaccactgataaagagtgtgagatatggttgtaggtgcaattcctttatatataacgcaagtcaaaatgtgatcgtccatcgatctggtttcctcctgcttactagtcctatgtgttagactttgcactaggatcacctaggttagatctagtcgggtggatctattgggttgatgtttgacattgtagatgaaagggagaggggtttagataccga

SEQ ID NO: 36473 - DNA, 1401 bp, Oryza sativa
agcacgcatctcgacaacttcatcgacggtgcgcagtgcgggtggacatactactagatgttagaatccatcctccctgtccatactatgatttggcttaccaaccctagatctttgtcatgtgtattaccttgttgacggctttctgatggggtgggaaatattttatctacctggagagaggctgcagtcaacaaaacagatagggagagcacgggtagaaaagtaaatggttcgcaaagtttatgttgaaaaataaatggtttctcgaggggtgtttagatttagaggtgtaaagtttctgcgtgtcacgtcggatattatatagggtgttgcatggggtgtttggacactaataagaaaactaattacagaatccgtcagtaaaccgcgagacgaatttattaagcccaattaatctatcattagcaaatgtttattataacaccacattgtcaaacatggagcaattaggcttaaaaaattcgtctcacaaattagtcgcaatctgtgtaattagttattttagtctatatttaatactttatgcagatatttaaatattcgatgtgataggttgaaaaattttaaggtgggatctaaatagcgtcctagtttagagataaaattggacttttcacaatgttgaggaagcgtgggagaccgaagctgatgaggacgggcatgggatgggagatatgcaatggctggcaactacgatggacggtttgactactcgtcttattaaaataatatatgcaaatataaaaaacaaaaaaattgtgcttcaagtactaaatcataaataaaataaataataattcaaaatttttttaataagacgaatggtcaaacaatacaataaattatcaaaattctttatattaggggacggaggggtagcattcttcacaggtgatgtgttactctttgttgcttctgatcactacaacagatagattaatttgtaacggaagaaaaagttcaacattaagtgttggaccatgtgtcagaaataattggttaatgatgatagagccacaccaggtaaccatccacactgatcctgcacatctgttcaccccttttgcatccgtcagttatgtacaagaaaaaatttcatgcatactgtgctagctactcatagccattcagaacaaggtactgatgtttcgataggtattggatagatcgattatggagacccgacgttcatgatccaaacaaaggctctggaatgatcgaactccaggcaatctgctgagattataggcatataatgatttaatttatttcataaataaattatgacattacagatgtatactagtatgaacgcatcattagatctacacatgtaaactaagcagtaaaacgtaaacagatcaaatatgtgcaaca

SEQ ID NO: 36474 - DNA, 1501 bp, Oryza sativa
acaaaactccaggttgcagctgggttgagattagtgggaaagtccttgaattctatgcaggggacgaaccacagcatggtgcagatgatatgtatcaggtcctagacctactggttgatgagatgaggttggaaggatatgttccaaatcttgatgtggtgtagcaaataagtttcagttgttgccgtcttgctgaaagttgcttctgcattggtgtttacgtctctgaggctgtgactttgtggatatgtgatacaagttacttcatgataccaccttcctaactgaaatgttgctttgctacagaattgggatgggcaaacacaatttagaacggcatcacactagagaaaattcttggcacaattattcaggaaagtgactcaaggttgccacctggatatatcaacttgatcaggtaattattttgcagttccttatttacttattcaggaatatgtcatgtgccattcagttcttactaacagaaatattccagaaaagtagaaaactaatttgttgcaccctcaaactcttcaccactcggcaccctcaaactcactgtggaagatattttgctttgtctgttatatcaatgttcagttaacatgcaaatcctagctaaattagcacccatgtgcgcaagtatcttgttttctcttcttatgttatatgcatcagtcaaattcttcttaataagcatttgcctcatgaagcatcttgaattaacattttcactttgtataaagcatgtatgggtatgctgcttccagatctcatataggccccaatgcaatcgcgaccaactgttccattgaatcttgcttagaggttacacaggagatccagaatttgcgatgacggctacctacaccctacgtgttgacgaagcaggcaagattgttgctgttgaagatcacagaattgtatttgggataagcaatccatcaatgtaccctgcaagcattggcttcccaaaaccagagaactctcacgaaggcggtaatctgaaataggggcactgatcatcctgcactacagatgcaacaatttttgctatgctgcttttcaagtggcaagcagcaatgttatctttgttattgaggcatttgcttctccttctctgtgcatgcagtagcatcctctgtttaacacgattgtttctcctctattctgtttattaacatgtaaaaatgctgttcctgctcctcacttttgcatcagctgttttatacaaacatgtgaaaactcagaattctgcgtacaattgaaataactaggaacacttgcctaatgcaattctagtcaaatcgtcatataacagaccagatcattaatcagagcatgaccaatgtgacaagaatcgtccctggaaatttctattttataagaatctacagaagtagataaatcattgacaaatcctaccctgctgtagctcgtcaacactctgctggcctatgtttcaggaagaagctgagcttctgtagcataaacataa

SEQ ID NO: 36475 - DNA, 1501 bp, Oryza sativa
tatagtttgttttgcaaatgatccatgaattttgatagtagggattaaggtctctatgctaaaatctagggtagtcctgtgcccatatggactataagctagctacgccactgttaacatatgttctaagaaatacacatctgaatctaaaaggtcttctaaagaagacagcaacttaaagtgccctatttctaaagagggcacaattatgataaacttgaacaacccttcttaggcatactttgttcaggctagggctgacatccttcctgttgtaattctgttgacgttattactatcagggagtcccatcgcatatttcacaattgctacagtcctaaggaatggtgctgcaatccacatcaatatgaagaagggctgcatgactacaattatggacagtgccaccaacatttcgtattccttgatagcagtaaccatgccaaaaatgtagagaaacactgtcgtagccatgtataaggtctgcaaagaaagaaataacaggtaaagtgagcgaccattcactgggactacaagataagaaattctggatgcaaagaaaattatacatgattgaagtaccaacaaaacaactagcactagataataacaaggaaaaattggttataccacatcaaagattttagaaaaatgatgacacccaaacttcctggtgcacaataataatagcaccgaaagatgatgaaatttagcattctgtcactccatctgctggcctaatcactggagtgagttaaactaccaactaaataagatagcaatatgaatcagcaaatgacaatggaaatgctcctaattaagtcagacccaacgacccgcaactatttcatcatttggttagttaccgaattgatagtacgatttcttctgttttagaatgagagatagagtgctttaggttccgacctgaatatgcatcatctataatatataataaactacttggcgcaattctaggttcatgctaggtgatggttaaaaagtagcaaaccacaatcaattcccacagtactaggcagtaggcaccagataaaaatttggaaactcccttttcctccttgagtcgatccatagattgtccgatgaaacaaaggcagaaccaaaattgtaatcttgcaacagcatatatataaatatatatatattgcaaggaggaaacaaaacacttacgtaaacagctcggatgaaggcagccagtagaggattgttgacgaccaggccatccggcggagcgtaacgtagcccgccgaatatgcggactgctactgcgggcttcaccttctcgcagatcggcttgccggacttcatctccggccgccggcttattccttgtttctttccaacactctgcttcctctcctctgctctcctcttcttgctgtgtcgcggcggatgtggtgtggtgtgtgggtgggggatccgatcgatcgatctatctatatcaacatatggagaagaacagaatcggacacggaaaccg

SEQ ID NO: 36476 - DNA, 856 bp, Oryza sativa
aagtagcaattgactattgtagtcttaattagacttagcatatacgcacgaaacacttagcatagatgactattttagtcttagcatgtaatattatttgagttttaatataagattactttatttgtaattagacttagtatgtaattattgactacggaattggtgcgacaagtagcaattgactattgtagtcttaattagacttagcatatacgcacgaaacacttagcatatacatgactattttagtcttagcatgtaatattatttgagttttaatataagattactttatttgtaattagacttagtatgtaattattgactacggaattggtgcgacaagtagcaattgactattgtagtcttaattagacttagcatatacgcacgaaacacttagcatatacatgactattttagtcttagcatgtaatattatttgagttttaatataagattactttatttgtaattagacttagtatgtaattattgactacggaattggtgcgacaagtagcaattgactattgtagtcttaattagacttagcatatacgcacgaaacacttagcatatacatgactattgtagtcttagcatgtaatattatttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacaga

SEQ ID NO: 36477 - DNA, 966 bp, Oryza sativa
atttgcgaaataagttttttttaaaaggactaaattataaaaaaatccaatcgaacctagcaccttttagttgcaagatgatatcacccaccactgagctaagaagagttgttgtaaacataggcgcatgtttgcgcctttatcaatgaagacctcagcgccaagtagtgtgccgctgagctttgctgatttggcttttccttgttgcgcagcgctatcgggattggcgctgaataaaaggtttatttttgcaattagtttttatcacggttcaatcctcaaataagtttcctaaaacgataattttgtcaaattttcggggttattagtctcgaaagctttgtgtcggtttgactttcgatattttctttagtagtaacctatttgagtgtaagtgaaaaataaatcaaccgagtgacagatagacagtcaaaaagattcaggagattaaatttttggtagttcgttgaggatgctctaataacaataataataaaacctcgtgtagtaagaacaatagtccccatttactgcatgaaattttttaaggtaaaatataactctcacatgttcactggcgctgcaactgctcaaacatttcctgcagagattacagctcaagatgtgtctcattgctctctgtgtttctccgctatgccgccacgtcttccacaatggaaaggcccatatatagctgtgttcggcactgctcccaaccgaagcggcctatattagcgtgtaattaattaagtattaactattttttaaaaaataattaatttaaactttttaagccactttcatatagaaacttcttttgaaaaactcactgtttaacagtttaaaaaatatgcgtgtaaaaaatgagggagcggggttggaaataagggtaccgaacacagccacgtaatcatgcaggttgcagccacgagtcgtcatctcggtgaaccgcaccgctcttccagc

SEQ ID NO: 36478 - DNA, 1501 bp, Oryza sativa
tcacactgcgccatataaaagggggtggaggacggggcggcacacagtacgaggttcgtcgccgccgccactccaccccacaaaaccctaaccgatcgagagggggcacaaccagtgacgggaaacgccaccgccgcgccacgcctcatcgccgggacgtctacgaccaccattgccgcaaccgtcatcgccgtcaacctcaccggcgccgcatccacgacaaccgcgcgaccacgacgacgatggccggcgcttcttcatcctccaacacctcaaccggtcggtctatctaaaccctctcccgttttcaatctctattgttcaaacatcaatcccaaatagaaccacccgactagatctaacctgggtgatcctagtgcaaagtctaacaatggtatcagagcaaccctagtgattagatcggttcggggaaagaaatccaaagaaagaaaagcacaagatccacacggatcaaaagatcgaaaccctaaccctaccttgtcgccggccgtcgccggcaaaagggggggagggcaaagggcaccgccgaggagccactcgacggccatgcacgcacccgtcggtgcacgcgccggcgagggggcccgcggcggcgccgccatctccgtctttcggccgccgctctctctcacacggtgggggttagagacggtggggggagcgtagaagaagagaaaagaaaagaggcgccggccatggcgcggcggtggcgagggccgccggcgtcggtgacgccgctcggcgcggccgcgcgctcgcaagagagagaaagaagagaagctagggttcggcgcggcggctgggggggtcgggggttttgtttgcccgatctccccgcccggccgtccgatcgaaccctagtggatcggacggccggtgacggtcgggccaaaaacggcccaagaaggagagcgcgcgcggcgactttcccggcccaggcccaggttgcggcctggggggaggagggagcgcccgcacgcgccaaaaagccgtgggccgctggcaaaagttcaaattaggtccctcggggggccgaaaatgatgaaaagagggacagtagcaaattttccttttattttgtataattttcatgcaaatttcaatagaattttgaattgattttgcatgttttacctctgtttaaattcgaaccaacgggagaacttttacagagagtaaattacagagttttgttgttgttcatatgatttttatatagtttttccgctgcaaatagataaatttgatgaaaattagtgtttctaaaattaaatttcgaaccaacgggagaatttaattttaggaacattaattatgtgctatgatgttgtaattttctgaccaacgttgataattgcaatgttatagttatggttatatgtgttatgtctaattctgcccaatggtgatataggcttaatgcataatattttaatgttaattttgttctcaccgtacatgattatttcaggtggctact

SEQ ID NO: 36479 - DNA, 1501 bp, Oryza sativa
atcgctctacattggattgagtttgatgttagaattttgtaccaatctttctctgttaaaatttccatcctcattggctaataaaaagaagatagtctgatttgggacagtgatcaatgtatgagaaggtcaatcagatttctaatgttggtccatttgattcaaaatatttgcaattatacatggtatatgtaatgcttatgtctacgtgtgggctatgtttgcacccgcagcaacgcgcggggtgccagctagttttcagaatattctgtctgtctggtgtcaaccggctgggactcacataccaactccgattaatccgttggtgattgaactcattgaaggacacggcaggacaagattcttctaggtctctccgttggtgattgaactcattgaaggacacggcaggacaagattcttctaggtctctgatcacttcacttgtttggttgctttcaactgctctatataattgtccgttaggccatagtgacagtgcggatgagacttaataatagtgctcctggggtcgttagtgtgtaacgttgatcctggtcgatcgtccggggttacctcatcgctgtctgtggggttaccttatcgctgtctgtggcaagttggaactgtcctacggctgataatgggcgttcggataatgaactaggggaagccacacatcggttttgataggattttgcctccgaagaatagtagtaaaggacccatcttgtttggagttaatttggagtactatattttttttttgcaggaaatttggagtactatagttggaagtcggaactcgaaagatcgccaaaagattccagacaaagggtgtgtttagttgacgtcaaaattgtaagtttggttgaaattgaaacgatgtgacggaaaagttggaagtttgtctgtgtacgaaagttttgatgtgatgaaaaagttggaagtttgaagaaaaatttggaactaaactcggccaaagaaagcagtagcactgttttagaagtatgtgcggtttgtgcccagtaagaagaagaagaaccatgaactcaaattttatattcatgagttaaatcaaatttacaaagtttaaatatgtccatgtcagtacatttgttatagtaaactcaattttactatacttacatcggtgcaatgaaagcgctatgcgggccttgggcccgaactgtcaccggccgacgttaatgccatgccgccgcgtacagtttacacgaatggttttaatcacacgctgcacctctcccgcgcccaccagtccactcacgcggtcactctcctccagttgtccagtctccgctcgctatatccgctcccgcgcgactcactcaacccagtacacacactccacctaatcttcttctcctcacacattcacacacacacaccccgcagaccccggcaccttaccgagcggcggctcagcacgctgctgctacgcacatggacaagagccagggagtcctactgtccagcaacg

SEQ ID NO: 36480 - DNA, 1501 bp, Oryza sativa
cccacttgctgaacgccaccatcagcgtcgtaagcacatgctcgtccacccaccccagctcgctcatcctttggaacacgtcgttggcgtcatcaggacgacctgcattgcagtagcaccgcaggagtgaggtgagcgtgtacttatcaacgctcccgtcgccgcacctcgccaccatctcccggagccttgcctgggcatcgtccgcgcggccggccttggcgagcgcgtcgaggaggcagttgtaggtgtacgagttgggggtgcaaccgaaggaggccctcgcggcgtcgaaggcgcggacggcggtgtcgggcagccccgcggcgccgaggcagcggaggaggaacccgagcgcgcctggcgtcatgaggcagcgcgcggagatcgcgtcggcggcgaggcggtcgagatgcgcgcgctggtggcgggggaggagggaggccatggcgttgagcgagtagcaggagtggcggaagcccggctggtcggcggcccagcggaagaagtcgagggcgtggcgccaggacgggagccggaggaggacggactccgcggcgggggcggtgagctcggcggcgagccggcggaggcgcgccgcgtcgcgggtggcgcgcgggcgggagaattcgtcgagcaggtggtgggcgaggtaggaaggggatgcgggcacgggagcgcgcggaggcggagaggcggaggtggagaaggagaaggagcgcggggcgcagagagagcgcgacgagggggaacgggctaggcggcggagcgacatggaggagggcgcggaggcggcgcacggcggagtggaaggcagggaggtggccggaatccggaagggtagagagaattccaagcaagccggaccaactgggcctgggccgaccagcctgactaaaggctctcacagtggatttatatatttatttatttattaaaagatttaaaaacataaagtaccgttcaaagttctacaaaaatatgctcctcccacccaaccgtagggcgaggacagaaggagcatattaatgtgaagtggcacctcaggagaggggcgtgcaatggcaattttctagataatctcctcccggcgataaatcgttcttccctagggtgatttattgctggaagggggtcgcctacaaaattaccatagcgcaacgtttagctatgtatgggacgcaccatagcaattgtgtagtggctccttcccaacaatgaatcgccctcccctagggcgattcattcttgggaagaagccgcctgcaaaattaccacgcacacctcccacagggtaccacgtcgcgtagattgtcctaccgtaggacgatttatctacccccgccctacggtagggcgggaggatatatttatgtgaagctttgaaatgagaatatatttttgtaaatcttaaaaataaatataaaaataaaaaattttcctcacagtgcatcccacctatataagaggcctcagagtgtcacgtaggctagagctacga

SEQ ID NO: 36481 - DNA, 1501 bp, Oryza sativa
gattggacggccgacgccggccgggccgaaatcggcccaagagggcacgccgggagggggtgctttcccggcccgggcccacgttgcggccgcgcgtgagcgcgcgcgctcagccgtgggccgaccgtgggccgcctctcccgatggaccaaaaaaaaggaaatgaacagtagcaattttcattatattctgtctattttcatgcaaatttcaatagaatttgaatagatttttgcatgttttacctctgtttaaatttgaaccaacgggtgaatttttacagagagtaaattacagagttttgctactgttcatatgaattttatatagttttccgctggaaatagatgaaattgatgaaaattagtgtttctaaaattatatgtcgaaccaacgggagaatttaattttaggaacattaattatgtgctatgatgttgtaattttctaaccaacgttgataattgcaatgttatagttatggttacatgtgttatgtctaattctgccaattccaaagtggcaatcatatacatcaaaatccaactttgatacacttattaaatttctttgcaaagaaggaatataaaagacatctcgaagtaaaagtgtgaagccattcgcgagttctagaggaagatctccaacagcttcaactttttcttcaactccattggcaactctaatggagctttctcttctttgcgtagtcctcgtcgaacggaatgcctttaaacaattacaagcatgaatagttgctctagaattaatccaccatgtggatctagagtaatcaacataatgagattcatttacaaatgtaataatgttctcacctttccttgccatgatcattttcaagaagtctggacaatctttcttgtaatgtcctgtcttcttgcagtggagacactgatctttctcaacagcgaactgttgttgctgaggtagatgctgagactgtttagcttttgaggtgggagacttgtggttctttttcttattatctgtaacatagttaattgaaccaccatttgactctttgtttctctcctcctcttgcacacagttagcgatgagcttttcaaagtttcatttctctggacttatgttgtagttgacaataaaattgtcaaactgctttggcaatgaggccataaccaaatggaccagaaagtcatctgttatgcccaaatccattggcttcaacttgaaagccatgttgctcatcctaagtatgtggtctctaacacctcctccatagtacctctctgtcacaagctgcttgatcagctgtgtagcataagtttttgaagagccagtaaactgactcttgattctttcaaggtactctgagacagcgtcacactctgggattgagcccaatatggtaggctcaatcgtgttctttaccacagccaaacatttcttgttagctaaggaccatttcttttgttcaatgtcatacgacatgacgagaggagcatctgttactgggtta

SEQ ID NO: 36482 - DNA, 1269 bp, Oryza sativa
cctcctcaaggaagacgcactcaatcaggccaatcacgtcgtcaacatcttgaaccagaccaagaccatgatcgcagcttcggtcccgattaactccgcaagcgtccgcacgccgactggcagccgagttcctcctcttcgatctcgagactatcaccaaccgagcctcagcgtcgtcagcaccggcaacatgatctattagcaggtcctccactccaatcccctcagatgagaacgggctcgacgtgccgccgccgctccggcaacactatccagtagcagcttgtcccccgccgtccgccgatgaccatgacgacgaggtcgacatgcaacgacggaacgacctcgctccaggctccagctagccacgattttctcccatctgaacgtacgcaaagatcgatcgggctgatcgaaacaacgagcaaaatcaatccgtttccaattccacaaatgggccgatggaaagaacgagaaaaagatcgtgtcccagggaactgcaatgtgaaagaagggtagacactcattttattcggccttttcgagggaaaatgaaatagaaatgagaaaatctagacagaagtaaccggcagtggtagaaaaagtaacggtggaaaattttcaatggtattaaagtttacccccgaactttcaatggtacgaaggtaaacttgtaaactttcgattatatagaaaggagagaggaggattagaaggaggaaacgtaagtaatgtacgaccgtacttgaggtttgggctggttggagagaagggaaagaggtgtggagattatgtatacctcatacctacacggcatgtatagtacaactgggtatggggtgccatgtatagatagaatatctttaaaggggcttgggttaaattccaaacttatatgtcaaagaaatacccgggattctagtcggttacgattgaatcttatctgtaaatacctattacgttagggatatagactgtattttgtaatacggatcccttcccctatataagaaggggtccgggtgcctcttggggcacgtttttctcccagatcatacgatcaataatacactcggcggatcaatccccggataggagtagggtattacttcttgattaagaaggcctgaacctgtataaaattccttatctctcaacccatccacttttccagcttgatagccaccccttttagtattgccgaaaacttgtttcgacagttggcgcgccaggtaggggcagcgtcaagttcttcgccgactagtgcga

SEQ ID NO: 36483 - DNA, 1501 bp, Oryza sativa
gtgtagcataagtttttgaagagccagtaaactgactcttgattctttcaaggtactctgagacagcgtcacactctgggattgagcccaatatggtaggctcaatcgtgttctttaccacagccaaacatttcttgttagctaaggaccatttcttttgttcaatgtcatacgacatgacgagaggagcatctgttactgggttacttggcagatttcagagtagtccaggcccagagcactggaaattggtaaagaaagtcttgcgttatttgcaaggaacaaaatgcctcatgctgtcttacagaagatcagaatcgctccagatagtggggtattcagattctgattttgcaaaagataatacaaagtcaacatcgggatatgtgttcaccctggcaagaggagctatttcatggaaaagctcaaaacagactatcactgcagggtctactatgtatgccgagtttatagcatgctatgaggcaacggggcaggtgaactggctaaagaagttcatacccggtttaaaggtggttgatagtattgagaaaccactaaagttatattgcgacaatgaacccgcagtaatgtacgttcacgacaatcagtcaagtggtgctgcgaaacacattgacataaagtactatgttgtgaaggacaaagtccgggatcaaacaatcagtctcgagcatattagaacagaaaggatgctcgcggatccgctcacgaaaggcctaccacccaacgtgttcaaggaacatgtagccggcatgggtttaagggaagccttatgaatcctggactacagggcccaaaagtaaaagtatctatttttgaatagagatgtgtatagtggctgttgaatccatcggtgattgaccgtgacgatgaaacatgctctatttacaaatctgtgatggaatagaaaaagctaaaagaaatagtgagatcaagggggagaatgttagatagatctcccacccgtcgggcccaacggcacaacggatcttgaccgcgccctgatcgggggcttccagcccaatggctggtgggccctcatcacactgcgccatataaaagaggggtggaggccggcacggcacaaggtacgagattcgtcgccgctgccaactccaccctacaaaccctaatccgatcgagagggggcacagccagtgacgggaaacgccaccgccgcgccacgacctcgccgggatcgcccacgaccaccgctgcaacaacaaccgtcgccgtcaagcacaccgtcgctgccgtccacatcaagccgcgacgacaacgacgatgtccggcttcttcctccacgaacacctcaaccggtcggtatctaaacccctctccctttcatctacaatgtcaaacatcaacccaatagatccacccgactagatctaacctaggtgatcctagtgcaaagtctaacacataggactagtaagcaggaggaaaccagatcgatggacgatcacattttgacttg

SEQ ID NO: 36484 - DNA, 1501 bp, Oryza sativa; identical to SEQ ID NO: 34090

SEQ ID NO: 36485 - DNA, 386 bp, Oryza sativa
tttgaattctcaatactagtgtatggtttccttcaattatgtagatgccattcatctcttaggcagagtaactgtattctttttttttaatttctaaagcttaatcagttaattgagcataatatttccttcagataaagtttaatgtgttctttcgtgaatatgatgtcatgataccataattaagtttctttttgttacccttcattctgttaccattaacatgttttaaaattcttatgctagatctttcaaggttccaagttaaattggaaagagatgatggaaccaaaagaagcactgaatttccagatagcaggactgcacacatttatggcgttgttcctgctgagagggatacctatcagcctcatattgagtctagt

SEQ ID NO: 36486 - DNA, 1501 bp, Oryza sativa
taccacaacccacctcttgtcgaaacaagatttcagcaatactaaaagggggtgactatcaagctggaaaagtggatgggttgaaagacaaagaattttatacaggttcaggccttcttaatcaagaagtaataccctactcctgcccggggattgatccgccgagtgtattattgatcgtatgatctgggagaaaaacgtgccccaaaaggcacccggacacctccttatataggggaagggattcgtattacaaaatacagtccatatccctaacggaataggtagttacagataagattcaatcctaaccgactaggatcccgggtatttccttgacatacaagtttggaatttaacccaagtccctttaaagatattctatctatacatggcaccccatacccagtcggactatacataccgtgttaggtatggggtatccataatctccacagtagcccctgagacctttacagtcgacaaaatagtcttctctcgtaatccaaacgataatccgagtactccgatttcttctgccttgatctcccgagtaccaaaatcaaagactgtgaagggctaaaaatagagaaaatcaagtgcatcgatcagatacacctaattaggtgtagacctgactatgtgattagttaaaaactaagcgtataatcaaggtgtaaacaatatccaatcaagtggttttacaaccggatcatccatggtatcatatagctaagcatatgcgacgtttaataaaacatccagccgactactttagctttgatacaccataaaaggagatattaaaagacccgagtgaaaaacactctaaaggtctataaaccaacacatatgataagaatccgagtaaaaactctcaaaaaagatccatcaaatgtggcataaatcataacaataggtgagtctaaattgcctgagctataactcacaccatatcaaaataagcatataacatgccgagagaatgactattcaaaaactagtcatctcaacaaaacccgaacagcttttgcagcctaaaaaggcttacaaaattagtataacacctttctgttgggcacctttttatttgcatcgtagtaattccaaagaattatctaactgcgtcaaaaaggattttaacagcattgggctataccgtcgtgagcaagtgttgctgaatcaaaatgcctaagtccctaaggatcacaacttggccacgtcgatagccaaatttaggcctaggcccattagtactcccgataacctaatgaaataacaccgaaagcaaagcgtcggttcgtcttccccgccgaaactctcgccactttccccattctctgctacagtgtcagaccacaccggcgaagttacggttcacagtttcgctccaatccatccaccaaagctccacaaaattctcccacgcaaccaccgcatcaatctcccatccattcccagccacattttgaaccaaatcacatcatccaggccacatcca

SEQ ID NO: 36487 - DNA, 803 bp, Oryza sativa
cgtcgaagtcgtcgaggtcgcagctgtcgtagcggtagccgaattcgtcgtactccacgatctctgttggtcgtgagtcgatgccgggggagctgaggtagccttccagttgatccgtcgaaatcgtgccgagtggctggagtatgatgccgacttccctggagctaggcatgatcggtgttgaagccaacttccgcctaggcctacggggagaagacgcccttgtagtgaagactgcagccaaatcgtcggggagtttcatcatgattggcgggtaggccccatcatcttgatctggtggtgtcggagtagatgggatctcgtccaagtggtttgaagccgactcgagcgagataagcttggagtagatcttggccgagttcggaataccgaacggggctgagacctggttctttcccgactggtttggatctgagtcgaggagagagatcttaccgaagtcgttggtgatgaagttgaggctgccgaaccgaaacgcctgcccgggagggaagacgaagttgtcgatgccggagacggaacccatcgcactgatcggcgagaaacttgacgcaacccctacctggcgcgccaactgtcaaaacaagatttcggcaatacttaaagggggtggctatcaagctagaaaagtggatgggtttgaagataaggaattttatacaggttcaggccttcttattcaagaagtaataccctactcctgtccggggatgattccgccgagtgtattattgatcgtatgatctggggaaaaaaggtcgtcccgagaggagcccggaccc

SEQ ID NO: 36488 - DNA, 1072 bp, Oryza sativa
cccactggaagaggaagaagtcgtagtcgaacccggtctgcggcatgtgcttgaggccgaagaactgcttcccgatgaagccgttggacggcgtgccgaaggcgaaggcgaagccgaagaggtagtagaagagcgccccggccgcggcgtcgagcacgttggtgagcatgatgttcatcgtgttcttggcccgcaccgacccggcgcagagcatcgcgaacccgagctgcatggcgaacacgaggtacgccgagaagagcaggtacgtcgcgtccaccgccgacgtcgtgtcggcgaaccggttgcacaggtagtccgtcgcgttcgccgccaccggccccagcagcggcgccaggtccgccgcgcacgtcgccatcttcctccctccctcaccaaaccctcctctctacgatccctcgttcaaactagagctgctgaaacggcggcaggattgggcgtgggaggttggggagaaacgctggcgccggatttataggaggaggaggtcaggtcgctcgctcgctcgctcgccgtgcgggagagatgacgcggaatggtttcgtcgttttggtttttggcggcggggcccaccgcgcagtgaatcttccgtggtggagggggatctcctttggctgggtcggcttgcggcggttgcggggtgggagccgtttcggggatcccgggagaatctggatgtgtagctgtaggccgcgattaatgatgtggttttcgctccctgtgtcatgtcctgtgagacaaacgacgagatgtggatgatgatgtgtatggtttcgaattaatctcgccttcatttttcgtgcttgtgactcaggatttttctccattctgtttttttaatacatatcctattctgttctgctccgtgtaaatggttatgtgcctttgtgtaccataacaaaatgggaaaaggaataattaaacagctggtagtttgacaggttggatttatctgtatggaagttttgacagaatcggaactcttttaacacctccaggaaggagagaaactagtcaacacacaaaaaatggaagtcgtgtaggaaattcttga

SEQ ID NO: 36489 - DNA, 240 bp, Oryza sativa
  unsure (1)..(240): unsure at all n locations
cgccgtcgccgtcgagattaggcggacaaaggagagggctcaccgaaacacctttttcttatatgtatttctnactggacacaagttggccagatggtaaagtctgaaaatccacctctcttgctttactttatttgttttcctgatttgtgggtaaaaaacttagggccgctttgaatcgcaggattgagaaaacgtagtaacagaaaaaacgtaaaattttgataggaatataagttt

SEQ ID NO: 36490 - DNA, 1339 bp, Oryza sativa
agcttaaagtatactcacaaactggattctcgtggttatacagtttaaataagttataaggatgtttcagatttgctatgatgtttttgcctttccatttctattaaatgtactgagaaagccaattttgtaggtgcttgttttgtattatggaagttataacagaatgatatgaatagcttatgacatacgaatatatacttatgtttcctaaagtttattactgagttagtgttttgtcttttagctgccacaatggaatgaaatgttgctgaaagagaatctcggatatattcaatggaaattaaagtctagagaaaaaaagtagttcatgccctagttggattctcccatatcagtatgtggaaattgaaatgttaacatgcataaaataaaattggctttatttaagaattccaagtttgattttttatgggtatattgggtgctgtgctctgattggatttgctaactgttgtgctgactcactttctatataatttacattattcaataatttccttaaggatttatcttttctagcctgcctgtaactattgaaatggaagggagtcttaatgttatactatatttactgccccaaatatctaatctgttctccacccacaagaccacaactaaacagtaatgcccattgctcatcatgtcggagaatgaggttttcttctatttgaacacccattaactttcactcacccatcatgtcagttgcactacttgaacacccattaaatttcatatcttgatctcaagctacattttatttcattcatgatgatagcaagaatacccaagtatctggtgacttgtttggcattgatttgggtttctacaacacttacagcttcagctttgattatttgcatttaaatgtcttgtgtaatgatccatttctgcatttctgcatgcacgacaccatgacatcgaccgctgccgccaaccaaattaacccttaattacttaatgtcgatcgaccatgcatcagctgacagtgttggtactagttcaatatgatgaaagctaattgattccgtgtccatgtagtggactcatgcggcagggcagattaattagcatgcagctgtatgtatagtgtatagtggtagtagtatacatactgcattcttatgctcactagaccgctgcatgcatatgcatatgcgccggtggatcgatgcgcacatgcatattgttcaattcttcagttgaaaaataaatctgagtattttacttccataaaagtacattttggtagtattaaattacgtggtttgacttattgttgaattttgaaaatatgaattgtagaattttggca

SEQ ID NO: 36491 - DNA, 1501 bp, Oryza sativa
tacccgtgttccatgccttgaaaatgcaatgacttttaccgtgtttagttccaaactttttttcaaacttttaacttttccatcacatcaaaacttttctacatatataaacttccaacttttccttcacatcgttctaatttcaaccaaacttttaattttagcgtgaactaaacacaccctttcgccgcccgcccggccatcgctaccctccagctacagaaataatggagccgtgaaaatgagagaacgagagatcgagagatatcatcgacgagaatttggttgccatgcggccgtacgtgtggtggtacacgcccctacacggcgcaccgcatccctaatcgatcgagcaacggcccaacggccaacggccaatgccgccctccccaacccgagctctggatgagacgcgctatctgatctatcagctgctttgtcgcggctggcaacggcgcgcgtgcggccagcggttcagttttctcgcgaccccggccgctgccatcgcgccggcgacaagtgtcacggcgatcgctgtcgccaccgcgcgcacgcgcgcgaacgatcggcgcgcgggctggttgtggatggaggggttagttagcctccaaaacgcgacgacgcgcggggccgggtcgggtcgccgtcgcgtcggggtctccggaaggtgaggcgaggctggccacgcgtcgatcgtgtatttttgcgccaccgcgcgcggcgccgatcgacgacgtcgcactcggacactcggtgtgcagtcgtgcggcgggtcttttagctccttctcgccgtccttgtctcgtcgatttcccagaatcgcagcgaccgcagcctaccacgttgcgtgcaccgtcatcggcggttcagcgtggagccgtggatcgcccgtgaggccgtgagaccaatcaagccagacgctcttggcccgttgcgcactcgggtcggctgtgtctggacttgggtgaatttcgatcgggccgtgcgaccgccttgggtggaccttggcaaatgggctctatgtaacgggccgtctgatttagagccgtctagttgggctggctggcctggtttgaatcattggactgcctcatgtaaattgtcaggcgggataagttcatctgaggtcccttaactcgtgaatgaattcgattttgtccttcaaccacaaaaccatatacaactcgcccctcaactgtcaaaaccggtgcaatatagggcccatgatggtttagatggcctttttagctgacatgacatctatgtggctaatttgactcgatcttcatcagacgtggcatttgacgtagcacatgaagcaaaatttaataatttaataaataaaataaaatgggcgcacatatcaatctttatctttacctattataaaagtttaagatgtttttaccaactttcttcgtacatcgtctctaggcacagtccgattccctccctgtacgcgaaacggacaactctagggtttgctatatggcttaatttc

SEQ ID NO: 36492 - DNA, 1501 bp, Oryza sativa
aatgacatacagtgcatataagagaaaggtctagtaggcttaactctgcccatgtgtccagctagctcattgcgacaagaaatcttaggctgtgttagagaaaggggagatagataagattgggaagatacgcaaaacgaggtgagctattagtgcatgattaatcgagtattaattatttcaaatttcaaaaatagactgatatgattttttaaaacaactttcttatagaattttttttgcaaaaaacacaccgtttaatagtttgggaagcgtgcatgcggaaaacgatgtgcaatctatctccaatctcctagaacgaacgctgccttattatctcttaccggtgacagtgtatctccatgcaaaacagaacaaatggagaaccttttcccagacaaaatgagatgcaccatccacaataatgtcatttttaaaagcatataatacataggctcactgtcccctaaaagacaaccctgattcatgcactgaacacagagcctgaatgtataatcataggtgcatttcatgttctattcagaaaatattttcttttgagaggaaagatgatattgtttagaaaaggactatcattggtgtccccttctaataggctcacacattgaatcttggttaactttttctaatcaaatacccattcccattgatgagaaactgttcaattattgtcctttgggtccatgcatgtgtcatcatctccacggtgctttcacctaccatggggatgtgacattggtcacgctctgacaagtaatgacttcgctgagtgttccagaactgcataactctgcttgattatgcggctaatatggcacgataatttcggtttaggatatggaattttgtattcggaataatcgaagtcgtggaggacgacactgacgcatccatccattggcagatagtaggaattaagatgcagccacatgataatgtggatgatggatgaatggtagcctagcctactgttgctagccagttttgggccatggcaggtgtaaagaggtcaggggtacaggacattcagattgatagtagacagataatccatatctacatcagcattatatgagcgcaataattggggaattctatctgtttttccgtggatcatgaatctctttcaattttttttaacaaaccggcacaatacaatgccaattttattgtatagcgtaggagtacaagtatttatctgaaaagaaaaaagatagtacaagtgtttttagagaaactagggtaatatttccacgagtcttttgctcctgctcacgcctaagttttcattcctcctttattttagtgacaagtgaagattgttgagagctctatatgatggaagactcgttggtttctttctttccaaatctcccaaaacgttagcaatataagtgaatctctttcgattggataatgaattcactactcatcgtagcagacataaaacgagagatgtgttgtgatgtaataatctcac

SEQ ID NO: 36493 - DNA, 1501 bp, Oryza sativa
aaataaaaattttctctatggaggaatgaccctgccatgtagcgccatgctaccgacgcaaaaaatgtttttttttaagtgcgcacatgataatgtgtatcgccacacaaatattcaccttgacattcaatatatatataaatggagatataaaaacatttaaacaaagaaatactgatgcgtgttgtttgtgtgcactattcagggtatgaatttgttttgttttctctatgtatatatacatgtacgtagaattttgagttggttttttgcgaggtctcgtacatgttatcgtgtccacagtatattttagtgtcgataccacagtagcaatgaacgcgctatgcagtagtacacatgagattctgttgctatggtttgagggctacttatgaatcccaaagtagtttttgtgtaatacaaagtgcatccggtcgtaatgcttccgcaataaaagattaaaataaaacaaaaaggatctctatatattattcatgtaaaagctatatttgcaaagaatatgtcttcttggtactcaacaatatgtgtgatttaattatcttccaaattatgtaaatcaagcagagttacacatgcatgaaaactaagtttcgaatttgtcataatagtacagaactatgttaaatgaaagctctctatatatctgcatgttcatataaagctatatatgcaaggaattttactttttcattagtagtatatgcatacataaaagatgtgatagataaaacattaaacaataaaatattgaataaccacaacaacccaatcaaacaaggaataaatacgtgtcgaccaatgattgaaccacacaataaaaaactatatctagccgtccctctcataaatgcaaacataacatatctttaggacagatcaatcatcgtccacacattgaaatgtggacctagtgacatcaatcaatccgtggataggtgttgccgacgggatgcgccagtaatgacggaaaggcattcggaaaatatttttttctttagaaagaaccccattccccacggtaaaaaaagctgacaacatgatatagcatgatattgtatcctctccgggatacggcagcggcggccggccaaaccctaagctagaacagcagccgtatatggcatatcatgagaaaagcaggaaaagagagatatggggtaaaggatttatgaaccatggtctcttcccccctctatatataatgctgcatccaccaggctatggtcacacaccaccaatcaatcaaagcacacagatctgagctagctagcgcccacctttcttctcccactccggcggcacatctccgccgccggccggtcagccggcagctagtggctctctcgctcctatgtggctatgtctgtctacctaatggttttctgttttcttggttttgggtggtggcagttgacagaagagagtgagcacacagcggccagactgcatcgatctatcaatcttcccttcgacaggatag

SEQ ID NO: 36494 - DNA, 481 bp, Oryza sativa
ctcctttttgtatttgcatttccaattttatccatcacatctagcaacacctgggacactggatatcctaaatgtgtaagctgaatattgcatagaaaatgacattgcatttactagaaagtataaactagaaaggcagtacgaaagtatggatctatgtataaacaaacacatcattaccaaagtaaagcatagcactgcaggtcatgaacacattttaccagaaaaaagtgtagcaatgcagatgaacaaatcgaagaattattggagaaacccaagcatataacagaatacagaatcttcagatcaccctaaaagaaaaaaggtttaaatagttcccagtgttaccataaattcatattttagtatttgcattaagcattaactgcatgtagggagtaagcctgaaatggcactacatcctgtcatcgtacaaatcaacatggcatcttgctttcaacttatctgtcgtctggtatta

SEQ ID NO: 36495 - DNA, 307 bp, Oryza sativa
tgtctataataaagaacattaaaaccaagaacaggttgtttttcgcagtaaagaatcttattcatcttaagttgttaacataacaagcagctgcttatgtgcgaagaacatccaaagaaataagtactaattaacagcaaaactcattattcctcaaaaataaatttgaaaaaggaaaaaaaaactcatgcacatgaatgttggcatagttagaatcaagcaaccactttcagactcgaacaatcagtacacaacaaataggcaaatagaaaacctcaagaaacttctatcaacagaaatcaatcga

SEQ ID NO: 36496 - DNA, 1501 bp, Oryza sativa
ggagtgctacgcacgaatgggctcatgccagtcccaaccaagacataatttttataaattccacatcatcaaaaaaaaaactaactagtattagggcaggtacaaagatagagtcagacatgagctctacattatttagagactagcatcctacaacagttagaatgatctctaatcattaatatatttaaatactttttcttacttttctttccttcatttcaccaccatgcaacaaaatttactctaataaatgctaagagtcgactctgagccgttgtcatgcataacaaccatacttctttctatttcttccatgtcatcaaatttatttgcatggcaatagagagagaccactaataaaggccgttgtacatgcccttagacactactctgtttcaatgcaaacactagtgttccatacttaaatttaatgctacttatctcaaatgatgttttggatgttgtatagaaaccatgtctcatgcaagatctgattttcttctctttcctcatttattcacttgccacgtcatcttttattctaggtgtcaacttatttaatggtatggacatcatattagtcattgggttggaactagcctcatgggctatctcgtgtgggctattttgatccacaccattgggatttagctacatccaaaccattgagatttcatccaacggctgatgtcgatgacgtagataactatagggagtagttaataccacccactaaaggcatgtgcttagggcctcttagccttgccaaccagaaaatttgctgaaactaattaaagagacgagtaggagaaatcttggatttagggtggttctggtgcaccaccaaagcataacctggctccgtcatttataggagacagaaacatcgatgttaaatataaaaataagtctctagaaaataaatttttgacacatgagtgtgggaaaaaggaaagaagagtaacacaatttattttgataggttaatacttaatagtagtctttattgtctcaagtctcaactatcgtaaagggtatactctaaacaacatgtacttcagaaatgtaagaagtgttgggtttgtccaaacctctttcaagtatgacagtttataaaatacgtcacgacatttttaacaccaaactaatatattataaaaatacatacagtggtggatttaatgaaattaattttgcattacatatgttaatatttttttatataaacataaaagataaaaccaaaacatcttatattttaaaatgatatgagtacactactacataaataacttttccatgcggtcaaaatcaattttcgcaagcgggtgggtggcccacctacaccacctgtatacgaaaatcaaccacatgcaaaaattctatttcacatgcgggcgcataagccacctgactacaaaaataattttggcaaaaaccaaaaatccacaaaccctagatccaaaagtccaaaccctagaatccgctgcagccacca

SEQ ID NO: 36497 - DNA, 270 bp, Oryza sativa
tgaggcggcagcggtggagaggtcgaggcggcggtggggagggcggcgtagagggcggagatggcggtagagagggcggcggagatggcggcggagaggtcgatggagatggacggcggcggtcgagagagtgagtgaggcggcggcggtggagagggcggcagagaggtcgaggcggcggtggggagggcggcgtagagggcggcggcagagatggtggcggagaggtcgaggtcgaggcggtggggagggcggcgtagagggcggaga

SEQ ID NO: 36498 - DNA, 1501 bp, Oryza sativa
gaccaccggctggaattggaatctgggcgatacgcttgcattgcagcaagggcgcagcatttgttatttcttttttttgcagcttgtacggttgcatcctcacacctgatgtgaccaacgtgtttctgtcccggcatgcttccatcgacggttggtgttgggatcgttgtgtgcccgaagacgcggaggggcaccggttaaactgaaccgacctctctcggtcgtgtacaagtacaacaagtcgcaatgctgctacgtacagtgccacgaacacgaggcaagtgtatggtggcgaagcggccaggtcgagggaaattgcgtaggcgagctgggctgccgccaaaggggaaaacggcaaaagcagtcctgtcttcttgcttgtgagagggtgagggtagctgcatgtgagaagatgatcgcttattcaatactcccccgtttcataatgtaagtcattctattattttccacatttatattgatgttaataaatatagacatatatatctatttagatttattaatattaatataaatgtgagaaatactagaatgacttaaattgtgaaacggagaaaatactagctagggaaaagaaagagactgcatttacaagacttgtgtgagcacgaaacggtgaccattgtcaaaggcgacaacggcctgcctgacttcttatcgttttgttgaaaagaaaaaggaaggggacgtatacggcttgaaagtagagattgcatagtcccaagcatagtgaagtacaggaattggccaggctcgagtacgtgcaagctataacactctctttcttatcgccctttcctgctgtagtattacgctcttatctagttcccaactttttctttaaacttttaacttttttattacatcaaaactttcctacacacataaactttcaacttttttcttcaaactttcaattttagtcaaactttcaattttggcgtggatctaaacacacctacgtataccaaactattctactcctataataactactattcactgcatagtactaaggaatcaagaatttgttcatgataatttcagggtttagggtttagggtaatactcccttcatttcaaaatacaagaatcatccacctttaatccaaatatcaaaaaaataattattatcatcttatagtttggatcatcttaataaatacaatttatgcatccaatataattaaaaatcttaagtatggaagattttaaacataatattttagcgggaaaaaagtgttacttaatagcatgcattcatgcatgccttatattgtaaaacatctaaaaaaagttatgttttatattatagaattgatagagtagcttctttgtactataaaggcaatagcaatgcggcgcatgtatttgtcgaacctcacatgccacatgggctaaggaacggtgatagacacgaggttcacaatgctgtaacctcaagtggggtctaaacaataaagtttttccttttcttttc

SEQ ID NO: 36499 - DNA, 211 bp, Oryza sativa
attcctgcagccctgagggctacaagtttgatataaagtttgtcttcattagagttcacataaaaaagttatgaattatttttaaatataaagtctttagaccgtcctatttgacctagatgatattcaaatccaagtttagggactggggtgatacaactgaactagttggaggatctaaacgagtgatctgcaagtttagagaccggga

SEQ ID NO: 36500 - DNA, 1501 bp, Oryza sativa
ttgctgtatatagatccgcgcagcaaattatgtatttagtttggagtttagaacattttccatgttcgaaattacaaactacaagtcgcacttcaatatattatttcaaaatccaaaaatgatgggtaaacaccttggtgtgtcacggtggaaatgtggatgtggagttgataatattgaagctttgtgactcagtgtttgcatagtctccacgggagcctaaatcccgaataaacaacattttgatagtacgatattccaatactcataaaaaaatttttaccagacgagtatccattcaattcgatctcttttatgaaaccggaatctccaacgttgctttgacaccaatgtgaactattttctatattcagtagtatttcagtatgtcaatgaaaacatccaagacaatttaaacgtttgccattaaccatgcatccaagacaacattaggggcacattgatgagaaaacattatatgcactttcaccgcctatgcatcttgttctttttgttactctagcatcataaatttctgttcttttttatgatccaagacaacatttatgatgctagatattgcttctcttattaacctgcaattattctcgaatcagccaatccattaatatagctacagatatattgttttgggcaaattgaacctacggtgtataaacttgtgttgggtgctaaatgcaacatcttgcaaaccatatgatttgggggagtggattctaataccttgagggaatgtcccctcgtgtatcttttttcttccaaattcaatacacaaatagctgtgaaaattatgaagaaaaaatttgaaaatgttgagtattgtgatatatatctatctgtccacgaaaaatgaagttcaaattcgacgatcaaatagttgtgaatatcttgaaggctatggcagcaacatcgactggacctcgagggtggcggcacagcgaagtatgtctccagcaatcattaatctgctcaagcagcttcgtccttcctttcatcttgttctttttgttactctagcatcataaatttctgtgtatggatctgtttgagaacgatggttgcattatggattattctccattcagttcagattgacccacatgcatgaattatggtcaccgccacgtataatcagtttgctagtgtggatgttccattcaaccagggtttacaacaactagacaagtttttacaccattattattttttatttttccgtatatcacatggtagcagggatagtcatattatctctcttttgctaccaatcaaaacataacaaaataccacaattattccaagtcgattttctaacccggtgatcatctgctatggtttgtggtcgaggcggtggcattttctacctcccccatctcgtcttccactcgactccgttttggttttgcccgtacgtacaggcgtgacgcccccagcctccgctcgtgcagccgcaatccgtctccgactccaagtcgtaaca

SEQ ID NO: 36501 - DNA, 1501 bp, Oryza sativa
ctagcggggctttttcccaaggtatgggccgggatcccggccagatcccgggctgccaaatgaggcctttcaggatggggttttggataagattattctagtagttgatgaaaactcgatcaagcagggcgagcacgggaatctcccttttgtttgacctggtatagagtttgtccggcaaaggcaattcaaaaagaaacaaggagttgtttgtgtcattgaaggcataggctaggttcgctgcaaagttatcattgtttttattccccgggtctctggtgaggttgaaggccctcatgaggaggagcggctatatagctaagctcatctaggaagtcaaagattattttgttatcggcaggggttagatgtttgtgatggagaaactcaggtcagaaaggttggaggtgaatgttaaagagagtgaatggtctctagagttgaaagaagtttctgtgtaggccgttcgaatgccacctccagtaaagattgattctttcttttcaaaatttccttgtaggcactctttgtattgcaaatacatgttgagttaatccagaagagtgtcctctctcgggccgtgactaggtaatgcacggtagcgctttatatcctaaccgaagaccacttcatcccatatataaatctccctttagtatggcgcatgtctttttttaacctctttaatgacttataacttttaaatcacatatgtgagctggaatagagtcaaggttaagatgatcatggattgaggaagaaatttcatatcatggctggctccaaatggaaacctggcctttagccaactgccaggcgacggactctcttagggtttgcctaaggattaaaactgagctccagaaggcagatttaggagtattaaggggcacatttcaaaaggaagtagtgcagaagtatagctcaaattaaggtcagtcaatggaagagaaagtaatgtaaggcaggtcattcaatagaatcattcaacaatagtattgcagtcttgcagtaatctagacaaagaaactttcacatttctccagccagccactttgaatttaattcaagcattaagataaacatgccatattaataattaagttcatggaattagtactccccaagggccagggcaaaatgatgcgccccccaaaaaatatttcacagaactgcctaagtttttaagcaaccaagtttctaataaaaaacacactcagttcatcccttgcatcaattgaagacccctccaccaaaatgtataattccaagatcagctttgactctcaggtcccttgtcaccccccatagcaccctcaggtcccttgtcttctggaggaaactgaaatgagagaatataacatattagcattgccactgagtaggattaaaaacacattagtattgctaaaagtggtgttctcgagtaaagtgttgccactggatagtgaaaagagaggtagaagtaacacatcgggggacatcgcagggggatgcaagg

SEQ ID NO: 36502 - DNA, 601 bp, Oryza sativa
agtgaacttcagtggagcaagctacttgagcaaaatatgcatcgattcagcgtgaatgctttgaaagatcttttaaagtacctcagtaccagtgatatcatcaaatcggatcccgaactttgttttgtaagtgcactgcaatctcaatgtgggacaacttttgtgaacgacacttcttttgtggctgatggtacatatactggacagtctcaactctctctgccagagaatataaccaagtcttcaaatagcaatctagatcagctttcttgcatgaattcgctaaacacaaatgtatttcccgatgagaaagttagcagtgagttctctgattacattatgaatactccacaatctgatgctaatgctggcttgagcgaggacattgttataggttcacattttgagagtgaacagaaagaacaacatgatctcggctggttggggacaggagtatctgcagttgacgaagtacttgattcaatgaatttgtatggtgatggttcatgcggagagatgccgtcagcatcagaaattcttgaattatgggagcaggataggataaatgggacgttttctgctaaaacggctgaaccaccat

SEQ ID NO: 36503 - DNA, 1501 bp, Oryza sativa
cggttaccgccacccggcggtacggcggttaccggcggtaaccgcggtaaccgcgcaaaaccgcgacaaatttacaaatcgaaatttgaattcaaaaattcgggcaaaccgcgcggtttgacgcggtaaccacgcggtttggcgcggttaccgcgcgatgtgtaatgggttgcacagtaacgggccggcccatttttttttctttttccaattttcaaatttattctccgttttgctctcaaatttgaataaatattactcttttttgagaaatttcttcaccataaaacactataaatcaagcactaccttcactattttttttttgatttttttctttttttttaaatttttgaatttggacgaattttattaaaccgtaccgcgcggtacgggtaaccgtacccccgcggtacgggcggtaaccgcgcggttaccggcggtttttcacaccttgtccgaaagtcggcagtcttgcttgcagtcgagtgtgaggccgaacccgccgaagcatccgcgaagttgtctgccgcgtacaagactggagagagagaaggtaccccctttgtcccattttaaatgcaaccatgagttttcgtgcctaacttttatcgtccgtctttttttataattagtatttttgttgttatgagatgataaaacatgaatcatactttactcatggcttatgtttttaagttttttttaaaattttttcaaataagacagacgatcaaagttgagcgctgaaaattatggttacacttaaaatgggacgaagggagtcctagaggaaactggggagagtagagagagatggaagcctcgcgtgatgatatatgcgcacaatattatattcgttgatgacgttgtttaagtacatttaagacgtgtagcttatattgttctttttctatggggctggtgaggttcggcatttgtgaacggcgcactgctaatgctctcaccatatccaattaacagatccggattgactaaacgtacttaaacaacgtcatcaccacgaggaacccatagccaaagttggctccgcggtactaatgaggctgcgcagattgatgatatgcaaggaatattcgtttttttggtggtgaggctgaacgccattgtgaatggcctgagggtatgcatgcaagacacgcgcacccttacacgtttttttaagccctctgatactcagagaaatcacaaagaaaatttaactagtaattatatttagttgtattccattgaacacatgggtcgaaatgtattttatttgtttgtgttaaaaagaggatagtgttcttttatcactcaatggagatgtcttatcgtttcttttatcgtttcttttatgtcacctaaatacttatatcttttctaaaaacattaagatatactaatatgagataatcacacaacaaacatgcacatccatatttggccttcatatagagtataacatatgttagttagagtttaatttattattttggtt

SEQ ID NO: 36504 - DNA, 258 bp, Oryza sativa
cgagtgatctgcaagtttagtgaccgggatgacacagttgaacaagtttgaggatctgaacggtcgatttacgagtttagagaccaggatgacacagtggtacaagtttaggggaccggtgatgaactttactctagaaattaagtgaaagttttaaaatgcccttggagccaccatatctcccatctctcttctctccgtccccttattccatactactatggtcgccgccgctcgtcgtcaaccacagaggtggca

SEQ ID NO: 36505 - DNA, 1501 bp, Oryza sativa
accacatccactgaacaatgcagaccatgaaacatcatgcaacacaaacaagcaggaaggagttgaggttgagagaccgtaaaacttacatatttccaactggcggcagcgcaaaacacctaccatatgcttctccactcccaaagttcatgtccgccattgaaaataaacttctacaggaatcaacataggaaaatgattagcacaataagataccattcaatgttggaatatcatattagtgtcaaaataatgaagtgatctaatctcctgcagctcaataaaacgaacaaaaacagctgtaaaaacgtaagacatcaatcagtaatataattgagcaccacagagtagatcatcatgaaaaccttagaatgcccccagaaataaagggatagaaaggaaagcagaggccctcgcggaaagataaaagaaaatgaaaagcacagctggcttaaacgaatagacagagtaggaccacgagaggtcattttttacgtaaggaataggctctaggaaagctgcctggaaaagtaggaatggaagcagaatgcttaccggcttcggaagataggactgcgagacttggacatgaaggagagttcccgctattccatagggatttgacagattctcatacaccaatatggccttctagctagaacagacacatcatgcagaccttctggtcagagagataaattacttgagaatcaagcaagtaaactaattatttaacataatgtaaactaattatttgtttttaccagtacataatctcctaatcaatatcttgctagataaatatactttgcatgctattcttttagatagaacacctaaaggtctcttctaattttgctatttttggttgagttttgatctcctgaactttgttaatgtttcaaaagttagtgttttgtcactataaacttgatggaattctgctttgtgatagaaccttgaaatctattatatatcatgtagatcagtcattctattcttaatggcctaaacttattgtgcacgcagagatcctcgcgttattgttttattatttaaatacattatgttttcttaattgtgaagctttttaattcatcgaaaagacatataagattacccatgtgtgtagagtttaaattacaatccacaggtaccacctaggtttatattcatctcagtattccataagtcgtagagctacaaaccaatgaaatcaaattaactaactgttctgtttttttttaaaaaaaaaactactcttatgcagtataaaaactactagaatacaaaagcaatcttaaaaaacatatatactggaaggtgagatataacttgtgcgtgtgtgtatgttgtgcggggaataaaaaatgaataacaggagttaaaagacttagaatgagatttactgatttaatttgcaatatcaacaattcaaattaagcatcggaaacttccgcgtacctgtcagacattgtacgccgcaatcaaccatcaaaca

SEQ ID NO: 36506 - DNA, 1501 bp, Oryza sativa
aaaaaaaaaaagcaaaatttacccccatggattggtcattcggatgcaggggagccaagtcctacttaagcctagtcacgaacgaggtgactagctgctcgccgccggcggtgatgccacggccgccgcagtagcgccggaggtgcgggtgcccctcgggcctcgccggaggaggtggatgagcagagccacgccgccgtggaacgccgcgcacaaggccatgattgcgcacgcctggcacgacgacggatcttgcggaagctccggcgcggcggcgattgccgcggagaccacgcagacggcgccgacgactgaggcgcgcatttccggtgaggtcagtctcagaaattctcttcttgtttttttttttttttcacacaggtcacaagaagggagaaggaacaaagagggagaggcgtagtagggagtaggcgtgcgatcgagtttgcgcttaagctgaacggagagagccccgcacttatatagattttctagggtgaaaaggggcgcgtggccgctacgcacgccggatcgatcgagccgctgtccgatgggcgctggcggttgtcatgcagcggacctgtcgctctcggttgtctgtcatggactcgatcatgggacctgtcggctatgggctgtcgctctcggtggcggccgagcctgtcggttagagcaggtacaatagtataatgtaagccagctataaatatattttaaaaagataaaagaaaagagagaagagcagctgtaatcagctgcagcatggactccaagacgtaatgtgtgtatgagaggtgggactaggtatttaatagtatagtaaacaactattataagaattacctattacattggttataaataatttaaagctaatagttgactatactattaaccatgctctcggtggcggcaagcctgtcggttatgaactgtcgctctcgtcgctcacacaaatgctctgcttttcggcagagtaacccgcgtctcgtggtcgtacgggtgccgtctccgcgcggcgcggcgggccaagacgacgctcacgcacgcacggacgattgcagaagatggatcgcaagatgccaaaaggagtacgtacgtactattatgaccattgactaccgacttaagttactgcctccatctcaaatataattttttttccacaaatataagaatctttagagttgaatatatatattaataaagaagtagtaagaatttaatgtaggatattataattgattgacaaatgaaggttagcgaagaaaattaaatgctaaagatttgtgactggttggaaatatattttgggataaattgtaagggctataaattgttatattttagaacggaggaagtattaatttttggtgggttgagaattttggattccaacatctacatatggctccgttcttatctaactaaaatagagattttatctttgtttcattagcatgttttttaaactgttaaaccgtatatttcatgctaaaac

SEQ ID NO: 36507 - DNA, 162 bp, Oryza sativa
aattcctgcagccctggtgagctagaacgtgacttgtcatacttgccacattacgctgatctttcagattcccttttcgtcagataattgtatgatccaaactaatgaagacaagcttaattgagagaaattcccccaattcgtggacaaacagagtcacaa

SEQ ID NO: 36508 - DNA, 1501 bp, Oryza sativa
ttgttattgttattttagggggtgttagttgtgtaccgataactaaacaactttaccgaggttgatttaatactttttttttatcgatcatgggggttaagacaacaattttgattgcataatctcatgtagatatgaattatcttgacacaaccaacatccctgataatttgggggtatgctcgtccaatgatgtttccgcttctttacaggaggaaaagagagccatggttagctctgcttttggcgaagacaaatcgggtggccacgcgactcggctcaccgtggatgatctgaagtatctatttaggttttgattggaagcacccgtgatctctgcgatacaatgacattgtatagtagcctgtgatctttgcctagatgcaactccaacagctgtgtaccgctgctgagtattttggtgcgaggtactgcggatttgtgtccttccatggctcgcagcagctccagttttgtcatgctctgatttgctagacgaaatgtagtaggcttagtcgctagcctgtgttgaatatttgaccccagcttgtaggagaattctgccattgctccctgttttatcaagagatccatctggtggtgtatatatatgtgccatataatgttgttctgtgtaacatataacttaatattcgaagagtattctgtcactacttattgcatgtgtgagtgggcatacgctgcttgtgggtattgctgttcgtacgatatgtgggtcccacctgtcagtgatacgcccaccccttccattttctctcttcctctcttcctctattctgtcgctgacagcctgacattgccttgaaacgcttgattgagactctgagggggttgtttagatctatgggggtgtaaagttttggcgtgtcatattggatattatatagggtatcgcatggaatgtttgggcattaataaaaaaactaattacagaatccgtcagtagacagcgagacgaatctattaagcataattaatctgtcattaacaaatgtttactgtatcactatattgtcaaatcatgtagcaattaggtttaaaagattcgtctcgcaaattagtcgcaatctatgcaattaattattttttagcctatatttaatacttcatacatgtgtttaaacgttcgatgtgatatggtgaaaagttttggggtgggatctaaacatggcctaagctttcagttggatcttcaagactttgagctgaaaatgatcaaaatttcgcaaattcaaagagcagaagtagctggcatgtggaccccacgatctccaagccctacaaaccaatgaactcgtgcagttaaacttcccgtatcctaagcgagaaagcggaaagtgtacgtttccctttatagaaagccgtctccatcccgcagagccgcaatacgcctctcattcaaaattcaaaaaaagaaaaaagcaaatcccaaaaccaccccctctcctcttctcttctctctacccctttggccctttcg

SEQ ID NO: 36509 - DNA, 1378 bp, Oryza sativa
gggggtatggtatggataagatgagcacgcttgatttgccgaacaatgagctttctggtcaggtgcctgcacaattgcaggatctgaaactgctggggtgttcttaatcttccaatcctggcctgtgcccgattccgatgtgggctatgttcagggaatggtgatcccgattccaaccggcgtgcccgaatacagatggctgtgcccatcctcactgctgctgctggcattctactcatgagtgttgcacggctagggtgcgtgcacggtagtcaagggcgagaatcggatttctgaaatcatgccatatttgcggccgaagatctaaaccggtgtgaccatgatttaggtttttttttttgcctgccattctttatagttcttgtatttgggatctaatttgaggagattttgaaaattagggtttctacaaattagggatttttctaggacaggtgtaacacaaactgattatgtgaaatcccgaccggatctaatttgatgtgggctcggaatgatgcgagaatgacggactgaaaaaaaattgatctatctttgaatttgtgctttatccgtcttatgcgatgcgttactcgcgcgtgtggaaacggaggccatcgctccatcagacttatggaaaaaaaatgatgtgacgaatggaacattatcaatttttaagttgttaagatattgtttaccgttcaaaactctttgaacatttttttctattacacggatgatgcacacatgcacacctatgaatgttgcgctctaacactcacaggaaggggccagtggcaaatcattcggagccatcgcgaaacggcgtatttgcaaacgaaaagtaaattatgaataaaacttttatatacgtgttcttagcgatctaaaagcaacgactgaaaaataaactttgatggttgaaaatttaaatcttggatgataagtataagcataagaaaaagatgaagccctttgacggcttgatgtcattggatttttattcctttattgcttctctgagccttttgaaaattacaatttgaagggattattttagtactgtcgactctcctctaaagtctaaacatatagaggtaaagataccttgttcaaggaaagcctgtcctaaactatgatgtggtcgatcgatagcacagccctagtgattcttgggttggatgttaagtaccttcgtgcttcacttttctgttaatgtacttcccaaacacaaattaattagaacaagtttgcattccaatccttcaagaccaaatttccttttaacaaaaaaaagaaaaatgtcgtgacatcctcacgccatcaaggctctcgtcaaagacctcaatggtcacgagagtatcccctgcctttcgaa

SEQ ID NO: 36510 - DNA, 307 bp, Oryza sativa
tacaaatattataaaagttagtggtcaaatttgcatttttgaacaccacgtagatgtccaaaatgacattgatgtgaccaggagaagtgatgttaaatcttcaacattactgaatttccttttgtcctggaggctggagcaagtatgtgtagaatattgttgttatgatccaacaaagtttcctcatgcttccattgaaccattgtctcatatcaaatgttataaagtggatgttaatttgtgttcccttctgattactggagatttcacaagtgtagtttctgaatgctgatatattgtgatccat

SEQ ID NO: 36511 - DNA, 312 bp, Oryza sativa
ctaatagttgaacttaatgagtgagatttgtaggactgcaattggtgaactataggatagattagtccattatgtaataactggtctgacaaaaattattcaatcattcagttgtattaacattaggttgcatatatggattttttctgaactacctaaatattcctaccatacactgtttatagatggtgcaaagacttaggctgagttctttttagggtgcggtaaaagacttgaaaaatagattaatatgatttttcaaagcaactttgctatagaaactttttacaaacaacacaccatataacagtt

SEQ ID NO: 36512 - DNA, 754 bp, Oryza sativa
aattcatttaaatggctcgaaacttctaaaattcatatctaattcatatgaactccgaattgagccattcaacttgcaaaattcatctaaaattgagctctacatgtttgtttagtttttatgtactttttcgttggtttttattagagtttttcctcgttttgcgtgccagtgtgtagaatccgtcgttttgaaagttcgcggtcgcaaggataagagttcggaagattgtttgaagaagcaatgcaagtcacacattccccttgagcattttgatcctaatttacaaatattttatcgtttgcaaataaaattgcatgtcttgctaattacatgggatccgggtattacgtgccatgtttacttgatatctgtactttgtcaacattgggtaataaatcgactagctcatgttacttatgtgacctagctagaactttatgcttagccatgcttaattaccactagctcagttgatgcgataattacagtattagacctttttagtatcagaatgagctgcgtgctcgagacatctggccatgcttcatggtcgtaattatccaactaaaatgcgactgaatggtgggctgtaggtgtatggttttgctagtcgcacccatggcaattaaggaccggttcgcgggatgccctggaagaacttatcgtacataccacaagccagcgtgggcaacggctgggcttgtagtgtagctttcctctagctgacgcatccaggcaagggtgggcgtga

SEQ ID NO: 36513 - DNA, 179 bp, Oryza sativa
aaaacacatcaagattgattacagtccaatgactccattataaaatgcctccaatactacaggaacggacaagagcatgacaaatttatcaacgtctagaacaaattgtgtgcttgtacttcatatccatctcaaacatcttcttgtactttcctgaaattgtaagcttcactcatcca

SEQ ID NO: 36514 - DNA, 1501 bp, Oryza sativa
gttgttttctgatggcatgatgatccaaatcacccatttcgattatttcctacagccgtgctttcagtttcatgaacacttgcatctaaatacacggtaagctttataaacctcatggctaattgtcagtacatagcaagatcgtcataaaaaaggattattctaatgaaatggccaataacatatcccacagggtcttttagttgaggagctacacaatgcatacaccaactgatagcagaaagtatagagcatgcaattacagtctggtacaggacacaattccaaataatataattgtttcaatattcaccaatggccagacgagcatatcatgagacttcaggaccctcaagttttagcactatcaaggttttcttcagttttgccacgttggatggaaaagactgtcccatctcctataaatttcaaccacagaatgtcagtcatacaccgccattgattacttattcactatatgcgcattcgcatgtgttacgccgataaccagtttgcaatctaacagaaaattcaaaatgcgaataccaactcatattttcatgtgtactactcataaacctgaactacataattataattcatgtacaaccagtaaattttttaacataaccatatttttatgtgtacaaccagtaaacctgaactgcataattataatttacgtacaaccagaaaaatttctgaacagaaccatatttacatgtgtagtactcactggttgcagcttacaaactatacatgcaacagtcacagatcattaattagttcaatcaaaattaccagaaacatactatatatatgacctagcgaggagtgatagctactggagtactcaaaataaatgagtcttctacaggttatatcaacatatcttgtatatattcacaccctgaagactgaaaaggtactgatctccttaacagaaaataaacagcgtcccagagcatgcccacggcgtcgtcattaaacctccacagacagtagaacaaccaccgcgaatctacggaacgtcccacccgcgtcagccttgatggcgaccacaacctcccttgccagcgcgtgttcctgcttgtctgcgagggtgacgtgcataagcacagtcccctccacctgccgcgtgatgtggctgccgatgaagcggaggaggcatgcagcagatgagacgaggaggagctggtaggcgagcgtggggacgtcctgggcgtcagcgatgaggagggagacaaacttcgcaacgaaggcgggttgacggaagctgtaggccgcgggtaggtcgtaggctctccgacctttcattatatttaagggataaagtaaataattcaagtcatcaaacaaatataataaaatatccgacgtcttaatagaagaatattgaaaatattgtggggcctttaacctgcccgtcaacttcaaactgagatgcgcccgttaaacaactcgaaggccacgaccagatgtgttacacatttaggagact

SEQ ID NO: 36515 - DNA, 1501 bp, Oryza sativa
acattgggcttcataagctaaagatgccgagtagtgcccatgactggtgagcttccaattaatctgatggggctactcgtcgctcaaatgcacgttgtggaccatagtccacaaagccaaaagctggtcaattagctcgagcgacattagcgggttcgcttctaggtctagatctcagacccatgcgtcgttcttctttccttggtgcaaggattttcttttcttcatagagattgcgtagacaagtggcatggcgtcttttggcctgcgcccatcaacccatggcgagttccagaagcgggttgtgtttccatcactgattgagaagtttgttgctgccgcgaagagggtcttgtcgattacaaagcatctcgaggcccacccaatgcttgctcggctctttccattcatgccataaccaacgcagtcgtaaggcccttgtgaatttcgccaagtttggtacgccaaggcctccctgtttggttggcatgcacgtccttgtccagatgaccttgcatccccctgcgatgtcccccgatgtgttacttctacctctcttttcactatccagtggcaacactttactcgagaacaccacttttagcaatactaatgtgtttttaatcctactcagtggcaatgctaatatgttatattctctcatttcagtttcctccagaagacaagggacctgagggtgctatggggggtgacaagggacctgagagtcaaagctgatcttggaattatacattttggtggaggggtcttcaattgatgcaagggatgaactgagtgtgttttttattagaaacttggttgcttaaaaacttaggcagttctgtgaaatattttttggggggcgcatcattttgccctggcccttggggagtactaattccatgaacttaattattaatatggcatgtttatcttaatgcttgaattaaattcaaagtggctggctggagaaatgtgaaagtttctttgtctagattactgcaagactgcaatactattgttgaatgattctattgaatgacctgccttacattactttctcttccattgactgaccttaatttgagctatacttctgcactacttccttttgaaatgtgccccttaatactcctaaatctgccttctggagctcagttttaatccttaggcaaaccctaagagagtccgtcgcctggcagttggctaaaggccaggtttccatttggagccagccatgatatgaaatttcttcctcaatccatgatcatcttaaccttgactctattccagctcacatatgtgatttaaaagttataagtcattaaagaggttaaaaaaagacatgcgccatactaaagggagatttatatatgggatgaagtggtcttcggttaggatataaagcgctaccgtgcattacctagtcacggcccgagagaggacactcttctggattaactcaacatgtatttgcaatacaaagagtgcctacaaggaa

SEQ ID NO: 36516 - DNA, 1501 bp, Oryza sativa
aacttctttcaactctagagaccattcactctctttaacattcacctccaacctttctgacctgagtttctccatcacaaacatctaacccctgccgataacaaaataatctttgacttcctagatgagcttagctatatagccgctcctcctcatgagggccttcaacctcaccagagacccggggaataaaaacaatgataactttgcagcgaacctagcctatgccttcaatgacacaaacaactccttgtttctttttgaattgcctttgccggacaaactctataccaggtcaaacaaaagggagattcccgtgctcgccctgcttgatcgagttttcatcaactactagaataatcttatccaaaaccccatcctgaaaggcctcatttggcagcccgggatctggccgggatcccggcccataccttgggaaaaagccccgctaggaaaatttcccagggccatatttcctgaccatttggaagcccacgaggtggatttttcagacccaaaccgtgtgggatacttggggaaacctcccatacctcacgaggttaggaaaaaaatcctcgttgtggagcctcatcacctctgtgcctcttcctctcgcgggaactccctccatattaatatgtaggaataagttcatttgaggtcccttaacttgaccacaatagcagatacaacaggtccctcaactatcaaaaccggttcagacgagatccctctgtggtttagatggcggttttggctgacgaggcgcctctgtgggccctattgactaggtcttcgagccacgtggcacttacgtagcaattttatccggaaatataataaaaccgcggggctcacatgtcagtcacacacaaaataataaaaatggtggtgccatttggccccacatgtcatccctcttctctctatcctttctctcacctaggcggcgcaggtgacgggcgagatggggcagagcggtcggcctgtgaagcggggcggacggtagccggtgtaggccggcggcggttggagcaagccggcacaagcgacggagaaggcggcggaagtggcacggtcgcctcctccgccattgtacctaccgctgccttcgtaaccacatgttaacgaccaaattttgtaagccatgaactaagttcaacatcggaatcgaagcggattcggcagggaatcatattatgaaaacagagtgcgcatcggctacgagagcatcggctgaaggctgcatcagctacgagggcatcggttgaagactgcatcggctgagatggatcggacagaagatagccgatgtagccgatttcgttgagatggttgtataatcgtctccaggattgatcaacgtgctacgcaaggattgtcgcgatggagataagctcacagataggcaattgtatctattagttaagatattttaaatagtttctttagagatgtgtttcggcaagagtctgctgtatagacttgttcgtatcttaga

SEQ ID NO: 36517 - DNA, 1501 bp, Oryza sativa
tgatctaggtcaagttggaatttcataatgctgcgtagaatttcttattcataaactgaaacagaagggaaaaaaaatggcaaactccgtcaggttttcatctgatgaactagtgaacccccccccccccctctctctctctctctctctctctctctctctgtgtgtttaaagagcagtagtataaaattataatacccggtgcctctatatgcttttgcagctaccgctactctttgtctgctcggtcgcaatcactcatccatatcgatataaacacagtatagaagtgctttcaacatgttttttttttgcttagatctaatcgattatggggattccttatgcttccatttactgatagaagatagatagacgaggctgtaaaaatgttgatcctcctcgcgaaaaaaaaatgtttatccaacatagttcagagtacgtgaaatgcaaattctgaatataccccaaaaaaaagaaaagaaaaatccagggccgacataagacttcgatttgtgcaagactcaagaaggagaaatcctacacatattctgatatcaatttgcacaaatcttgctcaaagaaatgaatatgtgtacagaacagattccagaccttgtccttggaggaagaagcacaatcacatcagcatgaatgtcacactcccacttactccctccgtccaaagactcaatttctagctttttcgtgttcaacgtttgactatccgtcttatatgaattttttttttacgattattattttcattgttgttagatgataaaaaataataatattttatacgtgacttatctttttaatcttttttataatttttttaaataagacggacagtcaaatattgtacacggaaacctaggaattaagttattttggaacgaagggggatcaagacaagaggaacatgacagagagaggatcagggtgggtcaaaagataaaagggtaggaatgaatgagacaattggcatttttttgactttccatgcatcggatcgaattccagctacatgcagacgttgcttctccaaagtccattgcggaattgcaccgcccgattctccaaagtccaaactcaaacatctcactcctttcatctcttgtctcttccatcggcgatgtcgtctgattaagtttggagaagtattgttcagcctcatctcggttacagtgtgcctgtactgcatactagtgtcatttgtgcttgtaaaggaagtaatagtagtttgtacgatgatggctttacgtactggatatggattttttgtgtcccttgtttttttcttttcatgtaaaccatatatcactgcacaagtacatggttaaattcgatttctataaattgtaaccaaaataataaattaaactctaactaacatatgttatactctatatgaaggccaaatatggatgtgcatgtttgttgtgtgattatctcatattagtatatcttaatgtttttagaaaagatataagtattt

SEQ ID NO: 36518 - DNA, 574 bp, Oryza sativa
agctcggtacccattttgatattttctatttgttagtagtgaacggttctaaaatgggtattgtatccctttttcctcgatcgtcaacgagcaagaaaacggatgcgcgtgctaacgctttcgcgctagtgcgctcaatccggtgcttgtttggatgtaagagatctcgtttgctggccgggcccttccatgagtttagatctctatgtatgaatctcttattcaatcccatactttttctcatttcagaacgatcagcatactgtgtgacttctgcgtgacagttcttgcatttcgtttgttgctttgcatgaacatttagatattggaaagcccttaattaggaatttcatagatagagaaggacgggaaaaaagagagagactgactaactacccggatcaatgctgattgacgactgaataaatagccggaagcaacaactgcacgagagagaaagagcggatccaactaaggaaatgcagtacctgttctgccggagctaatcatgcaaagctagcgtagcgccagccgtcgaagtgaatgaattcgaaagaacgaagaagtaaggaaa

SEQ ID NO: 36519 - DNA, 455 bp, Oryza sativa
ccttgaatcagataggaaatcctcacttttccaagacaaaagagaggcaagcacgggatggagcaactagcgcgaaagaacaaggaatgagcgctttgttgctaaagcgcatacgttttctggcttgatttttatacgattttttgagcaactagccgatcacgaaataggctcatgctcactcgtggtccctactgcttatgggactgtgatcgaatccgatctggaaaacagtgctttctgataactaatcactggaagcacccgattctctctactctgtttcacctctctttcttttggcttcttcttgagaatattttcacgttggatgaagggatgggctttcttttgagttggctttgatcgattgcttggtgtcacgctatttactactacggttagctaaattcgtttatgacaccgattcatttctagttgatccattcgtaagg

SEQ ID NO: 36520 - DNA, 588 bp, Oryza sativa
tagggcatctatacccgcctccggtttaggtggcaagcccggcaagtagacatccacaggaattaacttatcgactccccgaacagtactataggaatccgtactgaacattccccctgtaatagtacaagctcccatagcaatgacgtattttggttcaggcatttgctcatataatctcactaaagaaggagccattttcattgttaccgtaccggctgttaaaattaggtccgcttgcctaggacttgatcttggtttggtaccaatccataacgatcaaagtcgaatcgcgagcctgaagcaaattcaatgaaacaacaaccatatagaaggggccataaacaggagagtcttgaccaattcgaaagatcatttggtgtagttgaaataacggaattggaagttgttcggtcaagtataggaaattaatataagaatgaataactttctcaattgtttattttctttcttttatttatcttaatattcattccattcaggccattccaatgctcgcaagcaagcacgaaaaagcttatatttctaaacggaaacgcccaatacatcgaaactcattacccatgg

SEQ ID NO: 36521 - DNA, 666 bp, Oryza sativa
atattcgtgttacttcgtctgcacttgtttgtacacgaatgcgtgagttataccgagtactcagtaaattatggacaacttcaaatcttcgttttcgagagggatgatccactccgcaaatatcgatcgaaacttgaacccttgtataggtatgccattttagaaagcacaacaatggaaatgggtagtcagtattggtataagatctattcccatgttccgatcttttcattttatgtacccatttcttgggtaaaatctcccaactatattggaaaatggattggttatccataaatgaaaataaagaaagcttgattttggttccgcttcttgctctaagcagaaagacttgtcggaaatcgccggttgggttggtccgaccaagaaaggcatgggagtggagaggcggaagtgaaagactggctaccaataaagatccctcactgcacactttatatagttctgtatccaggatcggctgcatgctctagtgttgaatctggtatagaacccaggatgcttggttacaattccgaatacgctaaaccatgtttgttttatttttttttctcgactggccatgggtaatgagtttcgatgtattgggcgtttccgtttagaaatataagctttttcgtgcttgcttgcgagcattggaatggc

SEQ ID NO: 36522 - DNA, 168 bp, Oryza sativa
aaaatagacgcaaaatactcaccccaagcatttgtgttcccccaaactccattactagcaaattaataattaggactatcaacgactctccaagccttagactcgttcgatccgacgagatttaaccatgagaaatcctaaaagcaggggcggatccaacatgggaca

SEQ ID NO: 36523 - DNA, 236 bp, Oryza sativa
aatagaggtagtaattatttacatgatgaaaaatttaaaagtaatccatagttacagtttagagtgttgtttcggtccttctttttgtaccacgtggtactagtaccatgagatactaaaatcctgaccgttgttggtcattggtgtggttagcgcgagagagccacggtggaagggtataatcgtaaatggagggatttttggatcggtgcaaggtttggctgagttggggaagc

SEQ ID NO: 36524 - DNA, 1005 bp, Oryza sativa
ccatgatgagtttgataatcttttgatgctattaagcgataatagttaccagttttatgtatgcttatccttgtgcattttgtctattataatcgttgatcttaactgctccggtccacaaacttgtaagatgggtgcagtttagtacaatgagttgtaaaatgctcaaatcagtgcaatgacttgtgtgtgtgtgaaccaagggtgagaatagtccacattttggttaatcaaatcatttgagtgctgactaggatgccataccagcaagcatgtaaatgcgtataaggcatgtgagtgaacagtaacatgccctcccggaacttgcttctttcctgctagaggctaccttctctttgaatattttttacatgacgcatggggcccactcatgcagtgtggcacaaatagtgcaaccagggcaccgagttgtgagatgaaagatttgtgcagtgagggagatcaatcaggataaagaaactggaatttcgttttttctgggtggaggcacgggatgtccgcaatgatgacagctcaaggatgagataacgattatccaaagacaaggcacacaacctcatatgtatggtgactcattctaccatcattatcaggaatgtcaggcaccgctatcaatcttctgcagatttccctagcaagataatttccaaaaggcataggagaactatccctatcttttctggatcacaagattcatgcatgcattcagcagcataacgctccgattcgctaacatggactattttggccttgttcgcacgcaccatgcaagtagttgaactggctcaaatgttttttagttgtgctgaattgcacctaccatgtaggttcatgcatccaaagtacaattttactctttcggtaattgctatattctctggattaagcactgtcagctgtcttgcaaatgtaacatgcaacctacaccgtctgtttttagccatttttctgtttatatactattatactcattcttgagtactg

SEQ ID NO: 36525 - DNA, 1501 bp, Oryza sativa
tctactgaaacagcctcggatgctattgactgtggatgaggatctcaagcccctctctgttccggtttgtgttggtcaagcagttgacgtcgtcggtcaggcgggtcgacccaagacaattactggattccagacgcattcaacgcctgtattacttgccgcaggggaacgagcagagctggcaactgaaaagtaaactaaaacatctggagaacaattttcaaatttgtcagttgatctttgcttatgcttatgttctttctatatgcagatatcttccactgacaccagttcttgagggttttgtgatcctaagaaataacccagagtatcatgaagattaagggatagatatggcacacgcaaaatgcaggaagggcctggagtattaggaagaggcttggatcaatatctaattgtcacacaaagcaatgaacaaatagcacgatgaagacaatgcatacttgatacggtgaggactgagttgtaacaaagagttcaggtataatggggccaatatgacaggagaactttgtaagaattaggaatagaatctgtgggtgtaatggcatggccgaaaatgtttttgactataccagaatgaaaatgacccaagagtttgttgccacgtccatgtatatgcagccctactactcggttgtctgatgtttcctttttttttttgaattgatcgttttttgtttgggtcatttgttacagtggctcgcactctagcagcagaaacgctgtactttatgtgatgttgtgcactgagtacagatatacagctggggatatcctgatggtaatatgccaccgactgcatgaatattagtttgtccgtatcaaaatatagtaatctagcgctgcatcgagaagctgagaaatttgtgtttgtgttgataggggtaggttgctagagcggcattaattgctgcatcacagaggatataaattcccctggtttctcgtgccgttttcttgggaaaaatttgggctccatctcgtggtggacatcatcgtcgtctccggggaataagttcactttaggtccttcattttgacatccaatttgaattgcatacctaaaccgttaaaccataaaactagatacaatgcattcctccaaaactactgagggagttaaattttacggttgggaggtctaaatattgtggtttagagatatgaatctattggtcactagtaaagggagtcaaataaacttattcttttattacagctttgggctttagttcgcattaatatggcaagtttgggcttgttaaataagttacttttggtgttggcccagtgaattttatgtcttgcagatggcccatttatatgcagaagtttgatttgcatgtacattttagtgtatcaatcctgtccattcgtttattttgatccaatggccgaaaaatcgtgtgagccctaagaaaaaacctcagtttactcgagtatcttcccctccttcccttcggcgcaaaagaacgag

SEQ ID NO: 36526 - DNA, 1387 bp, Oryza sativa
tcctgcgcccgtacaaatgttctttcttttttccttcaaaaaaaaaatgcaaccatgctagtaacaaaaaggcacctgtgatagtgattgaatttcaatggctctgttgtctgaatttcttctttcccttttggctgctgcttttgtttctctgtttgtccttgtaagcagacattgctgcagtgaatcacattcagacaagcagagactggctgctgcaataggaacagaatgaacagaagctgcacaatgcactgccactagtcatcaaaagaagctgttttttcaccagcttccgcagttcagaaatcattgctctgctactgagactattttgttgtgggccagagaactatatcttgcacgtgccttttggcaaagttgagtatggagtatcacataaattttgaatctttgatacgttatctgaaaaacataaagtaactatgcctgatgtatttgtgaactcccaccccctagtccaaatttttgccgtgtctgaagctccgattatttctcttgtatttgtgaactcctaccccctagtccaaattgtaagttactccttttactctcgttctttacttcttttgtttttttgcgaggatgaatacactgttctttttatatggtgaaatgaagcatagcaaggacatgaaagatgtaattagtacagccgaaacttcactgaatgcacctcgatatttttgaatcatatgtccagagaaaacgtaggacacctaaatgggtcccagtgattcatcaagccttagcaggacaaatggatccaattttcgctgcttctcatattgagttatatgatgtccttgttgtcttactaatactatttattattacctccgtcttagaatatagctgtacatttttttagatttataactaaaagttgttttattttaggagggaggtagtagcttcttatgttctactcctatgttgatttccatagtttccgtactgttctagcatttgaatcctggatgatccttttatacagattacagctatcttagcacaactactcaaatgtgtgaattaaattactccgagatcatgatcacaatatttgcattcacttgatatccagatcatattcatatacatggagtactgagcaaattgagtttttttgtttcccctatgcattagtacaagtgtaacatgtcaaatcttcacaaaatcaactcaaatgtgctatttgttctcatgaatgcaaaatctgcatggaccccaattgagatgacactcatggagtccccaagatgataaattcagagctgcatgcctgtgggctccaagaatttcctcctgataaaagtcttgtctgcaccactagggttcttggagctgccaatttaagtctcca

SEQ ID NO: 36527 - DNA, 688 bp, Oryza sativa
gcatttctaggacttagacgcttgtcaatggcatttcttggattatctcaaataaataagtgaataacatgttgatccaaatataacaaagtgtgacaagtctaagttgtgggagtgaaacaaatatctacctaactgatgcatgagttctaaagaaaaactgagacatgattaaaatatttttcacgaacgggcaaaaggattgcacgtcaatgtattagaagaaagtagagtttcagttgtacaatgcaaacggcgagaaagaccattgtcggaggacaaacatgattaaaatatggcttgaggagaggagtaatgaacaaaacaaccccttcctatacacattggtggcttacaggcttaccattaaggtgcagtaacctctcttcccctgctaaggtaaaccgtggtgtaaagtgacggtaaatatttgttttagatttcaatcgctttaatttgtttgggggctagaatagctggatgcaattatcacctttcaaaagtgaaactgataacaagacaatgatatgtcggaggaagatgtaataaggttgacgagaaatagtacaacaagagtgtactacagatatgaacaaaaataatatcagctcgatctgttgggaagtttgctttctattcgaccatttgtacacacatgcattgatgcatatgtgcacatatctctagt

SEQ ID NO: 36528 - DNA, 202 bp, Oryza sativa
ctaacagtgtaccggtaatttcaactaatcagagagctcaaagtagtagagcttacctaacttctaaatttaattccagaagttagggtttgaagtggagttatgaagctggccaaacccagctccacctctctagttcattttgtgagagagctccaccagctctactcccattttaggtgggctctagctccaagagaga

SEQ ID NO: 36529 - DNA, 1501 bp, Oryza sativa
tgagtgacatgcgaaacatagcattatattggccttctcccaggctaaagatgcctcttgagtttaggaaaaaattagtgacattagctgcgggagccacaaggaatcctttgttaatgctaagtcatactcaaataggccttaggctcagttaagtcaatgaggaataataataataattccatagactttaactgataaataaaattaagtggcactattattgtggttgcttgtgcaaattacgtacaatagtacattaacttacgcaataataacttaatctttatttcgctttgcatcaccgttgggcagagacaaaacgaaggaatcaataaatgaaattacttataatccaaaatcaagtcaccgttgggcagaaatgattagggaataaacattaatgtcttaagtcacatcaccaaaaggtagaagtgataaagtaaaaaaacccaaatcaaatcaccatacggtagaaatgattaggaaatgacgccattagtgatgccatagaattaaaattaaaatccttagccatatcaccgttggctagaaatggtaaaggaattaagcttactgacagagtagatcctcgatcacatcaccgtaaagtagaagtgataaaaggaattaatgcactaatggcatcaataaaattctaagtcatatcaccattaaggccaaaatgacagagaaaataattagatttcttcccttaattacatcaccgttgggcagaaaataattaaggaaataacaatcttaatgaaatcatctttctttctagataaacttcccgctggttccatttatctagaaataacttactcagtattgcaacagatcttaaatgataagaattgctgatggcatataattagtttaccatggctttaatcaatcatatgcaaaataaacttagaatttcatagtcaaagcaccattggtcataaataattatgaataatcttaaaattaattccttaattatatcaccatttggtagaaaataactaaggaataaaaaattataattgacatgcaattataataacgtgggttaaatatagcttcatatcttaatgcttctagtcgaatttctcgttggttccattcgactataaataattaagtttctaaggaaatgaccatcataatgatgttgacatgaaatcataaatactttctagttaaattttcattcaactagaaataaattaaatggcttaaagaaataataatcttaataaatattgacatgaaattatattaacgttagtcaaatataatatcatatcattaatttctttctagttaaacttcccgtcggttcccgtcggttccatttaactagaaatagttttccgagtgatcaaataattgaccataattttccagcaattttaaatggctaaaataatgccagatgaaattgtgtaattttgaaattaattagggcgtttagtgaattaaattgatttcggcccaattcttccgtagt

SEQ ID NO: 36530 - DNA, 500 bp, Oryza sativa
ttttaagtgcaaaataccccgttttaaaagttcaaagtatgttttaagacaagataaatagtccaatgatgtaaagtagttttatcccatcattttctaagatcactctagtatgattcactctccttttagatggagttgaaacattttgattggactttaactgtaagaggggtgaagctaaagatatagcctaattatttagatacgagtatgtctacatacataactaaaacataactaaaagttagatacgagtatgtctatatacataataaaagttagtatatatatctgaaaacgtataaggtgtaaaataaaacatattttatgttcacgttcataattaaaagttactatattatgaaaatgatatatggtgtgaaactgtgaaatgagacatattttcgtgtttagttttagtctggcggcaaaccgccgtgccggctcagtcgctgtaaacgcctataaaacctccaccatatcacacagcagctcac

SEQ ID NO: 36531 - DNA, 1051 bp, Oryza sativa
atagcccccgagcgaacgctcaaagggtaacatgttataatatgtatggaaaaccgaaaatgaattaaacttacagaccaatgttttgtatatgagcgtctactcttttaccgacttcgatcagtcagtttgttgagttatacactctccctagcccccagcattgtcgtcggagaatcgttctcggaggataaggctcttggacctttgacctgccttagttgaataagcactgatcctagcccccagccgtgaagttggaaaatccatttctgattacacagcttggttaatacgcacggcgagaactcttacacgaccagatcttacatggtctttcgtctctgaaggatccgacaaggccttatcggctctgggcgtcccagctaaagttcccttagattcctcagaggccttgtcaagacagcgtaaaggaacagtaggataggtttcaacgctaggtgtcatcgtggtaagggatctctgggtaaaacagttggcgatattgtgtacctgatatcaactttgttgaagtaaaggtaatgggagaatcgctacacctctggtcaaggaccaggtagtagtcataactcgaccactagaagtaaaggtagtgggagaatcgctacaccgctggtcgaggaccaggtagtagtcataactcgactactagaagtaaaggtagtgggagaatcgctacaccgctggtcgagaaccaggtagtagtcgtaactcgaccactagaagtaaaggtagtgggagaatcgctacaccgctggtcgagaaccggatgtagtctaaactcgaccactagaattaagggcagtgggagaatcgctacaccgctggtcgagaaccagatgtagtctaaactcgaccactagaagtaaatgtacgatagatcgctacgattgactggttgagaaccagtaagtaggtgtctctcgattatttgaagtcgtggtgcgaggaccgctgcgttattgctgtagtcgtacctcgaccatctgaggttgcggtgcgagagattgctacatactggttcgaggac

SEQ ID NO: 36532 - DNA, 1501 bp, Oryza sativa
tactctacgttaagatattaaaacagatagaatatatcaaacagaagtctgatatactttattgcgataaaatcttaatataaagggcagacttagcatattagttaagcatataaaacataaagctaagtcaggtaagatcggctgaaaccccgatactatctctctcgatgatcataaaacaagctagatatcacaattatgaattctacttaatagatcgaactcaaccgatgcagcattaaacataaagacaagtatgagatctaagcaggatgatgaaaatctacaagagatggtagatatatgatacaatctaaattaataataaaacataactctaccgattgtttcctaacgataagaaccagccgataacaagttatatagcgccactagcatagattgcaacatgtatatgataactcgatggattacataaacagggttaaagtatcatagagatggaagcattaacctcgataacgcaagccgccataacaagttttacttctagttgaagatcgaatcgatgcagctcaacccgaaagcaagaactcgtagaaataaacgaaagtaaaagggtggctgtcgacgggtgatacccgtagaccggatatagagggtattggggtacgttggtacaagggtctacgtagtacgacatcaagcagacaaaagacgaagattatactggttcaggccccttgataggtaatagccctaatccagttgatgtgggattatatgatggaaaacacaggttacaaagggaacaatggaactcgatggatctggcgagatcgtagtcgagttggttcgactaaatccccggcgatttggctcctgcaggctccgactttgtaggctgtgggggttgtgttggctctgagattcgatgccttaggtcctccttggggggtcccttttatatcgcaggtcaggcggtttccaagtagaactcggagacatcaaacctcacatgatacgttgacgacccagtctggtccgagtaggactctttccatccgtaaattccgtgaaggatttccttaatgcatgcggagggtatccgtatgcgcgtgggtatgccataccgatatgcgacgtatatcaaagggtaaagggtatacctaactcgtaaccctgatagtagcccccgacttctgcttaaatgaactcgtgtaaccatttgcgacttcttgtgtcgagattgttgttgttcccggtgtgaggaccgtagagataggacgtagtcgagaacaccatgtgaagcccaacggtcacgagtgaatttaaactgaagtccaagaaactaccacgcgtaacggacccagaaatttccggcggccatctctctcctttccttggaattcgcaccgtcagtagtgcgtctatttaaaggaattttggggatccattttgaagtccgcctactgtgaagaaaacatcccgcctgcaagcgttcttcgtcttctccgctcccacaagaaaccctagc

SEQ ID NO: 36533 - DNA, 1501 bp, Oryza sativa
tttctcgagggagaaaaaccaaactaaaacttttcgagttagcggaattcctagtaaaaataaatccaggattcttccacttagatgaaatagcttagatgaaatagtaagtaatagtcccgctcgtatccatggaaatgggaaaggaattattcctttagaaccatggaacccccgagcggttgtggttgtacctgtacttgcagggatacgaaaactcgctattcactcagtttctggtcaataataagattatgtaggagagatggccgagcggttcaaggcgtagcattggaactgctatgtaggcttttgtttaccgagggttcgaatccctctctttccgtttctgttaattcaccaccgaccacaatgtatcaaatcaaatagatttcagcaataagacttttatttgatagaaattcattattaaaaattaattactttggtacggcaataaaaaaaaatcctactgtagatccatttgtgatacatgaatgagaaaatacggattaaggcccttccgcgaaaaggggaaataattttatgaacctttcttattttcgttaggttcaagtctgacgagaataatattctacgactaagaactcatttattttcaccatttactaaatattattttatttactagtcctttatattggaatgagtcactagtcaaatgttttggcaattcctcgtgggcggatgatgcaatagaattttgaatcagcgttttgatctttggttatccttcatagtaataatatctcggagtttgcaacgaaaacttagtatatcgactagacgaccgtgaaataaaatatgtctatctatggttaactaattgcctggctccgggaatggtcgaagccatacccaatcgaaaaaggatgttatccaaacgcatttcaagtagttgtagtcaaacccgacctgttgacccttttgcttttccagcaatatgtacatatctaagtaattgtcgttctgtcagaccatcatgaaaacgaaatttccgtttttcttctagacgaatacgatattgcgatcttttcccagaacgcaattggtttttaaagatacttcaggatctaggtcttttactagttagtcccggtaaagctcccaaacggcgtattttttcgaaacgaggtcctcggtaacgagacataaagactccttttttttcttttttttcattttcacacaaaatccaaattaaaactgggataaacaaagcaaaatcaactgaagtactaaaaaaaatgaattgtatcaacatctggattatataaatatataaataaattatgaatgattatgaaataataaattaggataaaattcagaattattgtgaatccattccaatcgaaggtgaaagaagaatcgaatattgagtaatcaaatcattcattctttagatcttttgaaaaacggattaatcggacgagaattaaagagagagtcccattctacatgtcaataccgacaacaa

SEQ ID NO: 36534 - DNA, 416 bp, Oryza sativa
cgaaatagcaaaaaccagactaattcgattctaaaaatagataatagatatgggctttctgctcaaattgtcccttttccttctgcttggacaaggagagatattcaatatttgaatcagattggatttcattccactttcttatttctcaacaacaacttctctcatcagctatttcgcgttttcaaagtcattaattgtcccattaccctattttctatttcgattgtatggcgtagcgtacgttatgcaaacagaattctagggttattatggaataagaagaattcttccattctttttctcgagggagaaaaaccaaactaaaacttttcgagttagcggaattcctagtaaaaataaatccaggattcttccacttagatgaaatagcttagatgaaatagtaagtaata

SEQ ID NO: 36535 - DNA, 615 bp, Oryza sativa
tcaggatatatggattgtgaattacttacttaataatagggattacttgcctatactataatatgttcatttgtatgaatgggataaaatccaaagaagtcagttcggatccgtttgtgaaagagtagaaaaagaaagatagtgaatcttgtttgaaccattaatgaaaaatagaggttggtaaaatagttagaaagtaaaatggctttttattggggatagagggacttgacttgaaccctcacaatttataaagtcgacggattttcctcttactataaatttcattgttgtcggtattgacatgtagaatgggactctctctttaattctcgtccgattaatccgtttttcaaaagatctaaagaatgaatgatttgattactcaatattcgattcttctttcaccttcgattggaatggattcacaataattctgaattttatcctaatttattatttcataatcattcataatttatttatatatttatataatccagatgttgatacaattcattttttttagtacttcagttgattttgctttgtttatcccagttttaatttggattttgtgtgaaaatgaaaaaaaagaaaaaaaaggagtcttta

SEQ ID NO: 36536 - DNA, 268 bp, Oryza sativa
attcttcctagtatggaagaagtaaataaaaagtactgcgtctcgatctatacgaaagggcactggttttttctttcggtttcattgatagcagaagagtacgctagctagcggagcctgaaaacgcttgcttgcgccccaccccgtaagctgactctattgcctatgcttgctgctcgctcagtgtcagtagaagggaagaaaagatggtcacttcttttaggaacacggcgagccttacttacgactgttgcacttcactcgcagc

SEQ ID NO: 36537 - DNA, 342 bp, Oryza sativa
atctttccccttcttgatgagcgcactacgactcattcaaaagagagagtaaaaggaaggatttcccatgccaaaggatcggaacagatcgggtctcaatccatccgtacttgcaatttcatcatgatccttatcaacagagctaatcgatacatttataaacaatgataccttgctttgtgtttcccatctgttcaagtggataatcccgattcggttttcgagggttcgctcgtcatttattcgtagtaacgtcgtattgcctatgcagctaaatcgataggaataggatttatcaaaggaaagggcgggtggacatacgttgcgggtgtccagttggca

SEQ ID NO: 36538 - DNA, 1501 bp, Oryza sativa
  unsure (1)..(1501): unsure at all n locations
tttcaagaaagaacgcgaatcttatgatatggtgggaatctcttatgataatcatccacgccttaaacgtatcctaatgcctgaaagttggataggctggcccttacgtaaggactatataacccccaatttctatgaaatacaagatgctcattgaatgataagaaattcatgctcacttatacaacacaactcctgattttattcaagtcaaggaatattttgacgttctgtttcgtctagaaacagaatacctattatattggaattaattcctattatacaaaagggtccagatagactgagcaaaaaagggcttcatttcgattctccaatttggaaaatcacatattcatttccttcatataaacagaaaaatacgatgactcaaagaagttccctaccacgaactttgtaccgcgcgcattacttggaacaactaggaaagtaagataagataagaaagaaaaaaaaatattcggaatagcggaataagaaatgcaaaaatgaagaaaagggaacctaatctcacctccttttgtaccataaagaaaaggaccagagatttttacccttctctaaaaagaagtgtctctatttagagatttctctacttagatgaataaatcatactctagctatatttttaacgaatatgtatcccaatccatctcgagtaatttgtatcaatacctattcggtagatccttttttctgtgccaggaaccagatttgaactggtnnnnnnnnnnnnnnnnnnnnnnnnnnnnnnnnnnnnnnnnnnnntgaccatttattgtgcatcatcctagtagagtacttgtatctatgtcaattaaagggactaaaaaatcaaaaagtattctaaaattggacttagtaaatgtcaggatatatggattgtgaattacttacttaataatagggattacttgcctatactataatatgttcatttgtatgaatgggataaaatccaaagaagtcagttcggatccgtttgtgaaagagtagaaaaagaaagatagtgaatcttgtttgaaccattaatgaaaaatagaggttggtacaatagttaggaagtaaaatgggctttttattggggatagagggacttgacttgaaccctcacaatttataaagtcgacggattttcctcttactataaatttcattgttgtcggtattgacatgtagaatgggactctctctttattctcgtccgattaatccgtttttcaaaagatctaaagaatgaatgatttgattactcaatattcgattcttctttcaccttcgattggaatggattcacaataattctgaattttatcctaatttattatttcataatcattcataatttatttatatatttatataatccagatgttgatacaattcattttttttagtacttcagttgattttgctttgtttatcccagttttaatttggattttgtgtgaaaatgaaaaaaaagaaaaaaaaggagtcttta

SEQ ID NO: 36539 - DNA, 1501 bp, Oryza sativa
tcattgccatcgtcggccttccccagctcccctccttcgtcgcttctggctaagcatctttcggcggaggaaaggaggcgactagtcgcttctggcgaagcagcgagttcatgagcaagtgaatgaacgagctgcgagtgaagtgcaacagtcgtaagtaaggctcgccgtgttcctaaaagaagtgaccatcttttcttcccttctactgacactgagcgagcagcaagcataggcaatagagtcagcttacggggtggggcgcaagcaagcgttttcaggctccgctagctagcgtactcttctgctatcaatgaaaccgaaagaaaaaaccagtgccctttcgtatagatcgagacgcagtactttttctttacttcttccatactaggaagaatggaaggaaatccttcgataacacttcttccttatttgaagaaatgatatccgacgcccgtggaaactctttcatttcaaaaaagttcttcttcttaagaagcaaatagcatttcctattgatttgtctcctggactagactagttatgtagattcggaattatccgtcgctacgctgttcccaaggactagcaaaatcgaaatagcgaaattcttgggtcatctcaatgggttcagaaaccacacgtttctctggatcatcatagcgtacttccacatatccactcagaggaaagtcttttcgtaatggatgaccctcgaaaccataatctgttgatatacggcgtaaatccggatgattgatggaagaaacaccagacatatcccatacttctcgctcccaccggccggctgatggaaatggactgactaccggagatattcgtgttacttcgtctgcacttgtttgtacacgaatgcgtgagttataccgagtactcagtaaattatggacaacttcaaatcttcgttttcgagagggatgatccactccgcaaatatcgatcgaaacttgaacccttgtataggtatgccattttagaaagcacaacaatggaaatgggtagtcagtattggtataagatctattcccatgttccgatcttttcattttatgtacccatttcttgggtaaaatctcccaactatattggaaaatggattggttatccataaatgaaaataaagaaagcttgattttggttccgcttcttgctctaagcagaaagacttgtcggaaatcgccggttgggttggtccgaccaagaaaggcatgggagtggagaggcggaagtgaaagactggctaccaataaagatccctcactgcacactttatatagttctgtatccaggatcggctgcatgctctagtgttgaatctggtatagaacccaggatgcttggttacaattccgaatacgctaaaccatgtttgttttatttttttttctcgactggccatgggtaatgagtttcgatgtattgggcgtttccgtttagaaatataagctttttcgtgcttgcttgcgagcattggaatggc

SEQ ID NO: 36540 - DNA, 323 bp, Oryza sativa
tgacatccccatcggtccaacatgcgtatagacaaatgtcgagaaacatgtcccttttagcacacgtccgtacgtccaatgatcgaaactaactttcaaaacattcccaaacaaattattgatatacacatatttagaagagaaatttttttaaaaaaaatcatatatacataaacattcataacaaaattttaaacaccactaaataagatgcccgcgcatcagcgcgggctacctttctagttgtatcaagtgtttgctataaatattatttctaattcactgaaaaacattcaaatttcatttgcacacaccccattagc

SEQ ID NO: 36541 - DNA, 453 bp, Oryza sativa
tttctgctgatactgagcgtcacgctgtgttcgacgtgtactaatctacatacttaaactgaaattcacacactgatcagtatgtattatgatctcaatagggatactgagcgtcacactgatcgaaatgtaccgctatttgtacacaaggataggtagtaacgttgtgccaatatatttccaagtagcaagggtatctggtaccctcccatgttcattttgtttcatcttatttgtttaaaataaatcttatcttttagtaatcattatattaaagtttgtgaaagtagtatgtgtggaatagatgaaaaataaacttattttttaaggggaggagcaccgtagtaggctatactaggtaaacgattcagatcaggtgcagttataagtgccactatgccttaaggattaaggactgcgcaaaattaatctcaataatatcccttgttacca

SEQ ID NO: 36542 - DNA, 1185 bp, Oryza sativa
aaagaaaatgtactcctgcttctgatgatattctgtaatgagtatattcttgcggttgcagtatactagattaaatttatattacttaataatgtgcgttgtacgtgcacttactagtacacttacaaaagagcgaacctgtttgattacacccagtcgatgcatacaaatactcgaactaacacaatcaatcaaatcatcaaatcgttcctttacttactttcagtcatattttctagtttaccatatacctaataactagttcatccatctttatcaatttggttgtaaatcgtccatcttttttgcaagagcatgatatcctttgtagttttgttccatgaaccttccaattcgcttacgagaaagttggttatctacaaaccagtctaaatcgggctagacgtcagtttgatctctaaatcgtctctgcttgtcggttctaatcttttctaagcccatcttaggttgcgttcggaatcccctcttcccaacatgcacaatacttacggaaaacagagcaatccattagcacgtgattaatcaagtattagctaatttttttcgaaaatggatcaatatgatttttttaagcaactttcatttttacagaaaacacaacgtttagcattttgaaaagcgtacgcgcagaatacgatggggatgcactactaggaaatcgggcttatgcaacggcaagaattgttgcaatatgcccaaaaccgttgcaataggtacaattgcaatggatttttgtcgttagggctcatggcgcaaaagtccgtagcaatatggtttttaccactggatcactttgtcgttgtaaataaaaactcctgttgcaactgaatgaaccgtggcaattaacagataaggcaacggttggttggtggtaatacaacatattgcaacaccagatgtcgttgtcgtaggaactagtcgcatcgcaccaaagcgtggtaataagtgctaatgtgtattgccacagacctcaaacgtggtaataggtcgacctttattgccatgctcacagtttggttgttatagatagatcccactattgccacgctacacatgtctctttgctataagcaggccccacctatcagtgactaaggtcgacgagcgcatagtggactaggtcctcgcatgcaccggccgtgggcgcaccatgtggcagccaca

SEQ ID NO: 36543 - DNA, 1501 bp, Oryza sativa
agatatagatctaacattttaaaataaggtccacaggtttgggtaagatgatttctttttctcaaaattttttatattaagatatatggtgatttaggaatgtttataggaagctacgtggtagctcgagagaatttgtaggacatctaatgaacttttaatatataataatagataattcatgtcatattaattaatatatcaatcaataattaaataatttgtgtgtgcagtgtcctgataatctttttatgggttcaccactgaaaacaaagggtatatatccaagtgatgtcttgataattttatttttgagttcgcccctggaaattaagggtatatatatccgagttatgtattataatttttatataaaaatatatgtaccaagagattatttagctatctaattaatttttatactatgcatttggttgttagccagaaaattggaaagatggaaggggagggttagacggggagagagggagtacgtacatacatgtgcgcattacgtgaacttgtgttcggagagggggaacgtacagtttttttttggaagataaaatttaatggtgaaaattaataatctaataatttaaaatattgggtctaccgatttaaaggaaagtgtcacgtgacggtatagaagcatttgtaggagtgtcatgtggcggcttaggagtatttgtatgaagtttaatggacttttagtaaaaatacaccttgttccgatcacatataaattctccatttatcataacaactcattatcactattataaaagttgattacctattaatagatgaaattgcatatgtgcaaataaaataagcctaatatatcattaatgcactacttagctaagtctcatgtctcacttatttccaaatccatatataaatattctaaaagtatcactttctaccgactaataggataacaacctttaagttaaatatgaatgcctcgctaacgggtgatctattaccttgaaagttgggtacctcatcgatgtagctgtgtcccctcaagatcagcatgaagcacaattctaatgcataatttactataacatcctcatagagtactgtaacatacttgggtcacctcaatttagccatttttatgccacgtgatccaccaatttaaatagaaattgacagtgacattatatagtgccacataacgacctaagagcatttgtaggagcaccgcatagcaacttagaatttttttaggtagtttagtagactattagtatataatattattttcttgctgcggacagtactaccgaaactttatttccttttcaatcctactgttttttttaacagttactatgtatacatatgatctaatggtctaaacaggtgcaccaatttaaacaaaaatcgagagtgagactatacagtaccacgtggtggcctaggagcatttgtaagagctccatatggcgacttagaagtgtttgtaggatcacaatttttttttaga

SEQ ID NO: 36544 - DNA, 1501 bp, Oryza sativa
taacatcataagaattacacttttgacactatgagaaatatttttataattaacaattcatatgtggttaaactgaacataattctaaaaactaatgttaaacatagggatgtttcacttaggacaaagcctataactttaagtaatttgaaattgggaaagtagttattagtagtatcaatagtaaaccaacatgcatattagcgatcaccagacccgttccttttacacccgcaacagtagaggcgtgagaagatataaaacacatgtgtccttccttttacaaaaacatagacaatgtacttcctccgtcccaatatataacaacttaggatgggattagaccaatcctagaactacggatctcactactacaaaagtgatttttctgtacgagagcccatgaattttgcaaacggaccattactagtggcgtctgcaaaaatcgagggtcattgtcccatacggctccttaagtggcccgtatggaaaaatcgattttcccctacgggcctcttaagatggccgtatgcaaaaatgagtttatttttgcatgtggctgtttgacgaccaaatttggtaaattatgaaccacgttcgacattgagatcgaggcggattcaacaaagaggttgattcgaagaacagagtatgcatcggctagaatctgcattggctgagatggatcggacagaggacagccgatacagccgatagaggtgatgcagccgatttcgatgatgacagtttcgaagatgtttctagaatcaatcaaggtgcttcatgaagattgctgtgatggagatagggctcttggataggcaattgtatctattaattaggatattttatgtaatttctttagagatatgtttgggcaaaagtctgctgcaaagacttatggtatcttaaagtttattagaggtaaatgtcgtgtccggcaaggacatatcttgtatctcgggtataaatagaacccgaacccatgtaatcaattaacaattgttcaatataatctcggcgcattgccattgtcagggttacgggttaggtataccctttacccttcgatatacgtcgcatatcggtatggcatacccacgcgcatacagataccctccgcatgcattaaggaaatccttcacggagtttacggatggaaagagtcctactcgaaccagactgggtcgtcaacgtatcgtgtgaggtttgatgtctctgagttctacttggaaaccgcctgacctgcgatataaaagggaccccccggggaggacctaaggcatcgaatctcagagccaacacaacccccacagcctacgaagtcggagcctgcaggagccaaatcgctggggatctagtcgaaccaacttgactacgatctcgccagatccatcgagttccattgttccctttgtaacctgtgttttccatcatataatcccacatcaactggattagggctattacctatcaaggggcctgaaccagtataatcttc

SEQ ID NO: 36545 - DNA, 1501 bp, Oryza sativa
gtcgtctaccggcatgctcatcttatccgttgttcgacgggttcaatggtagtatacctgaagagtttgggggtatggtatggataagatgagcacgcttgatttgccgaacaatgagctttctggtcaggtgcctgcacaattgcaggatctgaaactgctggggtgttcttaatcttccaatcctggcctgtgcccgattccgatgtgggctatgttcagggaatggtgatcccgattccaaccggcgtgcccgaatacagatggctgtgcccatcctcactgctgctgctggcattctactcatgagtgttgcacggctagggtgcgtgcacggtagtcaagggcgagaatcggatttctgaaatcatgccatatttgcggccgaagatctaaaccggtgtgaccatgatttaggtttttttttttgcctgccattctttatagttcttgtatttgggatctaatttgaggagattttgaaaattagggtttctacaaattagggatttttctaggacaggtgtaacacaaactgattatgtgaaatcccgaccggatctaatttgatgtgggctcggaatgatgcgagaatgacggactgaaaaaaaattgatctatctttgaatttgtgctttatccgtcttatgcgatgcgttactcgcgcgtgtggaaacggaggccatcgctccatcagacttatggaaaaaaaatgatgtgacgaatggaacattatcaatttttaagttgttaagatattgtttaccgttcaaaactctttgaacatttttttctattacacggatgatgcacacatgcacacctatgaatgttgcgctctaacactcacaggaaggggccagtggcaaatcattcggagccatcgcgaaacggcgtatttgcaaacgaaaagtaaattatgaataaaacttttatatacgtgttcttagcgatctaaaagcaacgactgaaaaataaactttgatggttgaaaatttaaatcttggatgataagtataagcataagaaaaagatgaagccctttgacggcttgatgtcattggatttttattcctttattgcttctctgagccttttgaaaattacaatttgaagggattattttagtactgtcgactctcctctaaagtctaaacatatagaggtaaagataccttgttcaaggaaagcctgtcctaaactatgatgtggtcgatcgatagcacagccctagtgattcttgggttggatgttaagtaccttcgtgcttcacttttctgttaatgtacttcccaaacacaaattaattagaacaagtttgcattccaatccttcaagaccaaatttccttttaacaaaaaaaagaaaaatgtcgtgacatcctcacgccatcaaggctctcgtcaaagacctcaatggtcacgagagtatcccctgcctttcgaatctatcgctgccttttggtgagaatcttgcaggaggcttggaaagaatcccaact

SEQ ID NO: 36546 - DNA, 667 bp, Oryza sativa
attcctgcagccccatctgccacgatttctctataattttttttcatcggccttaattgcttttataattctctaacctattagctttatagtatatcatatttgtgttatgccacgatttcttcataattttttttatcggcattaattgcttttataattctccaaacccattagctttatattatatcatatttaaataatatttataagtaattatttgtaatattcttcatcatttgaaaagatggtagacttattttcttcagaaaacatgtcaacaaaagtaaaactaaggtgttttgtccagattcgtagctagagtttgtctttttctgggacagagtagtacatacatgtgaataacaaaattgaaaaaccaaaagtgaattaggccatgtttagattctatgccaaaactttacaccatgttcacatcagatgtttgaacacctgaatgaaataataaatatcggccaaaacaataactaattgcacatattgcgattaatttgcgagacgaatcttttaagcctaattgctctatgatttgacaatgtggtgctacagtaaacatttgctaatgacggaataattagacttataaattcgttagtattcgtctcgcggtttactaacgaattttgtaattagtttttttattagt

SEQ ID NO: 36547 - DNA, 954 bp, Oryza sativa
ctccgagaacgattctccgacgacaatgctgggggctagggagagtgtataactcaacaaactgactgatcgaagtcggtaaaagagtagacgctcatatacaaaacattggtctgtaagtttaattcattttcggttttccatacatattataacatgttaccctttgagcgttcgctcgggggctatttctatctaatattcttttctgagtattgatttcaggaaaattctatttgacattatcgaagattccatgtctctatggttctacaccaagatcaactaaggcgagtatgataaatgttgacaaggctccgtcgcagactctacgcctactcgattactcgagaacggttggtggatctcgacaaggaatacggaatgaagagatggtgtaccgccgagataaaatttcttgacttcaatccaaattctcgattacagcaagacgggagacttagtcgtatgctttgtactttcttggttgacatcggagattgactcagacaaaccctttaggtgtccgcacgaggctgataaaggaagtctaacgttatctctgaactcaccgagaacggttacgtgcgctcgataacagttcctccaaggtctgcggttgagaatatgaacttgttcatttgcattgaagtcgggggctactgtcagggttatggataccacatacctaatagtagttgactaaatctcggcaggacccactacataccatgtcctatacggaagcaacatttggatataggaggagttccggataaggaaagacaaccacagttctacatggaaacgataatgactactcggattgtatctatattagtttccctagttctacttggacaaggggacacctatgggtataaatacaagcccccctaggaggagaggggggaggatgaacacccaacataatcgacatagaagccacaacat

SEQ ID NO: 36548 - DNA, 1008 bp, Oryza sativa
ctatagtgctataaaaaattctccaaatattgggccgtatagcctggccgagatattcgcaaacagtccagctaatgttctgtggtaatggcccggtggaccgatttatgcaatggagtcaagcaaataatctggccgttcattttctatcgggagtgactattcatttgtcgtcgggtgatttctagtaaaaaatcacccagattttttttacccttagatttacatccaacagactacaaaagaaaataaaaattatatatttacttacacaacatttttatcaaaattacagtacacttacatgtcatatcaactaaatttacaaatgtaattttagttatataggactgtaattttatattttaaagaaaaataaaaattacatatttacttacataacatttttatcaaaattaaagtgcacttatatgtcatatcaacagaatttacaaatgtaattttagttatataggactgtaattttgtattttattttttactttagtttcaaatgagagtgaggagagagaacaacgcacgtgccgattttttagagcaaataaaaaagagcgactttaaccgtccgacgacgctgttacacgcggcccaactgaatcctatgcgggtttcccagcccaatatatacgcacgaatcttggtacacatcgaatggccgaaaaaacgtcaaatctgagagaaaaaatcacacgacaaatctatagcaaaatcgttttctatcagacacggctgataatcatccaaatgaactgcacttttattctgcctttatgcccatgaatgcaggacaaccaacgtaaccaaacacccataaagtaatgtaaatgtgctccaagaaatttaaatggaactgcttaagttggttttaccgtcaaaacaacaatcacttccattgtgtttgtgctttgataaatgctgaggttcagataagacaagatcatgtgatagctgtgtttctgcaaaccatcatatcatgtctttttcaga

SEQ ID NO: 36549 - DNA, 197 bp, Oryza sativa
cctgcggcccgcagagttcggcaccgatcagacaggaaaagggattagtttggctaatcagcaggaatccgtaactggatcaagcgattaatcaaaaagattagtccttgattaccattctgccagttctttgcagctggaagtgataagcagttcttctgccatggttggctgtgtcctccgtcgtggggtttagc

SEQ ID NO: 36550 - DNA, 1501 bp, Oryza sativa
aatcattttaattgtttatagctttttcaatagtgaaaattatataaaggatataaagttatgtcgtgtagctatcttgcaggttagttttacatttggatgattaatctatgttatattttttccctaatctcattgagctaatacattactttggttttgctttttattgatcaatcataattgtttatagcttttttttcaataactgatcaaagatgaaaatcatataaagttatatcgcatagctacatttaagttatttctactattatgataaaaaaattcccgcaaaaatttctagttagaaactcctatttcgtaaaaaaagtgtaactctagactactatgggttcatttggttccactagaaaggctaaatatttggaaccagtaaaaagacatgcttttaggagcaagctagccttacagggtgagaaaaatcccgctggccagggagagccgatttagctcgccttccatggcaaaactccaattgcaaaaacaaaagagaggaaaagctctactcgcacgaaaaaattaggataagataagaacgacccaggcttctctgaaatcagaaatcagagatatttctcgacaactcggcccaatctcataggcctcttctcccacctctcgctgacgaagtctttccctgaaagcatcctctccacctactcataaaagtcacagccatctggagaaaaatcgattagggaagaggcgaactcatccgcaaactcgatctgaggcaaatctattcacacggccgctcctggatcttgtttctctttttagaaacaaaacgagaagcaaaataatcatcggcagagcaagaatttcgtacacgatccaaacagctacccactatttcttgcctcaggaagcaaactaaacacaggaggtacgacaaggcaagcaaactgacaatgagatggtttaacctcaccgagctaggttacttgcgccaagatccaaatataatgtaccctatctctccctttcaccaccccttgttcaatttttttccatctgaccactaactaggggtatgcattagatggtttgttttattttaaacaaaattggtcatctaaaagactaaaagtgtctaagaccgagtaattgttcggtcttttatcaaaacagaaatggttgacagtttcataagagcaagtttaatagtatagcccactattagctccaaatcatctatagccaatgcaatagccaattcatacaataattgtttactatactattaatacatggtcccacatgtcatatacacattgcgtcttggagtccgtgctgcagctggctacagatctgtagcccgctacttttctctctcatcgtttatcgtattaaaatatgtttatagctggctaatagcctgctattgtacctgctctaatgctctaagattataattaaattttggcaacacttctcttcttttaagatttctttactgctctcttgaaatgatcatata

SEQ ID NO: 36551 - DNA, 493 bp, Oryza sativa
taccatttctcttggttcatttgtgatgctaacggatactaagttgtgatcaacttgtgatgtaattcaaattattgttgataaccgataatttggtaagttattgattttatttctctttgttaaattacatatctttcaagttattattcatgtgagatccatagggtacccactggatatactcgcgcccgccgggcatgggtacgggcatggagttttgcccgctaactctagtaggcagtgttcgggtgggcaatgtcgggcatggttttgctctacccgtgtctgacccgacccattgccatccctacacttgacactacaaaattaacctatcagtcacatggaggcaaagcctgaagctaataaacattcagacttcgtgggctattaatatttctggggtcctcttcagagtaagttcagagcgagcaacaagaaggaaggcgatcagctcgttcttcttctccctctcctccagcgacggcca

SEQ ID NO: 36552 - DNA, 461 bp, Oryza sativa
taatatgtaaaaactagtactaagagtattattgatctgtatcacaaaatagtcgtatgaatgaaaaagttacaggctcaatcacacacaaactataaaattactcacaggtgaatcaaactagaaaagaaaataaatgattcagccgaaaatccattatggaatcatggaaggatgtagcggtgtggtatagagatgagctcgacgttgcgcaatagcagctatccatcatctagcaagcacaaaaaaaatgcaaaaacattctcgttcatgtaatacagatgatgagcaaaagaaaaatagcaaacaatctccatcaccagtggactccaccctatcctctgcggccagccacatggagcacgatgtgcaaatgtagaacctgtgcagcccatcaattgagatcaggtaatattggagattgcatgttaatttgatttgcaaaaaaaattagggcttca

SEQ ID NO: 36553 - DNA, 197 bp, Oryza sativa
tcccaccccacgtctcgcatcgtgcacccaccattatcagagtaaataatttacttcgataaaaacaacttctctactggcggtatatattctatttttctcgtacccaaccaactactctcgcccccactctgttttttcctttttttttcggatctgaatcgatccaccatcccagcccacagatcagcgacaca

SEQ ID NO: 36554 - DNA, 1501 bp, Oryza sativa
gattcgtattcgctccgtatctgtattcgataatattcgattccgttttcgtatccgggtttctgattccgatttcgattccgagaaaaaatataaaaacgaatatgatagaggtagtttccgactgtattctatccgttttcatccctacttgccagcgccgcgcgcctcgttttcctgcgcttcgtcttcttcttcctcgcctccctgcagttactgctctctgctcgcctgcacgcgcctagaggctgccatgcacgccgcaactcgcaagcaagggaccgtccgtccaggcgacgcgttcagctcagctatatatgcatcacagcatcagcgttttcgcgttgccttcctgctggccaggtgattgtttgttgcttgcagctggctctgtctggtgccgtttctttttgtcctgcaccgctgctctgctcgactcccctccttttctctatctctgcctcggccatttctgccactgaattgagaagtgatgcagggaaggatggatggctaggtactccaagcagcgtgatgacgactgatgaggaattgaggaggaagacgacgacgtacgacgcctcaagctgttacatttttggatggttcgagctgcagcagcgaagcgccccggccgcgcggcgtgtgagcgtggcgcgtggtggtggtggtggtgcgagcagtgcagtgcagggcaagggcgcgcgcggttgggtccgggttttccgcgcggcaactggctgtggctgtgcctgcagcctggcaggctacaggagtggctgctcctggccggtgggctggaaaagcgccgtgttggtgtgcgggaagcttgcattgtgacagatggaccgcatgccacacgcgcacggcgcactgcactgctactccctgcatgctccatatatacatggcggttccatacctgtttggcttcctcgttcgtatcgtatgctctttcatgacccaaagaagacaatagcgtatgataaatggaatataaactactgtctacgttttaaaatgtttgacaccgttaactttttagtacatgtttaaccgttcgtcttattaaaaatatttatgaaatatgtaaaactatatgtgtatatgaaagtatatttaacaatgaattaaatgatatgaaaagaacaaaaaattgacgaatggtcaaacacgtactaaaaagtcaacggtgtcacatattttgaaacggagggagtattacaaacttaaaaaatgtttttttaatttattttaaaataagtctttataaaaagtttttgaaaaaaaaatcagcagtttaagattcatgcttaagaaaaacgagatagtaactacgaataaagttagtgtagcttaactacactctggtggtgaaacatattcgtatgagttcaaattctaaacttgacacggctgttcgtatttacgggtaattattctttcagtgatagacgacgcatctgtgtcaaaaataagacttctgtggtgactttatgat

SEQ ID NO: 36555 - DNA, 458 bp, Oryza sativa
ttgaaaccacttattaatcattacaaacagaaccaaagtgtttcgaaaagattttgaaattcatttgtcaactcctcctatagactagtacgaatttgtgatatttcgggttaaaaatgacctatagcatatatgttttgggaacggattgttaaaaattaaaatttgatagaaatgatgcttggcatgttgacacaccggagaatccttcttgtgtagtggaaaggattatgttccaattggaagaatgggcgaacttgaatgaaaagaaggcatctaaggtccagcaaccgacacaacaatggtagaaacctccaatggggtggttgaaagtaaagaccgatgtagctttcaggacgaaaatttttagggtgctactggagctgttgtaagggatgacataggtgagtttttagtaccaacttctcacttatgtccttcagtttgtaatgccacaa

SEQ ID NO: 36556 - DNA, 532 bp, Oryza sativa
taatacacctgttccttgttttatgttgttgctgcccctgtggagtatctttgcccctgcttctgctacccaatgtgttccttgttaaatggccagtgatgaattgctcaataagaacagattatctacacttgttcatttttttatctattcttctttttgcccctgttgtggctcaataagtaatgaattgctcaataagaacagtttatctgtacccttattgtgggctgttttttaaatttgcatgattgactcagtggttatatacctctactcttgttctttatggataagaatagagtatctacacttgttctttttttatgcataagaacagattttctgcacttgctcttttgatgttatgatttcctctttttatcccttcatgcaaatgaatataattgatgcatatttctgagcaaaactgaggccatatctttcatagtataccccgtattacattggctctaatgctatttagtctaatggtaggaaatttataatctttttcgcgaaagttaaacca

SEQ ID NO: 36557 - DNA, 1501 bp, Oryza sativa
cccccgtcacaaatccctaatcccctagtcgccagttcccgtcgtcgagctgcagacgtcgccgtggctgccacgattgttgtcgtcaccacccgccgaagcccacgctcgagccgaatcgcagtcaccgggtggccctgacccgtcgcttgccgaatctaggagagaggagggggttggaggagcccggttgttgtcgtcgtggcagccgcatccagatccacctccttgaccgctgtggaggactgctcacgcccccgccacctgagcaccgtccgccgccggattagcccccacgatacctcccaccacgacgaggggaggggagtggggcagtcgccgccgtccgcgagctgcatgcacaagtaaacctttcatggatccacgcacgtcttgaaaccacaacactgtctatacacgtaaacctttggtgcgtaagcatggtgtgataggatgtcaaaatcgcttcctcttattttcatcgattaatttgagtaccagtataccaccaatcgagccatcagctccaagggcgacgacgtctttacaccatgttgctaacaatctagtatactatatgattccccgtattttgctgcggaaattacaaagcaagttttaaatatattttttcaacaatcaatctaggagtaaaaagaaaaaataaaacgtcagggtttataagtacttattgttaaacaaacaaatgatatctacactttaatgttgaacatgttgataagtaaatattaaatactataaaaaataatatgtatatttgttaagggcccctttgaatcacaagaatgaaaaaacggaggaataggaaaaacataggattctgacaggaatgtaagtgtaaaacagaggattgcaaaacacaggaaaaacataggaatgaccgtttgattggaccacaggaaaaacacaggaatttgaggagagataaagactcaaaggatttcttccatgaggttctacctcttgttaaaattcctccaaaacttgtatgggaagaggcattccataggaatttcatatgattccatagggttcattcctttgattcaaagggctttgtaggaaaaattcctataggaatgaaatcctctaaaattcttatgaattttctttgaatcaaagggggcctaaaatattatggaatgatatgataggtgatgattggatatgcttgcatgttgatttgtagaattaaatagattgtagatgatgttgcgtgcttgcatgaggttaaatatgtattattgctagcaggtgatcttatcaaaaagaaaaacaaatgatacctgcactttaatgtggaacatgttgataagtatatgttaaatctctactattactttgttggtattttggtacgtcatccgtatttgagtcagtttttaaattcgttcgtttttaaaaatacagatctgtgtatgagtaggattttaaattcgtgtagttttcgaaatacaaaataagtcgtataagaaatttc

SEQ ID NO: 36558 - DNA, 1501 bp, Oryza sativa
atgtatgcccctcctatacttgtaaaagctgctcaatgccctttagagaaagcaagaataaatggatgtaatgaaaataattcttcacataaaaaatagttgttttcatgttttgtgtagtcataatttgtttatggtattaatcagtactgcccaaatttttatggtatagatacaatattctcttttgaaatgagtgaggttgatcattaaaaaatgtatcgctaaatagatatatgaccgtaatcatcttcaatgtatcatatcatcatatcattgtttatattttgactaagatttatattttagcttctagtttgtttttgtcacttattgttcgtaattgcatcatacacctttactatttttaaaatttatttatttatcaaaattatttacaataactaatttgttggagggcacttgcagtcacgtcggtggagtgtatatagcatacatctatcaattatcacttatgcccgatatattagagttactcgactataaaaaaaatatattatcatgagtagtttaatgcacatgttatatgatttttcgttttttaccaaaccaatatggaaaaaggtatggattaaggggtcgtattatagcaaaattattgcctagaaataccaatgaaatagttttgaaaaatctgaaacaaaacatttgagaatcttagtctccataaattaaaattaaatcatatataattgacaaaacataatgttgtttcgctttcacacatgtagatttcagttagtgtactatatatttgccaagtgatatttgacaccacaaaatatgatgtgaaattattcaaagattatgatgaaattaattattatatgtcacctaaattatttgaaaattattataatattaattattatatattatctccatgtgttgtaatgtatttagcatcataatataactatgataagtcatcaacatttgaatacaatggattataatttcatcttataaatttaaaaataattaaaaaatgggtgtttaaatatatttatttgatatttatattgatctagtttaacttgcatatttctagagtaataaatttggttttacagtgtagaaaatcctatcttgagaactgtctatattttttttgatggttgtacgaacatatatatatgcattttaatggtatgtacgtatgttactttagttttttttttcaaacatccggtaaacagcttcactcggataaaaaggagattaaaaggaagcgaggtaatgtaatgtaaaggtataaaatgcggggtacattaatttaaatggaaatcgatggtgaaattaaatagtgtcacatggcggtttaagagcgctagtagaagcagcaaatgaccatgtttgtaagagtaataaattttatttttatagtatataagatcctattttaaaaggcctcaatggttatataacgttgtatatatatattttcctttagagctttaatcgtgtgtagatgataaat

SEQ ID NO: 36559 - DNA, 402 bp, Oryza sativa
cctcccagcaccgtcgccatagccatccctgccccctaaacagttgtcgtcgtcgccgccttccgcctccttacgccgactcccgccgccccgcgccctccgcctccctcctcccagcgccaccgtcatcgccgtcgccgccttccgcctccccacgctgactcccactgccccgcgcatgccgcctccctgcgccgcctccctcctcccagcgccgccgtcatcgccgtcgccgccttctgcctccccacgccgactcccgccgccccgcgcctgccgcctccccgcgccgcctccctcctcccagcgccgccgccatcgccatccctgctccccaaaccgttgtcaccgtcgccgccttccgcctccccgtgccgcctcccgccgccccacgcctgcagc

SEQ ID NO: 36560 - DNA, 343 bp, Oryza sativa
agtttcggtgtgagtttggagtgtgtttgcccgagaggcttttgtattaggattagtttggagtgtgtttgtccgagagattttaagtttgtgttaatgttcctctgaaggaatatgtttgctcttagttgagcggttattttgcatcacctttgaatgaaatgatttgaaggatttcgtttttgccttgttcatttaaattccgcaatttaaattctacttgcaatttaaactttgcgatgatgagttttgttatctcctcctcacctctcttctagtttgggaaattccttttctctttctcttctagtttcgggaatttctttctctcttcttttctaga

SEQ ID NO: 36561 - DNA, 1435 bp, Oryza sativa
ataattcaaatgcaagtaaaatatacaatatacaacatatctgatgcatatatgataccaaagttcaaacaaatactataaatcacttaatcacataaatattcactccatcgacaaagtaaacaatctatctatttttattttacttgcatgatcctgtataaaatattgggatagtgaacattacgatgccagcaaaagttgaaaaccacaaagcatactgaaagctctaatatatcagacacactgaacaaacagtccgtaccattatacaactgaagcacgtattacacatttgtcgcattcagcatatactggattaatgtgacatctagctcaactgcttactactgtaatatcaaacctttcaccactgagaaactctatggacctaacaaatagcataaccgtatccatcaaaagtgtaaccatagctaaatagacaaggagactatcactcaggaaaaatagaaaacagaagctcgtaagtgcgacataactatgagtaaagaagtaaccatgcataagcaaataaaactgggattttgctggccaacatcaaaagtgcacacttggcatagtaaacaatgccataaataaactcagcctagcagattgatgacatcatggaataaatgaatacaaaaggaaggatagcaaataaggaacacgatagcaattggcaaaaacaatttcagatggcaaaccattgcagtagtaactgggaaatggttgtattagcacgatgaaacgcaatgtaccagtacaactactacaagattcatttacacaatgatagatcactctctaaatactggactggctaattcagcatactatgaaatataggagacacaagtcttttgcagagttctacattcgatgaacagtcataagtttcataacaatcacaacaataattaatgatagtaaaatctaaccaatagatggtaaccaatgcaatcgcaacatgtttaacacatcctagcagcatgaagtacaacagtattaactgaaaaaactacacgaggcacaacaatccaagttggatgaactgcaacagcctgagcctgagtatatgaatcatccacccaacatcacatgaccgagctgacacacagataatagacgcaaaatacacacacaagcatttgtgttcccccaaactcccattactagcaaattaaaaatcagtactatcaaatgactttccaagccttagaatcgttcgatccgacgagatttgaccatgagaattcctaaaagcaagggcggatccaacttgggacatgggggaacgaacaaacaaactgctatacaggttaaggctctgaaattaagagaagagcttcttccagatctagggttaacgaacgcaagcaaattccagacaaaagttaagtcccggtgggagggggagagatggatcaggagg

SEQ ID NO: 36562 - DNA, 203 bp, Oryza sativa
ttgttgcccatgatagatttttatcctcttaatatttatctagtattatatgggttgcggtatattgaaatgtaaacataaaagagagggtagaggataggctcattacataaaaaaaatggaagtagccatagcaaaaaaagaaaaagaaaaaaagggagcgtgagagccaaatgaattgaaagattcatgtttggttcagg

SEQ ID NO: 36563 - DNA, 391 bp, Oryza sativa
ctcctaaaaattcgagctattttccaaagaacccatattcctgtaatgtctgtgagtaatcaatccatatttttgagtgcaaccaaagaaaatggaatctaggtatcttcatctaccttcagaaaaatccacactaaattattctacccacaaattaaatacttgatatactaaagtgggagagagaaataatccttaaaatcattcaaaccttttgttcacccacgtttctgcccaaccctctcaccctagcttagtttgccacgacctggacccacttggcagccactctggctcgtcctcaccctgtgcaaatcttccagccggaccaaagacagccgagagagagagattggcgccggctgtgtacgacgcgtggcctcgacgtggc

SEQ ID NO: 36564 - DNA, 276 bp, Oryza sativa
acatatcttggatttactgttcatatttagcggtaatcaattcatgttctgcacagtcttttacacttttcctcatatttttttccattatatacaatcaatttaattttacagtgaaactgaatatgtgaacagtttttcagctttattccagtgtttatgaattaatatttttcatcatcttctaatatttgataggcacagctggttctgtcatttggctgttcagaagcctggaggctgggccatttgatatcctgaagttttgagtaagaa

SEQ ID NO: 36565 - DNA, 1501 bp, Oryza sativa
tggaatggcaaggatattctgctcgaatgtgacagaagccaacacgaccagggttgtgggcacacagtaagtactaatcaccgatgatggtcaagttacacagcacatgtgtttttgttgtgtcagaaaagaattagtgatagctacagtcggatgcattgatgatgttgtaatgactgaattttgtgcttttttattcagtggttacatcgctcctgagtatgcttctgagggtctcttctcgatcaaatccgacgtgttcagcttcggtgtcctgcttctcgagatcataagcggcaagaggaccgccggattctaccagtacggcaaattcttcaatctcacaggatatgtaagcacaaatctctgacatccaaaattcacaaatttcagttaccctgaaagactgaaattcacctgaaaatgcacggccgctaataactgaaaacttctgaacttctttcaggcgtaccagctatggcaagaagggcaatggcacgagctggtggaccaggcgctgggggaggacttcccggcgatggaggtgatgaagtgcgtgcaggtggcgctgctgtgcgtccaggacagcgccgacgaccggccgaacatgtccgacgtgatcgccatgctcggcagcgagggggtgacgatgccggagccgaggcagccggcgtacttcaacgtcaggatctccagcctggccgtgtcgtccagctccttcggcgagtcgtactgcatgagcaacgtcacgttgatggaggaggacggcagatagcattttgcagtgcaggcacgtttataatcatgtagattcagattgtagtaagcgattaatcacgattggtgaagttctagcttggcaattgtgtatatgatttgttatgatcagacggaaaccaaaaggaacagaacatgatgacatagtcgatggcaattcaaccaacatgttattcttcttttctttgttggcttcgttagtttggagttttctttttaattttttgctatttcacttgtggcagatttttgaagtgaagttgcagtgcactcagttacttattacacttacactcagttgcagtgcacttgcactaacaaaattagattttacaactgattttgtatcttagatttacaattttttgacatgtttgtctcttttattattattattttatttaaaaaaggggctatatccattggttcaaaattttgcaagattcaaaagttaaaacttcgaatctattgaaaagatcaataggtagtcccattttctttcccttgattcttgctgtaacttcacctcaactagctggtggcctgcgcaattgcgcggctagaatccatataaaattatctatttttaatatgattttacttaaaatttatttaatagttatcttgttattttaagacttttaaaaaccaaaccatatcatccccgtgtttaattttatagtttttaaaagtcaccctattcttaatttgcttgcttgatcta

SEQ ID NO: 36566 - DNA, 1501 bp, Oryza sativa
caaattactccatccgtttctaaatatttgacgccgttaatttttttaaatatgtttgaacattcgccttattcaaaaaatttaagtaattattaatttttttctatcatttgattcattgttaaatatacttatatatatacatatagttttacatatttcacaaataatttgaataagacgaacggttaaacatgtgtaaaaaatcaacggtatcaactatgtagaaacagagagagtaataaacacggtgaagattgaaccggatctgtgatctgcccgcagattgcacaatcctgcccgatcttctcgacatactgcgtacgtgtcgacacgccacacctccggcgactaacccccatgtctgccaccacatctccctcgtagcctcaccaaatcacttcattcaccaatgttgcttgcaatctctaccctactctctaaactctctttattagtggctaagcaaaagattttctttgtctgctggagcaacaaacccgtccataaatcagggttagcagcatgttagcatgtttggagtggccaattttgtaatccctttctggtctaatcacatcagcctatgttgatgcttgatagtactaatttcgctttagaaaagggagttgagagattgctgagaatcgttgagctgtgcattggcagatctctcgtgagagaaaaatgagagaatcttgcttcttgctgggacaggaggcaggcagccacagagcagggttagctggaccgcgcaagtgttggtgtgtgatttgagattttctgactgatgaagaagatgtattagatactatagtagatgttctccttccagacgaatcgcgcacagaaaaaaatatctgatgtgttaaatttcgtttggaatgttctgaatcttgtcactgacataaacatgagaaattacagtagtataattgaaaattgaggataatgttcccttggtgcttctctgatgaaccctggaattttattttgtcctttgtatccccaatcaattcagagatgttattttaattgaatttgagtccgggacggcagaggaaaatatcgtgcaatcatatcatcaagattgcatgattgcaagatgcagagtaattaattaggatggcaagttttggcaactataggatggcaagttttcgcaggattacttatatagttaccaaaatttgacagcaaactaaatatagccattttttttggcaactttaccaaaatttggtaaggttgaaaatagcaccaaagggaacaggccccaagtggtacagtctgaaccacagcagaaacagtaattcaataagtaaaaaggtgatttgcctaacaaaaatcccatggtttaaacttccttctcaaataatcttgcttaatattcatttcatttcagttggtatccagatgaaattctggttacaccaactagcagttgcacaaccccatcacctgatctatgtgctccactgaacttggttaattcagggag

SEQ ID NO: 36567 - DNA, 369 bp, Oryza sativa
ggatttagctagaaggatccaacaaccaattgctttcttaatagaatgagaagaatttgttgatgttgccctctaattagtgaagtacatggggacgatctctaaatttatgtggtgtgtgccatttagatttttaactcctaaaatacttttatggctctttaaacttgtcttgggtgtcatataggtctaaacaggttctaacccgctccatctgctaacatggcaataccacgatgatgtctacatatcagtgggacccacatgttagtcatataaaatacaattaaaaaccatatatttttctcctcttaggtagagagaaaaaagataaaattaaaaaataatctaaggtagagtggagaaaat

SEQ ID NO: 36568 - DNA, 1034 bp, Oryza sativa
tacattatagctaagatgagtgagatccatagtaattctttaagacaagtgaaactatattatttataactaatttgtgtaagaaatattagttctccctttatttgttgaggcaagtgatgatcaaacaatcgatacttagggcccctttgaatcacaggaatgaaaaaacggaggaataggaatgacataggaatgaccgtttgattggactaaaggaaaaacacaggaatttgaagagagataaagactcaaaggatttcttccatgaggttctacctcttattaaaattccttcaaaacttatatggaaagatacattctataggaatttcatagaattccataggattcattcctttgattcaaagagcttcgtgggaaaaattcctataggaatgaaatcctctaaaattcctatgaatttcctttgaatcaaaaggaggccttaacaaccgtaataccttttctatcagttgatcacatttgctgagaataataattcaaacaaagcaactcctttgtcaacaggtctagggatcacaatcaacataccggacggtacaggtcttgggatgccaagcggtatttactgtactggccagaataattttaaattcaaatatgaaatttaactttaaatttgagtatacgaatttatattctcttgcgacttctttttttttagaaattcaggggtgagtgtgtgtctgcgtttgttcttgcaacttgtgtaggtatatttgtatagataaatgagaactcggagaggcacattcaatggggaaaaaacagaaatatagaaaactatatatggcccacagaatatcacacggcaaaaatccccaaaaaaaaaaactaaaacaaaagtttggcccagaaccaacagacaattggaatagcctatccgccttttcctggccataatgcacgaagatatattcattagtttcaccagtaatagaaggaactggaggtacaaaatgagtatagttacatagtatagttacacaaaattacttctatacagatgc

SEQ ID NO: 36569 - DNA, 855 bp, Oryza sativa
ttaaatgcacttttagacaaagtatggttttagccggttaagaactacagttaatctagtttttattagtttgactgttctttgaggtaccaaatttagttattaaattataccaaaattacagtgagttgtatgtgttgattagagcctacatgaattttcccatgattttatcttgcatgaattattttagataattcgcaggacttatgtcttatatgtgtttctctttcctaaatgcatgtaaatgtttataaaagttatatttggactctcattaacatgaggtgatgttgatatgttagaattacagtttaccttacacatgtcataagctccttccctatttatgcctaagtttactttagtattaaattaagagaatgcttatagagatgattaagatagaatataccctatatgatataatttatttgttcactttcatgttcatgacatgtcttcagatggatgtccaaattagttttgtgaggcttgacattatccatgttgatttttttttaaggtgtatggtttctgtgtattattttccattagttagcactaggccctaatggtttagttgtttgtctagattgcaattatattcatgagacctattatgaaatgcaaatcgaaaatccaaatgcatatgaaggactcaagtcaaaatatgatttatgcaagtatgcatgctttcacttgggttgcatccaagtcctaggttaaagatgaaaaagtttttaatttgttctcaaattttattcttgcaagagttggatcaactccaactaggtttaaaatagaaatttttggtttacaaaattgaagaacttccctttcaactagttttga

SEQ ID NO: 36570 - DNA, 1293 bp, Oryza sativa
atatttaataaatgcataaagtttttttttaaaaaaaaaacaggccttagaagctcgaggaagatgaagaggagtgatggcagaagggaacctgcatgtttaaaggcccatttagaggccaatctaatcatttggcccactaactcatttggtgggctgctgcgtacaggacacgggagtggggacggctggctgcgggtgtgagcgtgcgattgcggcgggcgacgggcggtacggcggcgacggagagtgcgcgagctgcgatcccgcgactggcgaggggccggccgccgatctgcttcgctagccggcgaggagcccagagccgcgggaggccgatctgcttggctagttcgcttcccgcctcctgctcgcctgctggctacgccctacagtgagggtggctcggcggcggagggctgccgcgtagtggctgaatgtggcgcacggcggttgaggtcaagcacagcggctaacaacgacgcaggacggctgacagggggcgctagtggcaaggtactctttttcccaaaccctaaaattttccccaccttttgcctttaaatctgctctactctctattcgaatgattgaatatattggttgatttgttgctactgtgcgtagaacaaatagaaaatatttagatctgaaaacttctcctatgtgtgtgtatgtggaatttcatatagaactatagagtagtgatgaggagagaatttgttcagaaatattttcagtggattgcacaaagttcagaaaattgatttaatgaatgtagcatgttgttatagaataaagtacagtaaagaactaattggtactagccatatggtaaatgagtgtctgtgtttaaagtagctaccagcaaagaaaacttgcaaccttttcagttcagaaaaccgaaggataaaattgtccatctttgcttccttcactcttcaaagatttctagagctgatcaaactagccaaacactttcagcccacctctagatcctataggagcaagctcccattggagttggagttaggagctaagatctaggagttggagccctaccaaacaggccctgattatgtcatgctattctttggtttatttctagacttcattctctaaatctatttgcagatccaacatactaacgaatatcaatagaccaattatgctcctgaaaatagagatgaagtgaggagggcatatttgttgaatgttccaaatagagtaccagttagccactgaatcattttctgcttatggcaatgaaaatttagttaagcttgctcgatt

SEQ ID NO: 36571 - DNA, 170 bp, Oryza sativa
atatttaataaatgcataaagtttttttttaaaaaaaaaacaggccttagaagctcgaggaagatgaagaggagtgatggcagaagggaacctgcatgtttaaaggcccatttagaggccaatctaatcatttggcccactaactcatttggtgggctgctgcgtacagg

SEQ ID NO: 36572 - DNA, 498 bp, Oryza sativa
tgagtctaattaggccataattagtcataattaagtgctacagtaacccacatgtgctaatgacgaattaattaggctcaaaagattcgtctcgcggtttccaggcgagctgtgaaatcagttttttttaatcgtgtccaaaaatccctttcgacatccggtcaaacgtccgatatgacacccaaagattttcatttcaccaactaaagatgcccttagctatgggaaacctcgggagaaggcgcgtgcacctataaggtaccactttgaacgtacgtgctctccaagaactaataatagagaaaaaaaataagaaaacgcaagagtagactaaaaaggttattgaaatataacaacagaagattaaggagtaaataattaagagcgtatctgatcgtacgcatggcaaaatggatgaaaaacaaatttaataaaaggaaaacaaaaaggaaagaagaggtagcttaattaattagctatagctgtagctcttacagg

SEQ ID NO: 36573 - DNA, 1501 bp, Oryza sativa
atgtaatacaattgtatctttagaactaaataatggtatatagaggagtatagtgacaacgtttgatgagaattctaaatattataaaaataaaatccaacgagatgataaactctaaaaacgataaggtccaatttttaaaggttcgggacttctaaagagtaaaaaaaaccaatgatattaatgtttgattttaaaatctcaatgacaataaagagaggatggagcatgcgagccatagaatagtatagtggcaaagctgttaacggtttggcgggacttctagaaagttaaaaaataaacccgaacaataattatgttcaatttttaaaatctcaatgacaataaagagaggagacagcaggcgggccgtagaagagtatagtggcagcgtttgatgagacttctaaaaattataaaaatgaaactcaatgagacaataaactctaaaaactaccatgtcctatttttaaaggttcggaacttctaaaaacaaaaaaaaacaacgataataatgttcaattttaaaatcttaatgacaataaagaggggaggcagcaggcgagacgtagaacagtatagtggcaaaaccactaacgatttggcgggacttatagaaagtaaaaaatgaacccaaatgataactatgttcgattttaaaatcccattgataataaaaagaggatgtagcggatgggccgtagaggagtagagtagcaacatttgatgagagttctaaaaattataaaaacgaaacccaatgagacaataaactctaaaaactacaagatccaaattttgaagtttctaaggagaacgagtagaaatagtggtagatcgagtaatcaaataaagaatagggtgacttaaaaattataaaattaaacacggggtgatatggtttggtttttaaaagtcttaaaataacaagatagagaatgagtagaaatagtggtagatcaagcaagcaaattaagaatagggtgacttttaaaaactataaaattaaacacggggatgatatggtttggtttttaaaagtcttaaaataacaagataactattaaataaattttaagtaaaatcatattaaaaatagataattttatatggattctagccgcgcaattgcgcaggccaccagctagttgaggtgaagttacagcaagaatcaagggaaagaaaatgggactacctattgatcttttcaatagattcgaagttttaacttttgaatcttgcaaaattttgaaccaatggatatagccccttttttaaataaaataataataataaaagagacaaacatgtcaaaaaattgtaaatctaagatacaaaatcagttgtaaaatctaattttgttagtgcaagtgcactgcaactgagtgtaagtgtaataagtaactgagtgcactgcaacttcacttcaaaaatctgccacaagtgaaatagcaaaaaattaaaaagaaaactccaaactaacgaagccaacaaagaaaag

SEQ ID NO: 36574 - DNA, 316 bp, Oryza sativa
atatttttgttttgtttttatgctataaggtctttctggttgcttttacctactatgaaatatatggcataacatccatgcaatcatacttcatgcatatcaattcttccttccttttggacactctttttctgagaaaaaaagagaacagttaacttgttaaaggcctgaatgatctggtcacaccaccgaagtggatggtgcttactttcatagtgtcatggagtcttctgggttcaatgtcagcttagtgcaaaacgttttttatggctgtcagcatgatttacttgtgatgatatacgttctcatttgcagg

SEQ ID NO: 36575 - DNA, 312 bp, Oryza sativa
cgatggtggcaatgacgacagggaaggccaagatcttgtttctctgacctgatcgagttcatctttgtgatgcatgggcagcataggcctaccagaggagccactatgagcgcggtggacaggaacagagaacccgcatccggaccgaaaatcaggcgtccgccgcagagaaatttctgaaaaagaaaaaaatggagaaagcaaagctgtctgtcatctcaaagtgtaaacaaaaaaaatattgatctgaatttcacaaggattatcgcaacaaaaattgcaggttgcaagaagattttcaaagagaagtaa

SEQ ID NO: 36576 - DNA, 296 bp, Oryza sativa
caagtcaagatgcataatggtttgttgtgtgtcctaatccagggagctacccaaaaggggcaattgcgttggatgatcttgcattagctattggcaaatccagttttcgttaatatgcatgcaggttggcaggaagtgcagacaagcaacagataagcaatctggtgaactagtctcaatccagtttaactgaaccgtttttgttcacccattaccctctactgggtattattccaatctgaatcctactaccaacaagttaaacaaaagtgttgcttgactaaaatgcattacta

SEQ ID NO: 36577 - DNA, 171 bp, Oryza sativa
cacagtaaccttggaccttctcctgaagagaacaactgcaaaaaatgaaaggatcaacaataccacaactgaataagcgacgacggcagcgattccagctgcactctttttcttccctgcaaacaccaaacatgaacttcaattggggaaaccttgatttcactgtaactt

SEQ ID NO: 36578 - DNA, 462 bp, Oryza sativa
aacaagtgatagaaagaaatgtcattattcgtgattgtactgctcatagacaacttcagtcagatttgattgagcatatttggctaaagtttgggaaacgaagttaattaggtgatcgtgcatcattttaagtctagtttacaatctgtgtattacatatactacttcatatatagcttagcagtaacagttgaactaaataactacttatttttttccgtaatgtgattttttaccttacatatactgacatctcttcttttatttccttcctgcagataaggtcatgtctaatgtgttgctgctctacctaatggttgaagtgctcctgtctgctggatagatgaaatgctcctgtctgctggatggatgacctaatgtccattggatgaatgaatttttaatgttgaatgtcatcaggctatctaagttattatacttatgtttctttattttgatgaa

SEQ ID NO: 36579 - DNA, 220 bp, Oryza sativa
ctctctcttctgttgtgccataatcccttcaggaatctgtgccttcctaaagttttgacaaactctacccaagtaaccttcgttgcatctggacgggtcaccacgtagttatcccaccagacagaagcgggaccttgcaactggtgtgtagcaaaagcaactttctcttggtcgttgcattgcagtaggttcagcttcttctcaatagcacggagccagt

SEQ ID NO: 36580 - DNA, 190 bp, Oryza sativa
ataataataataataataaacaactttattatgtacgtgtccaatccaatactatgttgttttatttgaaacgggagagtacttttacttgtatcgtcacgattaatttacttggtttgtctagtaaatcctctccataataaccagctgaaataacgatctagagtattatttggtaatggcagaaaga

SEQ ID NO: 36581 - DNA, 644 bp, Oryza sativa
caagtgcctgcacatgagacggcgcgaggggtgatttaaacagctccaggtaccgcaagaggtcctgctcttcaaccttgttctcgttgtcgacgacgccgagtcttttcatcacgacgcgttgcgcccatggcggtgtgtagggagctgggcgagagcggtgtcttggctgccgaggcctcttcccaaggatggatgtcgccggcggagtcggcctcagacatggcggcggcaactgaagcactgagtggctggccaggctgcaaagctgggccactcgagggtgaagtgcgctcctccagcccagacccagacggctgaagcgggaaaggtcgtgggccttgaagttctctccggcggcagtagactcggtttgggccgaagaagcgccaatccggcccatcttgagattcctgggggacgtcgtcgaagtaaacaagcagatagaagagaggaagcacgcacacacttgtgagttgtgagtcttccactaacgagttcaagtcaaagcggttggcgccaaaactgcatactcgatccatctgactatatatacttactacacgtaccaacaaccaactcaggatataaattaactcagcaaggaaaggaaagattaagattatattggatggaaatggcgc

SEQ ID NO: 36582 - DNA, 451 bp, Oryza sativa
cctgcagccctgagagagaaaagtggatccactctccacaaggcctaccaacgtggccaatttgtgatgactaggacatcgccacaagagaacaccgtctagataagagtttggccagaaattgacctccaacatcctctcttgagaggttgcgacgctgatggtgttgttgttgcgcaacttgggaaacaagggtgtggttttcacctaaggatttgtaacagcccaccatccagaaccgcgcagtccagctcgtctgacggatggactcacttacacataccatctcatttacaatttcatcgttgcttcgtacgtgctaaagggtaacctggtgaaagcctagtccgaccacttaactaccagaagcccccaccctgcgagcacctttggtgcacaaccatcgaccagcgccataacaccaaccagtaaacacaagcaggaggctgcg

SEQ ID NO: 36583 - DNA, 233 bp, Oryza sativa
attcctgcagccctcatcgtgcaacaaagcaacagaacctaaagtcaattcgtgatcctcttccaacttacctactactataccagcgtggctatgatctccctcatacgtacgcaatgttttagctaatacatggaaatgcatactgtcgacgtttgatgtctcgactacggtatttgcatggcatggggatcgttggtactaggatatacgcgagactaaggtaaaagaga

SEQ ID NO: 36584 - DNA, 1501 bp, Oryza sativa
ctctgccaacggcacagccggggcggccggtcctgacacagtatacggcgccgtgctctgccggggggactcctccgccgagagctgcgctacccgcctccagagagtgcttgacacggccagcatcaatggaactagtggcgatgactctggctactttcagaaccagaagaatgtcaccttgtacgaccatgatttccaggccctgctaagcttctccgacaaggatttcatctccagcttcagcaacgcgccggagtgcactgtgagcgcttacctgaaccctccgccggatgctgatcgcgcgcagttcagccagcttttctctgagctcatggagaagatcgctgcagccgtggtgagtagacggccggtcaactacttgacgggcagggggtggttcgacctcaagagccagacggtgtatgcgctggcgcagtgcacggacggcatgccgccggagaattgccggagttgcctggacggcatcatcgacgaagggaagaagatggtcggcggtggcctgacgggtggcgcggtgctcgggatgcgatgcagcctgtggtaccagacggatgtcaagttcttcgccggcgacccagaggtgtcgctgcacatgcctacacgtacgtcccaccttcacctttaataaattgtgccttgttgatttggttcaaccagtctttcgtcttcacttagtcttcagtcttcattgcctgattactactcagcagggacattctttcatcttgagatgcccttatctctgtgaaaacaaatcaaacgatgagattagttcagcattcaagcatgattttcattaccccatcaacaaaaatctgcatgcttttttgagagagatttgataatttaacataaatgggtttcgattatctgacatcttggcccactttcattcactcagatgatcctacatgtcatcctcacaagtgtcaattaaagcaactgtgtaacgaaaaaaatgtcaaattatcaaatttctccttttttttggaagggtttaagttgggatgcacaattattcccgtgtgaaaatcaaccaaaaacgatttcaaaaccaaagaaactgttcaccttcccctgtttaatatttaccttcaaagtgtcgtgtggccttcctattgtttccactagtcataactcatatcaatggatgtgcagcaagcaagttttggatctgggttgtaattggatcgttctccctcatggtatctatttcatggttgcttgttcatatttggatcaaacgagagagaaaaagaggtaaataactaaatattagtctcacaacattctcctttgcgtaaggatatatgcatctgattcaattatatagctgcccgctaagagcctatatgagtgacaagaatagactgcttcactattttctttttcagaacaagcaagatttgaactacgattgctgtcgatggcagtacagaatgtaataaatctttggaggattgaagaagggaactca

SEQ ID NO: 36585 - DNA, 314 bp, Oryza sativa
gagagaagggaaaaaaaagggaggggaggggaggggaggggagggggggagtgaatgaggaagaaggagattagttcccatataatgttttttctggaactgtccctattcacatcaattgctcaactggctaggtgagcacttatctttttaaagtagctcactcttttagaactagcaaaggtgttattaaaagtttgcatgcatgtatctcatgggttgggattttaatattctcatagaaattattctctacataggtcttggatcacataataattaattccaccagttaagcctctaatcgttttaga

SEQ ID NO: 36586 - DNA, 297 bp, Oryza sativa
gggggagatcaggaggagggcggacacctcaccctcgggcccgacgtccccgaaggtgccaggccacgtgggcgattgcgtctgcctcaagcctctggccatgatactcccggtcccatatcaccgacagtagcccccggcgttatgccagagcaatttcccttcccaagggaagcggtcaggtgtgacgccacccctaaagcctggtgacaggtgggaccggtttccgtagctgggcaaaatacccaacggtctcaatccatgcacattggtattgataactttggttgtccataa

SEQ ID NO: 36587 - DNA, 1501 bp, Oryza sativa
cttttctatttttttacttttaatagtcaaagttaaaaatatttgacttggcactatactaaaatacttatattttgggacggagagagtaagtcttttcaaggagtacaaatttttctagtttatgctttatcgtccatcaaatatttacagaagtggttaaaaaataatgtatatgtagcaatgataatcgaaattcctatctctcaacgctgataaagtgaaggatgatgtaatgtagggtgaaatttatttattttttcttttgtagaggtggggaggacaacgacgacatgggtgagctcgtgatctacctcttctcgaacgtggtatggtcgtgggaaggagaagataagacgataacgttactatttatgcacaaatcttgatgcagtttacaaaatcaagtgaaaatttgcggtatttttgggtgaaactagacagtaaaaaaaaaaaaacttatactgctacgcgctactacctacaggatgattccaagtttgtcgccccattttaatgatcaataacacacagtgagtccgctagtttcttagccttaaactaaggaaagtatcatgtatggcctgtcttttgtgcaacctatagctagctcgtgtgttccattggcaaggcgacagctccggtctcaaaagagccctccaaggacaaggagagccggccgcaatggcgatcgaatagtaccgtccattattgtagagtatacatgtactatctcctaaactactattgctacttccatagctgaagttaaagtgaagccacaattagtttttttttttcatggcaatcgtaacccacgttttcgaatcccagaactaaaaaaaaagtacaatataatctcgctgaaaaactaatcgtcgtggcctcatataaatcaggcacgattgcgtcggcgacgagtaaattaaaataaagagtgcagagacagagagagagagatgcatggctagctcgtgcttagctttttcgtcagtgttatgttgcagctagctataatatatatatatatatatatatatatatatatatatatatatatatatatatatatatatatatatatatagacatacacaagtatgtaacggctaatggcttagtgggagacacataagattagcagcgtgttgttagtggaaaagcgatcgagagctcatgcataattaattagtgacaaacgtgttaatgttcgatccaggaagcactagtttgtgggtcagtatttgtaggcttcaaagggctcaggggtacaaaagctgcaagtataataacctgtttcaggtagtttcgcccgagcactttacgtgttccaatccaggaggcggctgcacatcatcgacaaagtcgtagtagaattaacctgggaagtgttctgttgatcagcttataatatagatcacacgcatatctctactggttttaattttgtcttaatatacgcatgacaagttattgccagttctggtgctagcaaaacagc

SEQ ID NO: 36588 - DNA, 189 bp, Oryza sativa
agcaaatccttttctcgatgcttttatacccttgccgtcgctgggcctggctcctcgtttctcgcgcccactatctcgctccctcgtatctcgctatctcgctccctcgtttctcgtgcccacgtttccactaatcccattcgcccgcttacggcgcgtgaagtggatatgcggttgtggcaatcgaaa

SEQ ID NO: 36589 - DNA, 688 bp, Oryza sativa
cggtggtggttcaatgaatgattcgtttcaaaaccgtttagtttagctgatgtaaaggcggattgaatgcgtatctgatcttcggaagaaaccaaatggtgccatcagaaacaattggtccttagcgaagtgagcgtatgaagcatctaggccccctagttgattttggtaattaataacaagctaattgtggactaactattatgttgagttatacattttgagataggaccacatgatgtgtatgccgtggatgatcaccgagtattaaaatcgatggcgcaaagcaaaaggaatgaagacggtaaaactaacggttttaatttaattgatcgaattttgctatatttatgtatagctttgccataccatcaataggggtaattacctaagcaaaaagatgatcaaaatgccacattaggtcatatgcattgaaacttggtacgatttcttatactcttgcagcttgtctaccttggccgattcgaccgcagggagtgcaccggtctgaccagtgtcggtctgactgggctaggctccatctgatcagtgggttgtgagccagttggacggcccctcaactggcgatacagagccgccagagctgcggctggtttgacaggccggcctactccgatcaaaccagactacccgttaccagtgcatttaatgcattgtaatggctaga

SEQ ID NO: 36590 - DNA, 619 bp, Oryza sativa
ctatctgatagtatggtatctgtcaagagattagttacttgttgtgcttgtcagcttcatcctctaggtaaagcctgtggtgcattgcatatgtacaaaacctcagcttgaagcttcagttgggaaaacagaatggtataaaacttcagttcagctgggagtacaaacaggtagcgtataaagtagagtagtacacatatacacacacgcagatggagtggttggatggatggatggatcatgagcagtgatgagagacgtactacgcattagcacttgcagtgtcaacgtaaagttgatggcactggcgccttgcaatttccctgtcctgatggactctctgattctacgcttcaacgactttatgcttgatgtggttatccattattataactaaatgttgttgcaacgcctgtgttaatttgtttgcctgtcatacatacatacatacatacatacatacatacatacatacatacatacatacatacatacatgcatatatttttacacttacaccaccgaatactgatcgcgttgatccatttcatggatgattctgagcacacgcctttaaactgtacaactagctaattgaatcagatcgagaacaggccat

SEQ ID NO: 36591 - DNA, 415 bp, Oryza sativa
  unsure (1)..(415): unsure at all n locations
tctctttacactataaactttgtattttagagatgaaataagatagaagaaatatatatataagaactagtttgtaatgctgaagcatattgatcggataagagttgataaaagtatatagctagcatattcactggtactatcattaattgtcttcgtctacaaaagtatagatcacatttgccattataatggttatatacttggttagaactcgtacgtgttgccttttttggttgttcatattttcattttttagccgaggctccaaaacagaagcgatataaacttttgaattttgtgtcgtctttctgcgtgcaggctctgaagcatgagcaggagaagtgcacttgctgcagcaggcctnnnnnnnnnnnnnnnnnncctnnnnnnnnnnnnnnnnnnnnnnnnnnnn

SEQ ID NO: 36592 - DNA, 536 bp, Oryza sativa
ttcatatgattacaatatattagagttataactatcctcgatgaaaccacttgatcagtagtttcctctcgttattattaagtggccatgcgcaaattctattaatccgaatccgtcactccctaggcagtgtttggctaataggaataggaaataatttttcacctactaaaagacatcgttaagttctaaccattcattccctcttttctatttaatcctaacccttcgtttattttctaatctcaatcctacttctattttctattatcctaacacaccctagaccggtcctttcctcattaatagctgaattaaccgagacggaatactaacacacacagtttgcgagggaattcttacctgggctggcccaaaaccacccatcgcctatcctaaacggctaaacccccacggccaccggataacacagccaccctccctcaacccgaaaagctgccgtcgcctcgtctcgtcgccccgaagcaccacaccacaaccacaacacaccacagcgggtaggccgagagcgcgaa

SEQ ID NO: 36593 - DNA, 261 bp, Oryza sativa
tgctaccctggttgccttcctctctgctgacctcaccaattccggcgggcccatgatgtcaccagccttcacactctcactgatgccctccaatctggtgtaggaaggggaagaagatggagggcgcaattggcattggggacgtcatcgattggttctctggcaaccggagatgggatcgcaggaagagagagaggaggaggatggtgaccttggggcagaggagtcgagggaggaggatggtgaatgtggggcggagtc

SEQ ID NO: 36594 - DNA, 1501 bp, Oryza sativa
cgtactagtaccacgagacagctagacagacacgtcaggtcacgacgcagcactgcagcagggctgtagcctgtacgggaggcgtaggcgcaacatctcgaaaattttgttccgtagctaaagcccccccaaagccagccgcggttttcatggattgcacaggcgttcctctccgccggattccggaaagaaaaaagaaaaaacaagatgtccgttccctgggtggtgcatccgttttctgacaggtgcatgcacctctcgctcgctaccgcggtagcgcccacacgaaccacgttggctttcggccaacttgcccgattctttaatcccctcacgacgtacgtcgctgtccaataaaaagttttaacaccaactatagtaaccagcttaattttaataaaaccaaagaaaattcttaattacttagagcatctccaacagggtcctcaaacaaagtccctaaataagttttgagagttgatgcaaaaaaatataggtccagcagattccctactagagcccccaatctagggaggcccctagatcactcctccaagcccccagtccggggggctcaaccccacagcccccatcctctttttttttggcgggggaaatttctgagcgcgcgccatcgtcatcctccctcccgcgtcatcgccatcctcccacaacctcccagcgagcaagccgccaggtcgttttgctccggtcggcgaccacccgacatccctcgggaagaaacttcggcgagatcccatggtgtgccgcctcaagccatcacaatcatcggttttactccgtcactcactgtcgccgacctccttgcatcttcggccaacgcacgtcgtcaccgattgatcatgcccaggtgagtctcgacgtcctccccgaactagctgcccacccgctgtccacaaggcctagcgccgaccatcgacagctatctatcaccggccgcacacatgctgcagtaaaaaaattcagagatgatggtgattaaaacaaatcacaatagtaaagttcagtttcgtatgtctgagtctccttgtttgattttgatctttatgggcttactaggcgtctaggcccatctaaatcattcgcacagcaaaacgtacattgtcatcattcatgttttatatgcagtgtcttgttctatgtcagagagctaatcttgcagagcatatataatatttaagaaataaatttgtgtttgcactgagtccttagtactgcgcaaccaatatatatgctaaataaatacatattgcaaacagtataacctgatgtacattgcaatcacttgttgatgtttctgagatagattggaaaggttgtcaatttatatatttattgcagtgactagattgcaatgacaagtggaggtgattcctttgtgcgcatgatgtccgaggacactgatgtcgaagtgctaatgccaaatgaagaccttcgtacttcaacaaatggtgcaaaaggaagtgccaaaagatcaagc

SEQ ID NO: 36595 - DNA, 1501 bp, Oryza sativa
aatcgttgacaggaacatcatgtaatttgtggcatgacagattaattatctgtcagccagacaggtcacaatagcaacagggtaggaggtgattatcaacaccttgaactgaaattccaaacatcacacatgttttcagtaacacacaattgtgttgaacgaaacgagaaattggacattctgccactaccaaaagagggtttcgctcaaatgccattccacggattggattcgttaaaaggccatccctaggcgataccaaaccttttctttgccatatttgccaattcactggatttccaccattttttcacttgggttgaccaatataccccttcagtcgggttcttctacctcagccctcctggccactcgttgagcttaggaaaggggactaaattcagttaattttagaatctaccattgcaggatacaataccgcactactagtaaatagagatcatagggagaccatctcttacaacaatattctaagtcatctcttattcagataaaatataaacaaataaaaaaggatgccagcactaatattagtcagaacacaacatcgatggtagtagcattagatatgtgacattttgatcagtgagggatcatttggagttgcactttcccattgctgcccttatttgcatagccattggcatcgccgacgtgtggcactacctccacacctgtaaacacggtaatttgttcatccccaaagtcactgttgctgcggaagaacctagcgatgcagaacctgcctgagccaaggttaacaagttgaggatccttgcattccctccattcctctggcaggttgagttccttccaagggcccactagctgtggctaggagtccatggcagagaggtcagccgcagccaagcgacgggcctcagcagagaggccaaaccagaggttgaactcaggcacataatcaatcctgccatggaacggcagtgtccacttgccaacttggctccatgtgtggcttgctgtctccaggcagtaggtgccgatgccattgacagataagcaaatgtgtgagccaccgccaagcacagcgtaggagctgatctctgggttgctgcagctgtgccagtgcttgggttcacggacaaaaggcgggggtgggagttgatggcagtgccaggcctttgtgtagttggatattgtaggcttgcggtatatgaaggcctcaaactgatcgctgttgaagcccaactccggtttgggaatcctctccatgacaaagaggctgctgccatagccatcatggtcatagtcattgtcagccttggcattggggacgaagacggccaagggcatcgacttgggcttgtgaagactgggcatggttcctacctggcacgcatcagcgtcgacgaggaacgcgcggccagactgatccatgcaaatcacctcgccgccagcaagcgggaaacagtccatcctcgattggccgttgacgttgagagctgaagctcggaaggtg

SEQ ID NO: 36596 - DNA, 1107 bp, Oryza sativa
attcctgcagccctgctccatgtcctttcctcgtcacaactaatatgctgacaatttcaccaaaggtcttccctaaaccttgttaaacgactaaaggtcttccctaaaccttgttaaacgattttgattttcgctctagtctcaacatccgcagacctcccggttgaaatagcagaggcccaacgtgcgttctgttgcttatccagtataagttgttagtagaaattgggaaagtactacactggttgcttcatatccctgtgaatgaaaaaaaatgctactataaattttaagtgttacaaatgtcactaaaaatcgtgttttgtgatatgctaaataagtcagtgttgtaaaataccgtcacacaatatttggagtacactgatatactccttccatcccataaaaaatcaacctattactaaatgtgacatatcctagtactacgaatctgaacatatctctgttcagattcgtttactataatgtgtcacatgtaaacctaaattcgtttttttaggatggagggattatgtagctgggattgggaattcgagaaggataatgttttatttaaaagtccaaagtaatggtaatgatgtgcctaaaaatattcggcacgcgttatggtgcaaatagtcatgaaaattctaggataaaaaacttaatgaccctgcatatgttgaaaatatggtcataattcgacatattttaatccaaaatattaagataataaacatgacatacacaataagaagcgatctagtgaagatgctaaacataaacatgctaaacataaacatgagcatgcttttgataacataagcataaacataatcgatattcacataggattgtaatcctatggataatattgtgaacacataaataaaaagaagaaaatcaagtaaagttaaaatcttatacccagaagatgttgaggcattcgtattgcccccgttcatgttgtctccttcgttcccgttctctccagtagaagccatggtgaagcagaagtagaggaagcagcgttgtcgtagaagaacaggagcagtcgcgccgagacgctctctaaaaacttgatcgttcgcaagttgaaactagtca

SEQ ID NO: 36597 - DNA, 1501 bp, Oryza sativa
gccttcccctcccatgcacccggtccaccaacacctcatctcttggaccccacacgcagccactgcccacggcaacgcggtgctcgtgcaccgagtccacacgacgcgccgcgcggtgcgggggcgccggcctctggggataaatgggctaatccggtagaaagcccaccactcgctcgccagttcgtcgtcctcttcgccgagctcgcgagctctcgcactctgtctccatccccgcatcgcatcgcctcgccgctgctgatctcgtcgcggtcgccggaggggagctacgaggttggggagccttatctctacttcctgagatttctagtagctttgtgtatgtgtgtgtgtttgtgtgttggggggacgccgatcgggtggatcctcctgtggtggttggttgggcgcaattcgtgcttggtttatttgctggaattctagcgggggagctggcgttgtcggtgctaattgctgcgggggagctgctggaattcgtgcttctgcttgggaattagaaggtttgggtttttatgattcagagggctgtagagctcttgagattggctgcgaaaattcgggatttgatcaacttagagagcattatctttggattaggagggatttttcttaatttttcttagttttttttgagctatcaagagttcatgccatcttatttctccctttgttcttagccggaaggatacacgaatcagttttttttttttaaaaaaaatatttatctcaattttctgcaagcatgttcaatttctaagtggaaatgctatttaaaagaccaggcttattgattggtgctatactttgattttctttggaattgtagtagaagcatcagtttcttcatgctgtcctaccaacctctcttattattagcaaagtaaagttattaaatttgctaattgttgatatgtcagtattttgtacgaattgtgaaatagttaattttcaataactacacaccatggttgtcctgttgttggactggaagcaataagggaatattccatttctgtccattaaaacccacaaagatgaccctgtgctcatctctaccattgccatgcacctgtttgtaggattgcctaacccagaagttggtgcttcgagatagccatggccaccggagtggcaccagcgccgctcccacatgtcagggtccgtgatggtggcatcggcttcacgaggagcgtcgactttgctaagatcttgtcggttcctgctactctaagggtgggctcatcaagaggcagggtgcttgtggccaagagctcaagtaccggttctgataccatggagctcgagccatcttcagaaggaagcccacttttaggtataactcgccggctgttgttcaccttgcatgtatattcgtgttagttgttcttagtgcttttaactgaatgaacattttttctgtaaagaatctgacagcatgtcttttgcccttttgttattctttagttcccaggcaaaagta

SEQ ID NO: 36598 - DNA, 262 bp, Oryza sativa
cttaaccctcgccgactgcctggagattcgtgccgatcgatacacgtggcagcgcctaacgcgtaacccctccctcacttggagattcgtgcaagcaactcgattaatgcattaatgctgtcgcgtaggtttccctacggaagagctgagtttcgtaacgaaaaaaaccggccacgtttcgcatcgagcctactttaattagcgtgggaaaataattcaaagtagcgacctgtaccctgtggcaacctagcgcgcgcggcca

SEQ ID NO: 36599 - DNA, 1501 bp, Oryza sativa
cgtcaccgccccttctcctcctcgccggagaagctcgcctcggatccctcctcctcctcgtcatcgttgtcggtgctcggcccccgcacaccgccgctcgccgccagccgcgccggccaccgctcgccgccgccgcctccgcgccgaggccactgccctcagccgctgcccccgcccttcccgaccatgagagagagaggaagagtgagaagagtgaggagagtgagagagagaagagagagaagagcgtatgacatgtaggccccacaattttttatatatatagaatgctgactggactgccacatgtacgtcacgtagaccaaaaccaccgcagattgggtcgaggggagtaattcgtccggtttgtatagttcgggatgaaaaatgtccggttttgtggttcagggggtaattcatacgaccgcgatagttcgaggggtaattcgtactttttactaagtgaaaactttaagttagatatggtccaatgtgaaacttaggtaagaaaaagtagtccaatgtggaatttactcaaaattctattataataagagaaacaaaaatggttaaacacggttaaaacaaaggagcattttacatctgacaagcattctagatggatttttttagatagtggaatttattcctgacaatgtggtgcctttatttgttcctcgtagcggtcggacaagccatcggaggaagccgaagaggaccgggacgggaacgggaaccgccggctgtggctgcagcgacgttgttgttgtccccctggtcggacgccgcggcggcggcggcggcggggagaagccgcagcggcggcattgcttggtggccgcggagtggtccccgtcgcccctcggcatgttgacgccggcgctagccatcaccatcaccaatcatgtcatgcgagcagcagcagaagcagcatccaccatgggaagagagatgcgttggaggaggcgagaggaagaagaagaggtggccgtgtggctaaggcccaaacacaagggcccatgagcataaccagttccttccgttacattaaaccctagacgctcctcctctcctgcccgcgcgcagttctgctgcttgctgctccggcgctggccctctcttctcccttctccgaccttgcgcctccctcaggttccccgcttgttgatctgcctcatcttcttcctatttgatcgaaagccaatttgcttatctgtgaatttatttcgctagccttttctgatgccatctttggctcttggatttgaaggctgaagatcgattacatcgcaggacaggacgcgcaatcgactttgcaggtactcttccttccttcctcacaattgtctcctggatcttggtatgtactactgcttaaatcgcctctcgacaaacggatcccctcgtttccttctgctctgcaaataatccacccgctttttttttaattatttccctagctttgaagatattttaagtatgtctccgtcgacgattgatt

SEQ ID NO: 36600 - DNA, 1026 bp, Oryza sativa
gggtctgttctgttttccatgtcctttaagtaaggggaaaatgaacatttgagagcacaagatgacaagaactgttgcgttcgaaaagtatgttttttctctactaatcggttggattatggatacgatgatttacttctaggacgagggagcctcgtccaaaataggctaggagggcagatatagatcataaaagggcattagggttgaaatgcacttgatagtgcagtgactaagaacgtgtgattttaaccctaaggccctttacttaaattcctagcatgctcacaatttaccgaagataccaccggtatatcattccaatggaatagctgatgtcatgattatgttagcataatatctaggtacaccagatcctatacctatcggatcatgctaacgtcggtatagtacctggtaccatatctgatgcatatagagtatcgtgctaacgacagctattccgttgtaatggtatgctgttatatagtctacctctttttattttgtcacttaagtttaaggcttgattagaattttagacagggcctccaaatttcagaggacggcccagtacgaggcaatactggactcctagcctcctggctagtgatgtgggcttaaaagagctgatcccagatgggcccttttattttaagcccacgacagcctttgatctcgtgtgttcttttccccacgttagtgaatcaatcaaccttgccaagtgccaactaacctactcctatagttgattccgtgaaatccctgccagtggtatagtcgtacatggtcctgttataattaatgccacttttcacgatcctcagttccttattatagtgcttatctatatgcatgtgcagaatagaatcatagattagccaatttgcagtacctttttttccctttgagagtaccaacttgtagttatacaccaatatacttaaccacacagcgaacagtaacacctccaaatctcaattaacaaaacagaggaaaagatcgaagtgtagtaatctccagaca

SEQ ID NO: 36601 - DNA, 1501 bp, Oryza sativa
acttagaatattgttgtaagagatggtctccctatgatctctatttactagtagtgcggtattgtatcctgcaatggtagattctaaaattaactgaatttagtcccctttcctaagctcaacgagtggccaggagggctgaggtagaagaacccgactgaaggggtatattggtcaacccaagtgaaaaaatggtggaaatccagtgaattggcaaatatggcaaagaaaaggtttggtatcgcctagggatggccttttaacgaatccaatccgtggaatggcatttgagcgaaaccctcttttggtagtggcagaatgtccaatttctcgtttcgttcaacacaattgtgtgttactgaaaacatgtgtgatgtttggaatttcagttcaaggtgttgataatcacctcctaccctgttgctattgtgacctgtctggctgacagataattaatctgtcatgccacaaattacatgatgttcctgtcaacgattgagaaacccctaagttgctgatatgctgcaatttataaatgccaaccttatggtcaatttttttaaaaaagaaaatttataggaaatgaacacttcccctatgtaaggttcgtatgtgtggcaatttggttatgcagccctctaaagttatggctgttaaagaaacagtttgctcatctatgctttcagtcttcaagtatgaaaaaataaaatgagaaaaatcataataatatgcttgtttatcacctgatacatcaaatcttcggtacccagttacatggcagagaatttccccaatacaacattttgcactcaaatactttctggctaactggaacttcctttagaagcaccaaagagaagacaagaatacattgcaaaattacattacagcaaattgcatgaatatgctgacctaccacacatgtttattccaatactatgattctataatcctaatttctagtcattcccgagataactctcagctcagctcctcgttgctgagggcatgataggggccatttccttcaacacaaacataattatccgcgttaacaaaatctctccttgttcgatttttttctgtttcctctatattctgtagtccatagttactttcatgtttgagcatgtggctcgttaggtctaatagtgggagaagtttttttggaattgtgacgggttcaaggacccgaaaaaaacataagtttgtttctgatttaaccaaagaacatcaacttgattttattgttttatctgagacggttaagaaggaattttctacatctgctctgaataatctttgtgttagtaaagattttttgtggcactgtaatctcctagaggcagatctggtggtcttctttaggaattaatcttctaaattttgacattggtttgattgatgagggggatttttaaatccaattttctttacggaattaggcttgatatttttaaatgggcttaagttttggtgatgggcccggcccagaatgagc

SEQ ID NO: 36602 - DNA, 342 bp, Oryza sativa
aaaactacacctttggttttagtatacttctttttcatgcatgtcttttaatttgatggatttgtgtgggggaaaatgtttcgcttgagcttctcgcatgctctattcctgttttatttcatcaaattttgtgaatctgtaagattaattcgattcatgggtaattggtaagcacgacatctgtgccattttatatcgtataagcacctttgtactgatgcatattacataagggccatcattttttttcatgttgcttttgccttccatactaagctggtcctgtagcattttggagtttttatggctgtgctgaagataataatttgagcagggagatgg

SEQ ID NO: 36603 - DNA, 1501 bp, Oryza sativa
tcagctgcaggacgggagcgtggacttgctggcgcggcacagcagctcgccggccggattcttctccaacctcatggccagcaacggtaagatcgatcgatcgattgcgctagccaacccattgttcgattttatttgttcatccgtgttcaatttggcgtcgcgtgcgtgcatagctagcccatcgtgtataggcgtatagctaattggttaggactactcagagtcacggatcttcaatttctagcttaattctgtcaggagagaacggctagctgtgcaaatgtcaacctcgtctttgccttcacatgccccatctctttctcgtcacacacgcacacgatcgaagtatcgatcgatcacatgaattgctgttctaggcttctagcaacaaccaccaaaaaaaacgaattccatcgatattattgttaatggtgttctttctctctcagtgtttcctccacactgtttcagattcttcccatacttatccgaaaccaaacgggtttgatcaatcgatcgatctctgtctacctggttcttaacttctatgcaactcccatcactactaactgccaaagccactagctcgctcggcgacgacgaaatgctgatgagctcgcgctatctagctaagctcgatcccttttgcaagttgcttctgcggcgcgcgcgtgaatcgatcatcgcgtgcgacttttcaccggtcctaactggttttttttttgggttaaaaagtggttttcgctaaggccgtcatgggaggagctagtgtgtatatcagactactatcagtatgcgttgtggatatccatggatgtgttagtctgcggctttttgctacgtgagttgccataaatagtatcatggagatcctctgtgcccatttttctactcagagccattagccataggctcctatatgtggttagtaacttttgtgtgataataatgcatgtttgccacagttagggtcaatatatatatatatatatatatatatatatatatatatatatatatatatatatatatatataagctgttaattaaggatccaccatgagatgttatatccatgagattatgcggcttaattgttttcgtgataatgtaatatgagttcaagtttttaaggcatatgttattacgaggagtgcacaaatttggctcggcgtgtaagaaggacgatggaaaactatgggctacacaggaggcgggttttctcaagtagggtatcatcgatagtgaaatgtggggtctagggttttgaatacaccgcttttattctttttacgtacgctttttataatcgagtgtctctagattgtcttattttctattgcaacttgctataaatggcttagtttttttgccacttgcacctggtgtccctctctctcatttgatccattattttcagttgcaaagtcattgcgcatgacaatccattcttcactacaatagtagacatggggaaaaaaaacaatttgaagctata

SEQ ID NO: 36604 - DNA, 993 bp, Oryza sativa
cgctggcaggagagagagagatacacatgtggatagggttagggatggatatggtttcctcaagggtattttggcattacgaattttatttatatttctttgtttttttaaatcaaatcttaacggtgtagtggaaacagggtcaagcggaaggttcgtttttgaaaaacatggtcaaataagcaaactaaaaaagtagggttaaattggtagttagacttcaaaatgggataaaataagcaattgtccctattttaaaagataaacaagtagacagttgataggtccactgatgcacgccccctcacacgtcatgagtcatgatgaggaaatgcaaacgctgggacccactcatatgcctcttgcaccccgcacacccacccatacactttagctggacctttggccgctctaccctctatcaaagtaggaaataacagcagcaacaacagctcacaggcgtaaaagcttacacacctcctcctactcctcttccacgcgcgtcagtgggccgcgctgcaccgcgcattgcttcacctctgcacacctgaaaccgaaaaactcaatttggagtgaagcacggagagagagagagagagagagagaggagagaggtgtcttggacggaagtttttgaaaaaaaatttccccaacctcgtgggcacgatgccgtcatgatccccccttacgcctcgctgcccaaaaaatttcaatatctcgcccacattaatcaccttcctcacgaggccaacgagcacaaatcccatttcatcatcattcataccaatgctctcggattcttccacgtccccggattcagtttcctgctcctctccccccctctggatccctacttctcttcccctcgttccagcgcgctcgccgtcgcccgccggcgtccggcgaccatggaagcagctggagtggaggtgaacggacgaggaggaggcgacgtcgtggtggtggtgccccagcagcatgaggtggcggcga

SEQ ID NO: 36605 - DNA, 365 bp, Oryza sativa
atcaagacaataattagtcgtaaatgcaaacacatgtgttgactctagaacttaattcggatggattaatttgaccataagaaaccaaactagttgaattacgccgtaatacagataaatcctaatagatctattttagaagatgataagttcataaataatatccaaattcggcatggttcacattaaaattagaaattatagacgaggaaggaaaccaatctgctgccgtgttacacggtaaccgcagtttgcaaccgtcaataggagaccctatccactacgaaatccgttggatccctcgtgctccgcaatctcagccgtccgtttccccctatagtcccccttacctccccttctacagt

SEQ ID NO: 36606 - DNA, 1501 bp, Oryza sativa
tgaaggtctgcggcatgtgtgccaagatttgccaatctccggcaaggatcaatctcttcttcaggtggttccgtgagggagacacggattgtatcgcccaagccatcctgtaagacaacaaaaggaagacataaggcatgcttaccctttgcagatggaaagatatgatatatgcaatataatacacaaagtaaaaatgcaattaccatcagaagtgttccaatgccaatggcagacttcatcctcccatcttcaccctctccagcttctgtaactcccaagtgcaaaggataatcccaccctaggttatacatttctgctacaagcaagcgatatgcttggaccatgataacagggttacttgctttcattgaaaacacaaagttatggaagtccagcttccgacagatcctggcaaattccaaagcagactcaacctgaaattatttgtagaacatgtcattcatctatcaaaacgatcattaattgaagacatccatgaaacgaaaagttatttgaatgaaatccccagaaaggaaataataccattccgcgtggagaatcaccatagtaactcattatgcggtcagacagacttccatgatttgttcctatacgcattgctcttccatactgcttgcatttctcaaccaacggggagaagacctgaaatgatatggaagtggctatgcaagtaaggaaacatactgcacattcttactgactaaattaacactaaagagtgagatatttggaaccttctcgatatgctcaagctctttttgataatcatcttcagtatattcaagctgctcaaattgggcacggcgatcagctgcaagtagagttctcagcatatgcacagagttgataagatattgacactaaaatgatacacatcattatttcactcaccaaaattccctgggttgacacgaattttgtcaaagcattcagccactcttaaagcaactgtcggggcaaaatgaatatcagccactagggggatgttgtaactgttgaaatgcaaaagcaagatgagaattcattcatgaaaactcactgaatctggaaaaatgatgactcttacttcttctgaacaagagtgttcttaatctcaaagcaggcatcagcttcctttctaccctggactgttattctaacaaaatcagcccctttatctgctatcctcataacctggaccagtgctatacttcgttatttcactagtcatgaaacatagaacatctaaaagaacacatgattaatgcatgcccagcattcaattattcaagcatagaattaaaaactaaaacatagaacttcaaataggagtgtacctcctctacggttttagcaacatccttggtatccgaggtggtcatagtctgaatcctaatgggatgatcactgccaagtggcacattcccaaccatcacagtgcgggtttttctcctccttgtctcatatatagattcacaatacttttgcctgggaacta

SEQ ID NO: 36607 - DNA, 511 bp, Oryza sativa
tcctggaagtcgcgttcgtcgatggcatttcttcgattagggtgtttgtcaatggcatttcatggattttctattcttctttttatatttttcatgtgattgacatgtagggtccatgtaggtcccacaatgacttgtcgagttgactgcagtcaactcatcatatcagccaaaattagacataatgctactctgggatctcgggtactccgatattataagttgagagacatgttacatctagtattgcagttcaaggatacaatttgaagtctataaggaacctaaagtgaacttattgcagacatgttatatctgtcactatgtcgtcaagtctgaaattcatcctaaaccgcaataccagatataacgcatacctcaactcccaatcagtgcaaataagatcccaagactgtttggatgacgttttcgactgacgtggcacttaaagttagatgggacccacatgtcagtgagttcggtgggacccacatcatgaccctctctttcc

SEQ ID NO: 36608 - DNA, 921 bp, Oryza sativa
gcgttaaaaactgaatacacatgtcgtttatttcacaatttatacgctaatattataatataatacctctagttttcaatatatgatgtcgtggacattttgataaatgtttgtatcatttgtcttattcaaaatttttctgcaaacataaaaagtatatgttatgattaaaaaaaatattaataacaaatcaaataaaaaaagatggataatcaaatgtatgtacaaaagtcatatattaaaaaattgttaattggatcatgccattccaaatttaccaatttgaaaaaaatgacactactgttcacgatatcggttaggtgccatttaaatttttgcaaaattaaaaccatgcaatcgtcatcaaatttttcatcttattccttctttttttcccttattctcctcattagcgagctctgggacacattagcggtgtcgatgttcggatcatggtggactgcggcaccacacatcgagcatggtcatcgtctgatcctcaagcgggccgaggcaatgcagtccgggaacgggttcctaccttattcggaggcggtgggaccggcaaggtccaggatagcatgaatcataggccggtggatccagcgagccgagctccatgccaagggtatggtgatgggggagggaggaagcaccagggatatggcctttctggctccggcaatgatctcggataggggaggatgctcgctagctgcctcctttttgtcgatgcgaagggggagggagggagggttcttcaccggagctagctggttgcctttctcgtggatgaccccctgatgggaagaacatgaaaaatctgacgacgactgtggatgtttgatgtcgcgattccggtatttacatagtatggggatcgttgatactagaatatatacgagattgtagtaaaaaaga

SEQ ID NO: 36609 - DNA, 493 bp, Oryza sativa
aacaatttggacaaattctgaatttgatggaattttgacaaaatttcagcattttgatagaacttaaacaaaattttgacaacattttgtaaaatgtaattatatgttccctttagatattagtcaatgtgcttcatttaattttaaatatactcacaaaaataaagttctaaagctacatgcataaagatggggacaaaaacacaattaatgaacatacatgagagggtataaatgccattttgtcaattacttaacatcattaacttcaccatctaaagtaggggcaaaacaagcgttcagttaaaaaagtgagggtaaaaaaaatcctaaaaagtaggggtaaaatcaatattagacattaaaataggggcagaaacaaaattgtcccttgtttgaactattgtggcacttaatcacattcgagcatggttgccacctgttacttttgaaggttgctgcatcctatatggttggaacgagttgtccagtg

SEQ ID NO: 36610 - DNA, 1501 bp, Oryza sativa
cttcttgttgaataattatcgcagctaaaatttgaattttaaaattagttaaattttaagttattctgaagttttttcatcatagttcttctacccatagttttgaatctctagtaacacgtacaaaaattgggatttgctatatctataaattattttttgtttgtttcgttccaggcttattagcctataactgaatctttcgattccgaaagtatgctgaaatatggtgcaaatggccatgcattttatgatattacttattttaggagatcggtagaatatattccctccgtttttaacggatggcgccattgattcgtcttgtccaaatattttatgcaaatgtataagatataaatcatgcttaaaaatactttgagtgataaaacaacttacaaaaaatatattaatttttttgaataatacaaatagtcaaacgtgtgacaaaaaatcaacggcgttatctacagaaaaacagaggcgatcgcagcggtgatggtccagaccggcggatcccttgacggagacgaggaggggaagcagagttctccagtgaggatccgcactaccgccgcccgctctcaccccacgaatttgtcgaccggcacatcctccaccagtccacccgcgcctatcgaccgacgaaggatccagccctagtagtgccttcggatgcggccgacgatgagtgccctctagccggtgggcggcacatagatcaagctccattgacttcgtcgtcttcccctactgcaaacaatgaccggttgagatggtggtgggactgccacacgcgcgcgctgggctgggcgtggcttgcgttgctgctgctctctctaactatatgcaatggacgagaattaaaggaattgattcggttgttaaaggatgaacgtttcaatactgatttgatgaatcgtattgatttgggcgttaatcctcaaatggaaagaatccaactctgacttgatttttccagaacattactctctcacgcacaatataaatggcaccaccaggggtagacagagacacaccactctgctctgttctcctctcactgttcttcttccttggtagtctctgttcttctattatattttagcactagcctttgcttcctcggttctgagcacctggttgttaaaggatgaacattctaataccgatttgatgaatcatattgattcgggtgttaatcctctaacgggaaaaattcaactctgacttgatttcttcggaacgttactctctcgcgcactatataaacttcaccactagggatagacagagatacaccactctgctatgttgtcctctcgcagttcttttttcttggtagtctatgttcttctgtttctgtgccagcctctgcttccccggttctgagcgtgcatgggtgctcgggacaagcaggcctccagaactccatccacatgtgtacctgcataagtcggcaggcgatcaagtttttggggagcgctcactagtgcgattg

SEQ ID NO: 36611 - DNA, 1496 bp, Oryza sativa
aagagcatcagaagcacgggagcaaaaatttgaagaaatcattgcacaagtcggaattgttgaagagaagcgtccttcacttgatgtctccactcgttggaattccacctatttgatgctttcctcatccttattattcaggagggcttttgattcattggatcggtttgatcctaactttaaagatgctccacaatttttcgattgggagaatgcagaagttctttgcaaacatctcaaggtcttctatgatgcaactgttgtggtttccgggacatcatatcccactgttactcgctactttcatgaattttggaaagtgaaggtgatgattctaaatgagtccaacaatgaggatgatcttgttgctagcttggtttctaaaatggatacaaaatttcagaaatattgggatctacagttcctgcagatttgggttcctgttatttttgatcccagatttaagttgaaattccttgagtttaggctgaaagcaggttttggagataaggcaactggtccaaatggatatctccctagaattaagaggacagtccgtacttggtttgctgaatattcttcacaaatttgtggtccaagcacaaccaattctcaagaagcatcaactagtggggtgaatgttggtggcagccaatttgctgactagaggcaatatcttcatgatcaaagcaagagtaaagtaaagactgagttaactagatatctcgaagatattcctcaagaaaatgatttccctgatgatgattttgacatactctagtggtggagggtgaactcttgcaaatatccaatatcatcacgcatggcacttgatttgcttgctgtccctgcatcctcagttgcatcagagtctgcattttctactggataaagaatcattagcgactataggagtaggttggctagtggaactgtggaggcattggtttgccttcaagattggatgcgagccgatggtatgaagcctactttagttgtgcattgctacttatattatgggccatgaacttatttatgttgaacttttgtattctgatgttttaggttttggtgatccatattcaattcaaactgatacggctgagggcgatgatgttaatatgcaactattgggtattcaaattacttgattttatatttctgtatgtctaattgaatatgggtactatgatgatctaataataatttacaatttattctacatttgcttcttaaatgagttgctagatctggaaaaagagttgtgtacacatgctgcattaccccctcaccatggtcataaaactgtaactgaaaattgtttctgttccttaaatagtactacataattttatcttcatttctaggtagtttggacctctctttttgtgggggtcagattcacttctattctgttagatagcttttaaattcaatccaagatgttctggcactggcaatgtagattatgttccaacttttaacccctttttgtt

SEQ ID NO: 36612 - DNA, 382 bp, Oryza sativa
tatttgaatctgttcgcacatttttttaagctcgatctactgatctacactcttgtataagtaagatttaccttccttaactctgttaccagacgttttatacttatgaactcttaaaccagatgtgctaagcacgtattaccattctataccaattttcatttcatcatatcagtatttgattgatcctttcaagcttcctcgccaagtcaatcgagatcatgactgtgatacgatcaagtaaataaagtagtataaaacgattcatacgacgatttttcaagcgtaaactaacagttaaacacccctataaaacaggcgccccgaagtagccagcacagtacgaggtggccgtcgtcgagcacctcgatcgctcgcgcca

SEQ ID NO: 36613 - DNA, 1501 bp, Oryza sativa
cggactcgtcctcttctgccgcccgtgcgccttgacctactccgtgtgcaacccttccaccggcggcgtgctacaccttcccccgtgtcactcagagtggtacatgagcagcgcggggatcggcttcgactcggcgaccgggaagtacaaggtggtgcagctcgtagatccaagttccccgaaagtagtggggacacaatgccgtgtgctcaccgttggcgacgaccctttgggctggcgggagcccttgggcgaggcctgcacaatcctccaggaggaccacgctaaagaaggaggctgcatcgccgatgtcgacccggttttcgcgaacgggcgcctccactggacgctcaccccaaagttcctggtgtgtgacacacctcagggcatcctcgcattctcgatcggtgacgaatccttcgtgacggtccccttgccaccattcgcatcggctgacttagacgtgtgtagcagcagcgtctgcgttgcgacaaatgtgtaccttgagcatgttcggccgagcaagttgcttccaaagaacaaggaaatctttgcgccggccggcacggtcctggccgagctcgacggctgcctgtgcatggtgcgggacctccgccaccgccgcaacatggacttgaacgagaccaccatgttcgagatatggaagctcgggacctacgagaccggggagtggtcgctggactaccggatagacctaccccgagggtacagggccgcagagcgacttgtcacgccatggcttgtcatgccgctagcttacgtcggtggtgatcccgcctcaactggggggcagcgtaggaaggccgtcctgctggcgacgacggctcatgaggcgcatgtttacgacccggaagcggccgtgctccacagggtggcctccatgtcagacgacgagagccgcagctgcgacgcggcgttttacctggataaccgtttgcgtctcacgctgtaccaggaaagccctgttcagatggacggcatggaacacgatggtggtgatgccaagcttatcgggtattccattctcaactcggagcaaaattagttgatttaactatatgagacaacacatcagggacgggccccggatgttgagatagtaattttttttacgaccacaagtctaatatttgatatgtataataacacgtagttctaatagttgcatgatatacagtacatatagaaagataattatatgagcttcatgattgttatctaatatatatgatgtgggggcgagttccatctacaattgcaacgttcacatcattcttcgttctttagcatgtcataggtttctttctgagttatctaaagagcaaaagctagactttattgctctcctagaaacaggtaaagataagtttgctgattcatggttaaataacatctgtggagggaaatattttctttggcattggactagaccaaaagggagaagtggaggtatcttacttgggataaatttagaactctt

SEQ ID NO: 36614 - DNA, 217 bp, Oryza sativa
ttcggacttcaatttaaattcactcgtgactgttgagcttcgcttggcgttgtcgattactcctcgtctctcggtcctcacaccgagaatgacaacaacctcgacatcagaagtcatgatcggttacacgagttcatttaagcagaagtcgggggctactgtcagggttatgggtaaggtataccctctacccttcgatatacgtcacatatcgata

SEQ ID NO: 36615 - DNA, 1501 bp, Oryza sativa
taaggagttgtaagggattattattcgatctcgatctctccctccccgaaggaactcgatcatccacagccacaaacgctgaaacttactgaaagcaacttggcggccggcagggttgatgtcttgatgatgtgattagaggggctttttggcaggaaaagagggggcttttttcgtggtcacgagcgtgctttatatcttaacaagttgctgcttagagaacagatgcgtgatagctagccaagcaatggtccactgggaatttgtactagtgtacatgtacagttgcatgcagtaatactacagcgttgagttgcatacagtaatactacagcgttggagattagaaggatcgtgtccacaacctaacaatagcaactgtggtttgaggaacagatcactaacagtatcccatgtcggcaaagaatgcagaatagctgacaaactgatatactatacgcttacacaaaaataacaagacgaaaaagaaacaacctcataattttttcagcggaggcttaaaaaagccagaaacttgatcatttatcacgacagggacaccgccaatctgaccgataatccttgcaataatgacccagcaccaacctaaatcaccccagcttggtttatcgccccaactgcaatcctcctaaacgtacttaccacagagtcacagaccagtccaccaccaactacagttgcatcatgcactcggttcaagttgaaggaattttccactactagttcctcagtaagtcatagccacccgaaatagaaatatcgatcacgtactaatctaatccctacagtatgatactccccctatattaaaaaaacaatgcaaaaacgtcgatcacaaattcacaactaatttaatcgctagagcgcattttactcctagattaaagaaaccgatgcaacatgcaaagtatgcacaccaacaccgagtacattgccaatctgatttgatctgatttgattaattttgcatgcacgcgaatgggtggccatgcttaggctgcgacccctgtgcgccctgcacgagctacagccagccataagcttccattattttttatcgtgaatcttactaatctactccattcttcttgtatcggccagtcgagtcagcagagatcgagatcaaaatcttcgcagctgcgcgatcgcggcaaaaaaagccgttgcgagttgcgacttgcgcagactagtagtagtccaccgccgcgcgctcgcgtccacaagttcttctccaccacaagtttcgcgcgctgctcgctcgcttggttggttggttgattgctcgcgccccgcgcggttgcgtgctccctcgcgccacgggtttatatgcgccactagccgagccgcgcttctggatccccttcttctgccgctcgttttccattgccgacgcgcagcacgcagctgcgcagccacacctttgcggctgtcttatcttgttcttgagttgtgttcttggttggggaggaggaggaggaga

SEQ ID NO: 36616 - DNA, 1501 bp, Oryza sativa
actccaggcgccgcagctcctgcgcgaccggccgcgggccgcagcccttccagcgaccgccgccgcggcccctcaccagcggccggccgtcacccccgctccagcggccggccgtcgccgccgccccagcgaccggccatcgcccctgctccagcgaccggccgccgccgccgcccaagcgaccggctgccgacctcacctgccgcctgcctgctctgacgccgccgctcccgtgccacccatccagcgaccagccctcccgcggtcgcccctcccgcaaccggccgccgcctccctgctccggactgccgccctcgccgcgccgcctgcacaaccgccgcgcacaagagaatcgcgccgcctggtcaggggagccgcgcctcctctcgtcctggtcaggcacgatctagggtttcccctattgaggagagggatgttggacttgggccacttggcattgggccattttctcaagtttgggtcaaaggctatttttgtcatttctgcaaaaatctgacaagttattagatcctagcaacagtcaacacacggtcaactcacgtgagtgacatgagagggtgctcaaatttgactcaatggcatataagggaagagccaattttgtgtggcatatcaaggaccagaccaaatttcaatggcatataaggaattctctcttatataaaccgtagacaagcataattcatacagaagaaaatagagcgagcccccagcgttagaccgtagttggcctaacatcagaaatgctcgcacaatagatattgtataaaagacatgctctaggtaaacataataaattattgatatgacaatattgtataatcttgaaaaataggtacgataaatttcatataaaatattgcgtacctttgtagatacatgccgaatgtatctatgaaattagtagattaatttagaaatcaatctcactaattaccttctgtgcacgtgtccgagtagcatagatgtcttaccaaaccaatttgcatatgcactgtgcagaaacacgttggctggtccacgcatgcatgcatgttctcggtcttaacctaagtaaacagtgcgccgttgatctcggtatgaattgtgccgatgtgtccgaggacacctcgtcgggaacatgaccaactcatatttaatcaatctcacgtgccgtcgataccattggttttccgctgcgacaaaatcttgaactagggtcaatcttgatggttccgatctcgtcggggcacgtactctggtcgggttagacttctcggatccaaagtagttgaagtatccctcgtcaaaatatccatagtgacgatgacttggtgaagcttgacgaagatcccgatccatcggagaacgcacttcgctcaggtcgtatcacccaatatacgaagtcgttgagtagtttgctggcgaagaatccatctcttgaacccatctcgtcaaaatcctgaagcaccaaaatccccctacctggcgcgccactatc

SEQ ID NO: 36617 - DNA, 1501 bp, Oryza sativa
gggcatctagaagtagaaacgtcgtcgcaggtgtttgctgcgcgcgacgtagccatcgacgttgaactttgccgacttcatgtgtgccgtgcgtgcgtacgcgatgcgaggatcggacgcgcacatgaggtgagctccgttgcagcgcgcggcgcggcggaagagccgcgcgcgcgcgggagagggcaacccgttccgtgcagggcgaaaataggagggggatttttgtacgctcacggcattttttttgtcagcgaaaattcatgcaagttgatcacggcgacgaaattctccccttgtctcgatgagacgagagcaccatgtgcagaggaaaagaaaaattgcaaagccatcgattgctcttgctcttctggtttcatgagacgcgtgttgccattgctatgtccggttccagccctattactgtcagttcgcacagggtctccatcgggtttaaaaatgccatggtaaatccagaaaccaccttgtaaactcacaggtttcgaaagagtttaaactgaaattcaaatttccggcaaaatgcatccaaatcttaccagttttcatcgttaacgaccactcgggcgtggtattcgtttttggaaccctggtacatccatcgctccatctcattttcattgttcatctgtttgcatttaggccatctttggcaattggaataggtggcccataaaagacggcccgttattaaagcccatggtcctttgtcacgttggagaagacgcgccacggcccacgggctgtaaaaagtggggcccaaggtgaaggctcaccggtttcctaacgggtgcgacccatctaaaaatacaatgcatctcgattcttatcccttccgtcctcctttctcctcccccctccccggttcgacgcgcacatcgaaccccgacgaccaccaccgcccggccgccgccggcgccgacgcggtcgtcctctccggtaatccctgttaccctcctcgtattattcctcctcctcctcctcgccggtcaatctccgcgtcgtgtttcttctccgcgcgccacgatccttgccggcccccagccagctccgccgcgccggcggcggaggcggtccggcgtgctgccccggaatccctttacataccggaaactcctctcctcgcccacccccacactgcccagcccgattcctaactccggacggtggtcgtcgtcgccgccgccgggaaggttcctggtttgtgcctctttgtgggtaggatgcgttcgctcgttttggaattgtggggatagttttggaattgtggggatagcgagaggagaagctagtttggtattccgattcgtcttctcctcgtcacccgccttcttggaaaccccgcctcgcccgtccaaccaccaaccccgcacccccgcctcgccgcctgccgtccaccgccatgaaccaccttacggaatacgtatccatcaccgttggtgttcgaggtaacctgcaccaattcaattcgttatttggcggt

SEQ ID NO: 36618 - DNA, 173 bp, Oryza sativa
caaaagaaacaagacgtcgaaaccggacggcgcaatcaagattgttccactctccggtgccaaccccgacaagaccgtcaagatcggggcatcactaggcgagaaataggaactcgcgctcatcaccttcctccgcgacaatgctgacgtgttcgcttggtagccgtccgaca

SEQ ID NO: 36619 - DNA, 863 bp, Oryza sativa
aatccgtgtacttttgtttatgactagactgagccacaaactaagccttacccattagacatgtggaagtacggtagtgctttgcaacagaggcccgagctttagtccttatagtggccggggtgctacttcccacaactggcatgcacccaaaccccaccgaaaacaggttttaggggttttgaaagaggaagagaggtgtgtgtccaattccaacataagccaaccattccaaagtgtccaaatgatatgagaatttcccaaagtctatagttataaaaccacctaatgttgcctaattaaattgcgaagcatctacctagaattatactagggataccatgagtagagtgtccactagttggggttttgtttaatctagggtgaacaaggtaataataataacaataacaataataatatggtcataacaaaggtaaataggcatggctaagtaaaacagtgataacgcggggatttaaataaagcgataatgcaataatttaaatcaacataattttataaactgggattcaatatgatcaagatgatgtgtcttgccttgctcgttttcccaatcgacggcttcgacttcaatgaagagcggatcttccgaagctgcagcgtctacacgaccaacggaaaagaaaaaggctttaacactaaataactccacataacagcagaaacaaagcacaaaaatgggttctttacatcttaaggaaaaattagagacttgaacggtccaattccgagttcaaatggccaagatatggccatttgaagtttatatgctctttaaatggatatttacgaatttcttcatttaattttcaattaaaaattcggattattgcgtcagc

SEQ ID NO: 36620 - DNA, 541 bp, Oryza sativa
attcaaactgttcaagaaaacattatatagaaaaatgacaaaaaataaaacttatagaccttgatgagttatacaactttgttgttgatgacttttttagttgaaatcatttagtatatgaaaatgttatttgaagttgtcatattttcaaattcaaattcgaactgttcaaaaaaacgttatatagaaaaatgaccaaaataaaagttacagatcttcatgagttatacaactttgttgttgatgacttttttagttcaaatcatttcgtatttgaaaatattgttttgaagttgtcatattttcaaattcaaattcaaactattcaaaacaatgttatatagaaaaataccaaaataaaaataaaagttgtaaatattggtatgttatacaactttgttgttgatagttttttcatttgaaatcatttagtatttaaaaaattgtttgaagttgtcatattttcaaattcaaactcaaacttgtcagggttatgggtaaggtatatcctctacccttcaatatacgtcacatatcgata

SEQ ID NO: 36621 - DNA, 1501 bp, Oryza sativa
gtttaaatttgaattatacagctacttattttgacatggagggaaaatacttgtttggcactgcatcaccacaaatagacgaaggtcccgttctaaagctccaaatctaaactacaacttactcgttttttctgttagcatgtttatcaaattgcgtatttttgtgaaagtttttttatatagaagttatttttaaaaaaatacttctaagtttgactccctccgtcccacaatataagggattttgagtttttacttgtaacgtttgaccattcgtcttattcaaacttttttttgcaaatataaaaaacaaaaagttatgcataataaagtaagtcacaaataaaataaataataattttaaaaaaaattaaataagacgagtggtcaaacgttgcacgtaaaaactcaaattcccttatattatgggacggagggagtaacaattaatactcgattaattatatgctaatcacacatctaatttcacgtgacagcaaaactaacatctaaaagcgacgatcgaacgcagccgaagtcctgtactaagctagctccattgcatctgtatgacatgcatcctagttggtgggttagggcgcataccaactaccgacgagactagtgactctcgcactgaacataaaaatcctatttcctgttcccctgggcaaacatgttcccacttcccaggtgaaaaaaagccgattaatggcgttttgtatactccacgtagacgcatattacaagccaactatgagaaaaaaagaggccattgttatcagcttatcgctttgattcagatcgcataaaccgctcaacacacgtcaattacaactatgggcttttgatcgagaaaatcaccatctgttgccgtagttgacttccagttgggcatctgcgctgctaaccatctcaaattccgaatttgattcttaattaaggcgagctattcactacagacaggatgctctgacgaattgatgtgcatcgaaatccaagaaacggagcagtactaccgattaaagttagtgcctttctttgcggggagattaagttagtgataatcatcgaaaaacgcaaacacaagtactaaacgcgaaggaattaagaagactagcagagtgagtgaggggtgcaagtgcaacaagatctcgccgaccgacaggggcaatcctgtaatctacaaagctgcaattttcgtgtaaagagagaaataataaaaacggaaatatttctttcttcttcttctcacctaaatcgaccaaactaagcatccgtttagttacaccgtcactcgcaaatccgatggcgtgtggggcccacaagctctgaaatgcctcactgcccccactgtcagtgaccgtggaatctcttgctcggtcccacatggcagcgtcggcaagctcgcgctccctcgtacgacgcgcacatccacccgccgctttaaaccgcgcttctctttttttttttcttcgcacctaattttcttcgtcctctc

SEQ ID NO: 36622 - DNA, 1501 bp, Oryza sativa
aatttctgattcttgcaatgacggcacggacaaaagatctttgtcatattctccctcaaagcatgctccttagcctgatcaataaatttagatgcttccttaataaatatcggctgcgttctccgcatctcatacatccatgacgaccgatccatctaattatataaaggcaaaaaagttacagataaaaaaatagaccgcaggtatttcatacaaaagtttaaatgcatttgtctcccaaaaaaaatacaacaatacatgtaactagtatgtacaattgattacatgcaaaatttgcccatcaaaacatatattttgaagctagattttgcaaaaaatagttggaacaaaccttgtcaaaatattaaaaaaactccactttccaccaacgaaatataacaaaaatggagccaaatgaagcaagatagagagttcttcacctttcgtatagagttcaagtaaaaatttcgagttgaaaacctccccccctaattggtgcttgctttaggagagagaaagcttcgttttcaaatggtcaagctcgggcctggaggagcatatatggcggatcatcgcatgcggctaatcaacccgccccggggggggcggtttttgcaggcgccgccacaagcggcccgcatggaacctaccgaccccctcgtacagaaaaacgatttttgtagtagtggcagttgcgggaggaccccggcggcggacgacagcggcagacacgctcgatttttgtggttttttttggatttttgttttcgcgtgcggtcgaaatatgcaccgcacatttttcgcgagtggatacgccacccacatggaaaaattggattttcgcagacccttccgagcagacaggccgaaggtccgcacacgaaaaccttttttggcccgtctagaaaaaatatttttctactgatcggatatcccctcgtatatatttttcttccaaattccaaccaaatactttaaaagataccatttgaaaaaaaaatgtcgtcgatatataatgggagaagggttacacgcatggtccatccgtcgatggagacgtacgtacgtaggaggacaggaagctagggcatcaccatcgctggccagctgccagctgcggcgcatcatgcatgatcaacatgcttggccttatatatttcctttgcattttcctcatggacacagtacactagtagtcattaagccgtgaaacaatacttatgcacgggataaatgctactccattatttgacgtacaggtacaaaagcaagacttcaagggcatgcccgatgattcccctaggatccctttttaaatcaactgagctgtgacatacatatgtaaagtaagagatttactaagaaaaaccaaaataactagatcatgtatgagatttggttttacacagcacataagacatcatgagagatgattggtgttaaatagctttagaaaaatgtcattactattcacgatatcagctgagtgccactgaaattt

SEQ ID NO: 36623 - DNA, 166 bp, Oryza sativa
ccagcagaggcagcaaaaccagcaatgattcaaacaagtagtgttttgctaggccgaggaagaatttccatatcttaagtccatgcatgccgtcagcagagggcaaaacgtcgtgtggctggccaaatagcacagcagcaactgctgctttcttccttgttacagg

SEQ ID NO: 36624 - DNA, 1501 bp, Oryza sativa
tccacaataagcccactgttcggcttgcaagtgaagtagctcatgcttttctatttcttgaatagttagatgcaccagatcctagcctgcaaatttttcaggcagcataagaacttctcatgaattacagagaagtgctaatctatcggaagatacagaaactaacatagttcaatcgtgtcgagtggaaacatagtgaattttataatagaaaaaagggaatgctgggctccccaactccctctataaagcattaagcgatgaatatctacttatatataccaaatattgcaatgtagactttctaaaaaaacagatgaatttgaacccttctgtctaatcatacacatccccttccatataatgaggtaaggagattgtccagtgtgacatttgcaagcaagtcataaatactaactaacctgtgtacccaaccatccaatatggaaatcacataaaataagtgacgtcttattgaaaataagactgttataggagtaaatagaactctacaatagaaatgttgtcatgagaaaaactctggttactggacatgaggacacaaaactacaatactaatcacataatcccatcaactcattggtgccaaaactatgccacaaatcacaagcagaatgccagaccacatgcattcaacatgttggaatggacggcacaatgcacctgtctttcttgctatttcacacagagggacaccggacacggaaaatcacacctttttttcccaagcaagtccaactcaagaaccaaacttaagctgagggggtaaaccacagcgcaaggcaagcatctacctccaccaagaaagcaccgccaaataacgaattgaattggtgcaggttacctcgaacaccaacggtgatggatacgtattccgtaaggtggttcatggcggtggacggcaggcggcgaggcgggggtgcggggttggtggttggacgggcgaggcggggtttccaagaaggcgggtgacgaggagaagacgaatcggaataccaaactagcttctcctctcgctatccccacaattccaaaactatccccacaattccaaaacgagcgaacgcatcctacccacaaagaggcacaaaccaggaaccttcccggcggcggcgacgacgaccaccgtccggagttaggaatcgggctgggcagtgtgggggtgggcgaggagaggagtttccggtatgtaaagggattccggggcagcacgccggaccgcctccgccgccggcgcggcggagctggctgggggccggcaaggatcgtggcgcgcggagaagaaacacgacgcggagattgaccggcgaggaggaggaggaggaataatacgaggagggtaacagggattaccggagaggacgaccgcgtcggcgccggcggcggccgggcggtggtggtcgtcggggttcgatgtgcgcgtcgaaccggggaggggggaggagaaaggaggacggaagggataagaatcgagatgcat

SEQ ID NO: 36625 - DNA, 1501 bp, Oryza sativa
agcgcctggattcggctgatgacggtggaggctagatgcggcctcctcgaagctagcacgaggagaaggtgattatgcgacgcttggatccagcctccccagagctcgtgcaaggaggaggtggtgaagatggcggtgatgtcggccggggagcacgcgcgcctgaatctggcctccctggagctcacacgaggaggaggaggtgaagagaatatgacggtgacgcttggatatggcttccctagagctcgtgcaaggagcaggtggtgcagatggcactggcaatgatgccggccagggagcacgcacgcctggattcggcctccccggagctcgcatgaggaggagttgaagatggtgacggcatcggccggtgagcgcaccagggcagtggggggaggagcagtaggcgtggcagccgttcatcgaggaccagcaggcatgaccgaactatagggaggagaagagacgaagagaaggcaggagaggagaagagaaggaagaaggaagaagtcggaaggatttaaaatgtgacggtgatggcacggtttcaattttgaaaaatttcagtggcatctaaccgatatcgcgaatagtaatgatatttatctattatattattataatagctttgaaaggaggtatcacgttcacttgggggctagaaatttccacattaatcagagaaaaatgaaagaagaatccaagtaggaatacaatttaaaaataattgaaatttggaattaaaaataagcaatattgaaagaagagtccatataagaacccaatacaagattaattaaaattcagaataaaaataaaataaaataagaaattagaaaaatgaaaaaagttaaagtagaaataaaatttaaaaataacttagatttggaatttaaaataagagtccagataataattaacccaatatgaaattaattaaaattcggaataaaaaaataactaaaatacgaaattagaaaaaaataacgaagagttcatgtacgaatataatttaaaaataacggtaattcagaattataaataaccaacattgaaagaagagtccatagaagaaaccaatacgagattaattagaattcagaataaaaaataaaataaaatctgaaattagaaaaattaaaagtagagttcaagtaggaataccattttgaaacaacataaagtggaaaagaaaataagaaatataaaaataatagtccgtataaaacacagtacgagatcaagtaaaattcgaaataaaaaacaaattgaaattagaaaaagaaaaataacattttaactaggaatacaatttataaataaataaattgctaatagaaaaataaagactattgaaagaagagaccatctagaacccacgatgagattaattaaaattctgaataaaaataaaaaaattcaaaaaatataaaaacaattataaaagttcaagtaggaatataatttataaaaaaaatatatcggaataaaaaataca

SEQ ID NO: 36626 - DNA, 1501 bp, Oryza sativa
acgggataaagcggcggctaggtttaagcggcacacggctacaacacggcacagcagcgacggcacagcacgacagcaaggcgcagcagcggcagcgactcaacaacgacttagcaagacggctaccgagcggtagcaatggctctgctaagccaggaacgcggcagcggtagcgatgcacgacagcggcgcggcgactgcagtacgtgcactagggcagcggctacgcggcggctagcagcggacaacagcgggtgcggtgcacggcaatgaccggctcgacgctagggccaaataagattagattaaattggattaagtccctagggataaactacaccggtaaatgacatgggagagaggagagctcaccggagaagacgacggcgacgaccaagatgacgacggcgaggggtgacggctagcggcggcggcgagctagggcagcggcggctagggtgctggaggaggcggctaaacaggaggaggaggaggctaggggcggctgcaacacaaaaaaaaacaggaaacaggaggggagaggacggcttatataggggaagattgaataggattaggtggggccaagggaggcacggcagaggggggaggggagggaaggcgtgcgcggctgggagaggggagaggcgcacggctgggaggaggccgagaggaggaagggaaaaagatacgggaggagaaggttgcctagaaaggaaaggtgggggaaacagatgcggtgccgttttgggaaaggaagaggaaacgaaaccagaaagagaataggactcggctcgtcatacaaaacgaaaccgcggtggcaaaaggggtcggcggatacgatgaaccgcggacggggagagtgaaccgggaaggattgacaaccaaaggaaggaaaggaaagaattattaattaattttccaattaaattaatcactgaatgatctttcaattgttaaaaatacttccaatgctcaaataatttcaagaaaaatcctgaaaatacttggacactcaaagtacttaacaagattataatcagaccatttaatgattaatttaatttgtgggtaattactgaaatgttctttgtatgattaaaattaggaattgagctccgaaaaatccgagaaaatttcagagagtataattaaccacggagaatttaataaaaattaaatccagccatgctttatatttaggaaattttatttcccacatttaacttcacatgtaaattaatgaacatttaatataaattctaataataatttataaatcctaaaacgaaaatcaggatgtgacagcggatcaaaccccggacaagagtagagtattacttcttattaagaaggtttgaacttgtataaacttccttgtctccaaacccatccacttttctagcttgatagccacccccttttagtattgccgaaatcttgtttcgacaattggtgcgccaggtaggggtagcgtcaagttttttgccaactagtgcga

SEQ ID NO: 36627 - DNA, 1501 bp, Oryza sativa
cgtcgttggtctggaggaagagcttggccatctcgacggaggagccgacgacgacggggcaggagccgaaccagagctgcacgatggggccatggcgcttggatatctcgtggatggagcggtgcggcagcgagctgatgaggttcaggttgccgatgatcggccatggctttggtcctggtggcagcttgtaagctcggcggcggcggagcagaacggcccggaggaggaagacgacggtggcaagcacgacggcaaagaaagtagcccatgatgattgtagttccattacttattggtgattgctgttaatgggtatatagatcgatgttaggcagcgcaatgaaaatataaaagggttagaagaaaacatatcacacaaacttcacgtgcacacttcgtgcacagttgcacaataactagcaaatgccacgaaaaattctataaaaaattgaatatttactcataatagtattacacatatatgcaaagtctcatattcaataattatgttttaaccgtaacaaaaaaattgaaaactttgacaggtaatagtaaaattctatcaggattatatcctttttaaggcaaaaatataatggattcgaaaataagatttcacatgtaggtgtaatattatttgaagtatgtttataatattatctaaattttttacgacatttgctagttggtgtgcacagagtttgcacggaaaacttgtgtgcatataatatattccttggttagaaagggttgtagtacctccgtcttaaaataacttcatttttcattgatttcacacactctaataaaaaacatatgccttttcacttaatcaaactccaatgtaaatgtccactttatctagccataatatatttgttcttaacctttatgaaatccaatacgtacaatagttgcttaaaatataagcttattttgatataatttactccctctgtcccgttttaagtgcagccatgatttttcgtgcccaactttgatcgtccgtcttatttaaaaaaattttgaaaaaaattaaaaacatatgtcatgcataaagtattatttataatttatcatctcataacaataaaaatactaattataaaaaaaatgtaaataagataagcatttaaagttggacacggaaactcctggtttcatttaaaatgagacggatggggtagatgctaaaaatggagttgttttgtgatggagagagtaagtatttagggggataggaattaagttggggatggattttaatccctaaggggatgtcccctcgtatatatttttcttccaaattccaaccaaatactttaaagaaaaccatttgaaaaaaaaaatgacgtcgatgtataatgggaaagggggtacacgcttggtccatccgtccatggagacgtacgtagggggacacgaagctagggcatcaccatcactggccagctgccagctgccagctgcatgcggcacatcctgaccaacatggctt

SEQ ID NO: 36628 - DNA, 1501 bp, Oryza sativa
cttattacaggcccagtcactgaatgaactctctggggctttagataacagaaccctcactctaacagcaaaggagcaagaagcaaagatcaagaaactcgaacaggatctcaaagtgcaagagacaaagctgaagaaacttgaaagcgagtttaagtcagggaaagtgtgaatacatccttcggccatcccggctaaaaagaagtgtgaatgcgtgatgttgtgattatagtgttactgtaaaaaaccagggcgtcatactttagtagctgtaaataataattagcacctccttacagtttaccatacttctgtgtgttgttcatgtacgataagaaaataaggtttagaaaagtcagcttctcttgaattcttttgttagtttgaagtaacagtgtttgatcttttctgtatcatgcagtaagtacatatatattgtggagatgaagttcatttggatcatctgccatcttcttcaatgtgctggaagtatctgtcggtgggaactacacatgggtttacaactacagtttttcatgttaaagatattgcctcaatttcatgactggcttggttgtttgactcttcttttaggacatagtcacaggcagcttccaaaatcttgcaaacctctctcctgtactgcaacatatcatgtcaagaagaaaccattaaatcctgtttttggaggggaaacaaaatctttaaagtgtctctgttaccatatggttgcataattagagggctttgtggtacagagtgccctagaatcaattgttatcacccatttgtcttgcatctaatttttcagtggtggtgactgcttttccacggcattaagatcaaggagttcttaagtctgggaactttggtgactggtgaaatcattttacgaagtgacacaggaggttagaattctgaactattgttcatccctttttttatgccatagagttgtgaaatttgaagtagaataatgtgttcctagtctcatattcattttaggccaccttaagatagtattagcatacctcatcagttgctccagactttattttggattgcaaaatgcaccatttcttcatgtttactcctataatgtgcataagcataatgtaatatttaacagaaacatcttttgctagcaaaagtttagcttaatacaatgtatagccaacttaccaatctttatatcaacttgacatgttgaactggaggttgttcttagatgccacctgcagtggatctatgaccaaggtatcaatggcaattcctctctcaggaaaaataattacatcttactgggaagagtgaatattttgtggttttatacagagaaagaaatggttaaagacgggccacttggtctcctcttcattagcattagtatctattgtgcaaaatgagtactttactatattaacttcttagacaatagaaaagattgctgaaaagacatagaaacggagaagcaagtaacaagttctcacaaaattactac

SEQ ID NO: 36629 - DNA, 246 bp, Oryza sativa
aataagttcgctttgggtctctcatgttgatgtgcttcaattacatccctaaatcacaaagtacaatgcatccctaagacaatatagcaggcggttttgaatgacatgacgctaacgtaccttgtgccttggcctccggtcaccaccgcacctgccctgcttgctgtacaccgccattgctaataatttcatccacctctactccccgtccgttggcgcccacttccgcgtgcccctcctcacaga

SEQ ID NO: 36630 - DNA, 1501 bp, Oryza sativa
actggtgaaatcattttacgaagtgacacaggaggttagaattctgaactattgttcatccctttttttatgccatagagttgtgaaatttgaagtagaataatgtgttcctagtctcatattcattttaggccaccttaagatagtattagcatacctcatcagttgctccagactttattttggattgcaaaatgcaccatttcttcatgtttactcctataatgtgcataagcataatgtaatatttaacagaaacatcttttgctagcaaaagtttagcttaatacaatgtatagccaacttaccaatctttatatcaacttgacatgttgaactggaggttgttcttagatgccacctgcagtggatctatgaccaaggtatcaatggcaattcctctctcaggaaaaataattacatcttactgggaagagtgaatattttgtggttttatacagagaaagaaatggttaaagacgggccacttggtctcctcttcattagcattagtatctattgtgcaaaatgagtactttactatattaacttcttagacaatagaaaagattgctgaaaagacatagaaacggagaagcaagtaacaagttctcacaaaattactactttcctgaccaaacaatctttctaatatttcaaattttctatttctatttgttcgtgttgtcaataatggtggcaaatacctcaaagtaagaaccaaatggaacatcatgtgcctgatgctttgtctcatagatctgaaatgagatagtaagtcataatttcattaaagaagaaaaatcaagaaaacctgattcacagtggacctatctgttactaatttaatcttaccagatttgttttgttctttgagaaagaagcacgttgccattctgtcactgcagtatctgggggacataaaggactgtggcatagagacctgaacatcacttcgcggatcttgccgccatactcatctgaggggtaccacttgctaagctagagaatgaaaaatcaaaacactataaattaaaaaaatgttggttatgctaccagtcactagattaacacatccaaggattgacatagcaaatagaacatgcgattggtgctactgacaaaataggaacctttaaatctgtatcttttcttccatgtcgatactgctggaaaaacattgaattgtcacctaatatgatactgaagaacttctcagatgtgccagggaaggttttctgatggacaatgtcatgttgaaaattaggggggaaagggataacaaattgtgcattgaatatgtaggaaaacaacttgggatgctcacactggttgcatctacaagaacatgttcattgatgaaaggttggaatgcttttgcttgttcaatgcttctttctgctgtctttaggtcatctattttgctacagatgacatcgctgcttcttctttgttgaagtgaatgcattctgacctgtttgtaggaaagcattacagatgc

SEQ ID NO: 36631 - DNA, 1501 bp, Oryza sativa
tagtagggtttcatttgcaaaagcagcatttagcaaacatttgagaattataaaacagttaagtgataattaaacaatattaatccaacactatacaacataccctgttgcataggcccaaccattctgaacaaccaccccggctgcacagttctatctccaaaccaggaatataccattccaaaccaggagctaatcaaattattaccagttaaagcaccttttattatgatgagaagggtgagactaatcacgaaagacattgttagacccgcccataaccgcgggcacggctattcgaatagttttactctgatcagaggtgtaccactgtacccacaagacacaaccccacatcttgtcaccatgtgcctcaataccaccacggtacctcggaaaggagttgtgacaataccccttgcataacacaatccaccgcagcgcacctttcctggatcataatcacccccttataaacaaggcatggactccccagcgacccccgtgggcttatctccgccacttctcagtctggtgccccgcaatgaaccatgctatacaaaaggtaaagccgttgcccatgctggcttgtggttggcacggttaatgtttcacaaccaaaactcgtgaactggtccttaattgtcatgagcacgaccatcaaaaccatgtgctcacaacccaccattatcaggttttagttggcaaataattaattaacaaatcacgattgaccatcgtgaactatcattaagccatcattaaataatagtgagtcataagttatcccaataatgtgctaatgtttctaagcagggctaagcaattatatctaatatctagctgaactaatataaataaagctcaactagtcaaattataataacccaaggtatcaaggaataagataatcaagaacaaaagggctataacaaacaataggttaattccacccaatgacattcgaaaataaatgcaatagttgaatagaaacaatagctttaaataggatcaacatgctcaaagggttgtttgggatctgtgtgacttgccttgctggccttggaactcttcaaactcttctccggcgaaaacggactctccggaaacgacggaatctaagcagaaaagagcaaaatcaccaaaacagcacataaacaatcatgaacagtacatgtggatatttttaatatgtagatctcaattttagaaaaatttagagacttgaaccaactaaatcggagctaagatgaactagttatgaatttttgaagattaaatcggattaaaacacttaaattgattttaattgaattatgacgcaataatgaattatttttgaaaaaggaaaaagggatttattgcgtcagcgggctagggtttcgcggtggaccgggcgcacggcggcggttcacgcgaacggacggccgagatcgacttgatccaaaacggacggccgagatcgatcggtccacgaccggctcacgggagagggcgacga

SEQ ID NO: 36632 - DNA, 698 bp, Oryza sativa
attcctgcagccctaaaattagaagtttgattgaaattgaaatgatacgacggaaaagttgaaagtttatgtgtgtaggaaagttttgatgtaatagacaagttagaagtttgaataaataatttggaactaaactcggcctcggtggctttgttgcccccagcaccaccctatactagagcctcgccgtcggcccaacagtattgacagtgcaaccattgcattatatagtcaccttctatcttcacatttcatcactcgggcaccggcctgcattacattggcctctcttttgatttcacacatgtatttatttttcatcggacatggattgtggcttaaaaccgtgcccacgggtacaaaatgatgaaacatcagttctttatcatgttataggatatataattgatagctagctagaaaacaaaagtggcattcaaacaaaagtggtgcaggacccggtgttagatgagattgacatgtgggcccgagtggtatttgggaataaaatttaggagagtggcatctgaacactggtattttggtagagtgacaaatagtaaattctcccgaagggaaggaggggggataaagtagtagagacagtagcgggacttagtctttcatgtaacaatagaattggagtgggcccatctatttcgggcaattaaaaatcgtaaaatagaccgacaacaaaa

SEQ ID NO: 36633 - DNA, 1501 bp, Oryza sativa
cttcaatttgccgctctcgatcatgaacttacaagctcttcattctttctgcttcgtcgatctagccgtcccaattgttcaattgtttgcgtgaaatttccatgattcaaacattctagatcagtgctatttgcgactgtgttaatgtcttgtccataatattgggcattggccattcctgtccaatcactacagtacatgtaggtctgtttggatagggctaaaatttttagtccctgtcacatcggatgtttgacactaattagacgtattaaatatagattaatgataaaactcattccataactctagactaattcgcgagacgaatctattaagcctaattaatccatggttaggctatgtgatgctagagtaaacatgtactaattatggattaattaggctttaaaaaattgtctcacgaattagctctcatttacgtaactagttttataagtagtttatgtttaatactctaaattagtatctaaatatttgatgtgacaaagattaaagtttagtccataaatgcaaacattgacaccgaatatttgctttgctgaggaacagagaataatggtgtagaagtatcgtagtggcaggcttgcaacaatgcaactattacatgggaaaagcatgcagagtgcccattccagaacaacctacgcacttaacagagtaacgtactgagcggcaaaaagccagcactgtagcaaaatacgacaacaacgcccagtccacagttccacacaacactgcgccccgaatcgcgaggtgtagctagcatgtgttcttttaccccttttccaacttctactttttatttcagaaaaaaatgtttcccaaaccactaaatagtatattttgttaattaaaaagtatataaaaattatatcaatccattttcagttttttagctaatacttaagcagtgtgggtttctaacccctcaacataacacaacattaaaaatcaaaatactggcacctacaaagctgaaagtgaacaggacaaatagtgtccgtgtaacaacaatcagttatcaactatggaagggtgcgtccgagcatgcatatgccagcacgtactattacataggccgagtttagttccaaattttttcttcaaacttccaacttttctatcacatcaaaacttttctacacataaacttttaacttttccatcacatcgttccaatttcaaccaaacttccaattttagcgtgaactaaatacagccatattctctatatcaaaaattttgccctctaatcattgtagccttgtgcctttcggctccccgggccgagcgtgtccttccgctcgctctctcgcctttggcaatctcactagctagtcagtggtagcgtgatcaccaaccgcgcggttgcaccacgctacgcttgggctttggctcgctttaaatgcgtgcagcgccccgcacgaaccgagctttggtttttgcctcgaggagtttgccatggaggctgcggggc

SEQ ID NO: 36634 - DNA, 1501 bp, Oryza sativa
ccctgctcctgcgattggatcctgcgccggtgatgctgaggcttggatgacggtaatcatgagatcggaagtgtgggacccggctgccagtcggcgtgtggatgctttcagagttaactgggactgaagccgcaatcatggtcttcgtctggttcaagatgttgacgacgtgattagattgattgagctcgttttccttgaggacggtgtcgaggagagtgatcgcggcaaccgtgttctgctgaggggtgcggaaaaccggtgtcccttcaacatcttgttggccgatgagatcacgcgctcggcgccctgcttccaaagctcgctgccgtcgatcctcagcctccttcactgtccgctcacgctcctgctgctcacgccgtagtcgttcttgtccttgtgcttgatgctcctcctccagtcggcgacgctcagtttcgcgacgtgcttcggtctcccgggcttggcgttgctcctccgtctcgttttcggccatgaagacgccgaagtagagaggggtgtagttgtcatctaggcttccgtcgaagtcgtcgagatccgggtcgttgtagcgagagctaaactcgtcatactccacggtgtcggtggggcgcgagtcgacggtgggagagctgtagtagccatccagctgatccgtcgaaaccgtgccgagtggttggaggatgacgccgacttccctgaagctaggcgaaatcggtgttgaagccgacttccgcctaggcctacgggatagagacgctgtcgtgatggagatggccgccaaatcgtcggggagcctcatcaggatcggtgggtaagccccatcatcttgatctggtgacgttggagaagatgcgatctcgcccgagtggtttgaagccgactcggttgagatggtcttgaagtaactttcagccgtgtttgggagtccaaacgggactgaaatccggttctctcccggctggtttgactccgagtcaaggagagagatcttgccgaagttgttggtgacgaagtcgaggctgccgaaccgaaacgtctgcccggatgggaagacgaggtcgtcgatgccggagacgaaacccattgcactgatcggcgaaaagcttgacgctacccctacctggcgcgccaactgtcgaaactagatttcggcaataataaaagggggtggctatcaagctggaaaagtgtatgggtttggagacaaaggatttatacaggttcaggccttcttattgaagaagtaataccctattcctgtccggggatgaatccgccgagtgtcttattgattatatgatttggagaaaatcaacctctgcccctagaggcacccggacccccctatatatgggaaggagtccgtgttacaaaagataatctatatccctaacggaataggcagatacagataaaatacagtcgtagccgactaagtctcaaggtatttccttgatgtacaagttgagaaacaaacccgagacacaaataagatatt

SEQ ID NO: 36635 - DNA, 1501 bp, Oryza sativa
catacttaaataaataaattatcttcagcgtcaaaaaggaacaaaaaaaagtgttcttccaaccttagaacgtgacaaagacaacgaaaagaaaaatcaatatgttcttttcagctttgaggttatcaccaaagctttccaaggatgacaagccgggatgaactttgcgtccaaaaagcaggtccaaaaaatccaaaccttttatcctggccccgtctgcaatccacttctccccctcttttgcctctgcctcagactattcattcgatggccagcgagtaataagattcgctttctgctatcctcttctgcttctgcacacttctttgcatgtgaacccaagctcacgcacgctgacagttcatacagctactgtaaaaaaaaagtttccacctggggccaatactttatacggactcacagtagtacttgtgagtagaacaaatggtctaaattgttcattgattctgttatagattgcttaagccagcagcaagaaagagtactggtaagcaggccaaatatgtggctggtttcttgttttttccctgtaatttgtacatagattaatgtttccttgcaaaacttgtgcctgcattcttggttcttgccataatttctttgggagcggatgagaggagatgagacaaggtcgtccttgctggaccgtgtctttactgctatgatctttgctggttgaggcagatgtggtggatggcttctcttgaagaggtcttgggttcacatggccattgcttgcctcctcctttctccgtgacgtcttcttcctgtggggttcttccctttggagcttggcccctacctactcaggacaagcgtgtagatgcaggcgtgaatagcctttgcctgtgctcccatgtcaatcaagtgttctgtgctagattggtcccagagatggtgcctctctggtgctaatttctcttgagggtgtttctggtttggattactgagttaatgacgccatggctgggcagagtaggatgaggtttcttgcttcttcctctcttgagtttgttcttgggtaattaatccttttcctgggagcaacttgtgagttgtgactgtttcttggtttcctccgccttggttttaccccctttttttgcgttttttcgaggcatcgatttctgagccggataagtagttgagctgctggtggctgaattattaacagtccaattaattgctgacatcccaagatgggcagttcttgataaccccagtaatttaatcgctcggtttagtagctctggtttcaattgctcccacatggagtaacaattcattagttagagggatttagagctgaaacttcttctcaaaatcgcagttcttggttgttgatttccctctgttcatcgtggaaacgtgttaagctcaagttcttgcaatttttctttgctttttttttttgttttgtagaggaaaatttcttgattaggagatagtacaaggttggtggctatggaggaggaatccc

SEQ ID NO: 36636 - DNA, 1501 bp, Oryza sativa
tgaattctaatagagaacctccacccgaagttggcaaatagatacataattgtcgtctcaagtttacgacattcatcatttattagcttgatatcttcatcatgcctttgcaactgagcccaaccctgaagccaatacattgccctgaaaagcacctgcaaataggattttgatggtgttttatcaaaaaccatatcatttctactaagccaaagagcccaacatatagcggaagctccaacaagaataagttttttgatttttttactaacacccacaagccaattcccaaacatatgagatatactatgtggaggataaagtccaaaagagaattgtatagctctccaaagaaatttagaaaaaaggactcaaagaatagaatacatataatctacggcgttattagatagacaaaacaaactgcccatgtattttctctaacttgatttttggatgagatttacaccaatatttagcttgataatgatcgaattcacattctctatatgctctgatcaaatccagtaaaaatctgcaggagtgcactcacgttcaaattgctctaatcagacgaaaacttaatcatgttgttggcagtttggcaccattcaggactaactgatcaattaatcattcttaagtaattttgttcatcatatataatgtctctaccgtgttccttagagaaatatatgtattttaagaatttaagcacagttgactttttttttggtgtgttccggtgtatatggaatggagttagtaatatcctacccaaaatagtattgatcggtgaattaatttacagcgctagaaatcttgatggatttttcttgcgctcgtgtttgagttttgatgactccagaacgatttggaaacattaacctgatacccaattttcttgtaaccaaattcacacggacgccaaattaacccaaagaaaaaagaaagaaagaaacgctttcgtaagtcgatatactaattcaggactataaacaatcaactaatcatcattaagaaattacagctatccgttaatcccatcaggaattcgggacagagtcggagaccaaaataggaaaggaacacaacctaattccaggtttttttttttacagcctagtacgagttcacaccgattcgcttggttcaaatcaaatatatcagatcaatacgatcccgattcggaattgcgcgcgaagcctggcctgaatcggatcgaacacccatggtggcagccaggataagaggcgaggagcgcagcgcgacaccatcaccatcgcctcgccgccagtcgccaccagcgtgtgcaagtttcttcttccaccactagcctccgctctcccagtctcccacactgctccggcgagcgagcgagagcggccatggattcgatcatggagccctacgtcgccgaccttctcgctgacgacataacggcctcgatggtcgagctcttgcccggcgacggcggcgcggcgcaaatggatgtcggggt

SEQ ID NO: 36637 - DNA, 1501 bp, Oryza sativa
atggcgatggcgacggcctcctccgtcgtgatcagccgtgtcgaaactagatttcggcaataataaaagggggtggctatcaagctggaaaagtgtatgggtttggagacaaaggatttatacaggttcaggccttcttattgaagaagtaataccctattcctgtccggggatgaatccgccgagtgtcttattgattatatgatttggagaaaatcaacctctgcccctagaggcacccggaccccccttatatatgggaaggagtccgtgttacaaaagataatctatatccctaacggaataggcagatacagataaaatacagtcgtagccgactaagtctcaaggtatttccttgatgtacaagttgagaaacaaacccgagacacaaataagatattctatctatatttggtatcctgtattcagtccaaataccatcgccgtgtagatatgggatatccataatctccacagtagcccccacgacctttgcagtcaaccatcatagccttctcaaagataatgatccgagtgcttcaaacttctcatgccaaggcctgccgagtggcgaagacaaagactgtaaagggcgaaaagacaaagaatatggtgcatcgaatagatgcacctaattaggtgtagcccccaactatgtgattagttaacaaactaaacatatagtcgagaacaaaataatagcacaatcgtgcgtcatatgacaaaagcatacgcggcgcctaaagaggcattttagccgactgctttttagccataataaaaggaatccgagtggttaacactctaaaaggttcacgaatgaacacacttgacaggcatccgaataaaaactctaaagattacccaccaaatattataaaaattatggtaatgaataagtctaatagcctaggctatgactattcaccataaagaaagcaggcatataacataccaaggaaatgactatggtaaaaacaagtcattccaagttaacccaaacagcttttgtagcctaataaagctgacaaaaaacagtataacacctttctgtcgggcaccttttaatttgcattgcaataattccaaagaattatatgaccgcataaaaaggattttatcagcattgggcaacactattgtgcgcataaattgccaaagcaaaaaaaatgcctaagtccctaaggaacacaatgggccacgctgtcaaaagtattgggctgaggtactgttcaggcctaagcccatttgcacctccgatacccttaacaagaaatcccgagatccaagcgtcacttcgtcttccccgccggaactctcgccattttccccactccctgctacagtacagagctgcgccggcaaactagggttcaccattccactcgaatccaccttcaaaaagttcatcaaaatccttcccgtgatccaccgcctcaatccctcacctctccctagccatccctcgaatcaaatcagtgcattcgggtaaaatcga

SEQ ID NO: 36638 - DNA, 1501 bp, Oryza sativa
tgtgatcctgtagctgaatttggccccgtactaacttgattaagatacaaaattttcctcgatttccttgattaagattcagctttttggtgttcagttcatttctgaattctacttcagtttatacatgagctgtaagatgatgaaatgtttctgggaatgacatgtcctcctttattttggatccatcaagaccgctgctccttgtcactctgaacaagcatctgaataagcatcaagaacgaaacaggacagcattgagaacattggaatttaacaggagccatttcagagaaaaatatcatagagcatttcagattggatgatttgggattcaaaagaatttctcttagaccaagatttattgcctcccatgccaatgccaattcgttgatcttggcacaaatccaatcgaagacgacgagcgcacgctcgattgcacgggtgttgccactgctgacaatgttggctgcggcgagcaggactacgatgctagggataccggacagtggacagctcgtggcggctctcactggacttggcgaagaagatgagcacatccgcgacgcgggcagagtcggtgagcgcgggcgcccgcccgcttgcacacacgatgcgatgcatgttctccgctagcttgcagagctcgtacaacgccgctgcggagaaaccactttagccattgtactgccacggttcaaaatttcggatcgaaatttcagttctattggatctcccagtatgatattattttggctgaaattttttatttatttcatcttttcatgaatttagtaacattttgtttaaatttgtatcaaattttatttaaaaattcatataatttcgggctgaaattttcaaaattgcgatattacggccaccccgctaaaaatgatcaaaccgaaagattaaacactgactaccactagatctagccatggtggaggtcaggacgacgacatcgcctgggaggcggaaccggctgcggtgcgcaatggtagcggaggaggagaattcaacggcgccatcggaggataggggcaaagtcggtacacaatgtgtcatacataaatgatttgccctgcaacgtcatacattttgaatcgttttagtttaacttgtagcgtcatacataatagaatagaggtagtactacgcttacgttttgcctgagatttacctgaactcgcttaacgcacttttaccattgtccaggaaactcctttaacggatttgttgtttcaactgcgacataattttgggctcctatctttcactttttcatccgtaggattttgcatcaaaatttgtgctcttctatatccaacttgcagttacacttaattacatagctcttacactcaattacagtacaccaaaattagattttgcaacattttttttctttatatttacgattttttacatgcttgtcttttttttatgttatttcacttaaaacgagctacattgattggttgaaaattctacaaaaatc

SEQ ID NO: 36639 - DNA, 296 bp, Oryza sativa
ggttaagtatgttatttccatgaaaggtgattctgagatgctacaaatcttgaattgtacatatgtggaatcaacaatgaagagcataaattgcacatgcagaaaaatggatcgtgaatgcctcccatgtgagcatatggttgcaattatgcatcatttgaagctcgatgccattcctgaagcatgcatagtgcgtaggtggacaattaaagcgaaacacatgtttccttctgataggtatggcgaagtatatacatggtcaaaccagatggagagatatcacaggttgcgtagca

SEQ ID NO: 36640 - DNA, 1501 bp, Oryza sativa
taaattaaaaagaaaaccaaaatatatgttcatacaacaaatgagaaaattatactcctaatttttgcgacgtgaaataaaaatgcatgtcacgtgcagaccgctataatgatgcggatatataaacacgcacgcgccaaataagagagggccagatgtcagtgagaggatacacgcgctctctctcactcaataaccaggcaattaaaaggctaactggagtaataaagattagaatgataacaataaatgggaaagcatgtaacgaccaggggcatgaccggtctgctcatgttcaccccactacctgcacgcacgttgccacattcatccagtcaaaatgaagggacccacatgtaagccaaagaaaggtgtatgctgttgagtccatttcccacgatctgcccacggatgcgcgcgggactctgttctaaaccacgaaaagctggttaaccccctagcggcaaaggaagttccaggggagattagcgtagaggctaggtgctgttcgtaggctttgcagaagcgctgcttgttgctaggcaatactgctgccgttccgctttgctcctatgccatctcgtcagcctctgcttcctcgctccactgtgctggaagatcagaggtgtttaaggtgggaatcatgctcctccttcgttattaggctcgttcattgtgtgcgagtcaaagaatctctcggttctcgttcttctgctcacgttgatgtattcttttgctatgttgttcggttcggctaatgagtacgaaccaggaagtcatcttcttgccatattcttaggcttgaccaccatgagtacaagccaaaggaatttttcgtcttttgttatgtccttcgtctcaaccaatgcatatgagacaagaaagttcgttttatttgatggcttttaacataatttcacacttttttctatggttcggccagatgagtatgggtctaggagtggcttctatgcacgttttttttcatgttatcctaccataccctctgatttggtctcgttagtggatacaagcctagacgagattctcgctctcaggttcggtcccctacgaatggatacaaatcacggatacaaacatgaaatttgcatacactactacaaaatcgatttttcatggcgttgactttttgttttctctagcggccataagtggaaaccgttagcgaaattttaacgagggatgaggcgttaaggaccgtcagcgaaaatggatcttcgctggcggctgggttaagagtaccgcttgtaaaaataggggactttttataagcggacctcttaagtgattttcgctggcggttactaaggacctccgacagcaaaaagtacatactcatagagagcagcgcttgcaaaaaaaaatcaaccgcgttattaaaaacccccacagcccacaacccaccacccaccgcatccctctcctctcccagtcgcctccctctcctcttctcccatacacggccgtctccctctcctct

SEQ ID NO: 36641 - DNA, 203 bp, Oryza sativa
accaccaaggctccatcgcgctaatcccgcggtggctcccctaatcacgataacgccgccgccgcgcctttgaacgttgttgcgccatccgtcatcatccgcacttccgccgccgtcgtcaccgcaatcagtatcctggtggtccagggtttccaccagtgccgctgccccgtctcgccctggttgtgcatcctcccaccagc

SEQ ID NO: 36642 - DNA, 1501 bp, Oryza sativa
aggttcatagggctgaagttgcgccattctaaaaagcggcaagttatgtgttgctcgagaagagccagcatctgtcatctacaaatgaaaaaaatatatcggaatatgtatataggtgcagcctaaatatacaatgaggaagaaaaggtattgttagacaagtttgacatgcaaatctaattaacaacccggattggctgcgtaacatatcacaaaatttccgggaaccccgattatacgagcaactcattctatacaaatgtggttaaagaaagttatatgtatctatcaacctgtaaaaaaaatgaatgactgaaagagggtgaagaaaatctctctgtaccttcctcttgccacacctaaatcaccaatcacccgctgaaattaagacttggtaggtttcgggcatgtgtgcatagggaagaaacccaaatggaattaattaatggaggaatgaaagccaacaataatagtaaaaaggaaacaaaaaaaaagatcgccagttcagtatgcaagatcaaatcaaggtcttacctttgatgctgtcattgatgaagtctctcctcaaatccttgcacagaagaggagaaagagggagaagactggagtagtagatgagttcaacgaacaagtgcctcactgcccctagccatagggaacgtggccaaataatcggagagatgctccttaattttctcaacaatctttcaaacaacgggcacatcgatagttgtgaggataaacttcacatgcatcatgtccctacgaatccaaaattatgtttcgagctccggatgcaaaaccaaaattttggcaagggggcatttgttgacactgattttggctcgtatcttaaataagatgtattaaattataaactaatatataatctcaaacataatgtaaaaaaataaataaacaaaaataggaataaacagtcaaaacagtcaaatgaataaataaaataaaatggcgaccaaaaatatatggccgcaatataaaaataaaatccgctcggtcagagtgaaatgatttccggcgcaaatagaaatgcgtatgcgcgtgccatataaaaataaattagcatcttggaaacacgttcaaaaaattaaaaaacgtgaacaaatattttttacgtgcttttcatcggaccgacgaacgctgatacttagctttctggtcgtgtgcacatatgaaattcgtgctataataaaagagatcgtataaatatattgagactacgattattcgctaagtacacacctggcctaaaacatatggccgtggaataggatttttcccactcacccaaaatagtcatgtcctaaatattttcaggaaaggtgtacgcaccatataaaatagttttagactacggtcatccaataaattaaaaagaaaaccaaaatatatgttcatacaacaaatgagaaaattatactcctaatttttgcgacgtgaaataaaaatgcatgtcacgtgcagaccgctataatgatgc

SEQ ID NO: 36643 - DNA, 1501 bp, Oryza sativa
ctgaaccctcatcgttcatgtccgtgcaacgaagtattgcactcatgctagccctagctttgtctctcctaccaactaccggcgatgtcgcaggctggcactgtcggcctccttgaaccaccggtgccggagtgcttgcgccaccgtcatcctcttctccgggttgcacgtcagaagtccactcaacacctcgaacccagcctccgacaatggcggccggcggagcatcctggcgtcggccggagatgggaagaagccacgaagaaagctgtccggcccgcatcctcccagcagccgctgccccttgtagcctcgccaccgcttgatgtcgttcacgccgaggacgtcgacgatctcgccgagctgctccctgtccgagctcccgcggaacagcggcttccgggcgaggagctccgccatgatgcagccgagcgaccacgcgtcgacgcgctcgtcgtagtccgtcgacccgaggaggatctccggcgcgcagtaccaccgcgtgccgatcgggttggagtagggcggcggtgaggcggtgctctgcgacaggccgaggtcgcagatcttgaggttgccgcgcgcgtcgacgaggacgttgtccggcttgaggtcccggtgcatgaggccggcgtcgtgcatcctcttggcgccggagagcagctgccgcatggcgacgcggacctcgagctccgaccgccgcgtcctcccgccccgctcgcgcctcaagacttgacgcagcgtcggccccacgaactccatgacgaggacggcctcgccatcgtcgcatcggccgtgcgcgcgaggctgcacgatgtaggggtggcccctgcacacctccatggcggcgacctcgcggtcgaagtcggagcggtcgacgagctccccgcagtcgtctcggtacgagcggatgcacttcatggcgacgatctcgccggagcggcagtcgcgcgcgcggtagacgacgccgcatcctcccgaggcgagctcgtcgagcttgacgaagcggcttgtggagattatggatatcccatatctacacggcgatggtatttgggctgaatacaggataccaaatatagatagaatatcttatttgtgtctcgggtttgtttctcaacttgtacatcaaggaaataccttgagacttagtcggctacgactgtattttatctgtatctgcctattccgttagggatatagattatcttttgtaacacggactccttcccatatataggggggtccgggtgcctctaggggcagaggttgattttctccaaatcatataatcaataagacactcggcggattcatccccggacaggaatagggtattacttcttcaataagaaggcctgaacctgtataaatcctttgtctccaaacccatacacttttccagcttgatagccacccccttttattattgccgaaatctagtttcgacagttggcgcgccaggtaggggtagcgtcaagcttttcgccgatcagtgcaa

SEQ ID NO: 36644 - DNA, 1501 bp, Oryza sativa
cctcggaagattgacatatttttctactaaacaataccgatcaattcaatttcagccaggtatttgagtaacccaaaatgccaatattttactagataattacttcactgccatcggttacgataacttttattccgtaacttacccttctcttgatcaacggttcatattgatctacctctcaatacctctagatacctcgcaaacactgtaaaagctctcaaagagtaataacagggacagcatacggcagccatgagaaggaggaggacccatcggccacccgcctgctacaacttccttcgctctacggcagtacgccgtacgcatatcggcgcgtcggctctcctccgccttcgcggcggtgttcgtgagagtggaggtgtgcaggcgacgatgcctccgatgcgacggccgaaaattcacggtggcgtacgtcgagttgtgacagcggacggcaatgagggcaggcgcgtggtcctagcagggaaatgtcaccggcggcccgacaccatgaggaaaagagagtgatgtggcctccgtgctccgtgcttcatgccaaattggatctgaccggatgggagctaagctccatgcactcccgtggtggccggggtgcaggcgcggcagtgtttgggcagccaggatgagttatgactctgcatcggtctctcagccatcgtctccgctgatgatgattgttcaattcctcttcgattcccctctcccagcgaaggcgccagcgctttctcccccgaccctctcccaagcacaccactgccagactcgagacacccaccattgagacgtaagtaggtcaaaccacaaattagtgagtaacacacaaattgatcgatctgtggttatctactaatttgatctataagtgtgttcacggattgacccacttacacttctagatacagcaagccaagccacgatatatgaacccgttggttttacccacttatatattttacttataagtgccttcacgggtcagtccacttacacaaccagggttgtgggatccaatagcaaaaataatctggcctacactaaaatggatgtattttggatagatatttcggacgaattttaatcaaatatgaacaaaatttgaatcaaatggagatgaatttaggggataatattgtctcggacctcaccgagatgggcaaatttcaccaaaattcggatctttcggtccgaatcccagaaccctgatccctatttccccattgggctctagcctcaagcccttaccgtcgtcaacactgaagagagcagggaagtggggtgaagaatgacgagagagaaagacatatgcagctagctattttttttaaaaaaaaattgatggctcattctagcacatgggaccaaaaccaccttataaacagcccggcgtagattaagggtgaaagatcgatctgtgaggtcgtcacacctatcttacgccgccgttgatcgcttgccaatggagaagaatagccgattt

SEQ ID NO: 36645 - DNA, 1501 bp, Oryza sativa
ggcgaggcgatggtgatggtgtcgcgctgcgctcctcgcctcttatcctggctgccaccatgggtgttcgatccgattcaggccaggcttcgcgcgcaattccgaatcgggatcgtattgatctgatatatttgatttgaaccaagcgaatcggtgtgaactcgtactaggctgtaaaaaaaaaaacctggaattaggttgtgttcctttcctattttggtctccgactctgtcccgaattcctgatgggattaacggatagctgtaatttcttaatgatgattagttgattgtttatagtcctgaattagtatatcgacttacgaaagcgtttctttctttcttttttctttgggttaatttggcgtccgtgtgaatttggttacaagaaaattgggtatcaggttaatgtttccaaatcgttctggagtcatcaaaactcaaacacgagcgcaagaaaaatccatcaagatttctagcgctgtaaattaattcaccgatcaatactattttgggtaggatattactaactccattccatatacaccggaacacaccaaaaaaaaagtcaactgtgcttaaattcttaaaatacatatatttctctaaggaacacggtagagacattatatatgatgaacaaaattacttaagaatgattaattgatcagttagtcctgaatggtgccaaactgccaacaacatgattaagttttcgtctgattagagcaatttgaacgtgagtgcactcctgcagatttttactggatttgatcagagcatatagagaatgtgaattcgatcattatcaagctaaatattggtgtaaatctcatccaaaaatcaagttagagaaaatacatgggcagtttgttttgtctatctaataacgccgtagattatatgtattctattctttgagtccttttttctaaatttctttggagagctatacaattctcttttggactttatcctccacatagtatatctcatatgtttgggaattggcttgtgggtgttagtaaaaaaatcaaaaaacttattcttgttggagcttccgctatatgttgggctctttggcttagtagaaatgatatggtttttgataaaacaccatcaaaatcctatttgcaggtgcttttcagggcaatgtattggcttcagggttgggctcagttgcaaaggcatgatgaagatatcaagctaataaatgatgaatgtcgtaaacttgagacgacaattatgtatctatttgccaacttcgggtggaggttctctattagaattcagtagttagaggatctttttcttttgttggtgtctattagtttgcttagctttgtttctgctttcgtgaactttctgtgtgagttctgtaataattggctgtaactctttgagtaaacgccggaatgttacattccattatctaaaaagaaatatgtattattgggagtaagcaatatcagaaagcttggctccgaaactttgttcaatc

SEQ ID NO: 36646 - DNA, 794 bp, Oryza sativa
tgcatcttgctcgcgcggccgccaacgagcttcttctccgtagccggcccacctcccactcgtcgttccttcccctgcctcgtgctcgcttggcttcacgtcgtcctccccgaaactcgccggctctacatcgcgtccccctcccccgctgtggcggtgacgcccctttctgctgcgggcacgggcacggcgaggggtggctccagcggccgcacgctcgtccaccgccaccgccagccaccgtcctcgccatttgtgagagaaaagagagagataggagatagagctgacatgtgggcccaagggcatttttgacatttcacgcggtttctctctcctccccaaccggaaagtattattttaatcggcgcggtgttcactggcaaattaccacgtttatggagtgttttcccccaaaaataagtttgggcagtgtcttagtgctaaaatcacacataacaagtgtcatgtagcaaaattttccctagaaaaaagtctagaagattttcgttcacgaaaataccatcaaggagtcgcaccaaaatactagaaggatttaccatgtgagaaatttaccaaacaaattgcctgcagacatgagcgaagcagagcgttgcgacagtgatgaacgccggctgagagctaccgaaatagggcaacaacggcaatagtgctaaagttagcgaaggatcgatgcgatacaagattgaaacgtaataaaaatcacgaatattttcctaataccaagtttacccctaactgtagtcctaacatagtactaatatgcccttgga

SEQ ID NO: 36647 - DNA, 876 bp, Oryza sativa
gtcgccggaggcctccgtcgtgcgcgcggccggcgagcccgctcgagtcgaaccggaaggtacctattcctctctctcgcagctcgtagcccccctctcccccatccctcctccttccgcgccacttcatcagcgggggcggtgtggactggagatcccccatcccggcgtggattggattcgattggtttgatctcgtttctctccctagcctgtagctttttcttttgttagaaacggaaaacggaggattaaaccccatatgcccccgcgtgttaggtttaggtctgcctgcacctggattcatcgttctagggtgggggatttatgatcgagtaccaaaggatttatgatccgcttgtggtttttcgccttgcgataaagctgaacacagttgacaataattctctctgtagagatagtcgatgggcgatcgtaatcctgactagaaaatttgattacactgccatcccgcactacttgtggttctatataataaatgaattcgttgctcgtcattgcgccgttgctcattctccattcctgagcacgcacaaactattgcgcaccatccttgtagctggtgggtataatatatgcgtattgatgcaagtgtgtctagtggccatcgctaccaaggaaaatcagtgatcactaggtcatggctgacacgattcagcagtggagctgtgttgttgattaagaccccatgaaaagtcagttaacctaagatagttattactaatggttcccttgtaacaagaattggggatggtacccagtgtgcccccacatccattgatgcaggccaaattgtttgtgggctgcaaaacctttctcttatcataacagacaaatgaaaaccagaaaatggtc

SEQ ID NO: 36648 - DNA, 1501 bp, Oryza sativa
gaggaaggtgtcggtatccaccatctgcggagtgccgccgccggagaaaggatggaacattgggagcgatgtttgatcagcaagaagttcggcgaggcagggatgatccatgatcgcgtcctccatgtagggatccaagatcaaatcccccatggtcgccggagcccggaagcgagatcgagggagagcgagaggagtcaagaggcggtggcgggaagaaacttggacggtcgcgtggtggtggccgaggaaggatggtgccgcactctcgccttttatcctcgtgccacgatccgactctgatcaggctgcgcacgcgtgaaggaatccatcaaattcaaagttcgcgcggttttccgaatcaggatcgaactaatgatgtttgattagagaggactaagcgcgtgcgtttctttcctttgtttgcatctccgactcgatctctgtcatgatgaaattcaccgatcatacgatactattatacatacactgacacacacacgcgaaaaaaaaagagcacatcatcacgcaaaaagaagtccaagcactcaaattcttaaaatccactagaatggtagattaagcatgggagatgacataccatactattatggattcatgcacattgctagagaagttacctaacagtgagcatatgctaacactctatcaaaatcttcaggatttctaagcagctgagcagaacaaaaacatggtggacgtccaatcgagtgactaaaagagaaactacctgttaatctttcggtagatttatagcatcgatttttgtagaattttcaaccaatcaatgtagctcgttttaagtgaaataacataaaaaaaagacaagcatgtaaaaaatcgtaaatataaagaaaaaaaatgttgcaaaatctaattttggtgtactgtaattgagtgtaagagctatgtaattaagtgtaactgcaagttggatatagaagagcacaaattttgatgcaaaatcctacggatgaaaaagtgaaagataggagcccaaaattatgtcgcagttgaaacaacaaatccgttaaaggagtttcctggacaatggtaaaagtgcgttaagcgagttcaggtaaatctcaggcaaaacgtaagcgtagtactacctctattctattatgtatgacgctacaagttaaactaaaacgattcaaaatgtatgacgttgcagggcaaatcatttatgtatgacacattgtgtaccgactttgcccctatcctccgatggcgccgttgaattctcctcctccgctaccattgcgcaccgcagccggttccgcctcccaggcgatgtcgtcgtcctgacctccaccatggctagatctagtggtagtcagtgtttaatctttcggtttgatcatttttagcggggtggccgtaatatcgcaattttgaaaatttcagcccgaaattatatgaatttttaaataaaatttgatacaaatttaaacaaaatgttactaaattcatgaaa

SEQ ID NO: 36649 - DNA, 1501 bp, Oryza sativa
gtccgatgaaaagcacgtaaaaaatatttgttcacgttttttaattttttgaacgtgtttccaagatgctaatttatttttatatggcacgcgcatacgcatttctatttgcgccggaaatcatttcactctgaccgagcggattttatttttatattgcggccatatatttttggtcgccattttattttatttattcatttgactgttttgactgtttattcctatttttgtttatttatttttttacattatgtttgagattatatattagtttataatttaatacatcttatttaagatacgagccaaaatcagtgtcaacaaatgcccccttgccaaaattttggttttgcatccggagctcgaaacataattttggattcgtagggacatgatgcatgtgaagtttatcctcacaactatcgatgtgcccgttgtttgaaagattgttgagaaaattaaggagcatctctccgattatttggccacgttccctatggctaggggcagtgaggcacttgttcgttgaactcatctactactccagtcttctccctctttctcctcttctgtgcaaggatttgaggagagacttcatcaatgacagcatcaaaggtaagaccttgatttgatcttgcatactgaactggcgatctttttttttgtttcctttttactattattgttggctttcattcctccattaattaattccatttgggtttcttccctatgcacacatgcccgaaacctaccaagtcttaatttcagcgggtgattggtgatttaggtgtggcaagaggaaggtacagagagattttcttcaccctctttcagtcattcattttttttacaggttgatagatacatataactttctttaaccacatttgtatagaatgagttgctcgtataatcggggttcccggaaattttgtgatatgttacgcagccaatccgggttgttaattagatttgcatgtcaaacttgtctaacaataccttttcttcctcattgtatatttaggctgcacctatatacatattccgatatatttttttcatttgtagatgacagatgctggctcttctcgagcaacacataacttgccgctttttagaatggcgcaacttcagccctatgaacctgaaacaagtgacttggggaaccctactattgtggataaagaattgatcggtggtgaattttcgcgtaacactcgtggcaggacttctggtcacgctttcaagggccgctgttttcaccctctcacccctttgccttgagatgataaggcttccaccttagggaataggatagtatctgagggattgggttgggaaaaccataaggtggaatttgttctagctccttcaggatatgcggaatggggtaaagcagtcctgcgtcatcattcccttcatttgcgtggtagcgaagagggggtagattacatttatgggtctatctattgctcccttggtttgtactgtacat

SEQ ID NO: 36650 - DNA, 665 bp, Oryza sativa
taagctccattgccctcttgcttggagaagaagggcaaataagtctttttttcatgtcaactcacatgtttggatgacaaatgtaacgggagtgctatggatcgcaagaaaattggtgccctgtgcttatggtcgaagtgaaaaatttgttgtgctattttttgatatcgggttttttcttgtgctatggatcgaattttctcatggtttattgcctcccatgccaattcgttgctcttggcacaaatccaattgaagacgacgagcgcacgcttgattgcacgggcattgccactgctggcgatgttgtctgcggcgagcacgaccacgatgctagggatactggagagctcgtggcggctctcgctggacttggcgaagacgacgagcacctccgcggcgcgggcagagtcggcatcggcgaagtaggtgatcagcgcgggcgccaccctggctggcactcacgatctctgacgcatgttctccggtagctagagcttgcagagctcgtacaacgccgtggccacgccaccggacgacgccactacggagaaaccatttcagccatcgtgccgcatctagatctgcccatgcatggcagaggtggcgacggtgatgttgcatgggaggcggaaacgactgcggtgcgcgacggtagcggagga

SEQ ID NO: 36651 - DNA, 1501 bp, Oryza sativa
  unsure (1)..(1501): unsure at all n locations
gagctcgccggccagcctccggtgcgggcttactacttggagacaaagacgactagtattgacttagaatgaagatgcggtgacacaaagtgtgacggagataaaagaaatcgtgatggaatggcacggttcaaattttagaagattgtagtgacatctacccgattttgtgaatagtagtggtattttttcaatacgacatagttgcaatgacatggatcaaattaaccttaaagaaaacccatgctagatccaaaacatactgtaatgcatgcccactaggattgatgtaacaagcatacaaaacggcaagagggatgcaagtggttcgagtttacttggttatccatagagcaaaagagaaacatgtaactctttgatttttcttttaaaaaaacgtgtgtccttgtaatatatccagtcagaccttcttggtcccactaaacaacaaatgagcgagatgttgattgttcctccattttcattaatatatacccaacaagtacgatctcactctcttttgtcaccagtttgataatctattgtgctttttatgtagaaaaaaaggtcgaattgtaacccttgctaatacctgtagaagttaccaagttgaagtgaaagttaattatgcatgcaatcagtgacggaaccggaatctttttaagcctaggactcaatcgatataatttacataattttgtctttatcttttaaaattttataatgcaatttcaattgatatttaggttcggaaatagggctgcagccctagctatcatactcttatagttcaatatccgtccctgcatgccatagcatggaacaagtatagagaaaaattaagacaacataaaactaataagatgtattgattgcatattttaaataatctctatacattttattagctgatgagtggctcatacatccagccccactaattaatgttcctaaacgagttgtatgcagtgggggccttgggcctttgggggatatatgcaanaattaacctaaatgcagctcagcacctgtcctcgtcatgcttaatcatcgtacccaaagacgagaaaaagagagaagacgtaaagattgagagtgaaatcgataccgatcgacaacgacgtacaataccgtccaagttatttaaccacgaaattaacctccttcttctatcaatgttattaacgtttaattaacagacgcatcgatctgacgtcgccgtacgacaacttaaggaatatttagatttggcggctatagactcaaagggcgccgagcccctctgaattagttgacggctttgatgactcgacggtgaatattaaggaaaggagagcaaggggaagagggggcagccctcggcccgatcatccaattcgctccgacgatccaggcatggttcagtagtcaaagcaacttcgtcactttcgtgtattctaaaaccaaccatttcctaggactgctataactcgcatgatatagaccacgaaaaatatgaagg

SEQ ID NO: 36652 - DNA, 1501 bp, Oryza sativa
atggtgaagattttactcgagatgacacacttatatgggtcttcttccttcccttacaatttcccttttgttatcacttcttatcttgatggtggcgaatatatggtatgcatttttcgtattccaattttaattccattgagtttatatttggatacatcacaatagataagtctctccatatgtgcacagttactaattctctaagtagtgtataaatttcttttggctgttttttaatgcactgaatgctacctaatataccctccaaacatacaaaaatctagatatcttttcatcaatgtaaatccgtgcttctagttatatccttacaaaaatctctatataaacagacgttccacgacagcatgttatatccatcattaggaaaaatatagccaaaggagaaccacaccttatccaataagtgatggtgaagggaaagggaagggctggcaggaaaaaggttgagatcaagcgcatcgaaaaaaaggatgcacgtgacgtttgcttctcgaagcgtcgccaaaccctatttaataaagctggtgagctttcattgctatgtaatgcaaatatagctgctgttgtgatttctcctgctggtaggggtttctcctttgcccatccctctgttgatgatgttgctgaccgcttggcctccatggccatgggcattcccaataaccattccttgggtggtgggtaccatgatagcggtgaggtgacaaacatagcgcaacagcagaaaattgaatatgtggagctccaaaagtcattggaaaagtcggaaaagaagaagagggttcaggaggcaatggagaaggagagggcaggacatcttatgcaatcactgacttctgaagttaatctcctggggcaggatgaattggaggagctgcacaacaaactctcagctctaccttacacttccattgcaaagttctaccaggtactgcaagatgcaaagggtactagaatgccattgccacagccacatattgaaatagcatgtcaatcacaatttctatttgaagagcaggctgtcacacccgcaaatgctgattttccgggatctagcacatgatgtccagtgtccagggttgtggtgactcttgcagctgcttcgatggacgatttgaagtgtgattcctattactagcctatgttttagacttgtaatggtgaagcatatatatatgcttgcaccaatcatggggaataaatcaaaattactttatgaaaactttctatgtcaaatctcgacttacaaaccaagatatatctaggatctattactgtgagaattttcttagaacatttttctttgatccaatagtatggtataattgagattatttcttctgattatgtaatatttcgcctcttgcatgatgtttgtaagagaaatgacagtgatacttcaaaagctatctgcaaatcctctattgaaaaataatgcacctatatatgtcttgtcatatgatatctaacaaagagt

SEQ ID NO: 36653 - DNA, 483 bp, Oryza sativa
tacagttgggcagaaacccaacggtcgcaaatcacgcacatcggcaatggtaactcgactgtcaataatgagcggcctcttcaagactgccacattactcgagtagcacacgaatcgggacgagccggttcgttttgcctggagatatggtgatggcacttcggtcggcgagtgcaattaacgcgcgcacgatatgttccatctcgactgccacagccgcatattcacctcatgcgccgcaagcgggcgaatgggattagtggaagcgtgggcgcgagaaacgagggagcgagatagtgggcgcgagaagcgaggagccgggcacagcgttggcaagggtataaagacaccgaggaagagatttgcttccttcctctcgccattattccccttgtcttcgccgcttgtgccctaactccttgtttcctgtgccctaccctcgccacacgcgctcgctctcaaacatctcttcttccggcgtca

SEQ ID NO: 36654 - DNA, 248 bp, Oryza sativa
atattattgtagtagtataaaaagattcggtttattggattagaaaagataacggtctacatagattctattatcagaagagaccatagttaaacatctcttcaaattgctgtgagtgaagaaaataaataaattaccttaaaattccgaaaatatttgaaaacttctactacaaattgtaagtaaagacaaatcaatattgtaatctggttctggtaaatattaatctctatctctacaacttaaga

SEQ ID NO: 36655 - DNA, 594 bp, Oryza sativa
tacagttaatacagcatggaagaatgtgtgcatgctatggtgtaagtggcatgaggttttaatcgatgcatggtgggagaatgtgtgtatgttgtattgattgatgtgatttaaattatccttggttttggtgtataaaatcaatttgggaaggaaggagtagattgactatagatgatttagagctagtagttggctatactattaaacttgctcttagcagctccaattctatccttataaaaaaacttagaaataataggagtaatatactactggtatcatgaataaaagtacaattgacattggacattcttaattccttcaattatttttttggtatctcaaacacatcttctctaacaaaagttcatttgcaaattttgatattctcaaacataccccaaaattttatcttagccaacggcagtcaagccgggtaaaactgttatttctcctccaaacaaaaccccctaattactcttgctccaaaacctccccttctcaagcgctctctcttaggttcgtcgtgtgtttcccttcaccctcccatggcgagcaacccaagcagctccgcggcgagggctgcgggct

SEQ ID NO: 36656 - DNA, 1501 bp, Oryza sativa
atggatctagaagcgatgacgatggtgtcagcggatagcttctttataaaggtgggaggactaccaagagggtccaagagtcgtgctctaccagattggggcgcaccccacatgggccccacttgggccggggtcccagacgtagttacaagcccataggcctattattggtgatgcaataccttgcttctgtgattgcggccaaatgagatggaattccaagatgaggctggatccgttggaaagaggactttgagagctttccatcaagtactcacgggcccaaaacggagcacgtgtgtagatttggcggccgtttgaagtcagcaacgtaacacgtggccgaatcagattgcagcacatggaggacttgatcttgatgtcttcttgttgattcatgatgtgagcaacggttgtatcgatagtagccatggtcacatcagtggcttgggggttcataatttggaaatacaaaataaatgtctcttgagtaaatggttgtttaagttaataaatgaaaaagggggtgtggcaagacttattgaagagaaagtatctttataataaatctataactcgagttgataagaaacaaggtgatttccatttttggtaaggtcttataaaagttaagagtactttcttaagtattggttcgtggattgtgaatagtggggaacaaataagattttgggaagataaatggttaggtaacttggcctttaaagataagtatctttctttatatgctattgtcctgaggaaaaattcttcaattgctagtgttatacgatctgttccacttaatgtttcttttaggagagctttagttggtcagaaacttcttttttggcatgatttatgtgcttctattgtacatgtgcagttgaatctctcttctgattgttttagatggaactttaatcagaatggacggttctcagtgaggtcaatgtatctggctttaatcaataatggccatactgagagaaataaaataatttggaaacttaagatgccacttaagattaagatatttatgtggtacggtgttgttctaaccaaagacaatttggtaagacggaattggaatggtagtttaagatgttactgaagaatgagactattcattatctctttatggaatgtcattatgcaaagtttgtatggagaaccgttcaattttcttttggtttataccttcctaatagtatatcacatattttttatggttggcttttggggatagacaagaaaaagagcaagcttatacttgtaggagcttccgccttatgttggactctgtggctaagcaggaatgatatggtttttgataaatcaccttctatttcatatatgcaggtaattttcagggcaacatattggctccggttctgggctcagctacaaaggtgtgaggaagatggtgagcttttaaaagttgcatgtcatatgcttgcgacaacagttatacaactttttgcaaattatggatggagat

SEQ ID NO: 36657 - DNA, 1501 bp, Oryza sativa
actggttcgagaaccagcgagtagaattatccctcaaacaccaatggaagttactaaagttggtttattacatgtgcatcttatgtggccaggatgactcacatacccaacttgtagcatatccggatgtccgttcgcaatcatgtcaggtgatcaagccgacatcgttcgcgagcaattatccgttaacaacccttttctcaaatagcccagccatagccggtgctatgagataggtcgtcggtcttcgttggtaggttgggtgcgacaactctgcatttgtcgagaatgttctcgataatggggtgtactcgaccacaacctactcgagtgctcaattgtccctgaaaaatatttttctagaaggcaaggcatatagcagagcatatcgagtatgtaatcaaaaaactgcatatatcttctagtattatcaggatataacgagcagattaaatatgagggattatgtaaaccgtaaacaagcatgatttatacagaataaaatagatcaagcccccagcgttagactgtagttggcctaacataggaagcactcgcacaatagatattgtattaaaaacatgctctaggtaaacataataaattattgatctgacaatattgtatgatctgaaaagtataggtacgataaattgcctataaaatatcacgtatctctacgaaattagtagattaattaaaaatcgatcttgctaattaccttggtctacctgtctcgtataagaattttggaggcaagcagatagttgcttttggtgctatgggcatcccgatgatcatatagtgcatgtccagagcaaggctatccagttgcatgtagctatgccggctggtcgcatgtccgagtaggtgggaaaggtccaactagtcagaacttgcaggcgcgcattgtccgagtaggactcgtagtatatgcaaagaaaggtacatattactctattactccctccattccaaattgatctattatatatttcataggtacaccaagaccaaaaaaagctaataactctctcatactatatttactctagcaacaaactcaatgcatgtaccatccccactattttctagccaatagcaaatcaaggtattgcatgtgggttataaatacatatgtgcatggatgcatgcatcaatgtccatttactccaatgcacaaataacgaatagacctaataaatgaacacaaatatgtagatcatttaggaataacctcaaaaatactatatgtagatcaatttggaatggagggagtattaccgatctacagtaaacaagaataatctattcacagaaatttgggacgacgaacctgatgtcattgtagatcagtagcgcgttttgtcgtggtcggccgatttgatccggttagaattctggtggtggaagtccgctcagaggttgtaggacaatccatctcttgaacccatctcgtcggaaccttgaagcaccaaaaatcccctatctgacgcaccac

SEQ ID NO: 36658 - DNA, 599 bp, Oryza sativa
ttcctgcagcccgtggcaaatagttaaataactccatattggaaggacaatgggcggcggacaggaacgatggaggattcgtcagagatgtggtgggctggtggttacggagcaaggagtagagatgtgatgaggcagagggagtagagaaggtttctgcttttatatttttcatgagatagacatgtagggtccacgtaggtcccacactaacttgccgagttgactgcagtcaactcatcatatcaaccaaaattagacacaatgctactctgggatctcgggtactccgatattacaaattgagaaacatgttatatctagtattgcagttgaaggatacaatttgaagtcttgaagtcaagataagggaccttatgtgaacttattgcagacatgttatatctgtcactatgtcgtcaagtctgaaattcatccctgaaccgcaataccagatatgacgtgtcccctcaactcccaatcagtgcaaataagatcccaaggctgtttggatgacgtttttttgctgacgtggcacttaaagttggatgggaccaacatgtcagtgagttcggtgggacccacatcatcaccacctc

SEQ ID NO: 36659 - DNA, 1501 bp, Oryza sativa
atatggaagactaatcctggagatgctgcaagtgaatcatgctgtaactacatgagctattcaagagcatgatatctgcatgtttgtgaagtaattcccatacagccgaggccatagtaggatagcagtctacatcaagcgaaaaatctatgggtcggctgatgtgggagaaagcttcactcttgttcatcgtccgccttcgatgcacaccatagctccttctcaagctaccacgcacacggatgatagcaagtgtactgtccagtcataattttattggatccaacaatttattgtagtatattgtaatctttcttttttaagtcttgttcggtttcgttcaacacaattgtgtgttactgaaaacatgtgtgatgtttggaatttcagttcaaggtggagataatcacctcctaccctgttgctattgcgatctgtctggctgaccgataattagtctgtcatgccacaaattacatgatgttcctatcaacgattgagaaacctctagtttgctcatgctgcaatttataaatgccaaccttatggtcatttttttaaaaaaagaaaatttataggaaatgaacacttcacctatgtaaggttcatatgtgtggcaatttggttatgcagccctctaaagttatggccgttaaagaaacagtttgctcttctatgctttcagtcttcaagtatgaagaaataaaatgagaaaaatcataataatatgcttgtttatcacctgatacatcaaatcttcggtacccagttacatggcagagaatttccccaatacaacattttgcactcaaatactctgactaactggagcttcctttagaagcatcaaagaaaagataaaagaatacatcgcaaaattacattacagcaaattgcatgaatatgctgacctaccacacatgtttattccaatactatgattctataatcctatttcctagtcattcccgagataattctcagctcagctcctcgttgctgagggcatgatatgggccatttcctaaaagacaaacataattatccgcgttaacaaaatctctccttgttggatttttttctgtttcctctatattctgtagtccatagttactttcatgtttgagcatgtggctcgttaggtctaatagtgggagaagtttttttggaattgtgacgggttcaaggacccgaaaaaaacataagtttgtttctgatttaaccaaagaacatcaacttgattttattgttttatctgagacggttaagaaggaattttctacatctgctctgaataatctttgtgttagtaaagattttttgtggcactgtaaatctcctagaggcagatctggtggtcttcttttaggaattaatcttctaaattttgacattggtttgattgatgagggggatttttatatcaaatttcatttacgaaataaggctgataattttaaatgggctttagttttggtgtatgggcctgcacagaatgagc

SEQ ID NO: 36660 - DNA, 576 bp, Oryza sativa
caagcccatcaaattgatttaaccgtttcttccaagaattgacacttcccttggtttttggctcactgtttgcagatttgactgtttcttccaataagtgacacttcccttggtcttctgcccactgttcacatcaatccagctagatgttgccttccatggtctaaaatttgcattgatcacaacaatacgcctagaagctaaaagataatatacacatagttgaacattaaagcgtacttttctgacttcaactaggtgcatcaattaatatttttgtatttttttcctgtgcttttcgaagcaagttcctagccagctggcagtagcattttcattagtgctgtcaccattatcacatgctattaatatgattattggtaggctcaaatcagatcattacaagcaagcaaaatgaccatatatatatataatatatcagatgtcctgaacacatgcaaacagtcactgcctgtggacatcacgaggcataggacaccaaccttctattgaatataagaatgaagcaaggaggtatgagaagaaattggacatactgctcctttggtcatcctt

SEQ ID NO: 36661 - DNA, 1501 bp, Oryza sativa
ggaagtatgttaatttcaatcccattacaaaatatcgtgtttctttcgttattattgtgttttgagcctttgaatgataacacctcatcggactagtagtatagcactatagctaaacaaaatcaaccactatatttatctgtgtgtatcactgaatcatggtttgcaaatgtgataatcagaggatggatgactggatgcatgcttgaaatagacctggttatctagcttatatatgctcggaaagttttgccaagtgtgatgacaaaccacacattgcggtgagctgtggtatgaaaataagacatgacaaatggctccaattccttgaaaagtgtggcacaccataattatagcaacaacaaaatactatactaattcggtggtcagaagtgtggctctcgatcaaacaataccttattctcaatatatagacgaaacaaaattctgtggtaataatgcatgtttgatgtgagatgagatagtcgggaattaattcaaagtagacaatagcactgcatagattaaatggactcaattctttttaacaacacaaaactaatcacactttaatatgtgcgtagaacctaacatgatattggccaaataacctcaaaatcatatcaaagtgctatgtaatgttcacacaaccaataaaaatcagctatccaccttctttcttagttatatttttcttccctaaactctaagtgataccgcctctaccattcttagttgatcctcctcatatactgctacatccaatgagataaccttcgaggccatctctattactggatgagtttaacggccttatcacctcttctcatcttagctacttcgtctcctactccgcttaccctaaatattgtcaccgatgttctcatatacaccacatatccgtagttctacccacgatgcaggcagctctaccgctattcaacacgattatttgagattaggaatgtgctgctcatttccgtctcttttaaatttttgaatgaaacctgtccaaattagacgattattgatgagcctggggacggaagtgtaagacatgaaacattgcagtctgcggggttcccaaaccgccggggccggggttaccgcgcctcgacggtaagcacggttaccgcgcagtaactgtgaaaaaaccgtataaaatttatcaaaaaatcaaattattttttaaatttatttaaatgtaagaagattaccatgatatttatattaccgtacccgcggtaagcacggtaatactgactgtaatgtaaacctgctgcgggtccctcccaccccgatccccaactgatctgagcccccaccaaataaacccaagggaccacgtgcaatcagccatttctcgttccccttttccttctcccgtcacggatccggggggccgggccaccgatccaaacgtaaaccgagcgcgcacacacacacgccacgcgcctcgccgccgatggcgacggatgccgccgacgaggcgccgctgctc

SEQ ID NO: 36662 - DNA, 1501 bp, Oryza sativa
gggagtggacttcatcagggtactcaacagaacacatttgttagctgtaatggaattactataaatttttcaatatactagttcacaattcagttgtgagttgtaggatactagtattttctggtaaagaggtgagggcggcggacgaggcgaggacgttggagccggcaaggtcggctgaggcggcaatggcgggggaagggaggagccacgaggcggggtcgctcggcgtcggcgccggatgcgatttgggacttctcttcgggcagcggcgtgaggaacaaatgacggaggaaagagcccggctagggttagtgaatgtaaaagatgattgtacccttccgcaaatatttttttcatagacaataataccctccatgattttactacccttaagtgaggtggtagtagaaataaatctgaaaccttggattaaatgagatcaacgatccaaattactttctactccaagtagaaagcacttccaagtaaaaagcaccggagtgagactcctttatgacttcgtcaaccagcctccttttggtctccaaatttatactccctgaggaagacagaacattcacattttttgcaaaggtgataaggatttacgtgcctttcttgcagaagggcgccaattcactatgacagtaaaaagaaaaaaaaagattggccatctttcctccgccccttcccttctttaaacccagattccaactccatatatggacaccagtttgatagtgaggcaagtagtattttcttttctttgtagatttattatccgataccttatcaaagaacaaaacaaggaattaaaactgagagttagcatggcctctcatttcccgtacttgggtggaaatggaacaaagtgacgaaagcactcattctatgagtccatctatttctatcaataactcgtactccctctgtcctaaaaaaaaagattcctaacatcccaaggcaaatttagtggggagtaaaaatgacccaaataaccctcatcaatagaaaatgtagtaatagtgataggtaggtaaatgatatttaagggatataacttctcgttttatgtgctgaagataaattggactctagaagttaagttttttttgacggagggagtatatagttaccctcacccacagataaatcaccatcaaattcttgagtaatgcatgaacgcgagtgtttaaacagagccgatcctgtttatccatggaatagttaagaaccaaagcttcaatcagaagcagtcaagtacggagtcgagttcgactgatcctctttcctacaagtccactgtcaagaactggttccagcagtgcggaaaagcccaacagcgaaaggctctcgaacacctatgggctggggccgcgcctgtcggtgcgcgcgggacgggacacccataggccacagcccagcgtcgaatggccacagcagtacagcccaccacctatgggccatggccgaattccacggatttccgtggatgtca

SEQ ID NO: 36663 - DNA, 167 bp, Oryza sativa
atacttcttcgcttctttatctcttgtagacttgtactactattaaatcgcttctttatctcggatgatttggaacagaaatcacgagacaacacttgtaggatttctaaaacactgcacaaattcgtataccgaaagatcgatcggccagtcgtccgtcgaaatca

SEQ ID NO: 36664 - DNA, 266 bp, Oryza sativa
acgggtcgaccgaatcaatcaacgacgtgacacacatgcgcttggagcagcagttgattcatacatatatatattgtggccggtgacccaaagcatcaccaccacacgtgattactggctagcgagagagctaagtagcttaattagctagatgtcgagttaccgcgtcgtcgtcaaacgctgtacgcgagctgcgattccgccagcgagctaacgtcgagctacaacagatcgtacgtcggtggtgtgtacggttaaattaacca

SEQ ID NO: 36665 - DNA, 1501 bp, Oryza sativa
agtgttacgttgaaagttagtcttacgtttagtttactgttaaacttttgttaataaagatggttcaaagtatatctcattctataaactatcattgttattttccatttaaaaaataggattagctaccctctccatttcaaaatatagtaaacctaagactaagatggacaaatcataatgatatgaatctaaacaagccctatatccaaatttatattattataatgtgtctagttttctaaattactatattttggtacagaaagagtaggaggtaagtaaatgtatttttggagggggggaagaaatgcgttcacacggtaaaacttctttatgctgatggttaattaaatgttttaggtgtcatctgtctacgtcaataagatctttgatgacacacattagtacagtgtggtacaactgtatatacatccttcgtccaaaaaagagtatgaaagcaattaaacagtccttgatctgatctctacaccatcgacccaagagaaaatttgatttatatactatcatgggaagggagcttgtaccacgaaatagaacatttcaaaatgttatgcctccctttaacctgatgcattcatacttggagaagaaaccacgtaatccctttttggtatcctttcctcgagactctttcgtcgtatcatcggaaaaaagaagggagagatttgccttgaaaaggaatgaacaagtcagagaactcaaatggcatacgacgacgatgtgaagatagtacactaatcaaatgcgatccagtccatgctagtactttatctgtctcctattaaatttatttttgggtccttacatttatttcaaaataaattcatttctactataattattatatcgaagttggtaaaagtaaaaaaacatttgtgtttaaagcagataaaataagagatagttatattattgtttgataaaatagtaatattctaatttcttttatgtgtgtggaattgataaaaataaatttatttggacttgctactactcactccacttgaaggttcgcttttatactggtcgatcgcgccacgcttagaagcacactaggggttgttttggtttaaagtcctaccaaaattttgttaatgctaaatcttggacaagttttggcactaccaaaattttggtaggattatgttgtttaactctattgaattggtaagatttggcctcaatccaaatagctaacgagtactgttcaaaactaccaaataattggtagggcaagaattggtttcaatccaaacataccctagtactccctctgttttttaatagatgacgctgttgactttttctcacacgtttgatcattcatcttattcgaaaattttatacaaatgtataagatataaatcacacttaaagtactataagtgataaaacaactcataccaaaataaattataattatgtaaattttttaaataagacgaatggtcaaacatatgagaaaaagtcaacggcg

SEQ ID NO: 36666 - DNA, 1501 bp, Oryza sativa
ccacaagctatatagaaatggtgactcaccggcgagcaacctgatcacgccagccactccgtaaatcttcgacaccctacaatcgcttcccgcagccgcttcctctgcacgcgaacaaatgcacaggttagtaaaaccaccatcggttcacgagcccagcactcaaaccaaccaacaaaaccggaacatagccgcgatttgttttcccctttgctttgcacggaacgattccggcggcggcgcgcttcacggtgaggggaggagtagtaagtggtaacctgcggagagggggcggagggagccgttggagcgggagacggcgaaggcgccgccgccgtcgaccgagcggatcacgtagcggtcgcggaactcccgcagctcgagctcgcggctgcaggcgccggggcggaggggctcctcggcgagcagcggcgcctcgtcggcggcatccgtcgccatcggcggcgaggcgcgtggcgtgtgtgtgtgcgcgctcggtttacgtttggatcggtggcccggccccccggatccgtgacgggagaaggaaaaggggaacgagaaatggctgattgcacgtggtcccttgggtttatttggtgggggctcagatcagttggggatcggggtgggagggacccgcagcaggtttacattacagtcagtattaccgtgcttaccgcgggtacggtaatataaatatcatggtaatcttcttacatttaaataaatttaaaaaataatttgattttttgataaattttatacggttttttcacagttactgcgcggtaaccgtgcttaccgtcgaggcgcggtaaccccggccccggcggtttgggaaccccgcagactgcaatgtttcatgtcttacacttccgtccccaggctcatcaataatcgtctaatttggacaggtttcattcaaaaatttaaaagagacggaaatgagcagcacattcctaatctcaaataatcgtgttgaatagcggtagagctgcctgcatcgtgggtagaactacggatatgtggtgtatatgagaacatcggtgacaatatttagggtaagcggagtaggagacgaagtagctaagatgagaagaggtgataaggccgttaaactcatccagtaatagagatggcctcgaaggttatctcattggatgtagcagtatatgaggaggatcaactaagaatggtagaggcggtatcacttagagtttagggaagaaaaatataactaagaaagaaggtggatagctgatttttattggttgtgtgaacattacatagcactttgatatgattttgaggttatttggccaatatcatgttaggttctacgcacatattaaagtgtgattagttttgtgttgttaaaaagaattgagtccatttaatctatgcagtgctattgtctactttgaattaattcccgactatctcatctcacatcaaacatgcattattaccacagaattttgtttcgtctatatattga

SEQ ID NO: 36667 - DNA, 1501 bp, Oryza sativa
gcctatgggtgtcccgtcccgcgcgcaccgacaggcgcggccccagcccataggtgttcgagagcctttcgctgttgggcttttccgcactgctggaaccagttcttgacagtggacttgtaggaaagaggatcagtcgaactcgactccgtacttgactgcttctgattgaagctttggttcttaactattccatggataaacaggatcggctctgtttaaacactcgcgttcatgcattactcaagaatttgatggtgatttatctgtgggtgagggtaactatatactccctccgtcaaaaaaaacttaacttctagagtccaatttatcttcagcacataaaacgagaagttatatcccttaaatatcatttacctacctatcactattactacattttctattgatgagggttatttgggtcatttttactccccactaaatttgccttgggatgttaggaatctttttttttaggacagagggagtacgagttattgatagaaatagatggactcatagaatgagtgctttcgtcactttgttccatttccacccaagtacgggaaatgagaggccatgctaactctcagttttaattccttgttttgttctttgataaggtatcggataataaatctacaaagaaaagaaaatactacttgcctcactatcaaactggtgtccatatatggagttggaatctgggtttaaagaagggaaggggcggaggaaagatggccaatctttttttttctttttactgtcatagtgaattggcgcccttctgcaagaaaggcacgtaaatccttatcacctttgcaaaaaatgtgaatgttctgtcttcctcagggagtataaatttggagaccaaaaggaggctggttgacgaagtcataaaggagtctcactccggtgctttttacttggaagtgctttctacttggagtagaaagtaatttggatcgttgatctcatttaatccaaggtttcagatttatttctactaccacctcacttaagggtagtaaaatcatggagggtattattgtctatgaaaaaaatatttgcggaagggtacaatcatcttttacattcactaaccctagccgggctctttcctccgtcatttgttcctcacgccgctgcccgaagagaagtcccaaatcgcatccggcgccgacgccgagcgaccccgcctcgtggctcctcccttcccccgccattgccgcctcagccgaccttgccggctccaacgtcctcgcctcgtccgccgccctcacctctttaccagaaaatactagtatcctacaactcacaactgaattgtgaactagtatattgaaaaatttatagtaattccattacagctaacaaatgtgttctgttgagtaccctgatgaagtccactccctcgtgtcgtaggcaagcctcacagcattgttacctcttatctggcatccatttcctgcaccgtgcatgttgtttggagttgagt

SEQ ID NO: 36668 - DNA, 1501 bp, Oryza sativa
ccatcacatggtcgtctcgcgtccccagccccatccctccaccgctggctccaggcttgtccctcactgacgatctcctccgtccacatccctcacagctccctctcctcaatcccctgccgtctcccgccagagaacttgttctcggaccgaaagatggcacggcgaagtcgagcttgccgcacaagaccatattctccaattgcaggccgagcacgcacatgacgaggcacgacgctccggccatatccaacggagctagcccgtcagcgccagtgctagagatctaggtggaggccgttgagcgcggcgagagtgctcctcgtctggacgtgctcttctagtgtgtgcatagcgcagagctcggtgtcccgcacctccaccgctggctctaggcttgtccctcactgacgatctcctccgtccacatccctcacagctctctctcctcaatcccttgctgtctcctgccggagaacttgttctcgaaccgaaagatggcacggcgaagtcgagcttgccgcacaagaccatattctccagttgcaggccgagcacgcacatgacgaggcacgacgctccggccatatccaacggagctagcccgtcaacgccagtgctagagatctaggtggaggccgttgagcgcggcgagagtgctcctcggctggacgtgctcctctagtgtgtgcatagcgcggagctcggtgtcccgcatgcagagttccttcccgagcttgccaaccatgatcttgtctcctccttctccagccatgccgcccccttcaacgctgcaaaacacgcctccatttcgtccatcccgccttggcggtggggagagcatcaggccgcttcggcttcggatccgatggttgggacatgagcgtgtcgaagcagccgatgagttcagcatcaaggggatctgctgcgccgcgtggaggagcacttccacctccgcctcgtcatagtcgaaggcagccgtcttctggccgcagcctcgccatggaggaagggataggcgcggagcagcaagtgccgtccacgaccattgcatggagtcatcaccacccacgaccaccgcctagccttcccagagctcgccggccagcctccggtgcgggcttactacttggagacaaagacgactagtattgacttagaatgaagatgcggtgacacaaagtgtgacggagataaaagaaatcgtgatggaatggcacggttcaaattttagaagattgtagtgacatctacccgattttgtgaatagtagtggtattttttcaatacgacatagttgcaatgacatggatcaaattaaccttaaagaaaacccatgctagatccaaaacatactgtaatgcatgcccactaggattgatgtaacaagcatacaaaacggcaagagggatgcaagtggttcgagtttacttggttatccatagagcaaaagagaaacatgtaactctttgatttttcttttaaaaaaacgtgtgtcctt

SEQ ID NO: 36669 - DNA, 1501 bp, Oryza sativa
cacggcgaggggtggctccagcggccgcacgctcgtccaccgccaccgccagccaccgtcctcgccatttgtgagagaaaagagagagataggagatagagctgacatgtgggcccaagggcatttttgacatttcacgcggtttctctctcctccccaaccggaaagtattattttaatcggcgcggtgttcactggcaaattaccacgtttatggagtgttttcccccaaaaataagtttgggcagtgtcttagtgctaaaatcacacataacaagtgtcatgtagcaaaattttccctagaaaaaagtctagaagattttcgttcacgaaaataccatcaaggagtcgcaccaaaatactagaaggatttaccatgtgagaaatttaccaaacaaattgcctgcagacatgagcgaagcagagcgttgcgacagtgatgaacgccggctgagagctaccgaaatagggcaacaacggcaatagtgctaaagttagcgaaggatcgatgcgatacaagattgaaacgtaataaaaatcacgaatattttcctaataccaagtttacccctaactgtagtcctaacatagtactaatatgcccttggaaatcgacggtttggattatttctacttgtagtatatactacaagtagaaagcaccggagcgtcgcccaagaagatatattctccacactttattctcctatatctaaagagcacaggaacgggagaatcaagtcacgttgttcaggggacgaatcaccgtggttaattactcctgcaaccttgctagcagacactctgttctgctaaatataccacacacacacaggttctttttatccgccgctgcttctgaattttggcccgatccgacatccaacatgatatactaccgatggccaaggcaggaactgggcctaacgacatggacaagctccatgtacatccaaggctccagccaatcgttttgtcttgacgcacacttcacttctgccgcgccatttttgtcaccccaggtttgctgcctctgagacggactaggacactacgctacgtgcaaactgcaaacataaacgtacccggcgaattccacagattccatattgatgcgaacacgaattccaaaaccaaaccttttccctgtacgtctaccgtctacgtgcaccatggggcaaagccgcgaaggcaacgaatccaaatatatgaggctcaggttccaatcttagctacgcgaactagtacaaagatgatctgcaaaacccctcacgtgaactgccccgtgcgctgataaaaaaaaaatcaatccatcggtttggtgataatattcttctccacgagctgctgctaatcggttaatcgcttccttgcttggatcgcacagcaaaataattagggcagctatattgccttttctcttgcttgcgacagcaggaattgtaggacgattaatcttggctaagctggtctcgtgatcgattcataatcgtcagcgtac

SEQ ID NO: 36670 - DNA, 1501 bp, Oryza sativa
ttatgttgatttaaattattgcattatcgctttatttaaattcccgcgttatcactgttttatttagccatgcctatttacctttgttatgaccatattattattgttattgttattattattaccttgttcaccctagagtaaacaaaacctcaactagtggacactctactcgtggtatccctagtttaaatttaggtagatgcttcgcaatttaattaggtaacattaggtggttttataactttagacttgggaaatattcatatcacctggacactatggaattgttggattattgtggaattggcttcacaccgccccctctattcaaaatcccctaaaatggttttaggctgggctcggggtgcatggttttgatggtagcacctcggccatataaggaccggtcttcgggcctctgttgcaaagcactaccgtacttccacatgtctagtgggtaaggcttagtttgtggctcagtctagtcataaacaaaagtacacggattggagatggatgaagtcgggggtcgatggacattctccagggcaaatgaaggctacacgagctgcggcccggtagtcgagatgtcatatggcagagggttggtgccctgctgctaggggctcagtcctgcctgcctgtcccgggggttccggccgtaggcgggattgggtcggtactcttgtctaaggctaggatgggttggaaactatgtcacgtcttccgtccgtataccgtggtggtatgtggcacgtggttacacgtgaggaagatgtgtcttgtgggtaaagatgtacacctctgatcagagtataatctattcgaatagccgagccctcggttatgggcaagccgagcaatgtacccaagttagtgttttaattcttaaaacttgcttaacaactaaaatatggaatggttggcctgggttgacttgggacgagctgggacccagggtcgggttgccagttcggtctgaatcatcataggccttgggttaaggcaggttcgtgtgggttcacggccttgattaataatattgtatagttctaagatcgtgtttacaaaatagccctgagcaactaaatgtctttaaatgctgtttactgcaaccctaaccctttatattataattcccttgtactcccttgcatttattctgcatttgtgggtgtgtcttgttgagtacggtggttgtactcagtcttgctcaatttttcccaagcccagaagaggagctccttgaagatgaaggctttggtgtctagctcgtgcctgccgtcaagcgcctgtggtcgtcgccctagtcttccgctgtttctcgtttgtctctgtgtgtgctgggccttcgctgcccatgtaataagttaactatttacgcttccgcttgttaaactctgatttgtatcaacttttggtgtaccttgcctcctgggacaaggattcatgcacgcacgtaaggaatgcccgttgggttatttccggtcgtgacagc

SEQ ID NO: 36671 - DNA, 151 bp, Oryza sativa
agattaagtgatcatgtacggttgtcaactactaaaggtttttccaataatgttgatggtgatttagtagatgatcattttgatgataatttcttactgcaacatttatgtagtgaaattatggaggaggtaatggattcaggtggggact

SEQ ID NO: 36672 - DNA, 890 bp, Oryza sativa
ccgcgggtgcggctgacgcgtgggacccacggcgccgaccgccgccagccgcgtgctcccggtccaccgtggaccgagaggctgacgcgtgggccccactcccgtggacccggtccgcgcgccctctccctcggctgacgcaataaatgagatttttaattaaaatttaaatgaagaaattcgtaaatatccatttaaagagcatataaacttcaaatggccatatcttggccatttgaactcggaattggaccgttcaagtctctaatttttccttaagaagtcaagaacccatttttgtgctttgtttctgctgttatgtggagtttagtagtgtaaaagccttttcttttccgttggtcgtgtagacgctgcagcttcggaagatccgctcttcgtggaagtcgaagccatcggttgggaaagcgagcaaggcaagtcatatcatctttgaacatattgaatcccagtttgtaaaattatgttgatttaaattattgcattatcgctttatttaaattcccgcgttatcactgttttatttagccatgcctatttacctttgttatgaccatattattattgttattgttattattattaccttgttcaccctagagtaaacaaaacctcaactagtggacactctactcgtggtatccctagtttaaatttaggtagatgcttcgcaatttaattaggtaacattaggtggttttataactttagacttgggaaatattcatatcacctggacactatggaattgttggattattgtggaattggcttcacaccgccccctctattcaaaatcccctaaaatggttttaggctgggctcggggtgcatggttttgatggtagcacctcggccatataaggaccggt

SEQ ID NO: 36673 - DNA, 789 bp, Oryza sativa
agcatgcggttgtgccgcacacccccctgaacgcgtagatcaccgcgtgtgcagggatgcatggtatggtgttgcggacttgacagaccgctgaatgtatgagcgaagtgactcatcatcccttcgctgtactgcgtgtaagtccgcttcttcacctgggcgcggatatgtgccttgaaagttcatggtaaactgttggcacaaatcctcccaagagtggaccgacgcgggtggcaagttcattagccaaccccgcgcctgtctcttcagggccatgggaaagaaattcgccatgaccctgtcatcacccccggcggcctcgatcccggtcgtgtagacctggagaaactcggcggggttgacgctcccgtcatatttttcggcgatggtgggccggaaccttgggggccaacggacgttccgaaggctcgctacaaaggctctacagccgacaccaccaaccgggggcacggagggctgatccccgcgtccgtgttgaggtgacactccggacgaggaggcaccctccgttgcgtgggtagcacgtcgaccattacgccggcgctcgataccgatgcgggcatctggccctccacgctgatcttcccgggtcagaggtgctgacgagggagtggcagccgaacggcgagcaacagccgccgctcgccgcgccctccgccttgacgacacggagccggtggtagcagcgccagaggtcttggtggctgtcacgaccggaaataacccaacgggcattccttacgtgcgtgcatgaatccttgtcccagg

SEQ ID NO: 36674 - DNA, 261 bp, Oryza sativa
agtgctgtcgttgtatggcgcacaacttctgatcccgcacgctactcatgaaaccctaatggtgcaccatcgtcagacagcactatctatcaggcagtgcgcatacgaaagccaatatacgcctagtatgtggatcggtccccccactgcttactagaattcattccggctagggcgagagaaaaccaatcgccccatgtgacaagatctctctttttggcaatctatcgcagtgaactcctcggctactctgtgcccgaa

SEQ ID NO: 36675 - DNA, 1501 bp, Oryza sativa
gcacgaacgaacgacggtaatgcaaaaggaattttagggacgacgtgtggtatacaaatcgattcgtcacggtaggaatagaatcgaggatattataaccaacatataataaataaatacgtcgatcagttgtaggtgtttgaggaaattatcgagttttgaactgatagggtgattctaaattaatcgtagggtaagagtttgagagagatatatatcgcattgcgaccaaaggaaacgacttcaggtctgattagtaccgaagcgctttaatgcaacagacgcggaggataaggaaaggacgtcaaatagggggcatccttttagcaaataagggttaattgacatcttttggaacaacagctaaacacacacaactaataacaaatcctattatgcacgctgggccatgcatttcaatgggaaaaaacggacttacctgagaaggccatttcttttaaaatagccctttaggaattatatttcacaaatacggtttctaataaatactttattaatggggaaaaaccggacatattctcagacaataatcaaagcaatattccctttgtaaaataatttccgttttaatgaactataccatagagggtgtccattcaaacttagaatatgtaaccctatttataaattgaatatgccacagaggatctattacatagagaagggttttcaggaaaatatttggtatttgcaaatactaacatatttcataatcatggttctttgaataaataatatttgaagtcaaaatgcatgcatattctcagacgttcgtcctttagcccatgcatagccggaaaacggaaaataaaatccaataaattccagtatgcaaggaagttcaaaaagatttttggttataccgaatttttaatttcgtatttcaaaaccaaatttttcatggtgttatagttcatccccactaagtgtagttaatgctatttctctcttctctcattaagccacatcaccctaattatttttagcctttgtatgatagatctatggctcaaattgcctcatctttcttctctcataaaaatgcaatctcaattatttttaggatcaaaattgtattaatttgttttagttttgataatcatattacatcttatttgtacgtattatgcaacataattttccataccaacgcgacggagtattcatctagttttccaaacgcactaggcatgcatcgtggagaacatgaagcacaatgaaggcaacactataacatccctgctgtcactgaagacagctccttgaacaccaccgatgccgctgaagtcgaggtggagcaccgtcaccgccgctgtagaattgcaaaagctaattaagcctcgtccaaatacggaggatcaaaatcgattgactcatttctaatgtgaaaatacaaatttacccttccacctcactcacctttggctggtacctcagggcaaatggtacctggaggtaccaatctatgtcagccgtccga

SEQ ID NO: 36676 - DNA, 243 bp, Oryza sativa
gaggtgaggcggtggcacatggggtagcacatagccgttttgaaataaaagcaagaagggtattcatgacgcagtaggttagagggtgacgagtaaagcaagtagtgtgagaggaagggtaagaagtagcaattggagattggggtgggggaagaagttaacgtggagaagagagtaaggagaaagtaaggctgtggaaaggacgagaagggcgaagtagggaggagatttagagtagcagta

SEQ ID NO: 36677 - DNA, 1501 bp, Oryza sativa
agtatttatcacgtcaatcaaggatgtccaccctaggtgactgtgacaagtgaacactacaacagaaatcttaattgatgccggttgggaaacccccttaggtcccaaccgacaccacgaaggcggcactgacgaacacaacataaacatctaagaacacacatcaacattaagaacacaagatgaacacacatgaacacaagatgaacacacaagaacaagcatgaacatccactgctgtgccgccgccgctgcatccgctaccaagccaccgttgtcgctttcgctcccattcgcctccaccaggccgtcgccaagtccggccagatttggtggaggggaggctccgctgctgcctccactgtcggctgccaccgctaggtggggaggccgctctcggtaagccgccgccacccaccacctccccacccaccggatctggcggaggggagttcgccgttgtgtcgtcgtcgggccaccgcctcctctcgccggaccatcagatctagtggcggggaggaccgccaccgcctcctcgccgggagggcgccaccgccatggcgttgcgaggaggaggctgccgccgagagacgtgaggagagcgccgccgagcgtgtgagaggaggaggggaggagaaggagggcaccgtagccatgagagaggagggggaagaagaagataaggttggggaggagaaggagcagaaagagatgggaagataacattgtggaggaggagagatagcgtgtgtggacggctacaaatatcttccgcatctccatgtggcttggctcggtttataagatgtcggtttttttaaaaccaacacctatactgaattataggaaccgacacttttagtataggtgactgtttttctcaaaaaccagcatctatagtctcttaaaggtgttggtttttttctgttttcagtccgtggagatgggaaaaacactataggtgctggttttaactattccggcacctatagtgcagatttgtatgtgcctctttgtagtagtggaagtactataaatatttagtgcaatcgaccatattggtatcgggtagtaccatctgtcaatctaacaccagtcattcatcaagcctattaatcaattatttgtcgtgtgagtactatagtctatttatttaatatgcatgcactccctctctctctctctctcattctaggagcagttgtgagtttccgtgtctaactttaaccgtccgtcttatttgaaaaatttatgaaaaaattaaaaaaaaagccactcataaagtactattcatgttttgtcatctaataacaacaaaaatactaatcataaaaaatttcaaataagatgaatagtcaaatgtttgacacagaagccaacaattacacttaaaattggcggaggaagtttgtaaagaacttcagattaaatcacttgttcttgtctttatttttttttcaaagtggctctccaagctaggtccccaactggcactgggatt

SEQ ID NO: 36678 - DNA, 519 bp, Oryza sativa
  unsure (1)..(519): unsure at all n locations
gctgccccccattagaatctctctttnnnnnnnnnnnnnnnnnnnnnnnnnnnnnnnnnnnnnnnnnnnnnnnnnnnnnnnnnatgtactattcaaaactaccaaagaattggttgggcaagaattggcatcaaaccaaaatggccctatatgtccctgtgccactaaaatatttgagccctccctttataccattgtcgaattttatcgcgccctccacaccgttccgttgctattccgtttagatttaactatttggcagctctgacatatgggcccgggtagaaaaaatgtcgctcttgccctttcactcagtcttctccctcgattcccctcttctccctcaggcggtcaggccgccgcccagctggggcaccgcgccgccgtcgcctcggcccggtcgtcgtcgtcctgatcctcgtcgtcggtgcgctgttcctcaaccttggtccaaccggctccttcagcttcaccatgccgtggatccgcatggagttcaacgaaccagtccacgttgcg

SEQ ID NO: 36679 - DNA, 246 bp, Oryza sativa
cagacgccaagcatgcatacaatttacctaggacaacaaagtagcgactgagcaaatcgataccatattaccatgtgatcttttatcatatcattgcatgagtgggagcataaaagcagcagcataaaccaaaagcatacaaaggaaatctattttttgaccactccgactgcaaatctttagcttttccaagaccccatttacgagattttcctgatttaagtatttaacttgacatgatctaga

SEQ ID NO: 36680 - DNA, 1501 bp, Oryza sativa
ttcctctcaggtttgccagaagcatttcatagctgtcagccacagagtgaccctgatctgccctgccaggcgaggcgagcgatctgccaggcgaggcgagcgagcgcgcgcgtgtgtttcccctcttctctccaccacacatgcttcaagtggctaggaggacatcctcccttttaaggaggtccccctctcctagaataagcaaggtggtactaaactccacatgcatgccatcccatgaggtgggcttttgtgattttccaaagaattaatcttcgagtgggctaaggcccattcattaattccaacagatataagcaagcaactaagcaacccaccacgttgatagcctagaacgacattgcagctctggaggtagcggaaaaatacatgtaaatgttggcagaaaatatgtgcaaaattgaagctgttcaacacaacaacagggcagtggatcggcccctgacaaaatgcaaaattccatggacagtgaacttactgttctgtcagtctgcaaagcataaacttatcttttcctttaatttccttgatgcataatcgatttttaaataaaattttccatggtgacatatagcaccatgatgtaaatttcaactcattttcaaatctaaatgctatagggtatcgcctgacgttctctcacttatgtgctctatttcaatccgatagtaacaggttttaccccaaatttcaaaattgaataattaattagactgcaggcattcgatttatctaaagagagtaacaaagaagctaggtgtccccaacaacagaccacccactgtggttttatgcatggtaggagaaggaaacacatcaccatatatgtatatggggcatagataatgatgataggcattaggcaacgaaagatgcagtcatgcagcctatcatgggagacagattttttttttttttggggggggggatgggagacagagttgagcattattgggacgaaacgatttttttttttgtgatatggtgcagatgaagttggtagggtgtgagtaatagtgaaatacttgaggaatagcgctctcaaaataaaaagacctaagggttttaataaacacatgttatcatgatctcacatgattattggagcattatcatccaagaaacgacatataatatattttatattatttactaactcgccattagtcactttttcttactacatagcacctactcgatcttttcttcgacaacctttctagaagctgtcaactttggaactgctctctcaactacaataggtatgattataccgatgtgattggcaatcagactgccgagtgctgattaatggccagatttttaattaggaaaaggatgtccacaaccaaataattgattgataagcgacatcaagttaagtagaaaagagaaatgaatttcaacctattaaggagtaactttcgacgactaaaaaaatctaagagtatgtttggataatgggaaagagaaatgaatt

SEQ ID NO: 36681 - DNA, 318 bp, Oryza sativa
  unsure (1)..(318): unsure at all n locations
aatgtcttcagtgtgcgtgcacaangcacnnnnnnnnnnnnnnnnnnnnnnnnnnnnnnatataaatgtgagagaaatgctataatgacttacattgtgaaacgtttttagtattatttactttttcttttaacgtgatcactaacatatgacctttctgaatagcggttccacatattattgattttaagttaaaaaaagtaagtaaaaaaatcgcaatccccgctcatcattttcaccctcccatccagttcgcattctacatcgctccagcctctagtagcttatcagccataattgaaattcaaaatttgaacc

SEQ ID NO: 36682 - DNA, 424 bp, Oryza sativa
  unsure (1)..(424): unsure at all n locations
gcgtggcattatatatcctatnnnnnnnnnnnnnnnnnnnnnnnnnnnnnnnnnnnnnnnnnnnnnnnnnnnnnnnnntttgtgacttaaaagcccatgttgaaaaagaaactacgttgaaaatatctcaaaatcaatctcaaaattaagcttgaaaattcaaattttggctttttctttggcttattaggccatctgatgggagccttacagaaactggaatatccagaaaatcatacaaatattaaaaaaataacaaaattacaaagccaacaggttatcttcagagtaatgtgagtatagtgcacaaaaaaacagtttaacatgaatattggatcaagactcttcagacagcaccctagattctgtttggtaaatcaagaataatataaaatcacctcctgtctcgttcttacaccacagg

SEQ ID NO: 36683 - DNA, 194 bp, Oryza sativa
aaccaacgggagaatttaattttaggaacattaattatgtgctatgatgttgtaattttctgaccaacgttgttaattgcaatattatagttatggttatatgtgttatgtctaattctgcccaacggtgatgtaggcttaatgcataatattttgatgttaattttgttctcaccgcacatgattatttcagg

SEQ ID NO: 36684 - DNA, 1501 bp, Oryza sativa
aaaaaaaattacagaaaattcatccatacaacccgaattccatacaaacccaaattcatccctacagccctacatccatattcacaatcctccttcattcacattcatattcacattcacattcaaaacaaataaaaccctataaacctaagtctaaaaattcgtaagaccaaaatttcctatctttaaatcctaaacattggcatatatatcttaactcaaaatatgctaagtttaaaatacctaaatcgaaagattgtaagtctaaaaattattgcactcctagtgctgcaatcagtatacttgtgtaccgcattttgttctattgcactcgtagcatgtccactttgtcagctgtgtgcttcaaaatcttaggtgatggcatttgcagaaaataaacatgaagcagcatggccatgtgtagatataagtaaaataagggcaacagatgatatactatacagcaaatgaaagcacacactatcagcaataatttgcttctgtagaacagaaataacatatttcagaaaaatataggtattgtagtgccagctaattaagatgagttaattaggatgttgatggtactaataatgacatacatggtaatgtctaagttgattctcaaatgttttcatgaccaaaggctgacagtgttgtattggcacccaaagttcttactcttagttttagttttgtaccatccttaggcatttcaatatcttgccagtaatttatctgcacaaaattggaaagcataaaagaaaatgcaaacaaagagcatcaaatagtacactcaattatcacataacctcatctactcacagaattagttccacattcagcctataaaagctcgccctatgtttttttcccaaagacatggtcttctaattatatcctctggccatccataagaatctacaaacgacataatacttttcatgcataaacattcatgattagtgttcaacagttcagtagccaccaaatcccagtgtactactgaatccagattcagtttccttttaaataaactgatgatatctatgtgcacgaaggtaatcaagaggtctgatgacaaacaaaacagcaacatctactgctagcctatctaaactacaggagaacacattgccaaatactttttgtacataaacacattcatgtcgagtattcacctatttggaagtcaactgtagatggtcgaccacctaaaagaatgaagcaaacaaatttatggatctcaataactaaagatgcataattaaagatcaaatctgaataatccaataaatcagcaaatgaacgcaggcactacttaatacttgtcagaggatgcttcaaatgtaacagaaagagcagtaattagtttagcatgaatatgtaatcaacaattaagcaaaaaaaggcatataattaatttaggtcattcaccagaaaaatattttctgcagaaaaactgaattcagttgagtattaagcttaatatttctagttt

SEQ ID NO: 36685 - DNA, 159 bp, Oryza sativa
  unsure (1)..(159): unsure at all n locations
gcgtgcattaggatcaccctnnnnnnnnnnnnnnnnnnnnnnnnnnnnnnnnnnnnnnnnnnnnattcatgaatcggggagtcaatccaaagaacgataagggagcagataagatttcggaagcacccaaatcctatacctatgtttatactccccaga

SEQ ID NO: 36686 - DNA, 1501 bp, Oryza sativa
gcaggggtccaccatgaatcatacaccaatgtcagaagagactagcaaagaagtcctacgggacgagaattgccggagtagcacgcagttgctggagaagagcgaagtgtagtcaaggaagatacagcgacgcttgcgatgagacgtgctggatgaagaagaaggcggagtagcgggaccaatggcttggacggcgatatcggtagccatgtagaggtagctggaccatagtctagagcggcgacagtggcagcttggaatcgcggcggcaatgctcgaagtagatgcagaagaacccgacggctgaagatgaccagtgcagacaacgaggttgtcgatgtgcgaacggcaaggaagacgacgagaggggcgacacatggtgcggctcaatgtcgatgcagtggcgagaactctaccggtagtgaggccatcctgaggagggtgtctgttagctttccaacaaccagtgtatgtggaccacgggcggcagcactgcagcccaagggggcgatgcgtgctcaatgacgatcggttgcagaagtcatcgtagctgggcagctgaacgggtgatcaagccgaagatgcgcggggctgaatgatgaagtcgaagcagagtcaataccgatgtcagagacgcgtagatgtcgatgaggcagtgggcgacgcaaaccgatctctgatcagaaaaaaaacagatacatgcagcagcagcagtagcaatccagaatcctccagtgccacataatagtagtagcatgacccggtcaatatgttgaatgactctgcacccatcttgtctctatctgctcacttgctagccacgtgcaagatcataacagagggagacaaacagattagagcgggcagcttgatgacagatcacggcaatcacgcgcaagtgctccacgcatagaggccgggtagtcggaagttccgacgatgagggccatgtacgagcacagagagggcagaagctagagaccgatgagtggcggcgtcctcaggagtcacaggctcgcagggggcagcgcgtccggggccgacggtggctgacgcggaggcttgtgcagcagcccccatgctccgccgccgaggacaccgatgctcagcaggccaggaaggacagggctgaccaggcgaacggaggtggtcgttgcggcatgcggcatggaggtacagccagtgatgacgaccccagatccgatctacgtggaggtagccgatggtttgctagctgctgatgtgtggagattatgggtaccccatacccacacggcatggttatctgactggttataggggataacttatatctatgagatatgtaacggatcatgacttgggtattacgtttccttgtatattatggaacggcctaaagttctggtttggtaatattgtaaagtagattttggaaaccaataccgtattggttaatgtttctatctggtaatcctactcccatcctatataaggtgggcaggaagccctatagggggca

SEQ ID NO: 36687 - DNA, 331 bp, Oryza sativa
tttaaatttgaaccaacgggagaattttcacagagagagaattacagagattttgctactgttcatatgatttttatagttttccgctgcaaatagatgtaattgatgaaaattagtgtttctaaaattaaatttcgaaccaacgggagaatttaattttaggaacattaattatgtgctatgatgttgtaattttctgaccaacgttgttaattgcaatattatagttatggttatatgtgttatgtctaattctgcccaacggtgatgtaggcttaatgcataatattttgatgttaattttgttctcaccgcacatgattatttcagg

SEQ ID NO: 36688 - DNA, 1501 bp, Oryza sativa
tcacatatagataattaaaaccgatgaactcattaaatctacctctataaaaatcaaaatctcctcactcaataacaataaaacattaaaaaaactgaaattctatattacgtagtcttagaatcgttttacataataaaaatcaacttagcgtgctctataacgctattaagtcataatgtatcacattttaaaagttagataaaatataattcaacgaaaaaataaaacatctatctgtcggttttcacttaaatcaatgacccattatttttaactattagatcttctttctctataaaaaaaatcttaatccaccacatatatatcatctgttaaagatttttagaatgagaaaacaacaaattctcacctacattatttagaaacattagaaaaacaatgtcccctccacctccctctccaaccatatgtgcacaacactattacactgccaacccatctctagctcgagttctatgttattcgttcctctccaatctcctctctattttcagctactaaaataaagagataaacaaatattgaaaataccataattttaaactacgcatataagtttctaatataattgttgctttatttataattaaagcacaattcaagatccatgtgcctatattttgttatataaaaatatgacatttgggcacattccaccgtgcactttgcaggttatccaaatagtgatggaatataaaaaacattatcgacatatatttcgtaattatacatcaatcttttttaatgatgcacaacatcccttcctttttacattttattcaaatttccattaaaaactatgaaataactcaacaacataagttgcaccatcatatattattttgcaaccctacatgactaaattagacattcagttcgcaaaaaatagcccaaacacgaatatttcaagcgagtacatagaaaacagttcatagggataatcatccaaattgccataaaagaataaaaaaaatcaaaaaacactgattgtatgtgcattgttttttcaaatagagttaaactagatatacatatataagaaatataactatctcaaatctaattgtctaaaaattggtgcttttacttagataaaagaatccgattaattcatgatactttttgcaattaatatgctcaaataatccaaacaagccaaccgatcttctgccaaagtgtcctaaactttatttaagtcgattagatgattgcttttttttatataaaggcgccatatattaccccgcacttactcctaggccttttaaaccgatgaacacattattttcatccgttagatctatctcatcttaaaaaacaagtgtgtattcatgatgcatcacattcaaaaaaatatatatagcgcaactatatttcttcatccaactgtattcactctaggttgcctggagcctcccacatactctacacataacattcgcatatggattgtctcttaaactatataattatatta

SEQ ID NO: 36689 - DNA, 165 bp, Oryza sativa
  unsure (1)..(165): unsure at all n locations
atgcgcctttgatgactgatgatccnattcgaannnnnnnnnnnnnnnnnnnnnnnnnnnnnnnnnnnnnnnnnnnnnnnnnnnntaattttttgcgccgatagattatttctgtaaatattaaaagaaaaaaattaaaaatgaaaaaaattccttgcccggaga

SEQ ID NO: 36690 - DNA, 1501 bp, Oryza sativa
ttgaaattcatttctctttcccattatccaaacatactcttagatttttttagtcgtcgaaagttactccttaataggttgaaattcatttctcttttctacttaacttgatgtcgcttatcaatcaattatttggttgtggacatccttttcctaattaaaaatctggccattaatcagcactcggcagtctgattgccaatcacatcggtataatcatacctattgtagttgagagagcagttccaaagttgacagcttctagaaaggttgtcgaagaaaagatcgagtaggtgctatgtagtaagaaaaagtgactaatggcgagttagtaaataatataaaatatattatatgtcgtttcttggatgataatgctccaataatcatgtgagatcatgataacatgtgtttattaaaacccttaggtctttttattttgagagcgctattcctcaagtatttcactattactcacaccctaccaacttcatctgcaccatatcacaaaaaaaaaaatcgtttcgtcccaataatgctcaactctgtctcccatccccccccccaaaaaaaaaaaaaatctgtctcccatgataggctgcatgactgcatctttcgttgcctaatgcctatcatcattatctatgccccatatacatatatggtgatgtgtttccttctcctaccatgcataaaaccacagtgggtggtctgttgttggggacacctagcttctttgttactctctttagataaatcgaatgcctgcagtctaattaattattcaattttgaaatttggggtaaaacctgttactatcggattgaaatagagcacataagtgagagaacgtcaggcgataccctatagcatttagatttgaaaatgagttgaaatttacatcatggtgctatatgtcaccatggaaaattttatttaaaaatcgattatgcatcaaggaaattaaaggaaaagataagtttatgctttgcagactgacagaacagtaagttcactgtccatggaattttgcattttgtcaggggccgatccactgccctgttgttgtgttgaacagcttcaattttgcacatattttctgccaacatttacatgtatttttccgctacctccagagctgcaatgtcgttctaggctatcaacgtggtgggttgcttagttgcttgcttatatctgttggaattaatgaatgggccttagcccactcgaagattaattctttggaaaatcacaaaagcccacctcatgggatggcatgcatgtggagtttagtaccaccttgcttattctaggagagggggacctccttaaaagggaggatgtcctcctagccacttgaagcatgtgtggtggagagaagaggggaaacacacgcgcgcgctcgctcgcctcgcctggcagatcgctcgcctcgcctggcagggcagatcagggtcactctgtggctgacagctatgaaatgcttctggcaaacctgaga

SEQ ID NO: 36691 - DNA, 318 bp, Oryza sativa
cacgccgtgaacactctatgatcatcgcaggggagctgttctatccatagctaatctattattaacccatgctgacaacgatttcgttgtatgtctaaccatttacaaaatccgctatgatttgcacaaaattactacccaaactgaataacattactatttttacagggcaatccaaggatgggtggatttactcgatggatcgacaatgtcactccatcatatcatacggagcgtcgatccctcgcccacacggtacttaatttttattaatactattaaatacctgtatgaaactgatggtccttgtccagcagg

SEQ ID NO: 36692 - DNA, 1501 bp, Oryza sativa
gcaaggcaggtcatcactatcccttgaacatgttgatcccaattgcgaaattatttttatttacaaataagaatgcatgcaatgatgaacatcctatttatgaatatgccataccttgattattgtttacccttattcccttgtaaccatgattacgtatgagtgcctagtcggtcgaaggggaggcgaggccgagggcgaccttgccgctgcgatgccggaggagacggcgacgtcggccggcgcatgggcacggcggaaggggttgccgaaggaactccggcgaggcggagggcgagaccgagggcaggccggggtggagggcgacgcggcgacgtcgagggaggagatggtgacgtcagtcggtgtaccggtgatgaacagcagccggccggagacggaacagtggcggcaacgccactgttgccggcggggatgcacttccggaggtctccgcgggaaacagagggcaggccggcgaagaggaggcggctgcgatgctggaggaggcgacggcacggccggacggcgctcgggcgaggagggagaggcggctggaggcggccggcgcggggaaaagagaagggcgacagcggggaggggtgatacgaccacggggaggctcgggatgaggctaaaacgatagaacggaggatggggattccattttataggcgcggggagggagccgggcatgggagagggcggaacggcgacgggaaacatggccggcggccatggaacgcggccgggaatggcgcgggcgttcccgatgattgggggcacgaatcaagggggaaattagggggaattgatgaggaaggaatggggattaattccccccaatcagtttggaaagaagggcattgattcgcgtggatttagggaggaaacgacgctaggtttcacgggagagagaggatgccgggcgggaggaaggagacgaccgggtgggtgggacccaccggtcgggcgcgcagtcagcgcgcgtgcggcgcgcgtgcacccggctggctcggctcggcctggattggcccgggcggctgggccaaaagggaagaaggagggagggcggcccaaaagaagaagaaaagaagggaagtggcccgggagggaaaggggaggcccaagaggagggagagaaggagagggagagaaagagagggaggaagggaggactttggccgtaggccgagaaagagagagaggactttgggccagacttggcccaaaggaggaaggaggattattttttggtttttctttttaataaactttgatcatagttgtggttgcttaataaatatttccggtgctctaaaaattcaagtaaaatttgagggctctttgtagactaaggagaatttaacaaaaattctctggactacattcgaaattttcttgtacgcatttaaatgtttgccaatttcttttcaaattttaattaattctattattccttttagaaaatgatttttatttcgggatgaatttatcaaga

SEQ ID NO: 36693 - DNA, 1501 bp, Oryza sativa
aaaggatggcatagtagggtttcatttgcataaacagcaattaataaatatttcagaatttaataaaacagttaagtaataattaaacaatattaatccaacgctatacaacataccctgttgcataggcccaaccattctgaacaaccaaccccggctgcacagttctatctccaaaccaggaattaaccattccaaaccaggagctaaataaattattaccagttatagcatcttttattatggtgagaagtgtgagactaatcacgaaagacattgttagacccgccattaccgcgggcacggctattcgaatagttttactctggccagaagtgtaccactgtacccacaagacacagccccacaacatgtcaccatgtgcctcaataccaccacggtacctcggaaaggagctgtgacagtacccctcgcacaacacaatccaccacagcgcaccgttcctggatcataatcacccccttataaacaaggcatgtacttcccagcgacccccgtgggcttatctccgccacttctcagtctggtgctccgtaatgaaccatgctatacaaaaggtaaagccgttgcccacgctggcttgtggttggcacggttaatgtttcacaaccgaaaatcgtgaaccggtccttaattgtcatgagcacgaccatcaaaaccatgtgctcacaacccaccattatcaagttttagttggcaatttaattaattaaccagtcacgattgaccaccatgagctatcattaagccatcattaaataatagtgaatcataagttgtcccatttatatgagctagtgtctctaagcacggctaagcatcctattcactttagctaaaaccatataatgttctagctaatcaatttattaaccaagtgacaaggatagggaatcaatagcaaaagggctataacaaggcaataggttatttccacccaatgacattcaaaaataaatgcagtagttgaatagaaacaatagctttaaacgggatcaacatgctcaaagggttgtttgggatctgtgtgacttgccttgctggccttggaactcttcaaattcttctcctgcgaaaacggactctccggaaacgtcggaatctaaacagaaaagagcaaaatcaccaaaacagcacataaacaagcatgaacagtacatgtggatatttttaacatgtagatctcaattttagaaaaatttagagacttgaaacaactaaatccgagctaagatgaattagttatgaatttttaaagattaaatcggattaaaacacttatatggattttaattgaattatgacgcaataatgaattatttttgaaaagaaaaaagggattattgcgtcagcggctagggttcacggtagaccgggtgcatggcggcggctcacggaaacgaacggccgagatcgatccatccaaaacgaacggccgggatctatcggcccacgaccggtccacgggacatggcgacga

SEQ ID NO: 36694 - DNA, 833 bp, Oryza sativa
  unsure (1)..(833): unsure at all n locations
cccggcattgatgacantcggatagnagancatcaaattgatgaattcaagattaaaacccatgatcttatggttcataacaaactctcctaaccaatttaccctatgacactttgtgatttgagatcattgtttgttttctatgtacatctattcaaattttgtgaacacaaatccattatgttactgtataaatcataccttgttactacgattcggtagtaacattatcgcagaagtgcagtaacatgatacgttactgtaaaatttataggtcgttactgtaaaatttataggtcattactgcacttttgcagtagcatcatgacgaaattgcagtaaaagagaacatacgttagtaactgtactattacagtaccactgcttgtgcatagctaaatttttaaatctcaatattgtgcaaaatacagtgccaaaaaggtgcatatgcatggtcacaagtgaaaacaagtgctaaaagtacttctctttctatatacaaagatacaaagtaacaagcttagtaaaagtaaacttttagatttctaatctttaaacaataatacaattgccctgttactatacgataatcaagacaagatgtttaacgaaactagatccatcatgactattttataacattgttactacgaaaagtactcgtgttactacatattgactatcgcgttactacgcatttccagcgagacgagaactaaaaaaagtaaatctcaacctttagagagcaatatctctcatgttatatattatttttgtaatccgtctgcaccataatgttcgtaaaaaagtgcataacaaaactagatccatca

SEQ ID NO: 36695 - DNA, 612 bp, Oryza sativa
cggccccgtttgaaggttgaatcggcttcgtctgcaagtagttcatcattacctttgtttattgtgtgctccatgggttgtagagatacgcaacacgtggtgatagctccgttcatactttgtaatgattcacattcaggtacatcatagagctataggcctgattcgtttggcaaaccatggaaaagccagtgccctaagcaagtgatagagttttaccttaacttaattcaagattattaacccatctggatcctctctatccccctcctaccattaaattgttgtccctggatgaacctgtttccttgattttacacacttgttccctgagattcgatatggttaagtgctacagcagtatccgtgcgcttgcgtatttatctgtgagtaataaatatcaatataagaatttctggcggtgttactatggaacagttgttatattatcttcaaacctagtttgccttcttatcttatctttttatatttcttttcttttctttccataatggacaacttttatatgaattgttccaagggcagtttgtgaggcagcaccttataaaaattaattttaaattttgatttaaacttggcttgctttatagc

SEQ ID NO: 36696 - DNA, 695 bp, Oryza sativa
taacgactgcaaagttttcaagcagcaaatccaggtggccattgagggaggaaagatcaagttcgatgatttgaagaagccgatgaaggtcgatggtaatcctttctttgttaacatggtacacacttctgggaggacagccgataggggaaaaaatctaaatttccggatgaattcggctagagttattaacaaatatcagaggaagcatgataagcagtaggaaaagtattatgaagaagatgatggtggttttgatcatcattgggattgtgaatttttcagattttgctggaatgaaggtatgaggctaccgtcgattgaggattgtcctggatgcagcaatgatgcagggagttctagccgatcctataatagaggcaatcggctgagtcagaaaagggtacctattcatcagaggttgggcccggtaaattaagattatcaccataatgaagatgatgataggaatacacaatggtgtcctacaagtattttcaccaagaatcagaagagaagggttcaaaggatgaggaacaggaagcgttttcaagaggtgcggcaagagattaatcatcggctgaggaaaacttggaccaagcaggagtggcgtgttaagagcacggttacaacagccgatgatgttgaagccgacaaggcaaaaaggttgcttaagggcaaagctgttgcatctg

SEQ ID NO: 36697 - DNA, 156 bp, Oryza sativa
gcacgcaagaggagcttgacgcttatgtgtcatcagaagtcaggagacaattgaagcctcgaagtccagaaaagaagattttatagacccgagtgtcaagaacttctttaggggtatgtctgcacctgccaaggaggccataaagctatcggacta

SEQ ID NO: 36698 - DNA, 1501 bp, Oryza sativa
tcatcatgggtttgcatggtgtccatgctctgtgatactacctgccccgttaaggcgcaactgctacgatttccagaagggctcacaattgcaggaggaatggtcggctggggatcatgggaccgatgtgcggccatgcgttcatcaaccttccttgccacctcctcttgcatgctaagctcgtagctcaataccttgtactcaagatctgcaatcttcgcctcggtatctctcttgctcctcatccgactcctgtatgtgtggatgtcctccttgaacccaatcttccaaggaatcacccctgtcacgccgggaaattcactagtaatttccgaactaatttgtgcataaaatcctcgtccaggaatcagccgaggtacacaaactgacaatttaatatacaaatccatcttaataatgacgttacatacttacaaaagaaaagaaaacagcagcggaattaacggtctagcgatggcttcagctccactcccacaggcagctcaactggggtataagccaaacgtcttctccttctggatcctttatcttcaactgaggtttgatgattattgcaagaatgagcatatgacatactcaacaagccacacagcaaatatgcaagtgcacaaggataccaaaggatggcataatataggctcatttgcgaaagcagcatttagcaaagagttaagagtagtaaaacagtagagtaattaattaaaaattttaatcaacactgaacagcacacccatgctgtacaggcccaaccatcctgaacaaccatacccggctgtacagatctaactccaaaccaggagctaagcaaattattatcaggtattaacatccataattattgtgagaggtgtgagactaatcacgaaaaacattgctcaacccgcccataaccgcgggcacggctattcgaatagttttactctggccagaggtgtaccactgtacccacaagacacagctccacatcatgtcaccatgtgcctcagtaccaccacggtacctcggaaaggagctgtgacaataccccttgcataacacaactcaccacagtgcaccgttcctggatcataatcacccccttataaacaaggcatggactccccagcgacccccgtggacttctcgccacttcacagtctggcgcactataatgaatcatgctatacaaacgataaagccgttgcccacgctggcttgtggttggcacggtaaatgtctcacaacagtagctcgcgaaccggtccttaattgtcatgagcacgactctcaaaaccatgtgctcacaacccaccattatcaagttttagttggcaagtaattaattaaccaatcacgattaaccatcgtgaactatcattaagccatccttaaataatagtgagtcataagttatcccaatagtgtgctaatgtttctaagcatggctaagcaatcataactaatatctagctgaaccaatatataaagcccaactagtca

SEQ ID NO: 36699 - DNA, 379 bp, Oryza sativa
agcgcttgccgcttttcctcagagtacaatgaacgcggggtgctcggcgaaatgtcccgtccggctcctcacctgcaatgcatgtgttctggagagtgtttatggattctggatcttagaccccctcaacgacttggatcgtcagtaaagcttcatcttgaaggtgcacatctgccgttgtttcgtcaaaatactatgcatgatctttaggtgataaaatattgattgaattgtctactgctatcgctcagaatccatactccatcaatcttacatatacacatatttgttgcgtcaaacacaagcttgctttccatacatccctgaacaattcagcctcacaactgctcttgacatatctcattcagaattttttttc

SEQ ID NO: 36700 - DNA, 1501 bp, Oryza sativa
ttaaaatcgttcttccttctcattcttctccttgcatgtatagaaaatgcggtccggattagcaattgccattgctctgcgctccaaaataaccttatccttgcgcaacgggtacttgatcaacaacaccttcttccgacaacttcaagacagggactgttggaataaatggtctaggcccaatataattcaattaaattccataggcccacaattaatgttagaggtaataaaaccacgtcgggaatttaagtggagagatctcaacttaaaaagagaactagaggagagtccctattgaccggttgagatagtgggcggactgccacatgcgcgcgcgcgccggccggtcggcccgtggccgtggcgaggcaggctgctgctgctgctgctctctctctctctctctctcatgttttgtaacaaacggagattgattcggcattaacgacgctattaattcccgaagattgattcggcattaacgacacgattaattcccgagcgaacgttactctcgggagagactctacctctctcccgtcgccagtcagtcctctcgggtctcctctctatgcctctcctcccgtcgctagttacctccttctgttactgcgctgctagcatgggtaggcgggcaatcatgtttttggggagcgttcttccatgcgactgctcttttcttggattctgcatggctgcgatcctcaccatgtcggcggacaacaccaacagcgcaacggatggagattggttcggcattaatgacgcgattaattcacagagattgtttcggcattaacgacacgattaattcccgagcgaacgttactctcgggaaatactctgcctctctcccatcgccaatcagtcctctcgggtctcctctctgtgcctctcttcctgtcgctggttacctccttctgttcttgcgctgctagcacgggtaggcgggcaatcatgtttttgggagcgttcttcaacgcgactgctcttttcttggattttgcacggttgcgatcctcaccatgtcggcggacaacaccaacgcgcgcggatgggaagggtacggctagacaggatggtactggaggcttcatcaacggagacaattatgcctcacaatccagcggagggccattctctgggtataatctctctatactattgtttactgcgttaattcttattgtgtttctgtttagcgcaatgttttcaatgcattgctgtatgatggatgtctatgcttattatatattaagcatgattcgttcgttacatttgtttaacaattgcactagtttattccctgttaaagtcatgattattatcttgataatttggattaaaatatgctgaattgtgaccatatttccaacaatccaaaaacctgataggtccttttcggtagttggatttgccgcatcactgaaaccgcacgctttcgatggttcaaactataagagatggaaagcacgtgcactactatggttgacagcga

SEQ ID NO: 36701 - DNA, 1501 bp, Oryza sativa
tcattatgccatattggattgactatttgacaatgcaatatattttagtttgcttctattttatcttcgtattttccctgtacatctctgacttcgatcttcatgcaactcataaattaatcatctctctgaggttttatgcgccgcctatctatggaccggtaatttcagttcaactaagtgtctggtttaatttgttcagtgcacgaccagttcttccctttagttctattcattgaaaacgttgcattggtttttgtcacattgcttctaggtgaagacacagctagttaatgctctttgttcttatgcccaacattctgcttgttaggcagatttgctaatttttatcattatggatgatgtcaacattctgcttagaattaatgcaaagtaaaaataatatatgtaaacttacatatgtaaaatattgcgaaatccactctatataatgttcaagatatagaacttcgaaaacttatacacaaactagcagggtgacccgcgcaattgcgcggctagcgtccatataaaattatcttcttttacatatgagttttcttatattttgttaaatagctgtctcattattttgggacttcaaaaggccgaacaattttataggttttaaaagcgatttcagtcgctaactcttattcgttagtcacccctttatttgattattcgatgtatcacgttttttttacattttatgacttctatttcagacagtgttgagttcccttcaaacttctaaaacttccgtcacatcaaatgtttggacacatgcatggagcattaaatgtggatgaaaaaaaagtattaaatgtttgcgtgtgagataagacaacgccgttaaaatcagtgttacagatatcttaactccatctatatataaatgctgtatagaattaaattattaatttcaactaatttcacatgtcagggtacttaaaagtaaaattatttttataataatataaatctattttttaagtttttctaactaatacttaattagctatatgctaataaattgctttgttttgcatgtgtgaagaaaataatatgttggatgtagtacacatctttgatgttttggataatgacacgatcttcaaaatatatatttgactatgtttttaaattataatatatataataaataaataatatataatttcttacttttgtttatcgtacttagtaagacaaatctttatatattaatcaacatatgtatctttgaaggtattgatttaaattttgtgctacaacccaaaaatttcatctcaacaaatagaaaaagaaaaagaaagagaaagtggaggggacggtagatacatatgttgatttttctcgtttcagccgcccatgcccatcccaatcctcacagccagtctctagtttcttctcctctcctcttctctcgtttcttcctgtgctgcctcttatcacccttctcacctccttcaatggccagatctgatcaggtgaggtc

SEQ ID NO: 36702 - DNA, 1501 bp, Oryza sativa
ggttgctacaaatcggacgtccgatcttttgcaatagatcggacggtgttgcactatattatcacaaagtgtttcacatgttgcaccactcacgaaaaaaatgtttcaacgaaaatgtttcatcgatcgaggaaaaatgtttcattgcttgaacaaaattgtttcaatcaaatgcaatatctgaaatagactggttgcaacacgaagaatcagtaaagtgcaatactgaaacaaaaacaaaatgaaacactttagcacaataaagtgcaacgagatagaacaataggttgcaacatctctagaactcaaataaaaatgaacccaccttcatcttctacccctcaccggcaagattgaaacatttgtatcttacacatgaaacatcaagtttatactgttgttgaaatgtgaaacaccattgaaaaatgcagtgaaacatttcgatttaacacagagaaacatcgagacaaaatagactggaacattgaaaaatcaaataaatttaccggtctagatttggcttcttcctccaccccggtggccaaatcttcaacggtgccggaatgctgctgttaacgaccaaatttggtaaatcatacattggatttggagttaagaccgaagcggatttggaaggaaatcggcaacaaaaacagagtataaatcggcttcggaactgcatcggctacggtgtgcatcggctaatatcgaattggacaaggaagccgatgtagccgattccgacaaggggatgttggaaccattgttgggttcgtttaaagtgcttcatgaggattgccacgtgcggattgagtccgaagaaggcaattgtatctattaattaggaatagtttattagtttccttttatctttaggaaagtgtgtctgataaggactttatgtttctgttttatcttttagaaagtttgtttcttgtccgacaaggactctataggcccaagggtataaattgtgtaccaggggtccctgtaatctatcaatctcgatcaatacaactactctcggtgcatcgccaccctctttcctaaggtttttacttatcaaccggtgggatttgggcacctgacgcggggctgcatcggctttcgatctccggcgaaagggtaagtcctacgttccgccgggctctggtgaatctgtcatctacgttggcgtcgtttaaggctgcatcgcttcaatctcttggatcgctctggtttggttgattgatttgcctacctgatatctcgattctatctttaattacattgtgtttagagatgcatcggtttagctggaactgtctcggttaagtctgatcttctatcatagccgatatatctctacaatcacaatgtcgttctagatagatttgttatatccatcacattaagggtattagattatcatatacaatctcgtgctgtatcggttaggttcgacctactagattgttgttgataatataagtcttgttaagccgataggttcatgctaatg

SEQ ID NO: 36703 - DNA, 1501 bp, Oryza sativa
catagcactgaggagaaatttgaagggtgggtaggagaagagaaaaataatcccctaggaaaatggtgtggtaaagcatgccaagaagttagctttgtgccctaggaatcaagagatgtggttgcactcgtgaggaaggagtgtgatagtcccccccttcttttttttttctctttttgtagagcatggttcagtatacctgcaaagtaaaggtcctagaaagtaggaaggagccttggcccttggaggttgagataacatttattcataccaattatccaaacctgtcctgttattgaagtctggacagccaaaaactgatcagttatactgcaatttgttccaaagctttcctgcgactgtagttttttgcagtgaccagtgtaaccactaaccacttcttttaagtacattaattggataaaaatatttatacctgcttaatacccccccccccccctattccttacttgccttcgagtttagtagtctgcatgtatatatctttataaaattattccttttctatgaatcatgcaattttatgtttgaaaatgactaaaaacccccaagtgagctgtcctgtatgatgagagagacattctgttgggtgcagaatgctgctaacaaaaccacttgaaagattcagaaaatcttcaggcttgtaactgaaagagtttcagtttcctatcttgtccaaaggaggtactatgaacctctatgcaaggacgaagttgcatgaaagtcaaaatgaaatgtggcgtagtagtaaacttggatccaggccgaacagcacagcagcagaaaccagtgagccagtgtcctgcaaacgtgttcaatgaaccgtccagtaaaaaggtcaaatggcttattaaaaggatggccgtgagggtccatgcctgtctctttaatttttcgtaccttaacctccccagaattacgctacgggccgtggtgatttcctccggacatgggcagctctggagtctggaccactgcatggggctctccatggtgggatggtggatagggtagggttggtggatgtttcactttcaccacataatatcgtcgtgcatagtcacatggctgtccttgtaaggacattgaagcacagtaaagtggcctacccgcagtgccccaatgaaatgcattggatgtacaatagaaaaacatggacatgttttctctcctatagtactgaattagaggttttagctgttaattttttgtacaggagatttaattatggtacagtttatctgtgcaaccatgctttcaactgggaaggtagccataaaaaaacaagcttgggaagtcacttataagaaaaaccagtcttggaaatgaacttcctcaaactctactgtgatggttcatttcacttgttacacatgtttgattagaaaggtttaagtttttatctgaaatgtttttttttgtcactgttatgcatttgattggagttgtatagtgccattcaattgaggcctggtttagt

SEQ ID NO: 36704 - DNA, 460 bp, Oryza sativa
acttctactattagggtaaatattgttatggccaatatttttttaaccattacaaactattttcatgccattgaaaatctataatatttatgccaattgaaatttacaggggggataagatcagattaacattgtgggggcaattggctcgattttttagcgaagatgtaattggcaaccaaacagttgtcattgttacatcaacaacagtgcaagaatatataggtaataacacaaactatggaaatcagattgttctttttatttatataatataaactaactaataaccatgattatataggtttatctctaaggtcaagcagtgccacgagaatatatacaaatctacacatacgtgagacatggacacttattgacaggtatatgttattttaatactgatttttagtaacataatacaaatccttctttgattcaaatatttatgcctcataga

SEQ ID NO: 36705 - DNA, 1501 bp, Oryza sativa
gatcgacgacgtattagtttgactatttaaaagcgcatcactcttcagcacactgcacgccaccttccattccacttttttttcccgatttttctatgaaagcaatcacaccttccagttccactatgttttggagctagctgttcccttgcattccttcatcctgcctctttccagcctgcttgaattttacaattttcctgatagaacatgaggggaggcatgcaaattaaggccccgttcgaatctgattataggatgaaaattaagtgtgcacgtaacaagagataaatcattagcatatggttaataaagttttaattattaaaaattgaaaatggatttatttgatttttatagtaacttttatatagaaagttttcacatgaaatataccatttagcagtttaaaaaacgtgcaaacagaaatcgaggaaaaatctagatgttgttggagtttagaacggggaacttggctatgcacgatcgatgcaagaagtgatggtatcatagacacgggaagcgttgggaattaattaggtggccttgtggagtaagcagtttggacacgaattgccctctttgtttctaatcatgcggtgcggtaatgagcgtgacaaaatctgcaggtcccaaccatgtgttacggtaacttcactgccacctgttccttcttttgctttattatcttactacaaactgacaccagaatacctcttacttttggttaattttgccaattcctgttccactgttagtaattagagcgtggagttacatgtttcagtaggaacagatgtttgtccattccgctttgacgcaataattatatagtatctgcaaacccaaacaactttatttaatttatgtgtaatataaattgccgtcagatatatcttcagtacgagggagatcaatgtcaacaacaaatgtatagaaatagtaacagaagagatcacaagggaggacggtaaggtgcgagttgtgcaggccatgacatataagatccacatgcgtctcatactaacttagctcgccatgtcagctgaaactaggcacaatagttagcccgttaaatcagctaaaactaggcataatactgctctcacaccttggtactctagtattataagacaagagacacttatatttgttattatgattaagaacatgattcaaactcgatctcaatataagagatctaaagtgaacttattcctttacttttaaggaaggaaagcctctttccttgtaaattgttttcttttgactgtgcggttcacaaactgaatggaaattgaattttttttttcaaaaatattctttgctaacaaagttccttataaattttataggaactctttgaattttcggcaggatccgttctcgaccctagttcatcgctggattctacttgagccgagtttcacaatcaaatcccgctccctgcggcagatattcaagaaattgaggccaacgcagaatatatatgcaatctcga

SEQ ID NO: 36706 - DNA, 1501 bp, Oryza sativa
cttagtcaaacttctttaagtttgaccaaattgtagaaaaatttagcaaaatttacaacaccaaattagttttattaaatgaaacattaaatatattttgataatatgtttattttgtattaaagatgttgctacatttttctataaacttgattaaacttaaaaaagtttgactagaaaagaagtcaaagcaacttataatatgaaacagagggagtatcaaacaaagacttatttaagaagcatattaagcctatttttacactgcatttagttttgcagatcattattcttaacagtagaaactcttctttcaggcaaagccaatatcaatattttttaatagtgagatttgtgtatgtgggtatggtagttatccacatcattgcagtttctctgagattggtgaacagtttccttgaggtacaacatttcgaacattacgtcgttttatgtttgctgaaaattgtcttgtcaaaatgggccagaatcactaaagcatgcaaaatcttgtaggctatactgtgcctatcccaaatgttccatttgaaatttaaattgcttgcccacacccacaagcacagaagcatttttgtttgaagaaaccatgaaaactcactaaaagaatcaccaagggtgcactcccagtctatatatatgtgtgtctatatacaatataagaacccaacaaatttcttggtggaccatctggtacaacaacaaaaggagggttgttttcacatgggtgcgtgcatagtgtgatggaatggtgtggcaccttgtgcttcacaagcaacaaaccagaaaagaacaaagagcctttgagaatcacacaaaacaagaaataatactagtggttccaaactaaagtacttaaaattggttcacttgttcttaaatatttggaaataatatatataaaaggtgaggaatgaggtgcgttaatccagtaagttcatagcaccacgccttctgatttcagacattggtatgttccgaagtaactagtttgtgcatagcaccatactttctgtcattctgatgcatatacggatacaggagtgattattccaagacctactagtgaactagtgtggaattattccaagaccaactagtgaactatggaatttgaaagactctaaaaccccagaaagtcaggcaaatttgttcctagtttatcacgtgcaaacctaacaaacgggtccaactgacctcattttctggtggacaatgacatagtggctgtgctctgcagactggaacaagaggaagcttgcttgtacagaacgtaattaggagtaacaaaccactttatcagggataggtagggtgtcctattgcaaaccgacagtggtccacaacattaaagatttcaaggtaccaaattaagttttcctaggccctgccctggaggaactaattgatgttcgtaacgaaccgccattgcttgaactagagaggaagtagagaggaggtaagagatagagaaatcagaaat

SEQ ID NO: 36707 - DNA, 1501 bp, Oryza sativa
agtgcttggtagtgaactcttcggatgaaattctttgttctggatgccaggaattgcaccaatggcattctagatgttgcaaccttctcaaggatattgcattggaagtatcctattggtgtcgcgtctcgtgccagcatccccgtaggttgggtttggtggctatggcgatggcatgatctatatgaatgactgacttatagcttagttgctcttagtattttccgtgttggttcaacgttagttatcgactgtgatgatagcgaaatatgactgacaaggaaacaaatacagaacaaatgagtgtggcggttgccattttctgttgaactctataagagagtcagggagaccttttggaaaactacagaatgaacaaccacattatctctataattgtcatcttgtggtccaatcaatccatgtattttcttcaatattttacaatcttcagtgtttgcacttgaattcatcccatagttatatttttttccttatacattccctttttaatcattgtttcaaatagttgttctttaccacctcttcctaactttcacttgcttgtttttcatgtccacacttcccaactcattaaatagtttgttttttgaaagaaaatgcatatgaaagtttttttaataaatatattgatttatttttaagtttattttaactaataattaattaattatacagtaatccctccatcccattttgatcactctctaaaattgctgaggtattcccaaattgattgtcatctaactggtgtctatccatttacatgtgtaagagtaaatgtgttgcgtttctatccgtttatgtgtgtaggagtaaatgctatagttacatatccgtttgtttatttgtgcatgagtaaattgtattattgcatcctcacgtgcatgtctaacataatattttgatcgataaggtttaatttaagaaagaatgatgttttttttcttgatcacgataacacttatgaatatgatgatgaagaggtgtgtaaaacatagttgaagatgtggaaatgggtggttgtctctccctctcctcctttcttctccaagtcaacagttcctacgctaccaaacccgatcggacgcggacactgacagagccgacgccgacggacaccaaacttcctttcaaatcaagggttttagaaccccaccacccggttaaccttaagaaaaggaaggggccaattccgcccgcctctcccttgtccaaccacacaaaccattggcccctttcaacaacaacaacttaacttcttcaacaacggccttcaattcggcccccggctttttcttccggttccttcttttcgcgctgtgccggttcccggtcaccaccctcgtcgccgccttcttcctcctctcccttttcatgtacggcgaggaagttcgcaccctcgccgagctttccatcgacgactacctttaccccgacgccgatttttacaaagtttccggccttccccctttcctcc

SEQ ID NO: 36708 - DNA, 177 bp, Oryza sativa
tctcttgcagtggcacttccttccttaatttgttcctctgaatttctcactgaagctcttgttgaacttcaacagatggccaagcaaggaaaggaaaagacaaaactcgctactctgaacatgtaagtgcatgccattctctactagcttagaacttgtgagtttaactgtaacagt

SEQ ID NO: 36709 - DNA, 1501 bp, Oryza sativa
ccttttcagcaatctgtttcagcgtagtccacccctttcttgcccgcttccttgaactaccagacatctgagcagaaccacttgctacagatttatttttcacacggtcctttggagctgacttggtaggcattgtaggggccttgccagtaactgaacttggcatctcccctttcttgttctgaatgcttcttgtcttgaccagttctgcagaatccttatggtccgtcacatccaccagtttgttctttcgaggagtaacaaaacttgatccgactggaaattctgcttttgaaggaaaatcgggttggcatattgcaattttgttagcagaaacaggctcagtttcatgcatacctttttcacttgtgattgttaccactattttctgtgagacattctcctgatcagtagctgatgctgactgattcagttccaccgatgaacacgctacctccttttccatagattcgtcaagaagattgggtactggactttcctcatactcattcttttcaagattttgttgtttcaacccagatgttgactctagttgtgagaccgctgcctgagaatattcaaagccctcttttatagttactaatctcttgttattactgtcccctttcaactttatgctggttacatccatgccaactggctttcttgatgataacaagcccttcataatattctttccgctgccccttattaggttttggtctccacagaaatggcacaggtaagaaatgctgttctggcaagtgtttaacttcttgcgtcgctttgcttttcttttgttgttctttatgcggattgtgcagttgaagcctggctgtaagactgtttcacacctgcaaaagtttggagaatgtttcttcagaagtcctatagagatattgctctcttctacagtagtaatgcttatgatccagacaaatggatacgcgcagtagaaaaaaaaaacataactaggaaactgaactacaaagtactcattataagatgttttgggttttgaatagattcatgcatggatccatgtatgtgattcatatgtgtccaaattgataaggatgttagtgaatctagatgaagaatggagaggccaaaacatcttatagtgtggaactgagggggtacatagtatgtcaaaatgttttgtagtcgctttaacatggctactttagtgctcacatcatactatagatgtattaatcataattatgggttgacttccaagatttagaacaaacacatggcaattactatgctgttatttgttcaagctttgcttcagccatacaacattatcaggatgactactcatttcaatttcttataggcaaaatttgctacaagacacttaaagtctgtggcctttactgtgagacactcaaagaatatgtatcttctcgtggacactgcaaaaatgtggtaattagctgttggacacccgagacattattttattattttcggtggagacggagagagaaac

SEQ ID NO: 36710 - DNA, 811 bp, Oryza sativa
tatttttttaagcaaatttgattttttaagcaaatttgattagctattttaaaaaaatagattaatttgattttttaagcaactttcgtatagaaactttttgcaaaaaacgtatcgtttagtagtttgaaaagcgtgcgtgtggaaaacgagggagatgggctgggaacatagggatgcaaacacagcctatgaaatggaggagagagtactcaagggaaaaaaaaactagataaactcaggttgtagacttgtcgtacttcaccttggccgttcccaacttccatcttttacttccatccccttccctctgcactgcagcaacgcctgcgtggtttttctttgttttttccaacagaaattaatccggcttatatttttctcctgtgaataaaaaaaaaaccagaatctcgaagaaccgaagaaaaccaaaccgaaccgaagagtgcgtgagccattacgtcgtctacctcgcgccgctcacctctcgccgtcgtcgaagccacacgcgcgccacaatttcttttaatcctcggtgagacgagagcacgagacccatccccatcgatcccacatccacggcgctgacttctccagctccactccacgtctcccagcacgaggggaggagaagaatcaaatcaaatcaatcagtcgcaatcgaggggaatcccacaattctggacaatccgagaccctcccgctccgctggattccccgcctccccttcttggattgggctcagctgggatgattggattgccggtcgcggtttgagctgaggagattcttgcatcgagggggggaggga

SEQ ID NO: 36711 - DNA, 1458 bp, Oryza sativa
aggcgaggaggcctctgaatgaggtgtggacatactaaacccgtaggacttcttgcgagaatctgacatgtagtaatggtgattaagatggtggtgaggatgatgttggtgacggggtcggcgaggcccaagcagcatccggcctcgccgaggcagtcagcgagctccgggatgtcgtccaggggaagccggcgcgccgcctcgtcgtaccacgtgtggttgcatcggttgtcgtcgtcgccgccgccgtgataacacgtaaatctgcccaagctgctgctccgtcgctgtcggttggggattttccgccgcttcatcgcaacctgacacttttccttcctttcttgttgatgtttgttcagttgaggcttccttccttgttggtgtatgtatatataaacacagtaataaggctgaatcggatacgggagcacgtagtaccaacccactgtagcttaccaccgccgctttctttctcctgcccaactgttatcgatccatccatatatctccctaacatcgacgatcaaacatttcggggacgcctacgcgtcggacagcactaaaatcggacgcctctctaacaactctctctctcactacctcttggtatatatacttatttaccaagttataaatagttttatctaataatttatcaatccaatctacgatataattatatcattgtaatcattataattaaatctttgcaacaagatctcatatggttatattttgataaaaaaaatgagcgttgtttcaccccttatattaaaattgtttcatcatgtaattaaatgtgtttcaaagagatgcaacatttcgataatactgactgcaacatcgacaatcactgcatgaaacgtttagtcctaactagtgaaacattaaaaaaagtcatgtgaaacataatatattcacaagaataattaatttgctaaaacattttttagaccgtgtgaaaaaaatgtgtaacatttataaatggaatagtgaaacactaagaaatacttattgaaacaactgagtaaaactatgcgcaacattaaagaataagttttaaaaaataaccagaatataattgagtgagatcttgttgtaaagatttaattgtaacaaatccaatagtacgatcaaattattgacaagataagtaaaatagaaaaaaaaaagttgtttaaagttttaaaataaagttgttataagcgtatacatcacccgtaggtgcacctgagcacaagaaaaaataatcaccgcgtaacacatgtactactaacattgagtggaggcgttcaatatttgtgattgtatcggacgtcagacagcaagtattcgtcaaacatttcagcagaatttccatccagcccatcataatgcccttagtttactattacttcctattcaaaaccatcatgcatatctccaaccggaaaaagtacgaattacctcctgaac

SEQ ID NO: 36712 - DNA, 1501 bp, Oryza sativa
ctaagacaagaatcgttacgaaaacagagcaagaatcggctaagtccgaattggttgcgaccttaatcggcagagttcgagtcggacaaggttaaccgattgagccgattttgacaatacgactcggtatacgttatcgggtcgagttgaagtgcttcatatggattgccatacacggattgagtcctaaggaggcaattttatctattaattaggatattttatgtaaattccttagagataagtttgggcaaaagtctgccgcaaagacttatggtatcttagagtttgttagagataagagtcgtgtccgacaaggacatattttgtaatctcgggtataaatagaccccgagccccatgtaataagataactcacgttcaacaacaatttcagcgcatcgccacccttttacgttcgttttgtttcgatgagttcttgctttcgggttgagctggatcagtttcgatcttcaactagaggtaaaacttgttatggcggcttgcgttctcaggattagtgcttccatttttatgatactctaattttgttcatgtaagttgtcgagttatcatatatcttatataatctctgacaatatcgctgtctaaccttcaatcggctaatatctatcattagtgggtagccgattaggttaaatattgacgttggcttagattatataggatatctaccattccataaagcttccaatagcttgattgtctacatattgtctttcttttcatacttatggctgcatcagttgagtttggtctcataagtcgtgtttagaactatagtctctagcctgcttcttggttgttgagtagagtagcatcggagtttcagccaatcttacctgatttagctttatgtcttatgtgctcaattgttatgctagatctgccctttgtgttaagatcctattgcatttaggtgtattaagctctctgtttgatatattttacttgctttaatatcttaatatagagtggtgtcggagtattagccggtgcacgctagatctatctgatcggctatgctgtgaacatctataatctcatcgttaatatatattttgatctaagtgatttatactgtctcggcatggcgaccgatccatcccaatcacttgatttaagtatatatcgacataaagattatgtgctgttaacatctacagccgatcgagtagatttagtttcaattcacttatttacaactgccgatcgattcacatatgacatcggctcaaagataaatgatatgtcatcggtggctggccgatcggctatcatttatggatttaactacagtttctttgtctctatttcttgttgattgcaggatcaaatcaactggcacgctcatgaacctaaaaggcaagattttggacctgcactggagttaagcagatctcccaggcctcgtgtttttcgcatcaacacacttttggcatgcccagtgggaccacgagtgttaacgacttcttcccgt

SEQ ID NO: 36713 - DNA, 1323 bp, Oryza sativa
gagagagagaatagagagaggggaagaaagtatgacaggtgggtcccatattttttattaaatagaatgctgactggactgccatgcgtacgtcacgtagataaaatccaccgttgattgaaccgagggaggtaattcatctggtttgcatagttgggggtgaagaatatccggttttgtggttcaggaggtaattcgtactttttccggttggagatatgcatgatggttttgaataggaagtaatagtaaactaagggcattatgatgggctggatggaaattctgctgaaatgtttgacgaatacttgctgtctgacgtccgatacaatcacaaatattgaacgcctccactcaatgttagtagtacatgtgttacgcggtgattattttttcttgtgctcaggtgcacctacgggtgatgtatacgcttataacaactttattttaaaactttaaacaacttttttttttctattttacttatcttgtcaataatttgatcgtactattggatttgttacaattaaatctttacaacaagatctcactcaattatattctggttattttttaaaacttattctttaatgttgcgcatagttttactcagttgtttcaataagtatttcttagtgtttcactattccatttataaatgttacacatttttttcacacggtctaaaaaatgttttagcaaattaattattcttgtgaatatattatgtttcacatgactttttttaatgtttcactagttaggactaaacgtttcatgcagtgattgtcgatgttgcagtcagtattatcgaaatgttgcatctctttgaaacacatttaattacatgatgaaacaattttaatataaggggtgaaacaacgctcattttttttatcaaaatataaccatatgagatcttgttgcaaagatttaattataatgattacaatgatataattatatcgtagattggattgataaattattagataaaactatttataacttggtaaataagtatatataccaagaggtagtgagagagagagttgttagagaggcgtccgattttagtgctgtccgacgcgtaggcgtccccgaaatgtttgatcgtcgatgttagggagatatatggatggatcgataacagttgggcaggagaaagaaagcggcggtggtaagctacagtgggttggtactacgtgctcccgtatccgattcagccttattactgtgtttatatatacatacaccaacaaggaaggaagcctcaactgaacaaacatcaacaagaaaggaaggaaaagtgtcaggttgcga

SEQ ID NO: 36714 - DNA, 1501 bp, Oryza sativa
cttataaggccctctttgtttaggcttagacttttaagtcagcttattggcttatatgatttataagtcggtggattaatgtcctaagtttagtggcggagccatacatctacctcacataagccaaaaaagcttctctaatctagcttttggcttaatagtgttagagtggcttatggcttttaaaaagccaaatgaaaaggttgctcgtttgtttaggcttagatttttcggcttataagttaacttataagcctaaacaaagagggtctaagcctaaacaaagagggcctaagcctgctcaaaccctaatctcggtccagtccacaccatatattctcattatctctttctaggagggagtaagttcaatttagatcccttaatttgttgtcgggtcagaaatttgtcccaaaacctaaataccaggtatatccttcaactcacaataccgtgtcaactttagtcccccagcagtataatggccggttttggctgacgcggcgagtgacaccgacgtgggccccacatgttagccatgaagggtgtctgccatgagtgggagctcatggcgacgggcatgtaggcacggccgggctccttgtaccgctgccaaactccctgtgggtgcctgtggcacacgcactgctatcaccatcttgccgtcgccgccaagcaaccgctgctagagctgtcaaaaatgctcgaggctcgtgagctactcgagcttgatttgttatgagctcgattcgagctcggctcgtctaagaatcaaaccgagctcgagcttgactttaagctcacgagcctaccaacacgagctcgaataactcggcgagcctcaacatctggctcatgttctttctcctaggtatttcctccccttctctctctttcttactcggtcaaattctctagtagtactggagtagcacaactgcacaagtactggcagtgccagggcagagggagcactatgcatttgttgtcccatttcccaacaagagagtaggagtactagtgtgcggcttgcacagttgcattagtatacataggagcactagtattacttttaggccctgtttctttcagcttgggattattataatccagattattgggagtaagctgaaagaaacagacaacttattgaagtagcttattataatctggagcccagcttattataatctgataagctcatttaggtgagtttttttccagattattgggtgaaaaattacccaccatgccaccccactctctctttagacttgcaaacccaataatctaggaaagaaacaactaaccgcttattctactatagattataacaatctagcttatagtaatctgactcaataatctagattataataatcccaagctgaaagaaacagggccttagccgtctaatcatgcatcacagtgtcagctttttctttgaatggaatgaattgttccagtattccaccgcaccaaacaggcttgagaaaagctc

SEQ ID NO: 36715 - DNA, 1501 bp, Oryza sativa
gcaaacccaataatttaggctctaataatctaggaaagaaacaactaatcacttattctactacagattataacaatctaacttatagtaatctgactcaataatctagattataataatttcaaactgaaagaaacagggccttaattgcatcactctagcggaaccatgaagcaaagggcaaagaagattgcaggaccctcttcctagaactgcaaagggcaaagaagattgcaacaccctcttcctgtaactcaagaagaaccaccatcatttctgatagttttgatgaagctcaaactcaagaacaagaggcacctcttgctcctatcaatctaaattatctttgtaaattttgaccttgctagttgaattagtcgattagtgatggtataagatataattctatcgcttttaaactaattaaatttctatttgtttatgggatttgcaatgttagaaaattttggtacgttgatgtgaatgaaatttctacttcttcaccggtacttgtgaaatagaactacccaaccaaaaattcttggccactatatatcatgatggtatttcttaaatagtactattagttgtttgaactatcgtaatacaaaatgttcatgggagtttctcttctacttcctccgtttcagattataaaactctttagcattgcccatatttatatatatgttaatgaatcttgacacatatataataaaccgtgaaagtcttataacctaaaacggaggtggtatataataagccgtgagtgctgcccacttatttttcctttacgcaacaacagaggagccaagatgcaatcgacaaaaaacacaccgagttagccaattaggcaccaggggttgcgtgtctattatactacgtcatagcgaccgccaaaatatcgaatgcgggtggaaaataaatttttcacgcaactgatgactagatggagaacctctttttttttaaaaaaaaagttacagtttttgacaaaatgcttcagttattcgtccctgacaaccatattccagacttccagtcatgtgtccagtccaattgaccaattgtccatgcacctccaggcagcatatccagagatatccctccgcaacagcaagtgggagccgcgcgcgagccgtcggcccgccgccggtcacgcgcaagcgcatatgcatgcatggcagggaataaaattaagcagaagggggatggacgatcccaccgggagatctcccacatggccaccaccctccccctcaccgaaccacggcgagaaacgcctgcccctgctcatgaaaacgaccggaatattctcaccgaccttgccccacaactccacacacacacacaagattagatactttctcaaacaaattcctcttctttctttctttctttcttgtgcgtcatctctatcaccgatctctatccccctcctaccacctacgctacgcaagcttatctatttgccgcctttttcaattaattccaaaaggaa

SEQ ID NO: 36716 - DNA, 624 bp, Oryza sativa
taaacttcttacaaacgttttcaaactgtcacgtgatgttctacaaacacttctagacgtcatgtggcgctctaattaaaaataatctaaacattgatttttcttcaaattggtggaccaaataattttaactattagatcttaaaaaaaatctggctcccccacctccacccccaccgtatgtgaccatgcatgtacatgctccaccctcctactctcctctaggatcccattgtcctctcctattttctagctaacacaaaaatatataaaaaataacaatagctaaatgatgatgattctcaagttacatgtacttttctcaatttatttgatttcttgtgttattgataattaaatacataatccaagagatatattgcccatattaactatataaaagttacggcctcatcttttcgcttatgcttattagctaaaatttaaatttttaaccttaaatttggagttaattttgtggttttctatctaagtttatttttcaatatttgttttttgatcgctaagaacatgtatataaaaatttttcataaattattttttgtttgcaaatatgttgtttaacatgggaccgttagataatttggttgttttgactacaaa

SEQ ID NO: 36717 - DNA, 1501 bp, Oryza sativa
agcaggcaggcatgctcctcaaccaattgactgaaattcttggcaattggtatgatattgccgacatccgaaagtattaacaattgatatcatctctgaatttttatggagaataattagagtacttctgagatgatatggaaagcttttatggatgtcgaagaatctctgcattttgcattctgaacaagaaagttaatagaattattacagtacttccacttaatgtcatttaggtaagtctatccaccttactctcttttggtgcaagttattttgaatttggttattgccttgagtatgtcttgcactgatgatccagaaagagattgcagctactactgatcgatagcactggagcatgtttagctgttaccaaattcatggctaggatgcattctgatgccatgcttcaaagggcatgtacagaaaccactggacagaaatcgttcctctagcagccactgctctattcagttccttgctgaccatggtacaccataaatgcaagcatgctgttacaacccaactcatccagacaaaggacgattgttcgagtggacaagcatttctggactgaaactggaggtaaactcgtgatctattatatactaaaattccattaaacgtcctataaacacttctaagccaccacatggactcctacaaacactcctcattcgctacatggcacaccattaaattaagaaaatcctataaattctgagaaaaaaaaagcaaaacatcacatccttaattttcacttaaaacggtggactcattatcgtagactattagatgtatatctatctattaaaaaataaatctgcgaatccttagccctcgcatgtcacatgccctatgcataccatcgggctttccttgcgcctctcctcttttttaactaagggttgggttaattggatcaatagatccatgccactgcaaatatggaaaattagaaaaatgccaatactattcgcgatatcgactaggtgccactaaaattttgaaaaattgaatccatgccactccatcgcgtttcccgtcattcttcccgtccttcccgtcactctttccaggaggccaagggcatggaggccagcgtcatgggcgggggacggcggagccgatgggtcgaggaggcggagcgacggagttgccggagccgccgctttctccgacgcattccgtcgatgaagctgttggaattaatagatgggctaaggcccattcaagaattaattctttggaaaatcacaaaagcccatctcatgggatggcatgcatgtggagtttagtaccaccttgcttattctaggagagggggacctccttaaaagggaggatgccctcttagtttacatgtgtagatctaatgatgcgttcatgctagtttacatctgcaatgtcatgatttatttatggaatatattaaatcattatatgcatataatctcaacaatccaaaaaccttattataggcgctgtgattttacta

SEQ ID NO: 36718 - DNA, 650 bp, Oryza sativa
cacccgtgaattcaccttccaccctaacacactctcgaagagatagaaaccagcaacacatctctcatcaaagtaaatccctatttaaaacctacttatatgtacggaatatttgtgaaaactagcaaggtacgtaccacgtctccatcacatcactagtatttccccaagcagtttaatctatctatctattatattattaaaacagtcttgaaaggagacaccacgttctatgtggggaataaattcccaagttaatcgaaaaaaaaagaaaaagattttaacgattggataataatagatctagattttaacggtaaagatttaatcagagttttacagagtatatagcagaaatcggacaagtcggacaaggtaaaagtcagaaccatttaaaagtccaaaggtagaaaaggtgtattacacggttttctatagcctttatggaattgggagctcttatttcatcttggcacacagaccaatgataattaattctatttaccatccatttaaacatgctcctagtcattcttcgtaaacatgcgattcattaatatttacatttcacgatgctcaagtagccaatcttgtatagaagaatggagagtcatacattaaatccgagaaagtcattaagatgatagatt

SEQ ID NO: 36719 - DNA, 1501 bp, Oryza sativa
tatttattaacatctatataaatatgatgagtaatgctagaaagtcttacattatgaaatgaagggagtataacgttatactacacaaatagatttctaaagattaatgatcgaacttaaaatggttaatttagataagacgacaaataattcgaaagcgggtagctgtacctttatccatcctctcattccctctgcagtacggcgccgacatacggtggtacacatgacatgaaacacagacattttgaagccaggaaaccaggtataaacattattcgttttttacctcataaagaaaagcgcacacgaaagaaagcgaagagcccggccctgtgttcggctcctgttggaaactaaggctctgttcactttgatgtcatttttgatcttaccaaattttgataaagttatcaaaaaagtagctatatttagtttgctgtcaaattttagtgagtatataattttggcaactatgtcaaaattttggcaatgccaaattttagtaagtctttttttgcattaaagagaacatgccctaatactctgtccatataaaatgggtgtactccctccgtactcgtaaagaaattcgtttcggacagtgacacggtctcgtttggacagcgatacggtctccgaaacataactttgacttcttgtttctatagaaatatttattgaaaagtgatatatgtatacttttatgaaagtatttttcaaaacaaatatattcatataatttttacatttttaaactcaacaacttgatagttatttatgatttatattcccaaggtttaacttaaacattgtgctaaacgacttcctttacgagtacggagggagtattcattagcatatataattaattaagtattagttatttttaaataggttaatataatttttaaagtagctttcgtatagaaaatttttaaagaaacacaccgtttagaaatttaaaaagcgtgcgcgtaaaaaaacgagagatgaattagggaagtgaaaaaaaacctcaacaaagcccctgtccctgcctacctggccccacacgtcagcaccgttccaaattccaattccttgcttccctcgccggccacccccgctcgatccgcatctgcgccgcaaaaagaaagagaaagaaaaaaaaaaaaagcaaagcgaagcacaatctcctcctcctcccttctcctcccctcgaagaaagaaagaaagaaggccaaagcggcaaaagcgaaaaagcgcgcactccgcactcacactcccccctccctcccgcttaagaagatgccttgcccccatctcctcctccccttcctcgccgatcctcaccaccaccaccgccgccaccgccgccaacgccgccgcggcgttggtctcgatcgttgtcgaatagggaggagggggtacgttggtcgtcgtcgtcgttgtcgtagtcgccgccgcggggcgggggaggcatggcgacggggggaggggggttgtcggggccgcagcc

SEQ ID NO: 36720 - DNA, 328 bp, Oryza sativa
ttgagtctaattatgtcatgattttgacaatgtgatgctacagtaaacttttgataattatggattaattaggcttaaaaaaatcgtctcgcggattagctctcatttatgaaattagtttttttattagtctatgtttaatactctaaattagcgttcaaacatctgatgtgacttgggctaaaaagttttagccccatctaaacaccccctaagcaaatccggcgacttttgctatctcgctgttctgattgccagcaaatttgatgatttggagctgctaagcaaatccggcgacttctgctatctcgctgttctgattgccagc

SEQ ID NO: 36721 - DNA, 812 bp, Oryza sativa
tcctgcagccagtgggaatgagttgttatgatgacccaaccagtactccctccgtcctaaaaaaaggcaaaccctgagtttccgtactgacgtttgactattcgtcttatatgaattttttttataattagtattttcatatttgttagatgataaaacatgattaatattttatgcgtgacttatcttcttaattttttttatatttttttcaaataagacgaacggtcaaacgttggacacggaaaccagagtttgttttttttttgacggagggagtacgcaataatttcattaggacgatatgacgacctaaccacttaatgtaactttaagttatttttacgttttcgtacagaaatgacccttaatttctggaccaattctaaaaaaaaagcgaaaatgagaggggagtggattctaatccttcgggattatatcctctcgtgtaccttttcttttaaattttatacaaatagtagtaaacaattatgatttttttagcaatatagggtataataatatctatcgctttaccaaaaatcatgtccaaattcaacctacacgttgagaaaaaaagataaatttagatgtgaatagtacattgctattcatacgttaaatttgtcttttttatcttttttttatcttgacgtgcgagttgagtttagacctaggattttgtggagttgtataaatatattgtataagcgttttcaaatttctttagaatttttcataacagtttggatggtttttaagcaatctagagaacgttcctcgtgggatcagaggagaagaatattctattg

SEQ ID NO: 36722 - DNA, 1489 bp, Oryza sativa
ggttggcttcagaggatggattaaagcttgagctagctcacctggaaggcaaaaggcaaacatctgagatgcttccatttgacgaatgctggaccttctcagactaaatacggtacaaaagtatataattactgtctacaagttcacagccaagtacaaacagattccaacaggtgctaaacagccagtaagctgcaaaacatagctgtcagggcgaatcagtgattcagtgttcgttttccctcaatttttttaatttccctataaaaattaagttttcgttgcaagccctatctacagtgctaaattttacaagaaacagttgagttagagcagtaacagcatgctaaaatgaagcaaacaatgagactgatcactgcaaaccataattgaagtactagtataccacattgttcccactactcatactgtcgcactcgcacatcaccagcacgttgcagttgctgctggacatcagaaagttactgtacatttcaactctttattgaagctctgtactagctggggcacatccccctcatgaattgaagacggatcagtactacgatccatcaaaatagaggtattctgaatttatatttctaccctccccactaatgaattgatgacctctggaattttactcaagttgatggtgggtgtgcaagcgagcacaaataattgacaaccgaccatgctctcgcagaactttcaacttaaaactggtaaagagttctaaacctcagtgcccatagctttccttgttgataaagggtatcacctctcgagcaactgcaagttatgacactatctcgagaaagaaagatacagtacagctgagcagaaccatcactgttagatatagcactttgtattcggatggtaggtcatcctgcaaatagccaaaatgcaccaagatgatgtttcagcgtttacagtaaaggataagagaagcagctccagtgcatgcctttttaggttcgctttctgtttcacattgttacacgcacccaaaatatcccctatatgccgaacaaatcaatcaatatgagcaactactttgcttcccagtcacagctgttatatactataatgtactagcgtaaagaagacagtgcacctgaaaggcagaggtgtcatttgagctctgcatttcgttggttagtctaatagtctaaggcaaatcagattagcaaatgagctagcattggataaacgtaccagaaaggtagatataccctttcattatgtacttgaaacgcagacaacagtgagaagaagcatcaacacctgcctgcaggagtctctacggccgtcggcctgatgagggcatacatcatccatacaaccaaaccatccgtatcaaacacataatgtcataatgatgtccttaaatattggacagtcaccacccatggtacactcattaaggtttcccaatgataacccccaattggaccaggcaccatgttgtcattaatgaccaagt

SEQ ID NO: 36723 - DNA, 1358 bp, Oryza sativa
gatccatgcactgaatggatatactccctccgatagattttagatagacaacatctgttgacattagtagtaatatgaggtgttccttaaatctaaaatctcttatgctttatggcgattacgcaacaattttgatcgtctgcttttatgatcaatggttcacactaaatattatagtaccatttttgtgaacagtgctttatataaaatattatacgtctcattatctcatgcgtgcatgtgaaacttgattcaattatataaataaaaatgtgtagcgacgattagtcactaattcttaataatattctaaacctagtccaatagagatatcattgttgcattatcgtatccgccgaagagtttattcgaaaataagattgaaccatgaatctctatacaatccaaaggttggggatttaattagtagtatgtgatgtatttacaattatgtataagatattacacaagaaaataatttgttagttttgtaaaaataaaatccatagtccaatctttacacaacaatggcaacaaaacactcaagaaaggcaataggcataggagtgggcagaaaaagactaaaccgaaaagatcaagactgagaccgaaaagactgagatcgagaaattcggtccagacaatgaaagaccgaatttcagttcggccaattcagttagtctcctcggttaaccaaatagaccgaataacaaaaaaaaagtctaaatgcaacctacaatccactgagttcaatatgattaaactatagttttcacatccctacttcttctaggcatgcaacctaataagagtctttattcatacgtgcttacgaattttttttgtgatttttgtgttgaaaatttctattatttctttgcatatatgaactattgttgaatttcggtcaggaccgagaccgagaccgaatttatcggtcctgatatttttgttttgaaattcgatttaactttttaaagactgaaagattgaagttcaagaccgattttcggtcagaaccggatgtcccctccctaaataggcatcattacccataacaaattcacacaacacgggtcgtgccatagacacgaaacgctagccaccacgccaagcgcccaaccccaactccaactccaacccgtcgtgctcaccgagaaaggcgaaattgaaaaccaccccaacccgagaaaattgcatatctaccatcgcataagattggcttcgcagaaataccatcacttaaatcggcttcgctagaataccactcccaactagaacggcttcgccaaaatgccattttggacaaaaatgaccctgcatctatctcttccacctccggcacgagcaaacgacaa

SEQ ID NO: 36724 - DNA, 340 bp, Oryza sativa
gtcaccaataccactatcaatactatcttatgaatcattttgtaccggttttaatagttgaggtattcgttatatccggttttatggttgagggatatgaattagattgacctataattaagggagccaaattggaatttttagttttactctcaacaaaatgagacccacaattagattaccggaaataaaagggccagctatcaaaaacttcaaagcaattacaaatcgggcgcccgatttgtttctcaaaaattgggcgttgtttcatttaggggtgaaaacggagcggattcggacgataatggtcataccatatcctaaaccatatattttaagc

SEQ ID NO: 36725 - DNA, 1501 bp, Oryza sativa
agagagatgatgtatttattaatgacccactttaagaaatcatgggttgtgaagtgtagtttccattgtaatgtcttattgatatgtcaccatagacactgtttatggacactatgggttgagactgccctaagttggtacttcttcaatttgcttgtcgttctccatatgttacaaattaaatcgttgtggcaatttacatcgctaccgtattaataacataacaataatctttttaaggcaagtattaaaatttccagtgatgagtacaaatagtagtatggatgcattgattatgggtaagaaggaaagtatacatctcggaaaatgttttggagtatgagaacgaaaagtactttcaccaaaattttaaatgctagagcgataagaaaattgaaacagaggttgtatggagctaggggtggaaacgaggcgagccgagccaggctcggctcggctcgtggaagctcgcgaaatgccaggctcggcttggctcggctcggctctccaaccgagctgtacattaggctcggctcggctcgtggtctggctcgagccggctcgagctggctcgtgagctttgcaatagcagcagttgtattgccagcagcagttgtgttgctttgcaatgacttggttattcagataataactctcaagtccctacaaagataattaagtatattatatgcagccaacatataacaaattgatgggcttttttggttttcagccagaagtctttctattcaaaccgagcctactaagctcgtgagctgctcgcgagctggctcgggctcggctcggttcacaaacgagctaaaacccaggctcgggctcggctcgttcaggattcgagccgagccgagccaggcgagcccgagccgagcttgagccgagttcacgagcccgagctatttgtccagccctatatggagctttgatagaaactatatctttgagaaaacagatgtttgagattggtctagacaacctaaagaggagcggctacatcggttctcctaataagtaaatgacaaagccaaaatttcaattttcaaacttaattttaaaattgattttaagatatttcaacgtagtttctttttcagcattggcttttaagtcgctaagaacacatataaaaagttttacctataaattgatttttcctccattcctaaggacccctaaatcttatgctgtacagatttgggttcaaccgttgtaggcgagttgtctggacatgcatgacttgtttgccgttggatagtttccaagcatgcagcttttgccgactttcaactactggtggataattcattgcaactaataaaagccaattgaaacgcagcacacatgccacacatcacaaaacgcatgcaacccgacggttacagggattgagaaactagttgaatagacagctccagtacagaccataatggtcatcatgaacaaacagcagcaatgaatgacttaaacacccaaatgcaaaggg

SEQ ID NO: 36726 - DNA, 1501 bp, Oryza sativa
tataatctatagtagaataagcggttagttgtttctttcctagattattgggtttgcaagtctaaagagagagtggggtggcatggtgggtaatttttcacccaataatctggaaaaaaactcacctaaatgagcttatcagattataataagctgggctccagattataataagctacttcaataagttgtctgtttctttcagcttactcccaataatctggattataataatcccaagctgaaagaaacagggcctaaaagtaatactagtgctcctatgtatactaatgcaactgtgcaagccgcacactagtactcctactctcttgttgggaaatgggacaacaaatgcatagtgctccctctgccctggcactgccagtacttgtgcagttgtgctactccagtactactagagaatttgaccgagtaagaaagagagagaaggggaggaaatacctaggagaaagaacatgagccagatgttgaggctcgccgagttattcgagctcgtgttggtaggctcgtgagcttaaagtcaagctcgagctcggtttgattcttagacgagccgagctcgaatcgagctcataacaaatcaagctcgagtagctcacgagcctcgagcatttttgacagctctagcagcggttgcttggcggcgacggcaagatggtgatagcagtgcgtgtgccacaggcacccacagggagtttggcagcggtacaaggagcccggccgtgcctacatgcccgtcgccatgagctcccactcatggcagacacccttcatggctaacatgtggggcccacgtcggtgtcactcgccgcgtcagccaaaaccggccattatactgctgggggactaaagttgacacggtattgtgagttgaaggatatacctggtatttaggttttgggacaaatttctgacccgacaacaaattaagggatctaaattgaacttactccctcctagaaagagataatgagaatatatggtgtggactggaccgagattagggtttgagcaggcttaggccctctttgtttaggcttagaccctctttgtttaggcttataagttaacttataagccgaaaaatctaagcctaaacaaacgagcaaccttttcatttggctttttaaaagccataagccactctaacactattaagccaaaagctagattagagaagcttttttggcttatgtgaggtagatgtatggctccgccactaaacttaggacattaatccaccgacttataaatcatataagccaataagctgacttaaaagtctaagcctaaacaaagagggccttataagtcaacttataagcctaaaagtctaagcctaaacaaacaagcagctttttcatttggcttttttaaagccataagccactctaacactatgcaaaaagctaggttggagaagcttttttgacttatgtgaggtagatgtattactccactactaaacttgggacattaa

SEQ ID NO: 36727 - DNA, 1501 bp, Oryza sativa
taggtggtaggagggggatagagatcggtgatagagatgacgcacaagaaagaaagaaagaaagaagaggaatttgtttgagaaagtatctaatcttgtgtgtgtgtgtggagttgtggggcaaggtcggtgagaatattccggtcgttttcatgagcaggggcaggcgtttctcgccgtggttcggtgagggggagggtggtggccatgtgggagatctcccggtgggatcgtccatcccccttctgcttaattttattccctgccatgcatgcatatgcgcttgcgcgtgaccggcggcgggccgacggctcgcgcgcggctcccacttgctgttgcggagggatatctctggatatgctgcctggaggtgcatggacaattggtcaattggactggacacatgactggaagtctggaatatggttgtcagggacgaataactgaagcattttgtcaaaaactgtaactttttttttaaaaaaaaagaggttctccatctagtcatcagttgcgtgaaaaatttattttccacccgcattcgatattttggcggtcgctatgacgtagtataatagacacgcaacccctggtgcctaattggctaactcggtgtgttttttgtcgattgcatcttggctcctctgttgttgcgtaaaggaaaaataagtgggcagcactcacggcttattatataccacctccgttttaggttataagactttcacggtttattatatatgtgtcaagattcattaacatatatataaatatgggcaatgctaaagagttttataatctgaaacggaggaagtagaagagaaactcccatgaacattttgtattacgatagttcaaacaactaatagtactatttaagaaataccatcatgatatatagtggccaagaatttttggttgggtagttctatttcacaagtaccggtgaagaagtagaaatttcattcacatcaacgtaccaaaattttctaacattgcaaatcccataaacaaatagaaatttaattagtttaaaagcgatagaattatatcttataccatcactaatcgactaattcaactagcaaggtcaaaatttacaaagataatttagattgataggagcaagaggtgcctcttgttcttgagtttgagcttcatcaaaactatcagaaatgatggtggttcttcttgagttacaggaagagggtgttgcaatcttctttgccctttgcagttctaggaagagggtcctgcaatcttctttgccctttgcttcatggttccgctagagtgatgcaattaaggccctgtttctttcagtttgaaattattataatctagattattgagtcagattactataagttagattgttataatctgtagtagaataagtgattagttgtttctttcctagattattagagcctaaattattgggtttgcaagtctaaagagggagtggtggcatggtgggtaaattttcacccaataatct

SEQ ID NO: 36728 - DNA, 1501 bp, Oryza sativa
tgaccaagtgaagatattgaagatgtggaatatgaagtggctactatggcaaaatggtgaaaggcaagcgatgcttggtcgggatggaccatgcatcgtgaagggtaagcaaggggcttggtgtcgaaaaaccaaatctagcggtgaagagcgagtgacgactttgtcacgatggaccgtgtgaggccatttgaagctacaagtaaccgcatcaatcatttgaagaatatatggtgaaacggttttggcgttgacgtcccttaagacaaagaaaggaagatggaaagaagtcattcctattgctataattttcttcctatttacatttgtgtcggtgacatgggaccgggagtatcatgacttagagacttgaggcagacacgatcacccacgtggcctaaccccctcgggggggggggggggggtcgggcccgagggtgatacggccgcccttctctttgtcttcccgaggggtcggaccgctcctgtctcggccccgagggccaaggcgccccgaccccttgtgggttttgcgccgcgtatatggggtaggtgagcatagcggggctcacctaaccacatttattgcggtttggacgagcgcatcacgccgcatgtaacgcagtgcagcgcactcgtttatccggtctgtgaccagtcacagaccggtcagatcgtgggttaggtggcgacaggcggtctgacgcacgcctcgccccatcccgtcaggacgagagcctccaagcactcgtccctagccggagccggcgtgttagctcctggagatggcacgttggttccggtcagatatatgccaggcttcatcctaaccattacaggcaagatattgtatgaagaagggcgaaatgcagattgataaactgacacgtggtcgacaagaatgaccgatttgtgaccggtctgacactggtcatgtcgtcagcagacagccatgttcccacgtcgcgcctgcttccggcggaagtggaggtaggtgtgggccgtcccatcagaaggtcattcggacggcaaccatacaagtcgccgtctgtttatgaaaagataggataagtccccacaaaaaagagagagatggggcatgtggtatccccttgagatataaaaggaggaccttgcccacttagaaaagaaaaaaaaaacgatcccagaacgatcgggggctggctagcactttgtagcttctccatacacagatccaccaaaacacaggagtagggtattacacttctcagcggcccgaacctgtatacatcgcccgtgtcttgtgctttttccattctcgcgaaccttccacacacagaccaggagcttagaacctcacccagggcccccggccgaaccggcaaagggggacctgcgcggtctcccggtgaggagccccaagctccgtcatctgacgcgccaggtagggggttctgcgtgtgttcttctaagctctcgcactttttcgtgtgcgccaagcttttcctgttcagcccaa

SEQ ID NO: 36729 - DNA, 727 bp, Oryza sativa
ttcacataactattttatttcacttgcaatgaacactggttgatctgacaaattgacaggtactactgctgatgagaaatctgtccatgaacttaactagccccaactttgcggcacatgtaagtgttctgtttttgtatttgttctccactgatattatgcatcttgtagctatctaaacatgttatgagtaatttagagtttgaactgtactagcgttaaggtttgccattttggctagttattgtggttaggttcttgttagctgaatttgtgttcgaagtttggggtagctaataatgttttaaataacaaacaattgactggctactttcatgattactgtgatcagattgcattagttgcctaccacatgcttactctcatccacctgtgttcttctggatatctagtgtcaagttgaccgcatccatgtcctctcaaacttactttgcaggatttgatcctgattgggctggctacaacagccatagaaactttatacggaactttctttttcctgaataactaaataggatattattatcatggtttcgtggtatatagtttctacagatatgaaatgcattagctatgtcaataagggcatattttatgttctacacaacacttgcatttgacttcgatttgttatagtgcaatgtcctgacattttgactctacctgattgcagctgagcttgctgtcatcatgtaattctggtggg

SEQ ID NO: 36730 - DNA, 1501 bp, Oryza sativa
ctccgccgtcccccgcccatgacgctggcctccatgcccttggcctcctggaaagagtgacgggaaggacgggaagaatgacgggaaacgcgatggagtggcatggattcaatttttcaaaattttagtggcacctagtcgatatcgcgaatagtattggcatttttctaattttccatatttgcagtggcatggatctattgatccaattaacccaacccttagttaaaaaagaggagaggcgcaaggaaagcccgatggtatgcatagggcatgtgacatgcgagggctaaggattcgcagatttattttttaatagatagatatacatctaatagtctacgataatgagtccaccgttttaagtgaaaattaaggatgtgatgttttgctttttttttctcagaatttataggattttcttaatttaatggtgtgccatgtagcgaatgaggagtgtttgtaggagtccatgtggtggcttagaagtgtttataggacgtttaatggaattttagtatataatagatcacgagtttacctccagtttcagtccagaaatgcttgtccactcgaacaatcgtcctttgtctggatgagttgggttgtaacagcatgcttgcatttatggtgtaccatggtcagcaaggaactgaatagagcagtggctgctagaggaacgatttctgtccagtggtttctgtacatgccctttgaagcatggcatcagaatgcatcctagccatgaatttggtaacagctaaacatgctccagtgctatcgatcagtagtagctgcaatctctttctggatcatcagtgcaagacatactcaaggcaataaccaaattcaaaataacttgcaccaaaagagagtaaggtggatagacttacctaaatgacattaagtggaagtactgtaataattctattaactttcttgttcagaatgcaaaatgcagagattcttcgacatccataaaagctttccatatcatctcagaagtactctaattattctccataaaaattcagagatgatatcaattgttaatactttcggatgtcggcaatatcataccaattgccaagaatttcagtcaattggttgaggagcatgcctgcctgctctttcactaacatgtcatcttgctcaaacagttgctgttttcaccctttacacttgcttatccagtcatagttgccttaccagtatggcaaatagaggaacaaaaattcagcacgcatgcaagcagtcgagcacttctttctatgctttttatataagcattcgtgtatctacctgcatgctctgcaacttaacatcatgttctgaaaggcacctcaaccatgttgcacatgtcttcctcctctccactaatattaaccaatagacagatatactatcacagtatatatactctcactgagattggttgtcccctttatatttcaacacagcagtttgcagttccatcttgaatcaagacaaacacaatcag

SEQ ID NO: 36731 - DNA, 1501 bp, Oryza sativa
gagcaattactaatctcttttatgatgattcatctgatcgaagcgatatgctcaagtgatcatgtcaatgtttctgttgtgcacttgtacttgaatttctcctttgacgggagtgggctccatcacacgacggtgtcgagcggctctcccaactccatcatgttagaaaatgatagacacataaaccataaaaaacaataaatcaatcataaagacataagatttaacatggaaaacccttctaaagtaggagagaaaaaaccacggtatcccaaacctccggcgacgggcctccgcttcgctccatttaaagctggcctttattcgtgtgcaaatgaatttggattacaattcaacacttccatcccattaactcaatatttgaaactttttactcggattggaaaactttcaaatcaagattttaaaacttttaactcggatttaaaaacttttgactcaagatttatttaatctttgagttaatgtttttaaaattcgagttgagagtttcgaaatttgagatgtaagttttgcagtttgagttcaaattttaagctgaaagtttcaaatagaagtttttaaatttgagataaaagatctaaattgtaaaatacattaaaaaacagaaaaaggaaaaacatgcgctggagattaaaaaaatcatgaaaaaaggaaaacgcaccggaaagttggggagcgtgcaaaaacagcaataaaaaaggaaaaatgcgcagggtaggagcacctgctggcacgtacacgctagatagcaatcctctctcctcatttagccaaatcgcaagcataaacataacttataaaaatcaacattggcttcatgtacatagaaccaccaccatcacgagataacgttgccaaaaatattgatacagattaatgcagcaaaaaatacttatatttcagatatgaagctagagttttggagttttaaaaaagtaactgcaccctttgtattttgtggagtagattcacccatgttacttttaaaaaaatgtggatatttggttcggttcctacttcatcggataaacatgccctcatgtggtagatgcggcaggagtaaaaaaagaagaagtaaaagaaaaaactagaaaatgcagaaaaacaagagcagattattatgaatcttgacgaaagcaagggaaaatctaaaaaaaaaaatcatgaaatgatgagcatacatatactgaattttgtcacgaccacatgtccttatctgaccagtgggcccacgtggcatagagagagagagagagagatgcacttctttccgcccgttagacagattccccccatcgttccaactccctcaaaccccttcccattccggcggctctccccgaaaatttgaaatcgccgccgaaaacccccccaaaaacgaaaccgactcaaaaaaaaaaaaaatcccccaaatcgacattcctctccgcggatcgatcggccgcgaagatgccagccgccgaccccgccaccgcgc

SEQ ID NO: 36732 - DNA, 251 bp, Oryza sativa
aaatttctaagtctattacgcgcggcagtttttggacttcagttcaaaattcactcgtgactgttgggcttcaaacgggatgctcgactacacatcaactccgcgattctcgcacccggaatgataacgttctagacgcccgaagtcgcgaatggtcgcatgagttcgtttttgagcaaaagtcggaggctactgtcagggttacgggtcaggcataccccctacccttcgatatacgatacgtatcgaca

SEQ ID NO: 36733 - DNA, 315 bp, Oryza sativa
cgctggataactggttttgcgggacgattttgtaactcgatgacaagttgagggaccttcggtgtactttttcccccagaaaatagagtactatttttcctgcaaaacacatatgggctttcagcccaaaacaggtttatgggaaaaagttcctacctgagtgcccgataaaaataaaaatatcgggcgctcctcattctcagccactcgtttcttatctcgctctccctcttctcgcttctctcgctccctcttctatggacgcggccgagcttcgcggcgttgacgatggcggcggcgcagttgtggctgaca

SEQ ID NO: 36734 - DNA, 1042 bp, Oryza sativa
aatgtcattgggtggaattaacctattctttgttatggcccttttgttcttgattactttattccttgttaccttgggttattataattggactagttgagctttatatatatattggttcaactagatattagatataattgcttagccatgcttagaaacattagcacactattgggataatttatgactcattattatttaatgatggcttaatgatagttcacgatggtcaatcgtgattggttaattaattatttgccaactaaaacttgatgatggtgggttgtgagcacatggttttgagagtcgtgctcatgacaattaaggaccggttcgcgagctactgttgtgaaatattaaccgtgccaaccacaagccagcgtgggcaacggctttaccttttgtatagcatgattcattgcggagcaccagactgagaagtggcggagataagcccacgggggtcgctggggagtccatgccttgttttataagggggtgattatgatccaggaatggtgcactgtggtgagttgtgttgtgcaaagggtattgtcacagcctctattcgggtactttccagtatcgcgacgcatggtagacatgatgttgaggctgtgtcttgtgggtacagtggtacacctctggccagagtaaaactattcgaatagccgtgcccgcggttatgggcgagttgagcaatgtttttcgtgattagtcccacacctctcccataactatggatgttatacctggtaataatttgcttagctcctggtttggagttagatctgttcagccgggtatggttgttcagaatggttgggcctgtgcagcatgggtgtgctgttcagtgttgattaaaatttctgattaattactccactgttttacttctcttaaatgttttgctaaatgctgcttttgcaaatgagcctatattatgccatcctttggtatccttgtgcacttgcatatttgctgtgtggcttgctgagtatgttatatgctcaccttgcaataatcaatcaacctcagt

SEQ ID NO: 36735 - DNA, 499 bp, Oryza sativa
aatgtcattgggtggaattaacctattctttgttatggcccttttgttcttgattactttattccttgttaccttgggttattataattggactagttgagctttatatatatattggttcaactagatattagatataattgcttagccatgcttagaaacattagcacactattgggataatttatgactcattattatttaatgatggcttaatgatagttcacgatggtcaatcgtgattggttaattaattatttgccaactaaaacttgatgatggtgggttgtgagcacatggttttgagagtcgtgctcatgacaattaaggaccggttcgcgagctactgttgtgaaatattaaccgtgccaaccacaagccagcgtgggcaacggctttaccttttgtatagcatgattcattgcggagcaccagactgagaagtggcggagataagcccacgggggtcgctggggagtccatgccttgttttataagg

SEQ ID NO: 36736 - DNA, 1072 bp, Oryza sativa
aaaggacaccaatgtgtgaatggggagattgttgaatagtcgcacattggttgtggaagaaaaaaggatctaagatataagtgggggagcccctcatctcattggctagctttttgggtgggaaagactctttacgatctaaaaaaccaatcaagctcattacagcttgaaatgcgttacttgttctgttgttcccacacaggctaaatagccagctaaatataacactttcggtaatgtcacgcccggaaattctatagtaatttccgaacttatttgtgcattaaatcctcgtccaggaatcagccgaggtacacaaactgacaatttaatatacagattcatcaaattaactaaaacgataaatacttacttatgaggcacttagtcctcaccatgaagaaaactacagcggaaaaaataaaatctagcgaagctccggctccactcccacaggcagctcaactggggtataagccaaacgtcttctccttctggatcctttttcttcaactgaggttgattgattattgcaaggtgagcatataacatactcagcaagccacacagcaaatatgcaagtgcacaaggataccaaaggatggcataatataggctcatttgcaaaagcagcatttagcaaaacatttaagagaagtaaaacagtggagtaattaatcagaaattttaatcaacactgaacagcacacccatgctgcacaggcccaaccattctgaacaaccatacccggctgaacagatctaactccaaaccaggagctaagcaaattattaccaggtataacatccatagttatgggagaggtgtgggactaatcacgaaaaacattgctcaactcgcccataaccgcgggcacggctattcgaatagttttactctggccagaggtgtaccactgtacccacaagacacagcctcaacatcatgtctaccatgcgtcgcgatactggaaagtacccgaatagaggctgtgacaataccctttgcacaacacaactcaccacagtgcaccattcctggatcataatcacccccttataaaacaaggca

SEQ ID NO: 36737 - DNA, 643 bp, Oryza sativa
gccttgggtgcatgtgacactatatatatttcaaataaaaagccttctaaaaagccttctcgagtcttaattgatttcgcagtatgagagagctcattgtcgtgcagagtgtgtgagactccatatagcttaacaagaacataatttcatagctaaaaataactctgcatgcgtgattattatgtagtgtggtatgattgttttcatgatttaaatatttttactctaattttttttgttaaacattaggaatttgtatgatccaaacgatcactctttgtcattttattttagctaacatgcattgggcatttagtgattatatttatattgcataatcttaaatgctaagcctacaatgcttgccctattttatctgttttgtttgaaagaattagccatttatacaaacatggtagtttaaatactaggtttcaaacgtttaagtttctaaaataataggtagataaagcttttagaccagtcatcacctatagtcccaagttagtttgcccactcacgctttaggtccataggtggtttggccccagttttgtccgacgtcagggtgtccacgtcggcacctctctttcccctcttctctcccttcctcctctatctctctctcacttctttgcgcagg

SEQ ID NO: 36738 - DNA, 476 bp, Oryza sativa
ccacttacttctgtcatattattctttattagcttgcttgatctaccaccgtttctattcattcttcttagaacctttaaaaattagatcttaaaaacttatagtttttagagtttatcgtcctattagggttcttttgtataatttttagaagtcccattaaatgctgcattatactcctctacaaccgtccactgcatcttctctttattgccattgctattttaaaaatcaaacataattatcgttggtttttttatattttttagaagttccaaacctttaaaaattggaccttatagtttttagagtttattattaatttttagaagtcccgtcaaacgatgcaactatactcctctacggcccgtcaaatttcggattttttaattaatctactattgggttcttatatttactcttatcaatattgcttatatttaattccaaatttaagttaattttaaattgtattt

SEQ ID NO: 36739 - DNA, 1501 bp, Oryza sativa
aggagaacacatgagagggtgaaaactatcatagcagaggagaaagacaagatgacacgctgcgagaagcccttcctctcttggccagccagctcaacttcgttcagcagaccccttatttcatccatgtctgaatcttttgcagcctgaaatagtctgttctgaaccttgtcgagctttgcaagccttctggcatgactgttgtctatcgcagaccaaatgaaaccagtcatcctccacaagaggattccgacgtagattgccacgatgcaatcaacactgtaatgatggcgctcccgtatctccctctgagcgctgtggaggacaagaaaccatataacaacagagatccatcccccatatgcttcctgtgacgatggaaaaaggatctattatgataattgaacagtaagtaacagcccaacacagaaattaatcaagatggagttatcatcaggaggaagggccatgcctacgaaaagaaaatagacaagggtaaactgaactcttcaccgcaagagtcctagctgtcacataaatgtagtgcttgattgatttaacaataattatcacagagcatgttagggaatgcttaaaactggttcatgatgtcacttgcaaagaaataaatccaattaatgatgcattgacacaggccatgaaactataaaagcaggcataaccatgtgcattttttaaaagaacatatagcaaggatggcttgatgagtgtataacattctttcgatttaacgtgcagccagttaattccgttttggttttagcagggcataaggagaataaatgaatgcatcttggtcgtgacttgtgacaatctggaagacaaaatagccatagcttaccgtccatgccatagcggtgaggacagcaacaagcatgtggccactatacataagatcactgcagccaccacttgccttcttcagaaaatgataccatgaggacccctcttcaacagttggcctcaaaatgtctactaagaagctcatatgtccccacttaggtctatactcacgagggtactctttaacgaaagctataattaggaaggaagaacattagctactgcaggccaataaaagaagccatatcagtaagggttataagttggatgtgctgaccatatggcatatcctcttgtatgaccctacggatcgcatctggatcagaggcatatggagcatagtatttctgtgcccaaggatgaggatgatcaggtatttgatatcgagcttcagcacaccaaggcctcgcggatggtagaatcgtagcaagaaatgttacagtccgcagcgaacgtccaactgccattgtgaacatatatcttgcagctatgccaagtccagggcctttgatgcagtcaaacagagctgaaaaccccagcatgataaacaacatcagatagtgatgaagactgatgatgggtgctctgaggagatcaaccacaatttgcggaagtttctcattcaatgctagaagca

SEQ ID NO: 36740 - DNA, 659 bp, Oryza sativa
atggcgatgaatcagagggggaggcggtggcggagtgcggcagcgcgagcgtcaggttaggggcggcaccgatctgggcgacggacgggacgggggcgcgggcgcgctccatggcaatgtgcagagggaaggtgtgggaagaggcagcgattgatttgctcgcatgcgtgattttcggccggtcaccccgcgtgcgcgcaatctctctcccacagtgtgaccccgcgtgcgccggtaccgttggatctagaagcgttggatgatttggaccgttagatttgatgaatgagtaatgtaggtgtaagagtgagttggtgaattatagggtagatagactatagttcgatttttatattttcctcaattttctactattaatgtaggattttctagacaatgagagtactaaacgtggaggcttctttttctattaatttattaagttaatagatttctagtatttattaaagtaccatgtggtaagttaggagcgtttgtaggagtgtcatatggcggtttaggattatttgtaggaagtttaatggatttctagtatataatagatagatagactagttttcacgagccgagctaagccgaatcggctcgttagccccccttacatgcgcgaggttgatccgacagctaatggcagtgga

SEQ ID NO: 36741 - DNA, 1501 bp, Oryza sativa
ctgtgttggttaaattaactgacattacactatcttgaaaagtatcaattgtctgcaccaagtgaaaaaaatcaccagaaacccagttacccaagtatatgagaaacaaaggggaaataatactactaaaatcaatgggtccatgttcttcaacaataataagaatacctgaatagggtcactgctctgtgatctgcaatcaaatgcacgcactgtgcgatcatagccagctgagactacaactgtgttaaactcattaaacttcactgaattgatctatggaagacagaattgaggtatgtaagcaatattatcaaggatcaaaaacctgtcaccgaggttgttcttgatctgttttcagtatcccaataatcatattgacgatgtgcagtgctagatttaaaaggaagtacaacaacaccattacagaggtatcattacagcacactcattttcacacaattcaccctgcaattgactagttgtgactagatcgataatgctagagtgctgatttcgtggtgttctccacatagcacaatggaacagacgttgtttgattataaacagtgccaactgctctattccactacaatctcaggctactgctaatcctatcataaacaaccgtgctctctctgtatagataaaatcaatactagtattgaaatagcagcggcgcttaacacactgatagtatggtgctgaaactgcttaatagtacaatttttcatgagcacttctcacttgctcaatccaaccgcgatcaccaaacaattacaacagcgcggtcatcatcacagtgagaattggggtccatacctcgctgttgtggccgcggaacttgcggatgacacgggcagatgcgacatcccagtagaagacctgcctgtccccgccgcacgacaccagcttggcattgtccctgcaagcaaaggatcctcaaattccccactggtgctcagctcctccaaatcagacaggggaagttggtgttggggggacggaatcgcagcgaggaagaggaagcgaagtggcttacgaggaggagttcacgtcgcggacctcgcggccgtgggacttgtagggcttgacgagggcgccggtgtgggggttccagaggcggatgatccggtccttgccgcagctcaggcagtagttcccgtcccgattgaatcgcaccgccagcaccggcccctcgtgccccgacagcaccctggcctccgtccgcggcagccgcgccgccgccgccgccgccatctccccgcttcctcctccttcccggcgtcggtgacggtgacgaactaggtttcttttttttcttttttcttttttcttttttttcttttgagatataaacggcgacgggttcccaacttgggctggcccatgggccgtgtaccgtgtacgagtcggattcccccgaggcccagactactactatccatccgtatatccgtacgccggagagccccgccgacgtagacgaaaccggccaaaa

SEQ ID NO: 36742 - DNA, 1501 bp, Oryza sativa
gctgcctacatggcagccactacatattagctgcctaacggccatgtacaaatctcactccaccgttaacgcgcaaaaccgaaattgtacaacagagttctgtaacataagagaaaaactatcgtcgaatatgggtataaagttagtttgccggtttgaaattgtaacagtgtagtataaagttagagtcaaactatcctaaggctgagtttggcactttagtttcccaactcactctctttctttttcacgcgcacgcttttcaaattactaaacggtccgtattttaaaatttttctatacgaaagttactttaaaaatcatattgatccattttttttaaaaaaaaattagctaatacttaattaatcatgtgttaatggtgaaccgccccgttttgcatgcaggaggggatttgttcccaaccacagctgccgaacgcagcctaagttctctctatgtacatagagagacatactagttatataactacaagacgatagtaatataggtgtgggtttgactagttagtggcctagtcgatcgagggttatgaatgcctagatacactgtaatatgctagattaaagagaagtggatgtaatcatgtctctttaaaaaatatcgagccccgatatcgtcaccagtttagatcttttcgcgatgttattctgtgttgagtttccaaagtaatatcatggctggtttaacgagaccactttggactcaagtgtcgctccccgcatgggcaaccaggtggcgaaaaacctagccgccgctcacccccgactcaggcggcgggaagaacactccggcagcgctctcgacggtgcgggcatatagcggcgagttgccagggcagcggacaatgccgacgcgacgagctggccatggaggagtggcaatgacggttgcgcatcatgggaggccgcggtagcgcggatccggccagcgcggctgagctgagacgtcgaaccagcaaaacttacaactgaaccaccaaatccggcatggtggcggggggggccttttaaaaggcggcaaatgcgggaaaaggaacgcccggtgcaaggagaacaacgggtccggcccaaggagacaaccgtgtggagcgagggcccaaaccatggttaaatttggcgcctggcaactccgtggttggctctggctggcaccgagcatctaacatggtggggcaagggcatagtggccaaggtggggcggtcggcatcggtggtaggtcgcgcacggaaggaggttggcgggaggctgacctagcgcgggttggcatggtaggagcgtaggaagtaggcatgatgatggcggtgggagcggcgtggtgcgagtaagaggagccgtggctggctggtgtggcacaagcggggtctgctgcggtcggcgctccggttggagtctcggtggaggcatgggcattaggacgaggcgacggtgatgcgggcaagcggcctaaggcatgcgagtagtttgactgaggcagcga

SEQ ID NO: 36743 - DNA, 414 bp, Oryza sativa
cttcgtagtcctaggatgggtctaatcccatcctaggttgtaatatattgggatggagggagtaagaaagtttttcttagcaatcagggtgtatgattcactacattcgcttaagaaatattgtgagatatttcaaaatccatggaatttagatggtagtgaatttattcttgaattttttccattgttgcgtacaagtattacttatattgacctatttccattcagtcgcacttttattcgtcgttttattcttgttgtacgtcaatagtcttgctttccaaatgattggcctgtaatatagctcttggagttgaaagtgtttatcgagtgtgtccagaaaattggtagcttgattcctctattgtgggtaagaaaatttgccatatacgctttatgctctttttatccaga

SEQ ID NO: 36744 - DNA, 551 bp, Oryza sativa
ctcggtacccccttttcttttccgttggtcgtgtagacgcggcagcttcggaagatccgctcttcgtgaaggttgaagccgacgtttgggaaagtgagcaaggcaagtcacatcatccttgaacatattgaatcccagtttataaaattattttgatttaaattattgcattatcgctttatttaaattcccgcgttatcactgttttatctagccatacctatttacctttgttatgaccttattattgttattgttattatttccttgttcaccctagaataaacaaaaccccaactagtggacactctactcatggtaccactagtatgattttaggtagatgcttcgctggttaattaggcaacattaggtggttttacaactctagtctttgggaattttctcatcacctggacactatggaatggatggattattgtggaattggattcacacctccccctctattcaaaaccctcaaaatggttttaggctgggctcagggtgcatggttttgatagtagcacctcggccatataaggaccggt

SEQ ID NO: 36745 - DNA, 604 bp, Oryza sativa
tcaagaacccatttttgtgctttgtttctgctgttatgtggagtttagtagagtaaaagccttttctttttcgttagtcgtgtagacgctgcagcttcggaagatccgctcttcgtggaagttgaagccggtgtttgggaaagcgagcaaggcaagtcacatcatccttgagcatattgaaccccagtttataaaattattttgatttaaattattgcattaccgctttatttaaattcccgcgttatcactgttttatttagccatgcctatttatcgttgttaagacattattattgctattgttattattaccttgttcaccctaggaaaataaaaccccaactagtgggtactctatttatggttccactagtatgaacttaggtagatgcttcgctggttaattaggcaacattaggtgattttataactttagactttgggaattctcatatcatttggacactatggaattgttggtttatggtggaattggacatacacctctcttcccctttcaaaacccctaaaacctgttttcggtggggtttgggtgcatgccagttgtgggaagtagcaccccggccactataaggattaa

SEQ ID NO: 36746 - DNA, 192 bp, Oryza sativa
ctcccgcatgcgccgcctccccgcacgctcgccgccgcttcgcccgtgcgctgccgccgcttccgcgccggtcgccactgcctcctgcgccgccgctcctcccctcccgcaccggtcgctgtcgccccttcggtgaggacccccttttcctccccttcctctcctctctcgtgcgcgccgccgctccccgca

SEQ ID NO: 36747 - DNA, 198 bp, Oryza sativa
ccccatatatcgtcgggataagatggacgtcaactatgtcggtgtttggtgcatgtgagtacgaattttaattaattagataaaaaatatgtacaatacaactccatgtgattgctactaacaaacttcttatgtaggatgcaatacatggatgctaagaagaaaaaagaacccatcggttcttggatccaactcaga

SEQ ID NO: 36748 - DNA, 470 bp, Oryza sativa
ggccgagccggcccaagaggggaaaggggggggaaagactttttagggtttttctttttataaaattattttaacattgtttatttcttaataattattattcgtgctctgaaattccactaaaatttgagggctccttttagaccaaggagaatttaacaaaaattctctgggccacatttgaatttttcttgtacgtattttagggtttgccaatttcttttcgaatttttaattaattctattattccttttagaaaatgatttttatttcgggatgaatttatcaggacgtgacaaatccaccccccttacaagaatctcgtccccgagattcgaggaggctagcatgaagataggttgggcggtcttctcttcttgtctgacttcttccgctccgctttctataacaaacttgcctaacaaagcttctccactctggactgcttggctcgatctcctgttgcagg

SEQ ID NO: 36749 - DNA, 218 bp, Oryza sativa
cttatatggattttaattgaattatgacgcaataatgaattatttttgaaaaggaaaaggaggattattgcgtcagcggctagggtttcgcggtggaccgggtgcacggcaacggttcatgggaacgaacggccgagatcaaccctatccaaaacggacggtcgagatcgatctgtccacgaccggctcacggcggacggtcccgatgacgtcagcga

SEQ ID NO: 36750 - DNA, 1501 bp, Oryza sativa
cgtgagaggatggagaggcggcggcaacaagaggggtggggtaggtagactctgggattagggagacggtgttagaggggaaagccaaaggagatggatttaaggagactagtaatatgcctgtgctaaacgctacgctgcaattttatttttgtcctaaataatttataaaatttcatgttagcaaaaaatatttttatatgatctgtgtatttgaacttttattcaattcatgtcgcacatcaaatatatgtaacgtaaagtacaacactaggatattgcgtaggcacaataaaattttacgagactatgatattgcgtaggcacaataaaactttgagtggcgtgcgtatgcgtatacatatcggcattataattcctgcacatggttggtattttatacggtctatacgccctatatttctattatacaatgaatgaattaaatatattcatttaagttgtatggacgaaccatctaaaaaaattaaaaaggaaaaaaaatataagcatatatatgcgttaatgtaatatagaccatagttacaatctcaattgacagctaaattttaataatctcgaagaaacaatctcagacatgcatttgtttttcttccaggatacacccaacacaacacaatcatacactatatatcaagggttgagaaacagacacagccttaccgtgaattagtctgaccacgatctggtgcacacttatcaattaggttccaccctcttgatatattgaacctacaattagaacaaagcctcagcttgctgccgtgaagtgacatggcatatgtttcacagcgcaaggggaaatctcataggtacagagcaaacaaaatgaccaacctcaagatgagaatgaatatgaatgttaaggagttagaaatgaccaacctcaagatgagaatgaatatgaatgttaaggagttagactgtcagcaaccaggggcaatgagaatctacatattccatgtaactattatcggtgcagtacgcttcacatgtgtattatcagctatgtgacaaattggtcagatttaggtataattcattcttatcaatgacacttttaagggtgatgcttgatagtcgctggataaccaatgttaaagttaaattcagataaaatattaataggctaacttcagatcaggtttgtctgaaacaatgtaaaacaatatgatttgttcaacttaataggctaacttttacatctcctgcgtatcatcagctttgcgaccatggccttcacggcgcccaggttctactagggcccaggttctactagggtccaacatgctattttacaagatcctaatatactgtttttcctcatattttttaatatgacaagcataagttgaatattcctggagtgatggcagtgaaaaattataggagatatttactaaatcaaatatcaaaacacgcagtgacacacgtatatttgctaatatgttcaaaaaaaatcaatcaaacatgaaatctc

SEQ ID NO: 36751 - DNA, 513 bp, Oryza sativa
aaaacaaatgaatgttggtttgattgaagcaagagaaaaatagagaattcgaaataagatttcaaaaaaaattttccaagagattaagagctcttattaagttttctgcaaaatctcttaattaatttttttttgcaaaacctgtaatagaaaactttttatataaaattgaaatttctcaaaattttgtatgttttctataaatcaaagggacttaaaagatgtctaatagcctcccttttaaaaatacatttgttttttgttggccgaattttctagttaaaactacagtctttgaagaggtgtgtagtactattatgcacgggaaaactgagagttgacgaggataattggcttcacagaagatcacttttttgtagtgggggaaatagaaaaacgttagctgtggcattctagtagtatggtggatcagaagaggcccatatggagagtaagcaggtatatgggtctaaggctggtgtaagttattataagggtcaaaagggtggatca

SEQ ID NO: 36752 - DNA, 707 bp, Oryza sativa
aaaatcatactagtggtaccatgagtagagtgttcactagttggggttttgtttattctagggtgaacaaggaaataataacaataacaataataaggtcataacaaaggtaaataggtatggctagataaaacagtgataacgcgggaatttaaataaagcgataatgcaataatttaaatcaaaataattttataaactgggattcaatatgttcaaggatgatgtgacttgccttgctcactttcccaaacgtcggcttcaaccttcacgaagagcggatcttccgaagctgccgcgtctacacgaccaacggaaaagaaaaggcttttactctaataaactccatataacaagcaggaacaaagcacaaaaatgggttcttgacttcttaaggaaaaattagagacttgaatggtccaattccgagttcaaatggccaagttatggccatttgaagtttatatgctctttaaatgaatatttgcgaatttcttcatttaaattttaatttaaaaagggtttattgcgtcagccgaggggagggggcgcgcggaccgggtccacgggagtggggcccacgcggcagcctcacagtccacggtggaccgggcgcacccgggctcgcaccggtcggcgccgtgggccgcacggtcagccgcacccgagggcacgggtggctgacggccgggccccacgcggcggcc

SEQ ID NO: 36753 - DNA, 511 bp, Oryza sativa
ggagaggagagatgggctgggccggcccaagggagggaagggggacttttagggtttttctttttataaaacctttttaacttccactaaaattatttgtgctctgaaaattccactaaaatttatttacacattttaggcttttaggaaatatacaaaaatcctccaagccttatttgacttttactttgcacattttaatttttggaggctttcacacacggattttaattattctaggcataatttaaaggatatattttagagtcgttttgggacgtgacatccttcgacggggcgggcgcaggtaggagatagaggtatatcaaaccatcagagaatgtgtctagatgcaatttactttttaaaaagtactttcttcccgtgcaacagtcacataggacatgtcgcagcaaggcgaaccaatgtcgacgactactactaggactactttgagccggaatcctaggacccagaattagattcctaaggaagtctacaccataacaga

SEQ ID NO: 36754 - DNA, 239 bp, Oryza sativa
atattcatctgatcataccctggttggaatggtttctttttggaaaaaaggcgaaacaccccattagctttacctgaactattaaatcagataggtatagtaagcccctacttgttcattggtccaaatgatctctgagcggtttcacctctatggtgtcactggtggagaaaccctttgtagtcccggttcgtaacccccctttagtcccggtttccagaccgggactaccaatccgg

SEQ ID NO: 36755 - DNA, 381 bp, Oryza sativa
aagggccctgcatgcaatgagttgcacaggtactacatggagaagtccaatgcaaggaggaagaatagagagacctccatgttgggctagcacaatagtcagccgttcctcgggccttctaccttcatcgccgtagacttcaaagatctatgggacctctacagggtgcgagcgatcgacaccaacctccttaagtgctattccttttaagtatttctgggtacgcgatatggtagtaactatccataaattacgcttaccctgacttttgtcttgctcgtaggttaacctggaagcatgtccatcataaagcaccccatgttgttttactcgatccagctgtcgtcaatgagataacgctaaaaaatgactgagccaaca

SEQ ID NO: 36756 - DNA, 177 bp, Oryza sativa
tggttttacaactctagactttgggaatattcatatcacctggacactatggaatggttggattattgtggaattggattcacacctccccctctattcaaaaccctcaaaatggttttaggctgggcttggggtgcatggttttgatagtagcacctcggccatataaggaccggt

SEQ ID NO: 36757 - DNA, 1501 bp, Oryza sativa
taattaatatttaaaaaacgaatggtgctgatttgctctctcatctttataaatatgagcactcgtctctctgtacatagagagagtgagagataacgcgcgggcgctagctagctagctcttaatgtgatatgtatacacaatttttcctttatctgtcaaggaatgggtaaatgcatggttgagagaattaattgagtttcagttatagatatatagctggctgagacgaccagttagccatcgtcggtcgacgaccaatcagatcaatcagttaactaattatggatcaggagaaggcggacggcggcggcaggaggaggaggagcagggcgacgagtagcagcggcagcggcgcgagcagcacggcggcggcggcggcggcggagaggaaggagatggagcgcaggaggcggcaggacatgaagggcctctgcgtcaagctcgcctctctcatccccaaagaacactgctccatgtccaaggtagctaggaattaggatcgactactcactaattaatttttattgagttttagtttgctactacaagattgttgatcgagcttatatatgctattggatgactaattagtgttcaatgctggttaaaataatgttcatatatgcactaatttctttggtttgctctaaggttaattagatctagttttgtctcatcggtccttacatgaaatgttaattaatgtaaatccacatgaaattaggctactatactagctagacattgttagagagttcgatcttgcgcgcggtcttaattagacaatcctcaagacttcattgaatgggccggccgggccggcttaaaattgtgtgtctcgatcggatccttccaaattgcttgcatagcataagaaaataaaatttctatatgtcgagattcggatgtgccatcaactcaattccactcattttcttcatgtaaatagttctgatcaaatttcagccaccctgttatatattacccggtgcaacgacgggcattttgctagtagatgtaaaaaatgacaagtaaacttattattagaagcacagagctagggtacaatatttttggtaggataagatctctctctctctctctctatatatatatatatatatatatatatatatatatatatatatatatatatatatatatatatgcgattaattgttgggcagtaaattaattagttaagctggttggagctagcgaggaaataaataaaatgaatgtgcatgcagatgcaggcggcgtctaggacccagctgggcagcctggacgaagcggcggcctacatcaagaagctcaaggaaagggtggacgagctgcaccacaagaggagcatgatgagtatcacatcatcgcgctgccgctcaggaggaggaggaggaccagctgctgctgctggccagtcgacgagcggcggcggcggcggggaagaagaagaagaagatatgacgaggacgacggcggcggcggcggtggtgga

SEQ ID NO: 36758 - DNA, 1501 bp, Oryza sativa
acgccgccctgtctgagcggcggatccgggggcggccgaagctgccactccggaaccggaggagttccatgtccacgcttcctccttccgagccactcggtccgcgagctgaaaaagctccgcggtagtctggggctctttggaagcgatcttttcgagcatgcagttgtgccgcacgccccccctgaacgcgtagatcaccgcgtgcgcagggatgcatggtatagtattgcggacttggcaaaaccgctgaatgtacgagcgaagcgactcatcatcgcctcgctgtactgcatgcaagtccgcttcttcgcctgggcgcggatatgtgccttggaagttcatggtgaactgttggcacaaatcttcccaggagtggaccgacgcgggtggcaggttcattagccatccccgcgcctgtccttttagggccatgggaaagaagttcgccatgaccctgtcgtcacccccagcggcctcgatcccggtcgtatagacctggagaaactcggtggggttgacgctcccatcgtacttctcggtgatggtgggccggaaccttgggggccaacggacattccgaagactcgccacaaaggctctacagccaacaccaccggccgggggcacggagggctgattctcatgtccaggtcgaggtgacactctggacgaagaggcgccctccgttgcgcggggagtacgccggttattacgccggcgctcgatgtcgatgcgggcatccggctctccatgctgatcctcccgagttggaggtgtcgacgagggagtggcggccgaatggcgcgcagcagccgccgctcgccgcgccctccgccttgacgacacggagccggtggtagcggcgccggaggtcttggtggtggcggaccgtccaccagcacccaggcgctgttgtgccgtcatgaccaaattggccacatcgtccagccatcgctgggctggagactccgggtcagggacgacaggcgggtgacgtaggagcgcgccgacagcctgaagcgcgccttgaggcgtgctgccgtcgccgtagacaaggaggcgacgctccccatctcgccgttctcctgcaccacccgcgaccggtgatgctgcggatttatcaaccctctcgagcgcctccccctgcttaggactttggtgtggaggaggtgggggagtacgagctcgacggcgtgggtttggctccccgtcgtcgccgctcgcactcggagagaggtcgtgcgcttttccttgctcggccattaggctgaacaagaaaaacttggcgcacacggaagagtctgagagctcagaaaacacacgctgagccccctacctggcgcgccagatgacggagctcgtggctcctcaccgggagaccgcgcaggcccctctttgccagttcggccgggggcttagggtgaaatctcaagctctcgctctccctctgtatctggaaagatcgtctgcccgcaagacacacgagacacggcgatgt

SEQ ID NO: 36759 - DNA, 1501 bp, Oryza sativa
ctcatatcatttccactccgtaagtatcaaaacattggtgaccctcaaaattcaaaaaaggtttagccacccagccaacccttttgaaatcttttctcttttaacttttttttgcttggctttttttacacgcacgcacgcacgcattcgcggccatctgtaaacgcctctgtttatatatatgcagcttaaaaaggcagtaaatgaatggtgtgtgcacgcagttactcctacgtaacctgattttgatcattaatttggtagtgtttgtgattttaattaaagaagatgcgtggttacaaacaagcaagaatctatggtactccaggagttaagagtagcatatatactcctggtagagaagaaaataattactagtccagtccagatcgatggagggggttgagctgaatgaatgaagaggctagctaggcttgtagttagagaaggaaaatggctgcagaatactacatagcatatttcagtaagcaggaggttgcaagtgatatagtactgtactccactatatatgtgtggatctattattaatgtatggtccggtcgatccatgtaaaaaatatttcagttgcagcagcaattactaacaaacatatggaggagtatctgaaacaagaggatgattgatgcatgttgtggataaaaagagagtagtaccttggtggaggagggcggcgatgaggaggaggaggtggagtagtggtggtgatggcggcggggagcggcggcggggatgagggaggagagcttgaggcagagacccttcatgtggaggcgccgattcttctccacatccttgcgctccatcttgctactgctgctgctatagcagttgccgccgcctcctcctcctccgctgctgctggtgtggcagctgcctgctgcttttgtgctcgtcgtgctgttcttcctgctcttcatccaccgaagcgaagattgcttcttccttgagttaattaaactcaaggatcgatgcaggcaagagtgagtacgtttcttgatctcagcttctcttaaaggatggatggagctagaataaaatggatggagctagcagtagcagtagcagatggatgatgagtggttgggttggattgggtggtcgatctgctctggttcattttatagcgggtggcaagtgtgtgtaacaacaacacaattgagggaggagggaaatgaaatgcggtcaactggtgcttacagtagatccatcctggtggggtgatgggatgggggtgaccccagggttttcgtgtggggcccaccctcccgcgcaccacacccacgttgtctgctgcctgacgcgtcactgacttcctcttttcttttcttttcttccctttcctttttttattttatttaatatatgccctcacatgatttttttttaatatagtactccctcctccgtcgtaaaatataagaaacgtcttatccggtcttacatattaaaatatgatagtaattagtagccataaattaa

SEQ ID NO: 36760 - DNA, 851 bp, Oryza sativa
ggtctgtgaccagtcacagaccggtcagatcacgggttaggtggcgactggcggtctgacgcacgccttaccccatcccgtcaaggtgtgagcttctaagcactcgtccccagctggagctagcgtgttacatcccagagatggcacgttaaccccgatcgatatataccaggcttcatcctaaccattacaggcaaggtgttacacaaggaagggcaaacatgcatgttgttaaactgacgcgtggtggacaagaatgaccggtctggcactggtcgcgtcagcaacgggcagccacgatcccacgttgcgcctgtctccgccgggagtggaggtaggtgtgggctgtcccatcggagtgtcattcggacagcaaccataccaatctccgtcaataaagagaagaaaagtccagtttggaaagggaagggtgcatgtggtatccccttgaagtataaaaggaggaccttgcccatagagaagggggggattcttttccagatttagagcttagaacggggaagaagttggctcacacttggtagctcattcatacacaaatccacaaaaacacaggagtagggtattacgcttcgcagcggcccgaacctgtatacatcgccgtgtctcgtgtgtcttgcgggcagacgatctttccagatacagagggagagcgagagcttgagatttcaccctaagcccccggccgaactggcaaagaggggcctgcgcggtctcccggtgaggagccacgagctccgtcatctggcgcgccaggtagggggctcagcgtgtgttttctgagctctcagactcttccgtgtgcgccaagtttttcttgttcagcctaa

SEQ ID NO: 36761 - DNA, 1501 bp, Oryza sativa
gcgttccgggcgcgccgttggagcggcgcaatccggcgacggaggtaatcgccgtacaccatggccccggtgagcccctgggatcgcaggcccgccaggcggtcgaggacggcgtcgtagtcctcccccagatctaccggtgcccgccagctggagacctgcgccgggggctggcttggaagtcggaggcgcgcttcgttggcgaggggggtgtagaaccagtcgctcttccagtcgtcccacttcttgcgaaggacgcaggggatgtagcggttcaataccggcccccgcggctggaagtagcagccgccaaccaccgacggcggtgacaccgactgcacggtgaagaaccaccggaacagctgaagagaggggcgcaccccgatgaacatctcgcacagatgcgcgaagatggccaatgtcatcaccgcattgggggtaaggtgcgccatctggaggtcatagaactccaggacatccatgaagaaatgagaaaatggcgggaccagcccagccatcgcgaaggggaggaagaagatggaccgccccgggtagtctggtgccgggcgcccctcgcccagcatcactatctcccgaccggtggcggactccggcatgaagcggcgcggcagtccggcgtgcctctcattcacgatgcgggaaggcggtagtacactgccgtcgagcagagcagagccccgtgccatggcggcggaggaagagatgattgagaacgagcgcgtgtggcgaaagtagggcgtagcagagaaagagttagagctcaggtggcgaaggcaagaggaacaatggcgaaaggaaggatgcaaatccttttctcgatgcttttatacccttgccatcgctgggcctgactcctcgtttctcgcgcccactacctcgctccctcgtatctcgctatctcgctccctcgtttcccgtgcccacgcttccactaatcccattcgcccgcttacggcgcattgagtggatatgcggttgtggcaatcgaaatggattgtatcgtgcgcgcgttaattacgctcgccgtccgaagcggcgttaccatatctccgggcgagacgaatctgctcacccagattcgcgcgctgctcaagtggtgtggcagtcttgaatagaccgcccattatggacaaccaaagttaccaataccaatgtgcatggattgagaccgttgggtattttgcccaactacggagaccggtcccacctgtcacagggtggcgtcacacctgaccgcttcccttgggaagggaaattgctctggcataacgccgggggctactgtcggtgatatgggaccgggagtatcatgactagaggcttgaggcagacacaatcgcccacgtggcctggcaccttcggggacgtcgggcccgagggtgaggtgtccgccctcctcctgatttcccccgagggggggtcgggttgcgcttgccccggccccgagggccgaggcaccccgacccccttaaggaagtct

SEQ ID NO: 36762 - DNA, 1501 bp, Oryza sativa
cttgcatgcctagctaatgtgtttcctagctatgatattacaatacattgatgccgctttataatatactaccacagtagataattgaaatacatatatacatgtgttatacaaaaatgacatttagaacttttagctaactattaacttaattagcaattttattaattacatgtttagtaaaaaaacgagttgtgccgtactgattctaatttcaacaccgaaaaccatgtcaatctaactaataaacgcttaattaattatatcactacatatttgtcccggaagagagtatgaatttcggatgacatatagttcaaatggacgttcctcagcatcctccatatactacttctctctccgtcccataataaaagggattttgagtttttgtttgcattgtttgaccacttgtcttatttaaaaaatttgtgcaaatataaaaacgaaaagttgttcttaaagtactttggataataaagtaagtgacaaaaaaaataaataataattccaaattttttttaataagacgagtaatcaaacggtgcaagcaaaaactcaaaatcccttatattatgggacggagagagtatttaaaaaggcgacatcgttgaacccttacacacactggtggagaaaccatcttttgtcggtcggccgaactccacactagtcccggatgcaataaaaaccggggctaaagatgatctttaaatatgcgcgttaccctttttaaccgggactaaagatcatctttagtcccggttcaaatgttgtcagggcctgtcaggccccccgggatctttagtcccggttggtaccaaccgggactaaagatcgtaacttaccaaccgggactaaagatcccgggatctttagccccgattggtaacactaaccgggactaaagtcccacccctatatttatgtcttcttcctcctccagctgcccgagcaagcttcaaaatttcttcaaaaaagaggggaggtgatgccaaaatttctagtgaatttattttggtaattacatacaaatcggaggtgcctaaaaggtttgcaacttcatcctccaatgttttttttgtcatattacatttgcagctatgttttgcacacttttttgtctccaaaatttagttgtaagttgatgagggagaaaatttgtgtggggaagaaagaatatatagaaatttagttgatttgctaaagaaggttttataaaatagttgagaaggaaaactatagtgaaagttaatcttgaatactagaaaacaactaaaatgaaaattaaaagaagtaaaacacattaaaattagtttaaaactttagaaatagtaaataagaattatttggtgtaatatttcatgatttttgtatgaataaagatatgtcattattgtatgactgttgaaacagtttgtaattatcttataattattgtatgactgtcattattgtaagaataattatttttgtacgattttttttcgactcatgtaga

SEQ ID NO: 36763 - DNA, 1501 bp, Oryza sativa
  unsure (1)..(1501): unsure at all n locations
gacaagtggtcaaacaatgcaaacaaaaactcaaaatcccttttattatgggacggagagagaagtagtatatggaggatgctgaggaacgtccatttgaactatatgtcatccgaaattcatactctcttccgggacaaatatgtagtgatataattaattaagcgtttattagttagattgacatggttttcggtgttgaaattagaatcagtacggcacaactcgtttttttactaaacatgtaattaataaaattgctaattaagttaatagttagctaaaagttctaaatgtcatttttgtataacacatgtatatatgtatttcaattatctactgtggtagtatattataaagcggcatcaatgtattgtaatatcatagctaggaaacacattagctaggcatgcaagaaaaattctggtccagcaacagtgctaaaataaaaagcatagaaagggagttatcacctcccacccaaaatgaacgtacgacacccaagtaaaacaacaataagaaaataacaaataaacaaaaggtccagtaaaaaaaaacaaaaggattgatcttccttacatatctgttgcacccaaattgtctaatttgttatggaaaataagcataagcatagatatattttttagataatggaaatgggttacatctccggcttctgttataagacacacagccataagcatagatatataaataaggttcttaattatccatgtggcacgtaattgttaattaacgcctttgttcggtttgaaggggattaagggagaataattccacaccacaataggtgttgaataaattgggaaataagtaacaatattgatgtggcgctagagtcttgatcatatccatcatgtttcgaatccaagtgtcaaaataaataaggtcacatgcatccttgggtactgcatgtagggatggaaattatgcatgtgatctatatatgtacataaaattataattaagtaaagctaatgatgcgttcaatatggtttatattctagggttttgccttctcctctgtgctgcgtcgtcgctcgtagactactccattccgctcgcangcgtgcacctgcaatcgggagagcaggtctccggaacctctgccttctacgtcctgcaccgggagaaggcggcaataaggtttttggaaagtacttggtgcgactgctccctgttagtccgcaaaggatcgtattcctattcgctcgcgtgctgtgcgccgtcttcgacgtcccgcaaccggaagtagttcctgcagagcaactggtctttccgccacttcggtatgtgttcgacatgttgtgcatatttgatctgttcatgttttactgattagtttacatgtgtagatctaatgatgcgttcaatctagtttacatatgcaatgtcatgatttatttatgaaataaattaaatcattattttgttataatttcaacaatccaaaccttatataggcactgtgattttacta

SEQ ID NO: 36764 - DNA, 270 bp, Oryza sativa
tgcaaagtttatttggagagctgtatagttctcttttggtctttaccctcctaattgcatatctcatatttttgatgattggctctgggggtggacaagaaaaataggaaacttattctcataggagcttctgttatatgttgcgctctatggttgagtaggaatgatatgatttttgataaatcaccatctgtttcatatatgcatgttaatttccagggcacgcactgacttaagtcttggtcactgctacacaagtgtggatgttgg

SEQ ID NO: 36765 - DNA, 279 bp, Oryza sativa
tgtacctttgccctctttttatgattgatatgtggactcaatcaatcaaatggataccattatagttcctaataaaattgacatgattttgtaattggagccttgtaagcggcacaactcgtgcaaaatgcagattagcaacaggtgtcgtaaaagcccaacaccactgataatgtttgcaggaggagcatgctgagctgctgcccagggccagcagtgtccagtgtcagcgggaacagagagctcactcacttctgaggctgagagagagagagagga

SEQ ID NO: 36766 - DNA, 1501 bp, Oryza sativa
cagtactcgcccatctcctcctccgagaatcgcgcgagattacggtgggggcgagcgctagtggggtttgcagcagtttgcggctgatgagagatggggatggggaaggccaagaggcaggcgaggcgatgagaaaaaggaaggaatccagcagaaaccgggagtagatatggaagtccgtgagatttattaggagatgccaatttaatgcgggagggatgtttcatgtttgcgcttggataataattaattaaggtatggacgagtttacgtttcttgtgcgcgatttaatttaggcaagcaatactagcgaataaaatgttctatccatagaaaagaaacagtatgataaaatgcaacacggattcttccttcttctttttctcctcttgctttctagtagtcctgcttgttttgattgaatggataattaaggaggagagtacgttaggcaaagcaagcaaatgctagaataaaatgttccatccatagaaaagaaacggtaccagtaggataaaatgcaacatggattcttccttctttctgcttcttagtgcttgttgttttaaatgaataaatggatgaatgaattaatgaattatttgtggtagtggtagtaattaatccgctggttatttccacttgacggttgcttttcgttttgtttgcttggcttctcagccttgcttagagcaagtacaataaaagactataagctagctataaacatattttaaaaaaacaaagaaagagagataagagcagcgggttacagatctatagccagctgcagcacggactccaagacgtaatgtatgtataacaggtaggaccagatattaatagtatagtaagcaactattgtatgaattggctattacatcgggtatagattattcggagctagtagtgggctatactattaaacttgctcttacacgtgtcaggcgggcccactcgtcggtcatcgcccaatgcccagggaatattctcttcttcttcttctattccacgtccacgtgtatggccaggagttgttgtggtgcagtggtggtgagagcgagctcagtctgagctggcttgcatttcgctttaggccgaaacgggctatacatattttctttcagcccactatgatccatcatctaactgattgacggcttgctcctccttttccggcttcctaaaccaatctgggcctcagcccaaaaacataagacactgctaggtttgcgaatgcagcagcaaaatccgaacgagggggcattttgcaaaggaaaaagtatacctaaggtcccttaacttgtcatcaaattacaaaatcgtcctccaaccacaaaaccggagaacgcatcctctaacttacaaaactattataaactagatcccttggcagtttttactctggttttatccgacgtggcagctgactcagcgtgggggccacatgggtcccacatttcagcctcttcttcccctcccctctccacctctctcctct

SEQ ID NO: 36767 - DNA, 1501 bp, Oryza sativa
gggtatggcggtaatcccccgatcagggatgttcatgagagatcgatcactgtagcgatcgccctaaacaaaatatctctttgccgactttaggtttagccgcaagatcatattttgcgttcacactaacaaagcatacagggaacgtatcataaactatgaaactatgcataaaaagtttcaagcaattaccttcgcactacaacaaaaacattatataaaggcactttatataaaactctaagatcaggagttttatagcgtagagacactttatagaggcactttcaaaattttctagaaaatttttactctagagactctttagaaatatttttagcacattttattagattttatcttgtagaggcattctttcggcactttaaaatgtgtctaacatgtaaagacatttgcttgagacactttaaactctgtagagacacttcttacaataaaaatatactaaatggctaaatataagtaacttaaggcataaacatatacaatgaatgacatggggttgagttggttagtgccttgaagataagaatgatttgttcaaagaagataagaatgatttgttcaagagatcatgagttcaaggattggcaaaaacaagggaaaatattttattctcatttttacattggtttcgtatggttgtggtacaatttaatgtctctagaaaatgtctctaccaccttatagacattttataaaatgcctcttcgtttgtagagacaattcaccataaggcacttattagacttttttaaaatgcctctatagtattgtaaaggcatttgaaaagtgtctctgtagtcctagaaaaatatctctataaagtatttttcttgtagtgtcggtaagcaatattttactggatatgagttcagctaatcaaaggtttcaagcaattaccagtcccaggtccttcatttggctccaattttatactccttctatatgagtagctgcagcattacttttctggaactccttaagctgtgtttagagcgctaactacttaccagaaattctccacgcaagcaatactgagaaatcttcccagctgcatcctgcgggggatagggacaccaaagaaaagattcagcaccgaaacacatttgtgacgattcatttaccagagtaattttgattgcttgtattcagatttatttgtttacactgacaagtgattttgtagcttagtactagtagtaagtagtattgacttggcagatatactcttcacgaaccaagtactagcattagaacgtacgggggatataggacgtgggtgcttgtttaagaatgagaagtacaacaggaaagctatcagacagttactaataggtgttcgacagtattgatatgatacagtcgatatgaacaaaactgaaattcctataaatgagatgcaatactcatctctcgactattgtaatccttgcactcccaaggttgaaggttctaatttggaagatacagaattcag

SEQ ID NO: 36768 - DNA, 1501 bp, Oryza sativa
ctaccggtcttgtccttgccagcgacggcggattccttggtgtactacgccgtctcggtggtcttctgcttggcggcgccggcggaggaggatgaaatcctgatgcagcacacgcgcttctgatccatctgcgtcaagtggctcaagcgggacgcgaacctacagatgcacatgcgtagacacagtgacaagtacaagagcgtgcccatgctgacaaagccgccggcggcggtggtaaggacaagcagcagctggagcggcggtactcgtgcacgttcactgggtgcaagcgcaacaggctgcacgcaaacttccagccactgaactactgattactgaagacgatcttgtgcattgtttcatcatccttcagtaaaaaaggttgtgttcaaaaattgatttgataaacaaaaacgatgattagaatataacaaaaggcagccggcatggaaattgggacaggtgcagggagccgatgcagaaccctccaccgcgccgtctcgtcggtctcggtggccttctgcttggccttctcggtcttctcgccgaggaagccgctagtctggtccttgctctcggcggccttgtccctcgccgcctacgccgtgccggaggtcttgtccttcgccgcatgtgccgtcacaccgccgccgacttcctccggagagcccacctaaggcagctcactgcgttcctccgccggcggcggcgtggggggaggccctcctgctcccgcgtcgtcgccgccgccgcctcgtcgcccgtcgccgaccgccggagtcccgtctcccgcctcccccaccggtctcctccccacacccgtcggttgccctgctcggtgagagaaaggaagaggagagaggtggagaggggaggggaagaagaggctgaaatgtgggacccatgtggcccccacgctgagtcagctgccacgtcggataaaaccagagtaaaaactgccaagggatctagtttataatagttttgtaagttagaggatgcgttctccggttttgtggttggaggacgattttgtaatttgatgacaagttaagggaccttaggtatactttttcctttgcaaaatgccccctcgttcggattttgctgctgcattcgcaaacctagcagtgtcttatgtttttgggctgaggcccagattggtttaggaagccggaaaaggaggagcaagccgtcaatcagttagatgatggatcatagtgggctgaaagaaaatatgtatagcccgtttcggcctaaagcgaaatgcaagccagctcagactgagctcgctctcaccaccactgcaccacaacaactcctggccatacacgtggacgtggaatagaagaagaagaagagaatattccctgggcattgggcgatgaccgacgagtgggcccgcctgacacgtgtaagagcaagtttaatagtatagcccactactagctccgaataatctatacccgatgtaatagccaattcatacaatagttgctta

SEQ ID NO: 36769 - DNA, 201 bp, Oryza sativa
tggtttggggtccggctatgtcggcgacgataccaaacagaagcattatccgtatccgtaccaaacaccaacactgcgaattatatatatatatatatatatatatatatatatatatatatatagatatatcttcctctacatctacacgacgtacacttggatactgcaggtagattagattagatgatcggccggcca

SEQ ID NO: 36770 - DNA, 1501 bp, Oryza sativa
agttatggtctaattttagtgaatgtgcaaagtagactaagtggtatgctagatattttcagacttagctaagtggtagttcgagtttaaattttttttgtggttggttgtatcgtgatcctgagtgtgaaaaaacatccgaaaaaataaaataaaaatgacaccgttgcaactccatacagagaaacaggaatggaggcggcggcgctagccatgctggcgccctcctccctggggcggcgccagcatggatggcgccctcctcctgccacgtcggttcgcgtgcgccacggtggtaggaggactcccgttggatgacggcgccagccactctggcgccccaaaaaggaccatttctgggataagttttttcaggggtctatttgcgaaataagttttttaaaaggatcaaaatgtgaaaaatccagcctaaccgcctgcgcagcacggcaacagtgttgttcaatcatctccacataagccaagattttctggatgacctgtcttggattagctaaggtaggattattcctggagtgatttctagcctcccatatatgccacaacgtgacagccagcgccgtcttttggatgcttgaacttctccccaggaaatcaaaatcccactgcttcatatttgacagatcagtcctgcatagcttcaaatcaaaatgttgcttgatgctatcccaaatacattcagcaaaagggcataggagaaaaatgtgctcgatgttcaaacctttgaaagatcagcctttttctttcaaacttttcacatcacatcgtacgttcaaaccccttcataaagtactccctctgtcctaaaatgtttgacaccgttgactttttaaaacacgtttgactgttcgtcttattcaaaaatttttatgaaatatataaaactatatgtatacataaaagtatatttaacaatgaatcaaatgatagaaaaagaattaaaaaatacttaaaatttttgaataagacgaacggtcaaacataattaaaagtcaacgacggcaaacattttgggacgaagggagtattaaatatagacttaaaaaaaactaattatacatattacaactaatttacaagatgaatcttttaataatatggtgttacaataaacatttgctagcgatggattaattagacttaataaatttatctcgcaatttactaacagattttttttattagtgcccgaataccctatgcgacaccttatataatatccgatatgatataccaaaactttacacttaacaattccaacattccaatctaaacacagcctaaaattcaccgcattttgacccctatattacgctaacaactccgacattattagtactcgcatttttacacagcagcatttcgttctgctgcatcaaaatgcacacggacgaatatttaaaatccattcacatgccattttactcgcggctcgtgagatgactaatacacattacaaaatgagagaatagtaagcata

SEQ ID NO: 36771 - DNA, 1253 bp, Oryza sativa
  unsure (1)..(1253): unsure at all n locations
cgaggagtgttgtgttaaagaaaccaaaagcgggaagcatccgaaatttatttaggacaagggtgtgggcaccagccatgatttggctcaaacggaaggtttcacaaaggaaaacatatacggggagaagtcaagagatggggtgttttgaaacgaaacatagggaacggttagggagccgtaaaaaagaaatcgatggtttgaaattggatactcaaacaaatagcgggctctagcgccgggtaggaaaaaatgtgntatanctatnngagcccggtcccaccgcngacgtggtggggcgatgttgaggtggctagggggagtgcgccagagtggctggcgcccccctcccccccgaaattttttatttttgttttatttgtttgatatttttttcacgcttagggacacacaagaaccaaccatagaaaaattgaactcaaatggacgtaacatgtgacatgtagaatttttcctctcctctcctctctccgaactagtgcagaggagagagatgtgcaacttttttatttttattttatttttttgatatttttttcacacttgggaactcacaggaaccaaccacgtaaaaaataaactcaaacggacgaaatatgtgacatttggaattttccaaagctccaccgaaaaacttctctcctcgaaaacacaatcttgcaagcagaatttagaggttttaatctacagaactttttctgtagatgtccgttcatatattatttgcctgattccgagtccgtatgagaaagttacgcctattttaatagatggcatatttttttccgtttcggtagagttttggaaaattctacatgtcacatattttgtccgtttgagtttattttttatacggttggttcctatgttctcctaagtgtgaaaaaaatatcaaaaaaatgaaataaaaataaaaaaattacatctctatgtactgtttaacttatatatgtcatttcatgtggttatattttgaattagattaagtaatttatatagtggtagagtgcattatgtttaacatgctgatcaaagggttttactaaaggagttatggtctaattttagtgaatgtgcaaagtagactaagtggtatgctagatattttcagacttagctaagtggtagttcgagtttaaattttttttgtggttggttgtatcgtgatcctgagtgtgaaaaaacatccgaaaaaataaaataaaaatgacaccgttgcaactccatacaga

SEQ ID NO: 36772 - DNA, 316 bp, Oryza sativa
cgagctcggtacccgcaataccaaatcattggcaaattttggtagtaacaaatgttttggcaacttatgtgtcttattggcatattttggtagcaaaccaaacactagccaaactactatttaaaataccaacaatttggtagggcatcattttagcatcaaaccaaaatggcccaccgtttctcgtgcggggaactcagccttactatgtgtgtcatccaacatctctatgataaattttggagaaaatttgcgaaggtaaacgttgcaaatatgcaggcaaccgaatcatcgcaacaactctcggcagcacatc

SEQ ID NO: 36773 - DNA, 322 bp, Oryza sativa
cttttattgaaaatggttcttcgtctttcttagtagaatctattttattttggatggcaacctgtggtatttcgaggatcggataatcaggttgcctatctcggatttatttgcgttggagcaaggcaagttattattcctcccctttgagcattattatcctatattctatatctctattattccatgcattacccattcatgattttaaatgcataacttgaacatatagcaaaccagatatatgctagattttgcttagccatgcctagttagattgcataaaatataacgaacttagattggaacagtacggtagaaa

SEQ ID NO: 36774 - DNA, 1203 bp, Oryza sativa
tagggcgaattcgagctcggtaccctgttgggcagtcgcagagtgcgggtaaagtgtacatccactacagtgtgagtaaaccaaatctattcgaatagccgtgctcacggttattgagtaccgggacatgtattacacttggctagactataaattctttaactggtgtgggatgggatattacatgatgatttttatgctgatggagccacttcctgagaggtgggaatgtggacgtcctcagaaaaccatgacgactcaatggcggtaagctattcttgggatcacaatggatggtggacagaaccgtcggtgattaatgtgaacactggtattaaaactagatcagtctatgctaggatttacgcttatgaaaagaattacaaaacttgctttgcgcaaaagaaccatagccatactttgaattcttctgtgatgtgcattattgctgcggtggcttgctgagtacgggtggtactcacccttgcaatattcaaacttaatcagaggccggagatgaagcttcggaggatccctatgcctattaccaggagggtgatgaggacgatggcgctcaataggtcttagttacggtcgttgcctgtggcaatagcgtgccgctgccttaactccgctgccttacctacttctgtttttgaaatgtattccggaccgctcggtccgatgatttaagactgtgcctgcgggcttatgatgtaataattcgtactagactctcatgtatgtgcacttgatatttcagctataagttcgtgtgtaccagactacttgatccagggaaatggtactgtttacacgattaattcctgttataaaaacgggggtctaaggaagctcaatttgagaagttttatatcccgggagatattcattaccgtattcatttcactctatattcgatccatatctttattgataatattttattacgtttttatacaagttttcaattctgattatgtttctgaaaaaaatgaaaataaacatggtagatcaaattttcatccgtttctgttccattttcataactagctaatactgaacagaataattgaatgcggcaggtaaaatcgttgcagcaatactcatacatcaacctgaaacgaccatcctaggctgtgaccaagatgatatctattgatgactttttaagaaatgctagataaaaaagtattcatgttc

SEQ ID NO: 36775 - DNA, 295 bp, Oryza sativa
atttaattcaaaacccaatctttagaagcccatatctcttaaaccgtagatccgattccagtgaactttggacctaaattcatctaaattcaaaatctacattttggtaccaaatttgctattttaatattttatttaaatttccttaatttattcaaataccatttggataaatatttgatcttataattgaatttacaatttaaacttatatttgcttttcgaatatttccgtttattttcaaaataccttttagccactaaaaagccgccggttggaactttacgcctttca

SEQ ID NO: 36776 - DNA, 661 bp, Oryza sativa
accacaagccagcgtgggcaacggctttacctttcgtatagcatggttcattgcggggcaccagactgagaagtggcggagatagcccacgggggtcgctggggagtccatgccttatttataagggggtgattatgatccaggaatggtgcactgcggtggattgtgttatgcaaggggtaatgtcacagcccctttccgaggtaccgtggtggtactgaggcacatggtgacatgatgtggggctgtgtcttgtgggtacagtggtacacctctggccagagtaaaactattcgaatagccgtgcccacggttatgggcgggttgagcaatgtttttcgtgattagtcccacacttctcacaataattatggatgttatatctggtaataatttgcttagctcctggattggagattagatctgtacagccgggtatggttgtttcagaatggttgggcctgagcagcatgggcgtgttgttcagtgttgattaaaatttctgattaattactccactgttttacttctcttaaatgttttgctaaatgctgcttttgcaaatgagcctatattatgccaacctttggtatctttgcgcacttgcatatttgctgtgtggcttgctgagtatgtcatatgctcaccttgcaataatcaa

SEQ ID NO: 36777 - DNA, 288 bp, Oryza sativa
cccatacacatatcacacacatgcacattcttgatcaaaaaagtataactcgctatctccttgggtccgaccttttggctttgcaaaatatgtatgcaaggtatgccccgattgatccctaccaagctccacatatacaaccttttagaatagggacaattcggcaaaatatgccttggtaaggatccacaaattaaaccacatgcgtgatttgagagaaaagtcatttgagaagtatagatactttgtgaaaacatatgaaaactcaagagattgacaggagaaaca

SEQ ID NO: 36778 - DNA, 157 bp, Oryza sativa
tgttcacaacatgttaaccattattttggtttattcatatgatgcggccttcgtaattgtaatattacacaatgtccttgataattatatgaagatacaagcacgaacttcagaatctagataataattgctaacgacgatgatctagtaagaaata

SEQ ID NO: 36779 - DNA, 1501 bp, Oryza sativa
acggcgacgtgggcggcgtggcccgggaagcgcgggagcgggcggttgcggggcggcggctgcggatgcggcagcgtccgaaggttgggggaggacccgacaggtgggccccacctatcggcgaccccgggtgagagaggaggcgcggccggctgctgggctgtggccttcggccggcccagcaagggcgcgggagggaggaggaaatgggctggcagctcattagggaaaaaggaaggggaaaaggaaagaaaaaagaaaaggatttcccagggattaaaataatgcttgtgctcgattttaattggtttgaattatttctagagctctgaaaattccactaaaaatcctgttagcatattttgacatgtagaactcaagaaaaatcccacatgccattttcgattattatttgcattacttcaattagggttcctctcttgattttacacaggtaatttctcgagaccatttattaattaatttaggctcgggagaagaacttcagggtgtgacaatatatatgtgagataaggatgatctctagaaaggaatattgccctaagatccgcattggctttgcccggttgccccgcaaaaactggcatactattctaaccactttttttcttctctggctgatatgttggccatcccttaagaagtaggatcatcacatccctcgtaccaaacggatagatgtgactatcccatcctaaaaacatggatgggtccaatttatcccacctcattctcaacccaaacacatatttaggatcgagtgaatactatagtcaaagacataatatataatccctttgcctcataatatataaatttagaattggatgggatgttttatagtacaacgaatttagacataaagtatgcacgaattctttgtaatataaagtgttccatctggtattaggttgttatatcatgtgagggagggagtattcaattcatcagcacgggagtaaagtcattggtgagcatgcatatatacatgggcgtgtgcacatcaactaatcgtcggctgtgtttagatccaggggtgtaaagttttggtgtgtcacatcggatatatggatacacttttgaagtattaaacatagactaataacaaaacaaattatagaatccgcctgtaaactgcgagacgaatttattaagcctaattaatccatcattagcaaatgtttactgtagcaccgtattgtcagatcatggagcaattaggtttaaaagatttgtctcgtaatttatacgcaatctgtgtaattagttatttttttgtttatatttaatattttttatatatgtgtcaaacattcgatgtgacaggataaaatttgttgacatgatctaaacagggctgaattgaatgaagagagaagagatcgaaaagctgcagatcgaaaagcttgaggtggtgtttagatccagggacttaactttagtccctgtctttagacactaatttagagtattaaatata

SEQ ID NO: 36780 - DNA, 367 bp, Oryza sativa
tttataatagtatagataagtcatttgatttttctcttagtcaacttttttaaatttgatcaaatttatagcaaaatattgtaatgcctggcaccaatctcgttgattagtacttagctttctcggatgggacagtgccaacgtcattgacgtcatcatgttagaccacggcactaatgacgttggtgctgcgaaaaaaaattagcaatagtgcccgtgcgttgcaatgggaaaaactacatgcccaaaatatcagctcgacccatttagcgcgagcgcacggcgagcggtgcacggcccatctaccggcgatggcccgcccgaggcgaactaagcgcgacccaaagactgcatggcccaacaatga

SEQ ID NO: 36781 - DNA, 488 bp, Oryza sativa
gtccataatccaaatacctaattgcggtccagcttccattgcttcaaatatctgcaagggtacatagggttgctagctatacatcccccctcgcttgcaacttgccgaaggttaattgctcacactgttcatcattttatgatgaactaactttagcaacttggaaaggaaaaaaaagcgcatttcattaaaaattagcaccccctattaatctataggatctaatggaagtagagaactgtacatgacaatgtagggtcatactaaggcaactattatccaaatagaaatattcatacgcacctcgagatgtaaagccaatgttattgcccataaggtttggttgaagctgtgatgaatgattatccatttttcatccaaaaaatagccatatggatcagcaattgcacatactaaaacctagagaaaatttgctgctttaaaagcccagcccagctgagcattgaccaaccattaacagatgtcag

SEQ ID NO: 36782 - DNA, 507 bp, Oryza sativa
tttgcttataataagtataagaaaaaaatgttgagtcccttggtattacagcagtgagtttatcaataattcacataaagaatcttctttttttttcccgttatcagactagaggcaaatattcgatcttacttaatttccatctaaagcacacttacatatgcgtatcattcttggttatgggcaagaaggttgggtttacttcatcaacgaaacccgatcgattttttgcgattttcaatgttttcgacgtggctcaaaatcaatatctgggagggatttcgaatggtctttgataaattcaaatttgaaacagtagtttgatccaagttttggccttgtttagttttaaactttttcttcaaacttccaatttttccctcgcatcaaaacttttctacacacgtaaactttcaacttttccatcacatcgttataattttaaccaaattttcaatttcaacgtgaactaaacacatgtcgaaatgcaatcaaaataccaccaca

SEQ ID NO: 36783 - DNA, 184 bp, Oryza sativa
cttcttcgatcatctgacatctcggaagcttctgaatttttcaaatcacgtaaagctcaagtgtccatgtcactgatgcaagcagatagattagctcgttctcttttgactgagatcatcattaatgaacaagttattttggagccaaagtgtttaatcaatactccagttgttaattagtaga

SEQ ID NO: 36784 - DNA, 366 bp, Oryza sativa
ccagtgatcgcagatgctgcaaatattcctcctgccagagaaaaacatttacatgtgaggtagtagctgctcgtttccagctctgcaaaaaccatcgggcacgtcacatactcacgttcaaatcagtatacatggaaagcttttgcaacgcaaagaaacagaaagcttgtccttaccgtcgtcatatcgtagatcatgtcatatactgtacaccacgattcagagaaagagacaacacagccggaatcctcatgctctttagtgattgatctttacgtctcagccatcagttgcgatcacgacaaaaaaagtgatcagcgtgcagttaaatcagcagcaatttgatgcattgcaaaaatgatatta

SEQ ID NO: 36785 - DNA, 202 bp, Oryza sativa
ttattcgctctcatgtaaaaatgatctatgcacaaaaattccgctcttattcgcttattttacttgagtcctttattgtttattttataattggatttgagcatgcattgattctccgtcctttgtcttctatagatggccgactgtcccctaatgcaccaaggtcagactatgggaggctttgttgcagagttgtcccgca

SEQ ID NO: 36786 - DNA, 979 bp, Oryza sativa
ccaagcttgttcacaattattggaggggttggatttaattgaattgaattcttgttcatcacaaactgatagataattaattaatagattaattgtcaggaatgtacatacatacatacatgtgtactggagtacatagctagcaattagtgtcaattatatacgttgttgtaagtcgttgtaagtaacagttaatcatgtgccaaatatatagcagtgttttacaacaaattaattgtctctgggaattaacacaaatatatatgtattcggatggcttaatatattacactagtttgatcctcatatacacgcatgctagcatggatcatattgcaattcagaatccgtactaaaggtttggctttcttcaattccatgaaagttagacggttggctcaatactgcatactcgatcacaggttgtccgagtatccagcagcaattaggccgagtttagtttcaaattttttcttcaaatttccaacttttccatcatatcaaaactttcctacacacacaaacttccaacttttccgtcatatcgtttcaatttcaactaaacttttaaattttggcgtgaactaaacgtccacaaccttaatgaagggtggaattattatatattattatgtataaatttcataatatatatagctaagggtgaattatttaaagaaaaaactagctagggtgagagttgtggatttctgaactctagttttttattactcttggtttttaatgcccgatgctattgatttttaatgtgacgttgaccatttgtcttattaaaaaaatataaatactatttattttgttgtgacttgttttatcatcagaaaaattataaccttaacttatacttccacatatttatactaaatttttaaataagataaatgatcaaatgttatgcatgcacaaaatcaatgggttcctacgctaaaaccaggggagtataacacaagaaccgcga

SEQ ID NO: 36787 - DNA, 1501 bp, Oryza sativa
gagccaagctgtccaggaccaggagtacatcgagccgcgccgttttggctgtctttttgcttctgcaattcagaccaaatgaatttacatgatgctgtacaaatatatatggtgttgtgaacctctcgccatctgattttaaatctccgaaacaacaaaaatctccaaaacggatcaactgttggtaactttttttttcattctgccaatcatgaccaatgcttgcataaaaaatgccctattaaaaatctaaaccggctaaaggacactatacagaaacaatttttctatacgaaaacttctatagtttgcaggcagacaggcgagcggcggtagccggagtggcggcgggcctcccccacgtcgctcgtgaatccagtggttgttggatgttttatttcttttgatttatgtaggtattggtggcataaaattggcatttaacagccgccaacagcgatgccggccgtcccccacctagttccgacggtggcagccctctctcgcccggcccgcgcggttccgccagcggtggcgagaggagcccagagaaggaggggagggtcgacgacgacaatggcgggaaagtccctcacctagctagggttttaattttgggggatttttattttttttttggattttgatttttgcgtacgcataagcacttgcacgcgaaaattgaatttttgcgtgcgagtgcaccacccgcatgaaaaaataacgattttcgcagaaattttcaggcatacggacgcctcaacagcacgcaagaataggttttgctcgtttggaaaaatgtttttttagtagtgggagccgatttaggccttgtttagttcccaaaaatgtcacattgaatctttggacacattcatagagcattaaatatagataaaacaaaaaactaattccacagtttgcatggaatcgcgagacaaattttttttgagccaaattagtccatgattagctataagtgctataataacccatatgtgctaatgatggattaattaggcttaataaattcatctcgtggtttccaggcgagttgtgaaattagttttttcattcgagtccgaaaaccccttccgacatccggtcaaacatctgatgtgacacccaaaaattttcttttcgtaaactaaacaagccctaatacgaaataggataaacatccgtctcgtgaatagaacggaaggtttttgggacagaccggacgacttacaaggcaaaccgacgaagatggataaaactagactaaaacttggtaaaaagtagatgcgatatttaaaaagaagttagaccagccgggtcttttcaaattcgatcatacttttctattcccgttctatttgtcaaatttagatgttaacactaatatctgaatttaaatctccaaaacggtggaaatggttgataatttaaatctcgtgatggcaagacacctctgtccacttgaccctagaaaaatccccagaaatattatcaccaatgc

SEQ ID NO: 36788 - DNA, 1501 bp, Oryza sativa
catagccgattagccgatggtggtgtagctcaattcatttgatttgattttattttattgaattttgtgatatgatagatcaaactgatgagccaattaagagaggcctgatttgctggcccaggtagatagagtaggaataattcgatttacgcgcggcgatggtgattgaaccgaaccgaacagtataaattactaagagattgcgtgtcattccatgcatcttaatttagtcacgtttggaggtcgattccggttgagtgaccgatcgaatcgaatcagtcacgttacatatatatgtactctgccggtatatatacgtatgtatatccggcgcggtgggtgcgcgtcggaagaaatacttgtgtttctgtcaaagatataatatactcctacttatgttcctgcgaatttgggctaccatgcatgcaacataacaattatttagcttgtagatcgaatatactcctacatgggtgctggccggaactgtactaaaaatctactccccctgtcaagaaaaaaacaaactctgagtttccgtgccaacgtttgactatccatcttatatgaaacttttttataattagtattttcattgttattagatgataaaacatgattaatactttatgcgtgacttatctttttaatttttttcataatttttttaaataagacaaacggtcaatcgttggccacggaaatcagggtttgtcttttttttttttacggaggaagtaattaagtgtgtaggactgtatttaccaatctagtactagaggctgggcgtgcggatcgaaggcttctctatactatacacaagctgttgctgctgcttaagagcaagtacagaagcaggttatataagctagttataaacatattttaaaaagataaagaaagagagaaaagagcagcggatatagccagctgcagcacggactctaatacgtaatatgtgtatgacaggtgagaccaggtattaatagtatagtaagcaactattatatgaattggctattacattggctatagataatttggagctagtagttgactatactattaaacttgctccaacaggagtctcaatctcttaccattgaattttacggccgggtcggaagaaatatatataaaactttactagtaagtaattaatttcggacaatagatatatacaacgtactgttgacaaaattaaccccatggtattgacatttgtatcactgtactagatcatacgtactttatgtattcacttgggaggaagaattaattaattaattaacgtatgtactcaggaattatatataataaaatggtctctcgatcgatcgatcgagctaggtgtatatatataggtggcctgcccccatccacaactctcaaatttctatccttttcttcttcttccatcgattgcattcaaatattgatcaatcacgagattaattgattgatatccatatatatatgatgaccatcgacctgcagc

SEQ ID NO: 36789 - DNA, 403 bp, Oryza sativa
agttctactactgctataccactgatgaatcatctcaaattatcatctgatcagcgattcagcagcatgagatgaatgatttcattgacgtagagcctcgcatctttccataggtcgacagcaaatctacctgctgtaccaacggaatctaccatttgtgtgcgcgtgcatgggctcaaacggggacagtaacacccagcgcaagaatgcagcacagcacacactacagcagcaagagaagcatggccaggacaggaggagaggaccattgccaatgaaaaagatgtgtaaaaacaaaagagaaaaagaaaaaaaactcaggataaggacctgcccctttggatgcaagcacacacaaaccaacactgacatcatgttcattcactgtgaggagaggagatgg

SEQ ID NO: 36790 - DNA, 757 bp, Oryza sativa
ttgggttttgcccctctctcccggtcgtcacttcatccagcacggggacgatcggagccatccattagatcggacggctcagatttgcccagcgtcgggccaccgccgccgttgattacgctgcgcccaacgggccgcgaaagtgcatcggaccgtccccacatatgtgtgctgcgtcagctgcttggcctgcgagccgtcgaattgactcaactaaccaaagatgggccagcccaagtttggcccggttgggaagacctgggccaatagcaaatttgatcaaacaatgtggctcagattttttaaattaaagtccgtcagataaactcataagtagattcgaaaaataaatctaaaactaaatcctaaatcctatgctaatttatcaaattagactcggtcctacctatttgttaatatatcaaattagacttgatttttaccgttttgaggttttcaaggtttcccactatcgaacggtgtttttcccgttgcaatgtacgggcactattgctagtaaaaaaaaaaagctgaagcccatgacgccatcttaatcctctgctcgtactgtccaccaactaacaggcacttgacctccgccagtccaatcatacacagccacgtgtcctggcacttcaaaagttagttaatgtgttcaaccaccagcagctaaaccccgccaacctttgcttcccgccattaatttctcctccctatttatgctcccccatcctccgcccaattcttcccccaaaac

SEQ ID NO: 36791 - DNA, 560 bp, Oryza sativa
atagagcttgtttccgaccgtattcgattcgttttcattcctacatatgtgtgtactgcgattttttttcttcctcaccagaacaaatcttgtaatagatctaatgattcaaaattgcgtgaaacttacatacaagttacactgtagtacatgcaagttacagtgtaattacatgcaagttatagtgtaattacactatgattgtattataattatatctgtcaaatttttaggagaaaatttgtctgacaaatgtataggtggtcccttgcggttttaggggtgtgaattaaactcaacgtaaagacgagagacgtcaagtggacttatttccaaaggagaaatttcatacgggacgtgtttctcggcccagcccaaatatctagagtacgtcttctactcatgattacgtaaataatgagagacgctatttactccgctagatcagccaccttctcctcgccacgtacgacacaagcagccactcgcgcgcacatggccacgtcacgcaaaacccgcagaattacgcgattcgctgagcccttttctgcaaaaacacg

SEQ ID NO: 36792 - DNA, 168 bp, Oryza sativa
acaatcatagtgtaattacactataacttgcatgtaattacactgtaacttgcatgtactacagtgtaacttgtatgtaagtttcacgcaattttgaatcattagatctattacaagatttgttctggtgaggaagaaaaaaaatcgcagtacacacatatgtaggaa

SEQ ID NO: 36793 - DNA, 453 bp, Oryza sativa
atttgccactgggttaaatctatatattgtaggattgccaccagataattaaaaaatgcaattagaactgttgttcgattggcatccttacaaaattaaaaaaaccagtggcaaaattgtaaatacaaaaaaaaaacaacatatggcatctagatacagcagaggttttggatgttgaaacaatttattaattgagttttgagtggatctaagaaaacttctcgagtttaactaaaggcccaagtattcatgggccgggctgcaatctcaaagccgcctccaaatctccaaccgagacactgaccggtgggcccaacgagagagccactcataaaccctaatcctcgcgaactccccctcctccccgcctccctcccatctcgcgttctcgcgctcgattcgaatcccaccgcaaagcaaaagcccacgcgcgaagcaaaagctcgccgcaaa

SEQ ID NO: 36794 - DNA, 627 bp, Oryza sativa
ctatattttactgtagaatggagatttatgagctgttttcatttgtatatgcttgatacctggttctttattcagatgttctcttgtcatttcttcagcattcaataaatatcattaacctaccaagaaagaatagtgacttttgcaattgcattactaatgagatatcgtgagtctcatcctttattcctttgtggctttgtctggactctggactaccactagatattatgttgttaaagttggtaacttcgttgtgtgcgttgtttcaaggtgttctgtaacttaaacttgtattgtatggtaactggcactgggaaagggataatattagagcctgtataatgttatagttctctctcgtacttgttagttggctagttgcccttccaatccttgcatggcagttcatgtatttgtaggtgtcatgtcaggcattcacattatatatgcatcacatggttctgatgcatggattgtactaagaatgacaaaacgaggcatttgatccctttgcttcaattattctccagaattttatctgctgtttcaagtgaatttcctgcaaaaatttctcagtttgtactcccattgttaaataaatgttcttaaccttgtatttgcagg

SEQ ID NO: 36795 - DNA, 1113 bp, Oryza sativa
  unsure (1)..(1113): unsure at all n locations
ttaccaacaacgcagcaatgtgagttcgattagtgccttcgttgtgtttatgggaaggcctgcgtgaatgggttcctgtgttcgcgatttgaatcgtcgtttgtggtggggttcagtgctgttctatttgagtagtagaggagcagaggcattcggttttttccctgtggatttgtgatgcttttgttgttgttgttgttgtcgagtcatttggtggtggctattaacctgtgcgtacatctagatctgtttgttgctagcagtcacgttgaattagtggcaaattatagattagcttgtgaggagatctcctgagtatttgacatagacaattagttaactgcagtagtgtatacaagcatttgcaattcaagttagcaacacactctaattnnnnnnnnnnnnnnnnnnnncaacggatggcagtactcctgttctctgttcttgctatacttagtgttctctgttctttcagattgaagttaattcaatcttctctttatggtgtaatttgatagctaattataacatgctgtttcctctgatggatcttgagggataatctgcaggtttcctgtgatgtgtttcaggtgtttggcaaaaagaaggtcgagcccatggtcaaggatgcagcagctccagggaagggcgggaggtgactccggtggcagtcgaatctcagtgaagggggctcgcatctgatcataaccaacttgagacaagtgtaaatcctcttaggtattcgatggtggaatttttggagctgtgagatcttatcgatcagtgagtagttctttgctgcgtcatcttgtttgtaattctaggccgtcgtagtttggacacggttggctgagtagtagctactgatgtttctacctgaaaaataaatgtgaacctttaaatctgtttggtagtagcatctatgatttgataactgaagtgcagtcagttaattttgtgccgctgctactctgcatttctgctatatacttactactatatgcgttcttgtgtttgcacctattctaacaatgttgatgtcttcttcagactcatactaatcaacttccctttgacttttctttttcaggcttaagatggaatctagcaatg

SEQ ID NO: 36796 - DNA, 778 bp, Oryza sativa
ttgaccggcgcggctcgggcacgcgcgtggctccgcgggcccgagcggctgcgcggctgcaggcgcggtaggtcagcgggcccggcgggcgtgaacggcgtggcacgggcggcaaccacgcgggcgcgcgcgcgaacgacgcgcggggagcggcagcgagggagcggaggggagggctcggctcggcgcgggcggctcacgcgcacgcgcgcgcggcgcgcgggcggagcggagggggagaggtagagagagagagagagagagcgccgggaaaaaaaggggagatgggccgagagagattcggcccatcgaacccgggggaggcaaaatagccttttgcggagggatttgatttgagagatttggattctggattgaactcgacgatagatcggggatttgagatctgagatggctcggtcactcgacaacaagcaaggaaacaaatttcgcaactagggtttttaagagataattttcccgctaggcgccacgacggaacgggcgctacatcagggaaaagaatgacatgtcggtttaacaaggaggctacggttttatttgtgaaggctgccattttggcaaaatgatttatttcacaaaactcctagtgagtgagtcaagttttagttgtcgggaggaggctcacgcctcgacccattccacaagttgctttgcaacaacttgtcacaattaacgaacaacaattaaattgttttctctattagttcctttttcacaacaacacagttcacacaaatctcctggttatcccagc

SEQ ID NO: 36797 - DNA, 1501 bp, Oryza sativa
aactacaattctcgatctggtgcaaatgacttttgaattgtcataagcacatcacaaaatactgtactacgttaattctatagatggctagtactctttagtaaaaaaaaaatgttttgaacatcgaaattatcttcaggttgcaactttgaatgttattttttaaaatagtaaaaaaaatccaacaaacttataatcctatacatatcaaggtagtttttgaggtaatatatcacgcatacaattttatactcccttcatctaacaatatactcccaacatttctcaatagaaggcataattgttcctgatgcaaagaccaactaaacaagtaaatatttctaggttatttatcatggattaaggatatttaaggtcgaggagaaaaaaaatagtgctcatttaggatgaatggggggtttgagaataattggggcaaaaagggaagaaattttagtaattaagaagtggttgatgcgagaaatactagtgtagtaatttatatattattggataatatttaaatgcttcaattgcttatatttttggacagacaatgtacatctaatctaaaaattttaaataatggtgtttttaaaagctttgcatatgaaacacatctaaaatggcatgttttaaaataactaatagtatgacatcaaattgttaccatgacttatttaatggtactacccgctcacacatgtatataataacaattaatgatgtaccataaaagactttaaaatagacagatcgaaagtcttaaaaattgcattgacatacggatgcaattcaagcatggaagaatacaagtaggacaggccgttgggaacttgagaagcatcttactgtatttattcactatagcaattaatttagtatccttatttagcaatttgtatacccgtgtctttcttttaagaagtagcacgttgaatagtggtctaaccaaacctattattacatatttacatccactctcaatttttaaatttttcaagaataatttcccccagtcatgtgccaatgttcagtttacagctgcgattagggttttacagatcaatacctttaattttttcccctttctttttggaaacaggtattcccatattggcaaacggattcaacaaaaaccagggccaagtaaaagcaaacctccaggctgaaatcatcagcttattccccgaagaactagagctaagcaccacagatttgccatggctcgtcggcgacgcggcgacccagaaatcaagattcgccttctggctccggacaatggagcgcgtgaagaccctccgctgcatcctcgtcaactccttccccggcgaggccatcgccgccggcgccgaccagcaacagccattgccgcaggaccagcaaatcctccaagttggaccattgctagccaccatcgtcactgatcgagcaaaaggcaacagcaacttgcggtgttcgccaatgaagacgacgaagaacgacaccagcacgtgtcagg

SEQ ID NO: 36798 - DNA, 181 bp, Oryza sativa
tggttgccgccaccgccagcccccatccctcagccgccgctcgccgaagagtatgagagagagggaggatgaggagagcatggttttatgtgggccccacatgtcaatgggtcccacccatacttttggtggatgacaaataggtcccacacatattttttatttctaatgccacctaagc

SEQ ID NO: 36799 - DNA, 1501 bp, Oryza sativa
tcgaaaccgggttgatgggtgcatcatgaatgctaatcaccactgccaccgtgctatgaccacatcttgaataaaaacgttattatgtttctatgtacaagaaaatatccattagcttcctgttaaacatatgtaaattatataggattacatataatattaactatatattaatttaaaaatattacatgaaaatatatttagctctatctttctcatccaaattatcttaataattttttaaataattaatagtagccactgtattcatttacgaaccttcaccactcatattttcttaacattaactatatttttattaaacagataccacatgaaaccaaaatttacattcttccatgtcattctcgtccaaatagtgttacaattagtaaaaaaaataaatttaacaatatatattattccatcatatattatccaacaaatattcataactaataagaagagaaatatcactcatgtattagcacatgcatgtatgaaggattactgctcgagctttttttcgtgtggttctcagtttctcaccacttaagtattagaccttttaagaggtagatgtaatcaatacaaacaatgtgattggataaagtgccaaaatttatctgaattaaatgttgtagcttaaagctaatagttagattgaaaaaattatccaagcaataccgatgaagaaaatttgtgaaaagatattacttttgaagtgtggcaattatcattcgattgatattctggccttataaattcttcaaatacatataatcatacatgcccgcgcgaatgcgcgggctaccttcctagttttcttaagaaatacataaataatttagtttaaagttacagaaaatagttgaaagtttcaaatcatgagttgaaagtttttaaactttttactaagatttggaaaactttcagctcagatttgaaaacattcctatcaagatttaaaacttttaattcagatttaaaaattttcaactcaataatttttttagaaaaaaactttcaacttagattttaaaacttttaattctgatttaaaaactctcaactcaagatttaaaacatctaactcatattaaaaaacattcatctcaaaattttaaaaatttaaattaaatttaaaaatttcaaactcaaaatttaaaagtttgactaaaattttaaaagctgagcttatggtcaaattgtccagctgacattctgtcaatctttttttcatttttgtttttcaagatagaatggaacatatcgaccccaaagtagaaaccacaccgccttctcctcaccccacccaattcgttttccagcgcattacgatctcagcgtcgcattcgtcgtcttctacctccatcacttgctagttcctactagcaaataattaattaatttttaattattataaatttttaaagtgaattatttaatatttttaagtaattttaatatagaaagttttagcatgaaatatacggtttaa

SEQ ID NO: 36800 - DNA, 1501 bp, Oryza sativa
cttcagtgtgatcagtagatgcttcttcttgcaaagttgttctaactttccataattcattgaagtacacatttgctgttgggcaaacaggaccagagattacttcaatagcacgataaaaagccctcagaatcttgcagatagactcaacgaccttatagtcttctgcaggtaacaactcttcagatggaaatgccttcttgcaatgcagaacaacttcaagcctgaagtaaattttgtgccaccattttgcgtcttcctggggacacttcaaacccatgtttgtaacagcttcaaaaagttgctgttgagttaacgatgagtacgcatgtgccagcataaatctttctagtatattatcaacaaggtgaagcattgattgcccttttgaaacaatgttgttaagcacgtcatccacacaggcaatattgtatagctcacctctaataggaagactatttttttgtatgagcatgtccttaagctttgtggtaccttcatggtttctaatttcactgacggatatcaagctaaaaagcttattatcaagattccaatcacttatagcttctgctatgacattatatggcccactttcagagtctaatacacaagcctccttataaagtatcattctttccaaatcagtaggcaacgaccaaaacacaccaaacttgattattttcctttgaagcctccattctgcatcaataaagtgcgctgtcaaacagatgtacttcacagtgggctcagctccatgaggagcccaaatgcttgctgataaggaaatccgtcgggatgaaagtgcagcaattttctccttaaggtcagccttttctttctgatataaaagagttgaatactcttccacatcaatgcttgatgccatgttaaacaacgggttgaggctttttgcaaatcttttcatttcttcatgttccacgattgacaagggatatccatgcaaaactatcattctaattagctcttgataagatgtttcctgatcaaatttactggtgcttacatctggagcagcatgagtagatgaggtattttgttctttggtcatgttgtctcgtgctggcaaagctagaatgtgctggctctggggagttttgtcaactgagctattaaccttgagaagtttgctagcatactctgcaatctgaactttaccgtttgtcaaggcaggtgaaagctcatcctgaaccccagatttaaaacttggtgcactggagggagaaaacggactcttatgatttattccagtttctcctcgtgccggacaagtctgagtatgccggttcaaatggcttctacctttatctgcactaagtcgcttgtggcaatggagacattcagcaccctggattctcccctcaacatatacaggcgtaaactcctcccacacctttgatctgaacctgctgttgtcactgtgacttgccaattttatatcatcaagtgaatctggatgaatttgatccaccggattaat

SEQ ID NO: 36801 - DNA, 1501 bp, Oryza sativa
ccatttcaacatcacgagcttcattgtttgacgtgtgaacacctttatccacagggccgcaatattcatgaaacagctccctgattatttcacgtacagcagctacatactttgctgcttcagcaccgaaagctcgtttaagacggaactcaataaaagtaattttgaatctgggatcaagaactataggtattgacagccataggtatgaattttcccaatattcatggaatgcttcctgcatctccctcaccatgctagcaacttcagtgtgatcagtagatgcttcttcttgcaaagttgttctaactttccataattcattgaagtacacatttgctgttgggcaaacaggaccagagattacttcaatagcacgataaaaagccctcagaatcttgcagatagactcaacgaccttatagtcttctgcaggtaacaactcttcagatggaaatgccttcttgcaatgcagaacaacttcaagcctgaagtaaattttgtgccaccattttgcgtcttcctggggacacttcaaacccatgtttgtaacagcttcaaaaagttgctgttgagttaacgatgagtacgcatgtgccagcataaatctttctagtatattatcaacaaggtgaagcattgattgcccttttgaaacaatgttgttaagcacgtcatccacacaggcaatattgtatagctcacctctaataggaagactatttttttgtatgagcatgtccttaagctttgtggtaccttcatggtttctaatttcactgacggatatcaagctaaaaagcttattatcaagattccaatcacttatagcttctgctatgacattatatggcccactttcagagtctaatacacaagcctccttataaagtatcattctttccaaatcagtaggcaacgaccaaaacacaccaaacttgattattttcctttgaagcctccattctgcatcaataaagtgcgctgtcaaacagatgtacttcacagtgggctcagctccatgaggagcccaaatgcttgctgataaggaaatccgtcgggatgaaagtgcagcaattttctccttaaggtcagccttttctttctgatataaaagagttgaatactcttccacatcaatgcttgatgccatgttaaacaacgggttgaggctttttgcaaatcttttcatttcttcatgttccacgattgacaagggatatccatgcaaaactatcattctaattagctcttgataagatgtttcctgatcaaatttactggtgcttacatctggagcagcatgagtagatgaggtattttgttctttggtcatgttgtctcgtgctggcaaagctagaatgtgctggctctggggagttttgtcaactgagctattaaccttgagaagtttgctagcatactctgcaatctgaactttaccgtttgtcaaggcaggtgaaagctcatcctgaaccccagatttaaaacttggtgcact

SEQ ID NO: 36802 - DNA, 1501 bp, Oryza sativa
caatattgtatagctcacctctaataggaagactatttttttgtatgagcatgtccttaagctttgtggtaccttcatggtttctaatttcactgacggatatcaagctaaaaagcttattatcaagattccaatcacttatagcttctgctatgacattatatggcccactttcagagtctaatacacaagcctccttataaagtatcattctttccaaatcagtaggcaacgaccaaaacacaccaaacttgattattttcctttgaagcctccattctgcatcaataaagtgcgctgtcaaacagatgtacttcacagtgggctcagctccatgaggagcccaaatgcttgctgataaggaaatccgtcgggatgaaagtgcagcaattttctccttaaggtcagccttttctttctgatataaaagagttgaatactcttccacatcaatgcttgatgccatgttaaacaacgggttgaggctttttgcaaatcttttcatttcttcatgttccacgattgacaagggatatccatgcaaaactatcattctaattagctcttgataagatgtttcctgatcaaatttactggtgcttacatctggagcagcatgagtagatgaggtattttgttctttggtcatgttgtctcgtgctggcaaagctagaatgtgctggctctggggagttttgtcaactgagctattaaccttgagaagtttgctagcatactctgcaatctgaactttaccgtttgtcaaggcaggtgaaagctcatcctgaaccccagatttaaaacttggtgcactggagggagaaaacggactcttatgatttattccagtttctcctcgtgccggacaagtctgagtatgccggttcaaatggcttctacctttatctgcactaagtcgcttgtggcaatggagacattcagcaccctggattctcccctcaacatatacaggcgtaaactcctcccacacctttgatctgaacctgctgttgtcactgtgacttgccaattttatatcatcaagtgaatctggatgaatttgatccaccggattaatatcattcatcactattatgtataaagcatggatagtttagtcagaatacacataaagatgaaagatatgcaacttggccgaaaaaaaaaaaaacaaaaggatgcttccaccataattacagccacagacagataaaataatatacagcagagaagtttaaaaattcccatggcattgacagaagaagaaaaatactagaaattcccacagggggaacatctaatcctaaaataaaccaagtaacttgcagcttttcaaccaccttggtagcagccattctactcttgctaaactaaatgggcaatcgtatcactcatcttgccagaaaaagagttattctatgagcaatgcagaccagcagggtgacggagatgaaaaaaatttaaggttttgaggtaaattagtaaattatttgtaacttat

SEQ ID NO: 36803 - DNA, 1501 bp, Oryza sativa
cttgataagatgtttcctgatcaaatttactggtgcttacatctggagcagcatgagtagatgaggtattttgttctttggtcatgttgtctcgtgctggcaaagctagaatgtgctggctctggggagttttgtcaactgagctattaaccttgagaagtttgctagcatactctgcaatctgaactttaccgtttgtcaaggcaggtgaaagctcatcctgaaccccagatttaaaacttggtgcactggagggagaaaacggactcttatgatttattccagtttctcctcgtgccggacaagtctgagtatgccggttcaaatggcttctacctttatctgcactaagtcgcttgtggcaatggagacattcagcaccctggattctcccctcaacatatacaggcgtaaactcctcccacacctttgatctgaacctgctgttgtcactgtgacttgccaattttatatcatcaagtgaatctggatgaatttgatccaccggattaatatcattcatcactattatgtataaagcatggatagtttagtcagaatacacataaagatgaaagatatgcaacttggccgaaaaaaaaaaaaacaaaaggatgcttccaccataattacagccacagacagataaaataatatacagcagagaagtttaaaaattcccatggcattgacagaagaagaaaaatactagaaattcccacagggggaacatctaatcctaaaataaaccaagtaacttgcagcttttcaaccaccttggtagcagccattctactcttgctaaactaaatgggcaatcgtatcactcatcttgccagaaaaagagttattctatgagcaatgcagaccagcagggtgacggagatgaaaaaaatttaaggttttgaggtaaattagtaaattatttgtaacttatagcttactctgatgctcttagtattgtgacggtatagtttagatttaaaatttttaacacactattttttgcaaacaatgctcctggccagggttgctggtaaccaccagttaccagcagtttccagtaaggacctgaaccctgattaacatatctatataattccttatgtgatcttcttaatcatggaaaatcatcagctaaagcctagcccattctgtcagctcctctgataggggatcaaaatattaataaaatattgtcattgttttaagaaataacaaaatatataccacctaagtgggaatgccctataattcctatcattgatttaaccaacaagctaatatacagcacctaaaaggcaatgccctcaactattgtcattgttaaaatgtccctaatcattatcatcattgcctaaagtaggttaaagtttgaatgctttatacaagggtaccataataagttgatgatcatccaaaactctctcaacgactataaaacagtacaaaatttacacactgtcaaatcaactaatacaccgatgcagatgccaattaa

SEQ ID NO: 36804 - DNA, 1501 bp, Oryza sativa
aactgtaagaatgaattacaatcatttgagactaggtatacaaaccattgtcactgtctgtgatgaccttcttgttgtcagtaccaaaagaacttcggctcggaaaccttgacgatgaaggctccccaattccattggcaacattttttcccatcctattttcagccaatctttgtgaatttccattggtaaaagatggtgggaatttgcgtgtctcacttgcaaccactggatgcatagcatttgttgtgcggccatttgaaaaggatgagggaagaatcctcttgccattatcattttcttccgatgcaaaaccattgtgcttcttgactacaatatcagttctgttggaagcaggagttgcccttgcagaatcatttggtgaccccctataagaacttgaatgcggataagctctgtcacctgaacctaacgcatgacgagcgttatcaacatgtctaccatttgtaaaagaaggtggcagagttctatattgaccatttatattttcagtaggcctagaagaagatgaagctagctcctggtccaaaccaccaactgaatcatctgagtcgaagtcaaaatctatatcactgtctgaactcaagtcaatatagttatcgttgttcatattgccagcaagcatgcgcacagcatctgtatagtcagaactccaattgtgcttagcagtacaaactgtgcataaacatgatcagatcacaatgtgccaactactagtttgaccccaaatatttccaaagcaaacccacttcctggtttatgcagatgattgggaagccaaacacacaaagcaaaccacagaggtcacaacagtagacggagttattagctatgctgacttaacctgcaaggtggatcaaataatggtgtagatgagtaaatattgaactgtgagaaaacactaaagaaaaaaaaaacagcaacgctaaacattttttaggaatttatttgcccttctcaaagtcgttatcaagcattatccatgaggggaaaaaaatactagcataggtaccaagtcatttcttccctaaaaattagtcatattaattaggaatggaagttagtaaccgcacagttcatacgaaagcagtattcacatggtacactcccgaccagttcaaatctaggaagcaatcacacatggataaactaaagcctaatctgatccagacagagagctacaccctacgaactggattgaattaatcaggtcatttcaaaaaaagaaaaacagaaatgcgcaacgggaccaaatctcgccgcgggacacccctaatcgacgggatcaaccaatctcccatcccaaccacacaccccaaacctcgctaacctcccagctatcccccataacccgatccaacaccgccaaaaattacacgcgaggaaaaaaaaaactcccacaccttcccccacacggcacgcccaaacaaacatcggggcctcaaacctcaaacccccccgaccaaccaaccaaccaacc

SEQ ID NO: 36805 - DNA, 1501 bp, Oryza sativa
aagaaggtgttcattttcttttcttttatttaagatgcaaaaggtgttcatggctgcccctctttaggttttgctattataccatctttaaaatgagttttgaaaaaaatatcaatctcaagcccgcgccggattttgtcattttctcattttcactaatttccgaaatctttttgtctctttttttggtgatcatacgaaatgtttttcgctcttcttcgacgagatgagtgctgccagcgtaaccgcctcgcctcacctcgttccatcttccaccaaacaccctcctcgccaagccctcctctccgccgcaccggagccctcccatcctcgtcgctgccggccaccacagccagtccagtccgcctgtgcgatgccgtcgacctagcctggtgtcagacggcatccgctacacggcaaacggtgatgacggtcgcatccgctggtaggggatgatctttgagggcgcttgtccaagtgctcaggccacggggggagcaagagggggtttgggttcctgatcgcatacggacctatgctagacatggagttgtagatggccataaggccaaggcccaacggcccaacccaagcacggcacggcccgatagttcggccatgcctgagccgagcccttggcacaatgggccggcccgacacgacacgatcaaagaaaatagtagagggatccaaatagacttaatcaactatagttggcaaggcccaaagagaagaggaatacaaaatagacttatttctagccatataagacatagcccaaagagttgaggaacgaaaaatagatttattctatggagaagcacgatgggctgttgtgcctttgggctgtcccggcacggccgcacggtccgagtcttattaggtcgtgcctaggccgtgtgtgtagtccatgggctggcacggcacggcccgacgtgtaggtcgggccaagccggcccgactgacctcagcctaggcatggtcgtgccaggctgggcgacccatttggccatctatacatggagtgcgtgcgccgacagcgcgctctccccgtcctgcagcacggctacgtcccccacgagctgtccagtgagccgctgccgctgggcatctacatgtcgaaggcaccatcgcctcgcacggtcagattcagagttgtcctcctgatgcaggggcccgccgtcgccgccgacacctagtgggaggtttcgcatctcgaggaggccgccactggttcaggtggatggccagctcaacccgaccaccctggcgccatgtacattggttcatcagtgactctatgcgtgacattccacatacttcatcaaattaggcaatttttgctacaggatatccaaattttgtgtaatttatttatatactaaaaacgtgtcacgacttaaaatatatctaaaaaactgataaaatatgctagaaaacactttcaactcaatcgtaaagataaatcccccctaggacaacatgcttcaaacgtggtgtt

SEQ ID NO: 36806 - DNA, 437 bp, Oryza sativa
acgaagggaagttagcggcggtggaggtcggactcctccgggaagcagtccacggagggttttgctggccgctgccgacgttgagctcgacgccatggctgcggcctttcgagccttcgaggaatagtagatttgggcccaataattgagtgatttggcccagtccaggaactagtaagtactctgcagagtacgcagaaaaatagtctccacgttggtgaactcgttgcttgatgggaacgcatgcaaaggctctgatcgacgctgatctcaaatatttcgaccaccattgcccgtattcctcggtgtccatctttgacatctgctgcaccctaattggtatctactcctcatctaatcgaatcgcaactcgtcatgtataaattaactccacacctcctcctttatcttcaaatctcaagattactctgccaaaa

SEQ ID NO: 36807 - DNA, 263 bp, Oryza sativa
ccggagtgatcaaaccttcccaatccgccgcgtcggtttgtgtagtccgtcagcagtgaggtattcatacgaaggtgatggattttgaagattccgtcttcgaatctgaaaatcacatgattggctgcacaaagtttcggttttaaagctgtcaaagttttcatttcgatgactatatgtgatgaaactgtatttactgtgtctcccagagaccagtaaatgataatgttactctatgtgatgaaactgtatttgctgacagt

SEQ ID NO: 36808 - DNA, 239 bp, Oryza sativa
attcaaatacatacaagtgtatattaattagatctctcgttgtttgtcatttatttgtagtgcgcaaagcaaaagcagggaactaacttgtgcggctattacatgtgcgagtattgccactgccttgcaaaccaaatcatcaccacaagagagctcgatgtacgtacaaataaattcaaaatttcattacgtagcgatttcttgtttaattactaatcaatttcatacattcatatagt

SEQ ID NO: 36809 - DNA, 537 bp, Oryza sativa
atgcacgtgcagcatgcagttgtgacatgcttgatctgaagtttctgaacttctatctgaaccggccagattttattttagaaaatagattaaaacggggcctctacatataaaacagatgtacacagccaatctaaactaagggtgtgttcgctaacagcagatgggaactttgcacagtgcacacggaaaacggagcagctcattagcacgtaattaattaagtatttgctattttttaaaaaaattagattaatatgtttttttaaataattttcgtatagaaactttttttaaaaaaacataccgtttagcagtttgaaaagcgtgcgtgcgaaaaacgagggagaggggatgggaactttagcatccgaacacaccataaatgaggtgcgagatgccaaaagcgcaagcatatctctccattattcagagttgcagatgaggatgaggtcatgaggaggagaggatcctgaattcctgattcctccagccttggagattgatgcacgagggaggccaccatcgccatcgcta

SEQ ID NO: 36810 - DNA, 258 bp, Oryza sativa
tcctgcagcccgtaatggcaccgtaaacattttcgagtgctatgacactaggcttcctgccctcaaaattcaattggcccatgaggttgatgaacggccaaaacgtcccacttcgctcgccatccagtcctgcaccatttccggcaagggataagtcctgacagggaaacgaagcccacgctaagtcggcatgccccggaagctgggatgaaagtagcgtggcgacatcctgacccacgagattttttttcccccagt

SEQ ID NO: 36811 - DNA, 1501 bp, Oryza sativa
cgcttgggtaaggcgttctcgcagcaaaatccttcgtgaggtctatctactgggcttgagtttgaggtctacatcgtaggtagggtcttctaaaaaccacatgaaccttcactcttctgtctgaggagggcaaatataggtataaagcctgggcgagtgtctttgtccagcgcgagaaagctcggaattgaatgctttgaatgcgcaaaatgaatgctttggaacagttggtactttcagatcggaagatgctctttgactttcgcctctattgttcatacttatttatgtgctgccagtcgtactcctgttaaaaatccaatttttgatacaagataagaaacgcttcgtgcctcgcatttgacgggcggagttcaatggatgctatttctcctgagcttaatctcggaagtgagttagcgaataataaattatttccattcttccagatcattctttcttttcccacgactccgtgttggttttgcagtagaatgagctgcagactcccagtgttatttcaaccttaagttccatcgacttaagcgtaagcgccccacctctcttttgagagtgcgagagatttccgcggcctgtaaacacatggtttttccagccgtgaccctaatttacttactgattttaaaacctacctccggccgcccattggttaggatcgccctttggttggtggaagcgagaatcatcttttgatttttttaagtttcccgaaaaaactgaaaaagcttatattatatatagtatctggcatgcctaaaagagatagctggcttaaaacacgacagaagtaggacgcactgaggccgagctttactgcttgagtaattgtctttccagtagagctttcccttgttaagtagagaattactgtccttcactcatattttgagaaacagtacgcagcacgtatggaaaagtcagcctaggcagtcaaccttttcttgacttcacgagtttcaaacctgtctgttagaggggagccaacactctctaactacctatactacgcccctattgattggaaaccctcggggatcccataaacaaaggaattatacagtacgaaatagcaaaaaacagactaattcgattctaaaaaatagataatagatatgggctttctgctcaaattgtctccttttccttctgcttggacaaggagagatattcaatatttgaatcagattggatttcattccactttcctatttctcaacaacaacttctctcatcagctatttcgcgttttcaaagtcattaattgtcccattaccctattttctatttcgattgtatggcgtagcgtacgttatgcaaacagaattctagggttattatggaataagaagaattcttccattctttttctcgagggagaaaaaccaaactaaaacttttcgagttagcggaattcctagtaaaaataaatccaggattcttccacttagatgaaatagcttagatgaaatagtaagtaata

SEQ ID NO: 36812 - DNA, 1501 bp, Oryza sativa
  unsure (1)..(1501): unsure at all n locations
agttgtagtcaaacccgacctgttgacccttttgctttttcagcaatatgtacatatctaagtaattgtcgttctgtcagaccatcatgaaaacgaaatttccgtttttcttctagacgaatacgatattgcgatcttttccagaacgcaattggtttttaaagatacttcaggatctaggtcttttactagttagtccggtanaagctcccaaacggcgtattttttcgaaacgaggtcctcggtaacgagacataaagactccttttttttcttttttttcattttcacacaaaatccaaattaaaactgggataaacaaagcaaaatcaactgaagtactaaaaaaaatgaattgtatcaacatctggattatataaatatataaataaattatgaatgattatgaaataataaattaggataaaattcagaattattgtgaatccattccaatcgaaggtgaaagaagaatcgaatattgagtaatcaaatcattcattctttagatcttttgaaaaacggattaatcggacgagaataaagagagagtcccattctacatgtcaataccgacaacaatgaaatttatagtaagaggaaaatccgtcgactttataaattgtgagggttcaagtcaagtccctctatccccaataaaaagcccattttacttcctaactattgtaccaacctctatttttcattaatggttcaaacaagattcactatctttctttttctactctttcacaaacggatccgaactgacttctttggattttatcccattcatacaaatgaacatattatagtataggcaagtaatccctattattaagtaagtaattcacaatccatatatcctgacatttactaagtccaattttagaatactttttgattttttagtccctttaattgacatagatacaagtactctactaggatgatgcacaataaatggtcannnnnnnnnnnnnnnnnnnnnnnnnnnnnnnnnnnnnnnnnnnnaccagttcaaatctggttcctggcacagaaaaaaggatctaccgaataggtattgatacaaattactcgagatggattgggatacatattcgttaaaaatatagctagagtatgatttattcatctaagtagagaaatctctaaatagagacacttctttttagagaagggtaaaaatctctggtccttttctttatggtacaaaaggaggtgagattaggttcccttttcttcatttttgcatttcttattccgctattccgaatatttttttttctttcttatcttatcttactttcctagttgttccaagtaatgcgcgcggtacaaagttcgtggtagggaacttctttgagtcatcgtatttttctgtttatatgaaggaaatgaatatgtgattttccaaattggagaatcgaaatgaagcccttttttgctcagtctatctggacccttttgtataataggaattaattccaatataata

SEQ ID NO: 36813 - DNA, 1501 bp, Oryza sativa
  unsure (1)..(1501): unsure at all n locations
ttcaagtcaagtccctctatccccaataaaaagcccattttacttcctaactattgtaccaacctctatttttcattaatggttcaaacaagattcactatctttctttttctactctttcacaaacggatccgaactgacttctttggattttatcccattcatacaaatgaacatattatagtataggcaagtaatccctattattaagtaagtaattcacaatccatatatcctgacatttactaagtccaattttagaatactttttgattttttagtccctttaattgacatagatacaagtactctactaggatgatgcacaataaatggtcannnnnnnnnnnnnnnnnnnnnnnnnnnnnnnnnnnnnnnnnnnnaccagttcaaatctggttcctggcacagaaaaaaggatctaccgaataggtattgatacaaattactcgagatggattgggatacatattcgttaaaaatatagctagagtatgatttattcatctaagtagagaaatctctaaatagagacacttctttttagagaagggtaaaaatctctggtccttttctttatggtacaaaaggaggtgagattaggttcccttttcttcatttttgcatttcttattccgctattccgaatatttttttttctttcttatcttatcttactttcctagttgttccaagtaatgcgcgcggtacaaagttcgtggtagggaacttctttgagtcatcgtatttttctgtttatatgaaggaaatgaatatgtgattttccaaattggagaatcgaaatgaagcccttttttgctcagtctatctggacccttttgtataataggaattaattccaatataataggtattctgtttctagacgaaacagaacgtcaaaatattccttgacttgaataaaatcaggagttgtgttgtataagtgagcatgaatttcttatcattcaatgagcatcttgtatttcatagaaattgggggttatatagtccttacgtaagggccagcctatccaactttcaggcattaggatacgtttaaggcgtggatgattatcataagagattcccaccatatcataagattcgcgttctttcttgaaaatcggcacttctccaaatccagaagacagatgggattctaggattatccttttgggcaaagacttttatgcatacttcttctgggttatctataccatactgtattctcgtaagatgatacacgctagctaaagatccaccgggtgcgacgtcataagcacattgggaacgtaaataattgtaaccatatacatataaaatgacagcaatggaatcccaatcctctgcttttatttgtaaagtctctattcctcgatgatcgaagcccaaagatctatgaaccacctcatgtttgactagccaattagataaccaaccctgctgcattatcttgatctctcctcctttgtataaatatttcgcagttcgaatgcaa

SEQ ID NO: 36814 - DNA, 1501 bp, Oryza sativa
cgagaaagccgtctagcacctgtagctggcttgcttcacgtcccgctgtttgcttacgagtttggtagcgagccgaggcagacgtttgtagatcttgcctcgaagcctcttcacagttgatagcatcacctgcgaggtatcagccttgcccctcatcattctttgagaatcataaggacccattccggtagtgcgaaaatctgctgcactgtcttcactgccaagctctagtaatagaaaatcaaatcaactatctaatcgagcatcaatcctaggaattttctcctcacggagagagatcagaaagcttggcaccggattccgaagtaccagtaccgaagaaagcaaaagctttcgagcgagcagcgactccaatgtttggtaaagggaatgaccctagatactcagtggctggaaaaacacatccatttgctcgatttaacgaaaaagcgcacaagtcacgctcgcctgttagaagtgattttaggaggaagttggattggtattttctactggatttgtgcctatagaccaaggataaagtctctctcgcatagccggaaaagtaagtacatagtgtagagggaaagaaatagaatctcgtgtcgacttggaaatcaatagtaaatcacaggcagtatgccctattttaaaacatgcaatgagggtacgagcaacactccccaaacttggcatgactcatcgccatcttgtattcatgatcttacctcgccttggtcacaaatgcatagcataggatcgagtggatcggcacccaataggccagattttcctatctttgatggtggaagaagaattgcgataaatattttcttatgttccacactccttacactacttggaaagattactccaccatgtatttcacgggtcaagctaaaatgtggttacaatctgtagaaaataaggtagagagtatgaattgggatgagttctgtgactttgtgtgtcttaggtttggtaaaagatgcagtatcaggcactgatccggcgcttaactcatgtgaagcagactggatcggttcaggactacattgagaatttcaagaccctaatgcaccaaatgctagcacacaacctcaacattgatcctgaaatattcactactacttttgttttgtggatgggttaaaataagaaattaggagagtagtgcttattcaacgccctgccgacttggatactgctggctctcttgcattacgtgatagaaatgaaatgacagcagccctcgctgaataccgttcaatatccgttattagacaaatcaagactttgagtgtatcggtatcgataagttcccgtcccgatatccctgggttccttactattaatggacaagttggtaacattcaattgagaggacaagttggtagacgcatcccactctctttgggaaaagcaggattctagcttgctcccttaagtctaagaaaaaagacaagccctccgaaagtaaaatgagctgactagaccagta

SEQ ID NO: 36815 - DNA, 1501 bp, Oryza sativa
attcggaatttcaagagaaaagagtcttatgtgtattggatccgctcttctgttagcatgaacacatgaatgagattctattcctcttccaaaatagaacccccaacctaggtgcgggaagtcaaatcaatccttgtttgtacatcgctgaacttacatacccgggcccggctcaacattcttttaaaacaatcgaataacggcttttccatgacttggccattcaatcttgtgaactaatcgagaccgaaattggataaagagatacaaaaggagaggaatacccaatcgatgaaagaacatgaaacccttctgtttctatagaggtacgggaaacggttgggggcaataaagtaggtgaagtggttggattttgcgagctgttccaaccactgctggatgtgattccaagagccgaaccagaatgaataccacacagaagagtcaagaccgggctccctaatagaatgtttaaccgatccattccggatcgatcgaattggtacggaagttgtaacatgggaaaagcacagaaaacacgacttatttgaataacccggtgacctaccaattgtagaagtaggatttttggcaagcaataagcacttaaataatacaattcgagtgtaccagattctttatcatttcgagaaaaaggttcgggaggaaagggaaacaacagagggatccgaatcgaacctaaatgggaatgacatgaaaaatctttttcaaaacctatcattaagggcgtgacgacgatatacgagaggaataaaaaaaaactcgtgattggtgtggaggggaagatctgcttatgaaattgttcaagaaagagtcgtctcatttccttacttcttcgttctttcgaattcattcacttcgacggctggcgctacgctagctttgcatgattagctccggcagaacaggtactgcatttccttagttggatccgctctttctctctcgtgcagttgttgcttccggctatttattcagtcgtcaatcagcattgatccgggtagttagtcagtctctctcttttttcccgtccttctctatctatgaaattcctaattaagggctttccaatatctaaatgttcatgcaaagcaacaaacgaaatgcaagaactgtcacgcagaagtcacacagtatgctgatcgttctgaaatgagaaaaagtatgggattgaataagagattcatacatagagatctaaactcatggaagggcccggccagcaaacgagatctcttacatccaaacaagcaccggattgagcgcactagcgcgaaagcgttagcacgcgcatccgttttcttgctcgttgacgatcgaggaaaaagggatacaatacccattttagaaccgttcactactaacaaatagaaaatatcaaaataacaaataatatagttaattaatatagttaatggttccaatttgtcctaaatttttcagtctgtgactggaaaccctttctcttttcaatagaaag

SEQ ID NO: 36816 - DNA, 1501 bp, Oryza sativa
ttctcgagaatattttcgcccctcatctaataaatcttcatttataggtatgggatacttgttctttatggttgcggcatttagttccctataattaatgcacatgcgccatgaattgtccttcttttttacctaaagtgcaggagctgcaaaaggactatagctgggttgaattatcgaatttctcaacagttcttcacatatattctctatttctgatttttgggggtgtgaatatctgtaggggcgcaagttaatgggttcagtaccttcgggggatcgaatgatccaaacttctcttgggaggtagttgagttggttcttggaataaatccgtgtaagattgaagaagtgtttcaatttgaggacttactaggtcttgactacctatttcaaaggaatcacaccattgcagcattaaaactacctcctctgcctccaaatctcacgtcccgctgggagatgggacctccacggcctctcggctgttgtgtaccgccacctctcgccactactccctgtgtcatcggtttgatgctcggtcccaagcatgagttttgaatttggcttgggacaccccctagcgaaatgaccgagcccaccacaattgtaacaagtgccattcttcctgtagcaagttgactcatgatgtctcccttgacaatatcgacaccaaaccttctcgtaattcacaacgccagaatttggcttagctggatttgcggatggcggggaattcattgactgacttggccttgattgatgatccatcaactcgtggctttacattgagaacaaagctttgctgacccttgctaggctcatatgactccactcgtagcgcatgtgccatcagatccactagtctcactgtaccaggaaggtcgattatttgtgtcaatctgggatgaagcccttccagatattgccgtcgcaagcggaagtcatctgccacaatgtcgggagcatacctcatcaagttgtcgcatttcatattgtagtcctgaacagtaccactcccttgttttaggctaacgaattgctgtcgaagcgcttcccgagacatcacatctaaatactgatcattgaattctcgctcgaaccacgcccaaggaatggttggatttgaaccatcattatctccattatgtctcttctttgcctcctgccaccagaaaggagcatggaaacatgagaagcaaagaaagaatgaacatatgggcgttaagcattgtgaagagttttttattagttaaatagctgggaataaggcttacccttcgtaagtccaatatgcgagtaagaacatgtgcgggaataggcatatgtttggggatatggaggaaatagaacgatttcactaattgtttcgtctgggtcgtcaatgtttgatttttttacttttttctataaatgttttatgcttttttctattttctttggttatatataaagagctctcaatttttttcagaaacctaataagccatgcctgcaacta

SEQ ID NO: 36817 - DNA, 1501 bp, Oryza sativa
ctagcctacaccaatgtcttaagtttcctcataataatgacatcgttgttgttttggccgaaccggaaacggtggtaccaccataagtaggttctttcggtattgaccaacaagtccctctcattgagattaataccagcttggtgaaaccggaatttcctaatcaagaaaatctgcttgaaaatttgcacaaggaacaaggtttaggaaaaacaaaccaaggccggttagagctagtggtcttaaccaaaaacaaagggactgggttattaatcttccaaaataaatactagctagggtttccaattttgctcccaatgtatccataaatgagacatttgttcaaggccttccgggaatgtaattacgaataaatggtctatttcaaaatgatcttgaggggatcaatgtgatagatagggtactcgcaaacactccacctagccaaagtaatgcctcgtctacctctagaacaaacctaccatcaacaggcgacaatccgataggcaacagagagaaagtggaagaattgcttattttctaactaggggccttctacatgctattattatacctcgcatcccatgagcgacttggaccgaaccggggattttatgttcctacacggcccgagaatccaatgtttcgagagttgcaatccgacattacaagaattgggaccaacgaactaaggagaataaacaatgaaatcacaccggcaaatcggtatgatgaaaaaagtttccttataaaacacatcgagacctactgtaagcaatgtgcgcctatgaggtatgatgatttcactttcattctttttttccaagctacccttacaggcactgcactcaaatcaacaattaagggattcaaagggaaagagttttgaccaatcagctctattttttttatcaccttccctttcaatagaactgtaagtaaagtactcttgaaagcgggcaaatgcaagtagctcaaccttagagatgcgagttattgatctcctacatcgcctaactcccgaatatcactatctcaacccgccgaccactcatctagactattgttgagtttatgaaaaaaaatatagtaaaaacatgaaattgaaaggaaacacggcggacctgagactgaaagcccagcagctcagcatgcaaggcaacaatttggagatacaatggaccgacctgcaagcaagaagatggatatctggatcagcaacagagaaaaaaaccgagaggtggttgcaacaatcacaaaccataaaaaaaaatgcatatcccgtgtgtgctctagtttcgggttctcctagaccaccattatgaaccaaaaacaaccatacctagtgaagtgatgcagtcgacctggagaggaagatttatcttgttcagtagatagatgtataacgcaactgattatgctttaactacaggtgcatacggcctttcttttcttcttcaggttcagtaatatcgtagatagacatcttgctttacatctg

SEQ ID NO: 36818 - DNA, 188 bp, Oryza sativa
cgccagagttcgacttttcatccctgatgatacaggctaaccattcagtggccctgccacgaagtgcttgcatatcttcagtcatcaaggcgtcttgtacccttgtcccgccatgtagttgcgcggcggcgtaccatttgccaacttgcgctaggtcttcaatagcgacttggctcaccttggccctc

SEQ ID NO: 36819 - DNA, 654 bp, Oryza sativa
  unsure (1)..(654): unsure at all n locations
aaataggaagaacgtaaatcttccacctctggaaagcgcctacacctaatggcttaagccgctgttcccatttcctcgctgacccatcatgcgaaaggtacgccgttagagtgagtgcgcccgcgctccgctccttcgactgattgttcgcatcggatctcaggttctctattgcactccccgattnnnnnnnnnnnnnnnnnnnnnnnnnnnnnnnnnnnnnnnnnnnnnnnnnnnnnntaacttaagcttatagggtggtccccctttctcgcgtaaaagcgatcatcattcgaacacgccgcgttttactgggaaggatcgaaccatgggaacgaatgaacagggctatcaccttctttggccggatcttccaatctttttagaaaaccagttcactgcgcgccccaccccgtcatcagtcctgtgttgcctatgcttgcgccccaaaacggttgctgactttgtacaactccgtagggcgcactacggcaacacagcctacgcttgctgcttgctggtttttccatcatccaatccacaacaaatcgaatgaaaccgcttcggatttcttttgatgaaaacccttgttccgctctcgctcgttgctactaacggggtctcggttgattttccttccttaagcaactcaga

SEQ ID NO: 36820 - DNA, 562 bp, Oryza sativa
tatctgatccaagggaaggaagagaggtggaaagtgttgctgtgtcaaatcgagattgtgtgggtgttcagtctaccgctcatgttcgacgctatcgaaaatcatgcattggatggatgcccgggcattgagaaggaaggacgctttcagaggcgaaaggccatggggagagagagcgtctgtgatccatggatctccgatcgggaaaccgtatccaagctccgtggctagtctgcgctctttggacttttcaaacttagcgaactgaaacatctgagttgcttaaggaaggaaaatcaaccgagaccccgttagtagcaacgagcgagagcggaacaagggttttcatcaaaagaaatccgaagcggtttcattcgatttgttgtggattggatgatggaaaaaccagcaagcagcaagcgtaggctgtgttgccgtagtgcgccctacggagttgtacaaagtcagcaaccgttttggggcgcaagcataggcaacacaggactgatgacggggtggggcgcgcagtgaactggttttctaaaaagattggaagatccgg

SEQ ID NO: 36821 - DNA, 1501 bp, Oryza sativa
  unsure (1)..(1501): unsure at all n locations
ctttagtttccttcaaatgccggctgtatgctctgtatagtgttggttgtttttaaccaagcaactattcaatatcgggctaacttttctgacaactcttttttagaagctttcctcctgggctacttgctttctagcttattacctggcatgccctttgaaagataggtgaagcatacttattcttttcccccgggatatttctgtacactagctttcatgcgtaattataaatacttgctcgtcacatccaagctggctcgtcgctacatctctagttacataaagaaaaagattactcttttttatagaggaatccctaggtggaatttgtgatgtaattaatgctctctaactaactcaatttcaagtcatgcgccagtgatttgccgttataggccagggccagttggaaagtatgcattagatagctagggctactagggctaagaggaatagcttttgatcagttgcctgctaaaaggccttctttcattatcggaagttctttcttctcacctgatccgcacaatgccaccaaaggtaaggatcatcccatacagagtaatgggcttcaccgctgcgcgccttttcccttttagcctttgacaaacctgcaggtagctcattagtgaccaaataatggaaaatatccgcataccatggggggcctcagcggataacagttgctcataaaccaaaagtaagtgttctgcacaaccccttcaaaaggactctttgacttcgccgacttacatatttcgaatagccttgtccttcgtaagtgtagcgtggaaccttcggtccatagattctaccgacccgcctagcgatcaagctcttgcgtctttaggaaaactttcactctagctattctcggatcacctatgaagtgctatttttttcattgccgaccatccgccattcgcccctcgaggattaataaaagtactgatgctataagttaatcttcacatcaataggctatccctagtcgatttgataactgaaaaaggtagactctattttccggtgaggataaaggtattcaggcaaccgattctggcaggaaagtaggggagtctaatcacacaagtgtacaggtgaggacggacaaaaggcacatagccattctgctcctcccgggatcaaaagccgcagctcttagttcccattctggcatgaagacaatacggatgggctcactcactgactttcaaacaaaggaccgtggcaagtagtacgctggtcatcaaacattaaaacattttccattttcattttcctgctttaatgaactaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaataggaagaacgtaaatcttccacctctggaaagcgcctacacctaatggcttaagccgctgttcccatttcctcgctgacc

SEQ ID NO: 36822 - DNA, 1501 bp, Oryza sativa
  unsure (1)..(1501): unsure at all n locations
ccgtatgctcccatctttaataggattcccgctaaaagcatacatgtactgtaatgcgcttccccatgggtatctggtaaccacgtatgtaggggtataatcggcaattgtatggaacaaaaatccatcttggctagctattcgggaggacttctccatcggatcagaacatgaattgaagggcatacttagtagatgcagatctaggtactcattcttcctcagatggggaatgggccaagccgatccgttgttggcactgaaagtgcatttgctagtttgaaagaagctgaatccgggtgggattcaaaatgattcttatgtttcgtagcatgcagcgcagactcacttggtaaatagccttccctaaaagaggcaaggtgctcacacatgaaattccctttcttcgtgcactcatttactagatagtcaggaaccttcttttgacttgaccagcttacttgtatagtatagtagtaggcctttgcttctgaacgaccttacgaatggatcaactagaaatgaatcggtgtcataaacgaatttagctaaccgtagtagtaaattgcgtgacaccaagcaatcgatcaaagccaactcaaaagaaagcccatcccttcatccaacgtgaaaatattctcaagaagaagccaaaagaaagagaggtgaaacagagtagagagaatcgggtgcttccagtgattagttatcagaaagcactgttttccagatcggattcgatcacagtcccataagcagtagggaccacgagtgagcatgagcctatttcgtgatcggctagttgctcaaaaaatcgtataaaaatcaagcaagaaaacgtatgcgctttagcaacaaagcgctcatcccttgttctttcgcgctagttgctcaatccgttgcttgcttctcttctgtcttggaaaagtgaggatttcctatctgatccaagggaaggaagagaggtggaaagtgttgctgtgtcaaatcgagattgtgtgggtgttcagtctaccgctcatgttcgacgctatcgaaaatcatgcattggatggatgcccgggcattgagaaggaaggacgctttcagaggcgaaaggccatggggagagagagcgtctgtgatccatggatctccgatcgggaaaccgtatccaagctccgtggctagtctgcgctctttggacttttcaaacttagcnnnnnnnnnnnnnnnnnnnnnnnnnnnnnnnnnnnnnnnnnnnnnnnnnnnnnnnnnnnnnnnnnnngagcggaacaagggttttcatcaaaagaaatccgaagcggtttcattcgatttgttgtggattggatgatggaaaaaccagcaagcagcaagcgtaggctgtgttgccgtagtgcgccctacggagttgtacaaagtcagcaaccgttttggggcgcaagcataggcaacacaggactgatgacggggtggggcgcgcagtgaactggttttctaaaaagattggaagatccgg

SEQ ID NO: 36823 - DNA, 1501 bp, Oryza sativa
aggtttctctagacaccttggaaaagatcactgacgagctcaatctcaaagtgtgaatgaaattatcagtttcatcctctttatgagcctgagatcatatgggtcaacaattctcatttcttagttatagaaagcccttctcaaggaagtgagccactcaatctgagccagcggattctcattcagctgtgccggtgcgcaaagcaagcacgcttagacaacgatgtccaatctttggtctgcccattaagggctgactccgctaggcaagaggactactactgggattattctattactaattgatgacctgggctcttctttctccactacagatattgactgacctgttgatagtatagcgggggcagtaaagaggaaaggaggaaaaagaagtagagttaggttctgttcttgtgtgtaagccctcggtcgattcgtctgctcattcgcagcgtatgattcttatccaattgcttcttctgaaaacgcggcgtcggttaatctttcttattctcccttcggggctcctcatgttgctactaatagaaacagttcggaccttgctcatacaatcctcgggactactattggttaatctttgtcctccctagggaaagtaaacaagacgagactttttgggaaagacagggttagcgccctttggttggcggaagcgagaatcatcttttgattttttgaagttcaatttctatcagaggacaatatgaatattataccatgttccattaaaacactcaaggggttatacgatatatcgggtgtagaagtaggccaacacttctattgacaaataggaggtttccaaattcatgcccaagtactcatcacttcttgggtcgtaattactatcttgctaggttcagttatcatagctgttcgtaatccacaaaccatcccgaccgacggtcagaatttcttcgaatatgtccttgagttcattccactaaaatacctttgaatagcgctgaagatatcattgctataaattgaaagaatagagtgagatttgtatttgaactagctaaggcatacttcactgaactcctgctttccagtctgcgcttcgcttcctctcggtcgagtaagattcccttagctttgatttgcttccatctttctaaactctgttgtctcggaaaagaaagtatcatgttgctcctcggaaaacgcgtatagtagtctcattggccaaagtaaagtcgatgggacgctccagtgtatgcgttactgtactgggaagctagcattttattttgtcatggcgcaaaagcagatatggtccggtattcccttgttccccgtattggttatgttctttattcctcgtctagcagaaactaatcgagctccgtctgatctccctgttccgcatggcatgaaaaaaccaatcaaatcttcgtttccttggaaaaaccgaggccagttgagatcagtctccctttctaggagcagagcttaaaaagatgggaaattccaa

SEQ ID NO: 36824 - DNA, 1501 bp, Oryza sativa
cactatgacttcaattcgattgattcttaacaaattagtatttgcaatttgtgagggccgttctctctatataagaaatcattgattaagaagaatagttaattcttgggcaactgcgtagatttatggaatcataacatgctctaccataattttttgcagataatcccaattttggtttaatagtacatcccaataaaggacgaccgtatttgttcaacttatccctttcaacttggataccatgaggcggaccttggaaagtttttgaataagtagggggaattcgcagatcctccagacgtagagcgcgtagggctttgaaaccaaatacgttacccacaatggaagtaaacatgttagtaacagaaccctcttcaaataggtctaatggataagctacataagcgatatattgattatcctccccaacaacgggctcgatgtgatagcatcggcctttgtaacgatcaagactggtaagtccatcagtccaaacagttgtccatgtaccagtagaagattcggcagctactgcagcccctgcttcttcgggcggaacccccggctgaggagttactcggaatgctgccaagatatcagtgtccttggtttcgtactccggggtgtagtaagtcaatttataatccttaacaccagctttaaatccaacacttgctttagtttctgtttgtggtgacatacgtccctccctacaactcatgaattaagaattctcacaacgacagggtctactcgatatggattaggcgtaaatgaaacctttgcaaaaatcttaaaaaaaagatattcaattaatatcaactcattaaagaaaatggggggcatgcttaagttaatgaatatgtttcattcatataatatgtttcattcatatataatgggtacaccctgtgtacattctatgctataggaattctactataggaattcgataagaattgagttgttgttatggtaagttaacatgcttcgttattaaaccatggatttgattcaccaaatccatctttattgtatactctttaatagatatagcgcaaccccaaatcaacttctaatccttattaagttcttaatagacccccttttcttattttgagtggaaatacctaaatactacgaaaattctctgttgacagcaatctatgcttcacagtagtatatattttgtatatcgaagtcctagataagaaagtagagtaggcacaaatcgtttacaaaaggcaaaatgtatatgaaaaaaagattgattgaactttccgacggactcattccatgagtaaacgattgaatgggattcgtttgggcaacgaaatcaagtgctggtccccttttctctcttattgaattaactaattcatttccttttgacttttggatttttggatatttttttggtgttgatttggcattattcaacaagaaaaaaatcaaaatttcgataaattccttttttttgaaaattatgtgataatta

SEQ ID NO: 36825 - DNA, 1501 bp, Oryza sativa
  unsure (1)..(1501): unsure at all n locations
attcaaatgaaaaatctttctcaacgatttctcctctactaacaagagtagacatgcaaaattgttgtttgttcctgaagggaaaaccgttcgagctgttcctgaatagcttccttcaaaaggatttccgcttcctcggtgaatgtcttgctagaagatagaatttcttggaattgaggtttggtatcttttaggtgtttacgtaactcatccagaaatttctttacctgtccaatttctaaggaatcaagatatcctctcgttccggtataaatagtagctatctgctcttccactgggagagggtttgattgggattgtttaagcaattctcgtaatcgtcgaccccttgccaattgattctgacttgttttatcgagagcagaggcgaattgtgcaaaggcttgtaactctgcgaattgagctaattccaatttagatttgccagctacttgtttcatggctttaatttgagccgcggatcctactctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccagattgagtctcaactattggtaaagcggtcatactttcttcccctaaaagagaattaaatttagcggctctttctaaaaggcgtgaatgcaaataaaaaacatcccctgggtaagcttcgcagccggggggtcttcttaatagaagggacatttggcgataagcttgtgcctgtttggagagatcatcataaattattaaagtatgccggtacataaaatactcagccagggccgtataaggagcgaggtattgtaatgtagcaggggaatccgccatttcagctactacaatagtgtattccatggccccctctttttcttcttgttcccaattcactactaagcaagttcgaacgaattgcatatatattatctctcatatcagatgtgagtcaccgcctaaactacactgacttatcgaggttcaaactgtctcgcgggtaaagcaataaactctctcttcgagctcagtcacaattcattcaatctgtggcagtagtcgtagatagcgtagcccgggatgttagccatctacctatagtgtgagagtacttttcttcgaaactctataagtgtaagaaaagagtgcatgtacttttagtggacttgactttttctatagtgtgagagtactttctgttcaatccagtcgctccagatctgcccgagacatgcgcctaaggagaaattgtggtacgtaggttatgtgtctgtcttatgtcgtcctagtgatttatcatcggaatagctcagttcgagagagggggtggaattttaaattcgaattggaaggtttgacagccaaggagcggcaaataagtaaatatcttcgacatagctgaagagaaaaggaataataatatctttcttatttctttcccatga

SEQ ID NO: 36826 - DNA, 635 bp, Oryza sativa
tatggtgtaccggttgttatgccaatagcagcgccgggcagctaagttggtatggaagaactgctgcgccgcgggaaatccttctctatacaagttctcgtacgaggtttttgaacagaacttcgataggcgagaggtgtaagcaccgcgaggtgtgaagcgatctcgtactaaacgaatggaactttccaaccttcgagaaaaggtcccatccttcaatatcatgattgggtcaaccaggccagatcataagtgaaatagtttgatctggtcgaccaggtcaggcccgatcaagcgaatttgtaaagttgtaagatgaatcgcctttttgtactatttatttcacggtttttcgggaaaatcttttttcattttcccagcgtcctagaattgcctttctgttttttccttctccttttgattttcgtatcattattattactttggtttcttaatagggggatgattcatcgtggaacccgttcccccaacgaattggattttcatttttttttatttttgtttacctataaattttgtttagagactgtttttttagatgacggagagaatgttttaccaaatccagcaggggatcaggctcaacccgcggatgcaccccttgctcctgcagt

SEQ ID NO: 36827 - DNA, 1501 bp, Oryza sativa
tacttttataatatatcattgatcaaaacttggttcccatggatgaagtgtttgagtagacaaaagaagaagaagctgtagaacaacactagaatgattccaaccgacatacccacacacaaacagactaagactttgtagccccattctgttgagaaggtgcaatctatataccaagttgtctttgaggtacctcaagcacaacctcctaaaagaccatgtgaccatcagatttacctcacgatagtcaacctgtgaatcaaaggctttataggtattcacaccaccggttgaaatttatgccataatcaaggagtgcccagaatggtactctacaacctagttcatgcctcaccggctcttcatgtaaagtctctagtgggtgcgagcggctcccgcaccgggtcgggtctgtagtctgtcgttttgaccaaaagatgaagtttggttaagtcctccaaatgagtccattcgcctcgttcacataggtcctttccacgagggccaaagtgaacccaaagtcttgtgtaggcttttttgtttatatccaatccatgtggccaaaacaagatatttagcagggatacagacgacgcgattcctgctttcatagtttgatcaggtagctgaagtcgtggtgctgatcgcgtggtttgcctcttctctcgcggccgtgtgttggtcagcgtggtatggagtagcggttcctcggtagtctgactgtttcgatgcagcatctctatctttcggtacatcccgggcaggccttttctaaaaagtcttgtgctcaggtgcccaccaagatttctgacatcttagcctcctagttttaaattctcgaatcgaatcaattaagaatcaattcaaattaataaaagaataaggaaacgctatctcatccctattggtagcggtttgggccactactgccaaaacaaaccctagtttgaggaaagaactgtgggttctcaaaatcaagtatcgccgggcctagttattctcttgccccaacttatgcggggtacgaatttttcgagttggatcagtactataagcctaagtattttattgatcaggcggcacccagatttgaactggggataaaggatttgcagtcccctgccttaccgcttggccatgccgccaaatccgatctaaaatcgagaaaaatcttattcatccacattattttactaattattgttcgtaggaggggattactaaaccctttttttttcgtcgaatccctttgtacttatccctttccaatccctttgaagaaattcattccggtttttttattggacccagttttattctcttcgattgattgtatctcaaaacacacactgcttaaataccttctctttctattgaaaagagaaagggtttccagtcacagactgaaaaatttaggacaaattggaaccattaactatattaattaactatattatttgttattttgatattttctatttgttagtagtgaacggttcta

SEQ ID NO: 36828 - DNA, 1501 bp, Oryza sativa
gtgagcagtaagctgcggatctccccttttttgggggaaagctggtggcccttttggcgtgttaattctttcgacggggcggccttcttcgttcggtagatccggtcgaggtggttttcgtttaccagcgcgtaggtggtctaagttcctatgaccgagtctttctggcccctgtgaacatattttcttaatgtattaaagagggcctctctaaccggtgaaaagtggtaggtgtccactaacggctattcctggctcggctccgataacgcaattccgggaggagtcggtagttgggcactggatcccttcggacctggagaacgtgtgacactgggtcggggtttggtgaaccaacaggtcgctcctttagttgaagtatcgggcccctttttcgttgcctaggttacaccttcggaataccccagacggggattgagctctattccccccaatcttcactttacgccacgccgactctccgtcgtggaattagaccaagggtcgaagacccataccataggaccccgtcccccgtatcttatctttcgcgcgtaggagatcgagacacagccttagggctatggggaaagtagatcgattgccctagaattacaactacatagagggtctctacaagtctataaagaagtttaaaaaaattgatcggtagtagtccggtcgcacccgaacaataatattccagagggaaatgcacctaagatcaaatattttgagccggcttccgtggaaaattcagactttctttttgatgctgcgatcacataaaaacataaactttgaagctcaatagctaaatacatggcaattaaatcatgagccgggatcattaagagcatactgcgagtaggaagtggaattaatacaatgaattcagaagcatcaaacctctctttttcgaaagaatcgaaacacatcgaaatggtaccagccgtacttaataatagaaggatttggcagaaatatgtaaaattgtccctcctaaaaaaattattccagaataaatgggcaatagttaggagaggtgcgccagcggcgagcagaagcaaggttattagataccgaaggaaagcccggccagaaccacacgtgcaagtttccctgcatgtggctcgtccgtgataacttcttcggatttgcgtgaactagcggaccgatcactaagtggttagtacctccagcatgagcgaaccttttcagaactggttaggaatgggcgccactatcccagcccggatccagccaggttctattgatcatgtccccttcccaacagttgtaccttgtcttggggtctttggctttactatcaccggaaaaataaaagtctttctcttcccgtcccgggtcatagtgaggcgaaggtgcgtccacagaagaggaaatcgcaatgcatcttgctcagcaggcgtagcttggagtgggagtgttgcgggagtaaggtaaggaaagtgtggcctaagagaggaaccaaccaggg

SEQ ID NO: 36829 - DNA, 1501 bp, Oryza sativa
ctggaaaagtgttcagtgcatcctaatctgaatctgcgaaacctttctattctaagacggctaagtcgagggcagacacaacaggtcccgaagaggttcgaaaaggcgtacatgagttcctcctacataaggggctcattggttgtcaaccaagtgagaggggtctaataaagctgaaggatgagtatagataccttcagccgagatcgcttgggaggcatagccgcctctaccaggagattctctcttatttcttaagaaagtatgaattgccatagaattcttcgaggcctgattcaagatctgaagtatgaattgaacattggttaaaaagaagagagagagatggcgatggcagtctctctctctcttctttttaagggatattattgacaggcaaaaaccgtttttgagaatgataatacttcatggtgtatgtagaactcaacatctcagtaatttgcttctcaatttcatctttaagggctggattatgccggtaattacttacctcacaagttacattaatttgcttaccgtcagtgtctcgactcttgactaccaaagcattataaatataaggtaacttgcccgggggaaaagtgacatccagcacgggtccaataatttgatcgatacgccctgtacttttttcttcaattgtagaaaccccgggacgagaagtagtaggattggttctcataattatcacataattttcaaaaaaaaggaatttatcgaaattttgatttttttcttgttgaataatgccaaatcaacaccaaaaaaatatccaaaaatccaaaagtcaaaaggaaatgaattagttaattcaataagagagaaaaggggaccagcacttgatttcgttgcccaaacgaatcccattcaatcgtttactcatggaatgagtccgtcggaaagttcaatcaatctttttttcatatacattttgccttttgtaaacgatttgtgcctactctactttcttatctaggacttcgatatacaaaatatatactactgtgaagcatagattgctgtcaacagagaattttcgtagtatttaggtatttccactcaaaataagaaaagggggtctattaagaacttaataaggattagaagttgatttggggttgcgctatatctattaaagagtatacaataaagatggatttggtgaatcaaatccatggtttaataacgaagcatgttaacttaccataacaacaactcaattcttatcgaattcctatagtagaattcctatagcatagaatgtacacagggtgtacccattatatatgaatgaaacatattatatgaatgaaacatattcattaacttaagcatgccccccattttctttaatgagttgatattaattgaatatcttttttttaagatttttgcaaaggtttcatttacgcctaatccatatcgagtagaccctgtcgttgtgagaattcttaattcatgagttgtagggagggacgta

SEQ ID NO: 36830 - DNA, 924 bp, Oryza sativa
gcgttccttttttagagtattcaaaatcatactataacgcttgatattcattctttttttttgctaatcagaattagcaatttcatttgctatgattctatgttctccttagtgaaatattaatcattaaattattagcaaataacaaaaaaaacaaaatatctcaaaaaatgtctataatgatggactgaaaatacaagaaattcgcatgttctctttattatgttttcgtatatatattatttattcttttccatgtattagattattcgtccgagccatatcaaattaaaaatatctaaaatcaaattcaatatagaaattggaatagattctattagaaaaatagatttgcgaattagagaaaaaagaaagttcaaaaaaatctatctaactttattttatgaagttctagtatttttttctaagtagaacttccaatttcgaactagttaatagctaagattaataattaagatctgacattttacggatttcctatactatacatatttctatttgttacactatttctgttatgtaagcccacttagctcagaggttagagcatcgcatttgtaatgcgagggtcatcggttcaaatccgatagtcggcttttttctctatcaatgttccatgaacaaaaatacctctttttctccgaattaaatggagaagccaggatctattatgtcgttctaccctacaattttgctagatacaaaacaataaaataaataatatatatacaaattttttgtggtacttttagtagattttactctgtttatcctttactttaattcagttttaatttcgatgtattctgtaatgtaaatacaatgaaattaattgtgtaaatgaaatttcaataaaaaaaggagtcttcatgtcccgttatcgaggacctcgttttaaaaaaa

SEQ ID NO: 36831 - DNA, 1501 bp, Oryza sativa
  unsure (1)..(1501): unsure at all n locations
actcactcggataagctgtattattgaaccagacaaaacaacaagcgataaaaccaaagacagataaagcgcctaaactataagacaagtaagcttctccagaccatacaaatgcacggcgagcccatgcgaagggtttggttaagatatgccaaattccgccaaatacacaaatgaaacccaaccatacatgtcccccaattatatcttctaaatcatccacactaacaatccaaccctctcccccaaaaggggattttagtaaataaccaaatataacaccggggctaagggtcaaattggtaatttttcttacatctcctcccccaggagcccaggtatcatatataccgccaaaataaagagctttgagtactagaagaaaagcacctatacctaacaaaattaggtgaatacccaaaattgtagtcattttatntctatctttccacacataaccaaagaatggaaaagattcttcaagagtctccggtcccagaagcgcgtgataaatgcccccgaagcctaagactgcggaggaaattagatgaagtactccagatacaaagttcggaaaagtatctagaacttctcctccgggccctactccccaacctagagtagctaagtgcggaagtaaaatcaacccttgttcatacatgggtttttctggtacgaaatgggccacttcaaataggttcattgctccggcccagaatacgattaatcctgcatgggctacgtgagctccaagtagtttacccgacaaattgataagtctggcattcccggcccaccaagcaaaaccggtggtttcttggtcacgaccagctaaaacaaaagttccattaaagagcgtttccacgtggtagaacctcctcagggaatataagattttcatgaggctgatcctgagctgccatccacgcacgaataccctcgtttaaaagaatatttttggtgtagaaagtctcaaattcaggatcttccgctgcacggatttcctgggaaacgaagtcataggcacgtaggttcagagccaggccgactacgccaatagcactcatccataaaccggtgaccggtacaaatagcataaagaaatgtaaccaacgtttattggaaaaagcaacaccaaagatttgggaccaaaagcgattagcggtgaccattgaataagtttcttcagcttgagttgggttaaaagcgcggaaggtatttgcaccatcaccgtcctcaaatagagtgttttccacggttgccccatgaatagcgcatagcagagccgcgcctaatactccggcaactcccatcatatgaaatgggttcaacgtccaattatgaaatccttggaagaagaggatgaatcgaaatatcgctgctacgccaaaactcggcgcaaagaaccaaccggattgccccagtggataaatcaggaatacggaaacaaaaacagcgattgggccagagaatgaaattgcattataaggccgcaattgaa

SEQ ID NO: 36832 - DNA, 1501 bp, Oryza sativa
  unsure (1)..(1501): unsure at all n locations
atgtagcgggtatagtttagtggtaaaagtgtgattcgttctattaataactgaatttgaaatgatatacttaaggcgtccttaaggttttttatattccgatgaaaactttagttcttagaaaggatttactcctttttctctcaatagcatattgaggaagaatatgcattttcgcgatttgtacccaaagactaattgaaattgcatccaaaaaacaaataggatttggattatgagtacagagtcgcgaagcataattttgcattggattaaggattccaatttttaaaatatgagtaaaggatctatggataaagatacaaaaaaatttatttccaatcgtaactaaatcttcttttgttaaaaaaggaaatggaagccaaatagctaaaaaacggtagttttggtttactagaaccatcagcatattgtttcagctcggtggaaacccaattcttttctcaggatctcttaaatgaaattagggaacgaagtaattagattagatagatttaggcaaatttctatctcctactctttagggatcatctagaaagcagagagccttggttccattcagacaaaaaagctgacttagatgttaagtggtgagaatacccataaaggagccgaatgaaatcaaaatttcatgttcggttttgaattagagacgttaataataatcaaccaacgtcgactataacccctnnnnnnnnnnnnnnnnnnnnnnnnnnnnnnnnnnnnnnnnnnnnnnnttctgtataaaataactattctatttgtctagacatggtagaggcctgtattcaacctttttcgtccaccggtttccagcgctccagagcggagtagagcagtttggtagctcacgaggctcataaccttgaggtcacgggttcgattcccgtctccgcacttagcagtctgtataaaaggactattctatttgtctagatatggtagagggctgggtggttgggcggtatccaaccctttttattcattagttcccgaccctataaggccaaattgagcaggttgcgaagtaacttgctaccacaagaggaactctcaaggccccctaccttgcagaaaagaaaaaataaatgaaagaaaggcacagtctatctcccttccctttaaaagctgtttgctggttgtttgtttcggtgaatccccggtttagggaaccctgttgccgagttcgattcccgccgctgtagtgctctttttttgagtggggtgcaaagggggctaagatagtaaaggggtacggtactagactaacacctattactttaataaaagtagactaaattttttatcatagtaccttactaaattaagctggcgagcggcgggaatcgaacccgtatcttctccttggcaaggagatgttttaccattgaactacgctcgctacgtcctatattttatagggtatatccgcctgggtcgaccgtctatgtctgggtcgaccgtttcattttctatttga

SEQ ID NO: 36833 - DNA, 1501 bp, Oryza sativa
cggttctagacaatcttatttttctgcacataaagaaataaagaagccattgcaattgccggaaatactaagcctactaaaggcacgaaaatagagggtaagttaaaatccatcatagaataggtgtctccattcaaatttactatttctatctattcgatttgatctattcaaaaaatatcttaagattcttatgatataattaagtatatctattataacgaatattgactattgtatttttgagtttgcaaaaaaagattttttatagtatagaatacttttttttagaatactttagtattctaaaaaaaaaagaatcgaatggattatataaataataagaaaatagcaaaaaaggagaagcaattaaaaagatttgatttttcttttccgatcctcgcggcctttctatccttctaatcgaacttgaaattggattcaaagtacgacctagtcgaatgcacctatttcgaatccaaaatctttttcgtctacttccttccacatgcaatacttattcaaccactctcggaccccacaaatccgctgtaaggattgatacataggacttttagttgattgatattgccgtaaagttgaaacttttttaggcttttttattaaactgtaatttcctctctgcatacgtgctcttctagaagcatatacaataatgcgcggtaaaggagggaaaatagcatactcaatcaagggacaaattcttttacctactacagatctcatactaccccttagactttgtaaggccatataccacccccaaagggtatgaaaataccggatgaccttagcttttcgacgaatcctcgtctcgtgcagcgaagtcctgttagtaagaccccgcgcaaaaatggattatataagaatataattctgaatattcctccgggtgcgtatagtagcattgcgattccgaatcttttttctttgtgaatagaaaaaattcattgtatcgttgggtcggaggtttgctccagaaaaattcggaacaaaacgtctaccgcgttgaagcccatagccccatggagttccgtgaaagtatgattcttatcatcaggagccttttgaacgtctctacgatgggtccagattctatagctgtccaatctgaaatgaaagacttctcgctcttgatcggagtcgtaaactaaaactacctcttcatcaaggttatagaaaacttcgtcatctagttctaccattttgaaaatcaattctcttttcttacgagcatttcgagtcacttgttgactcacgattgtgcctgttaaaagtttcaaaatgtcctcttttttgaaagagagtcttagaaaggggtctaacttccaaactctgtcttttttcattcattctcctttagtttttttctctatctagaagtggaatagaataacccggttaaagggtaatgatcatacgtctgtaatgcattgtatgtcattgattctttcccaataaatgaaaactttttctgtaa

SEQ ID NO: 36834 - DNA, 745 bp, Oryza sativa
tttgtaattaaaatttaaatgaagaaattcgcaaatatccatttaaagagcatataaacttcaaatggccatatcttggccatttgaactcggaattggaccgttcaagtctctaattttttccttaagaagtcaagaacccatttttgtgctttgtttctgctgttatgtggagtttagtagagtaaaagcccttttcttttccgttggtcgtgtagacgctgcagcttcggaagatccgctcttcgtggaagtcgaagccgtcgtttgggaaagcgagcaaggcaagtcacatcatccttgagcatattgaatcccagtttacaaaattattttttttaatttaaattaatgcattatcgctttatttaaattcccgcgttatcactgttttatttagctatgcctatttacctttgttatgaccatactattattgttattgttattattaccttgttcaccctagaataaacaaaaccccaactagtggacactctatttatggttccactagtatgaatttaggtagatgcttcgctgattaataggacaacattaggtggttttataactttagactttgggaattctcatatcttttggacactatggaattgttggtttatggtagaattggacatacacctctcttcctctttcaaaacccctaaaacctgttttcggtggggtttgggtgcatgccagttgtgggaagtagcaccccggccactataaggattaa

SEQ ID NO: 36835 - DNA, 249 bp, Oryza sativa
gctcctacggaaccaaggtcgaaaggattgaaaaagtcagtcattctcaaccactgatgaaggattcctcgaaaagttaaggattagtagttctttttcgaaatcgatttcgaaaaagaatggattcggtcttatacatacgcgaggaaggtaatcaaaaaagaaagaagacaagttcttctttcttttatcacttaggagccgtgcgagatgaaagtctcatgcacggttttgcatgagagaaagaag

SEQ ID NO: 36836 - DNA, 1501 bp, Oryza sativa
  unsure (1)..(1501): unsure at all n locations
cgagatcaatgcagttaattatgtttctcctagaagttggttagcgacttcccattttgttctaggattcttcttttttgtgggccatttgtggcatgcaggaagagcccgggctgctgcagcaggatttgaaaagggaatcgatcgtgatttggagcctgttctttacatgacccctcttaactaagattttcttatttatacctgttctactgtttttttctgttctggctcggttattctatctagccgagccattcattcctttctatgaaagaaagataaggggacagaacaaaaaaaacaaataaagaaacaaacgtattcaatacgcaaaagaaaagagagaggaaagcaaaaggagagagagggattcgaaccctcgatagttcctagaactatannnnnnnnnnnnnnnnnnnnnnnnnnnnnnnnnnnnntctctccacagcctaatccttattttattcctacaaatagaacatagccatacgaaatgactcactaacctctagaaacatctcaaatacaaatcccttttcgatatatttctgtatactgtatccatgtatacaggatccgctatatccgcttgtgaaataaagcataaaaccccctcaaccccatatccaaataaaaaaagtggtgagtaataagttttaaagagaagaatcaatggattcatgattaaacccctcctacttcttgtattttattacaattttgattaagtgagggatcaaatataatatgtagtcaactttatttgatggtaacttggaggattagaaatatgactattgctttccaattagctgtttttgcattaattgtgacttcctcagtcttagtcattagtgtaccccttgtatttgcttctcctgatggttggtcaaacaataaaaacgttgtattttccggtacatcattatggattggactggtctttctggtagctattctaaattctctcatttcttaaatgtgtttagtatttagtagcccgatacaaaataaaaaagggccgtttattcggattgtgagacgcattaaaatgcaatttgcgccccgaattgattgacagacaattaaattaataaaaagaaaactcaaatagaaaatgaaacggtcgacccagacatagacggtcgacccaggcggatataccctataaaatataggacgtagcgagcgtagttcaatggtaaaacatctccttgccaaggagaagatacgggttcgattcccgccgctcgccagcttaatttagtaaggtactatgataaaaaatttagtctacttttattaaagtaataggtgttagtctagtaccgtacccctttactatcttagccccctttgcaccccactcaaaaaaagagcactacagcggcgggaatcgaactcggcaacagggttccctaaaccggggattcaccgaaacaaacaaccagcaaacagcttttaaagggaagggagatagactgtgcctttctttcat

SEQ ID NO: 36837 - DNA, 725 bp, Oryza sativa
ccaataaggataccactcttactagcaaggtgaaggacacatcaacccgcatacccttttaccacacctaccccttgttgggcacgtttacgcatctcttgacccatccacatgacccgcttggctaactaaaagaagcttctcggagcatctatgcatatgagaacggatgccgagtaaagggtggccagcttcgacctttgctttgaacaggggttagcattatcaaaaaccattgctcataaaagggatctctttcctaaaaggcatatctcgtacgctagggaatgtgcttctctcgtacgctagtacgctagggaatgtgcttcggcttcagcctagctacttttttgattggtgactaaactactaaaagcaaactttagctatcaattcttttctctatgttcagaaatcattaacggatgcagaactggatactctgcttaaagcaataagcctcccttggatagatcgaagaaagaagcactgtgcgttaccaggtgtagtggagaaagcaagggcaaaggtttcatcagaaagagatgctcgagcgataccaggatcacgatacgattaatctgatggcgcagcacgaacaggaaatagataacctagccctgggaaggaaagggaacagtttagtccctccgatccgtcaatcaacgatagggttacccagaattctaattaataggaaggttggactacctcgaatggcaaca

SEQ ID NO: 36838 - DNA, 526 bp, Oryza sativa
ttcttcatcaagtttataaaaaatatagcaattcttatgatacaaaattagatccattaaatctaatactggacatattttaatagtatatttgcatggtgccaaaaatattgttatatgtttttctataaacttgataaaacttaaataattgtgatttagaaaacaaaaggcatattataatatggaactgcgggagtattaggtaagaaaaacttgaaaaatagattaatatgaattattatagaactatttttctaaagaaaatcaccatttagccatctagaaagcgtgcgcgcggaaaacaaatgggtaaaagttgggaaatataatatagaacacaacctaaatgcattgattagccacaagctagtaaatcattcagccaccttggtacgacatgatacatgggaaattgaatatggagtatggacgtacgttctcaactaaatactagtgcgagttttgcttttatgatatttgagaatgtaaactaaaccaaaactaagccttgcaaaaaaaggca

SEQ ID NO: 36839 - DNA, 1501 bp, Oryza sativa
attggggtgcctagcatagtaaatttagttgtaataataatctagtgagtttttttaaggattgggcaagggtttgtaggttccgcatgccttttctcttttttctaactatacgcggaggatgatctggctggacaggcgtacacgatgttcgtatgaggattggaccggaccgaatagtgtatattttttggggaaaatgcttctcttcgaacatccggacacaaggagaaaaatcgggcgggcaataaatatgctgcctctgacatacatgcacttatccaagcctatatctctatctccgatacgacacacatgcacctttagcgatattcaaaacgatttttctcataaattacttatctaatatataatgcgatcataccgttttattcgttgtaattatatcttaaggacaagatgccgcatgattatattctgataaaaaaataatcatatgtttcaatccattaacactctttgtttcatacacgatagtaatctattccaatatgtgtcttcagcgtgtttcacaaaattcgtgaaacttcgtatcactactctctcctctctctctccacctcatacatgcatgcattttagcgagcttcgaaacgatttttctccaaaactaattgtccaatctacgatccgattatatcgttgtattaattgtaattaaatctttagagtgacaggttgggaatctcattcctgatcccgacagttaatatagcaaagaatactttagagtgatgaggggaaaccgatgttgagaaacaacagaccgagaagcggatgaatgttaaattctagaacataaataaaactgctattccaaattttacaaattctataaaattttacattttctataaaattttgaaaatggttttgattgttccaaatttataggtcgttactgtactttttgcagtaacatcatggtaaaattgcggtaacagagaacatatggtagtaacggtactactactctacaactgcttgtgcgtagctaaatttttaaatcttactcttgtgcaaaatacaaagtcctaaaaaaagtgcatgtgcatggtcacaagttaacacaagtgctaaaagtacttctatttgtctatacaaagatacatagtagcaagcttagtacaagtaaacttttagaattctaatatttaaacaataatatctctcacatcacatattattttttagaaccgttttcaccataacgctttaaaacaacgttacagcgagacaatagtctagttactacatgatggctgagacaaaaatgcttttataacattgttactgcggaaagtagtcgtgttactagaacattgattgtcgcgttactatgtcgttctagtgagacgagaactaaaaaaactaaatatctatctttagagagcaatatctctcacgttatatagtatttttctaatctgtttgcaccatgatgttcgcaaaaaagtacttaccaaaattagatctatca

SEQ ID NO: 36840 - DNA, 962 bp, Oryza sativa
caaatgcgtttgagcttgttcagaaaggaaaagaagatcgagtgtcattaggtgagcactagctgagtcaggctcaggcatgcaagaagcatttaattttttactagtttagtttgctagttgagctcagcatgaaattatatatattcattcattgtgtgtccgttatcaataaatgtaaaaataaataaataaagacgagcgatggtactgctgcctattgtgacaggagtatatatgctatatagacaggagtccgtccttaattccgggtaatcagcaaaatgatgactttgacgaccaaagtaatcgctgcaagtgcaggatgaaatcaatcaacgagatatataagcagataatacatacacatatagtaataatactatagattaatagatgggatgtgaatagagaagtagtatagtaagtaacagcagtagatggttgctgcgagtattatgtggagaaagaggaaacggtagcaatgagtcgcaagcagcatgtgcaacagaaagcgaagccgcaccaaccgcatacaaccggtacagaaagaaatatggaatggcaatgaaagcatgatcaacaagtgcagttgcagttgcagtgtagagcaggcaccggtcgaattcgagcctaataacttgcgcttctcttctcttctctgctgtgctttccatccatccactcccacgaaccgcacctcaccttctttctctttcattctctctgtactgtacgtacgttgccaatactagtacagtgagtgagtcatttgcatctgcataccctaccttacctgctcctactactgctcgcctcgcttacttactaccctcctgctcctaacaacaacaacaacaacaacaacaacaacaaggaagctctatcgggaaagaaataggaggaagaaggattaaggaaggaaagcaaagcaagcattaattaaaggaaattaggaagga

SEQ ID NO: 36841 - DNA, 1501 bp, Oryza sativa
  unsure (1)..(1501): unsure at all n locations
tatacagactgctaagtgcggagacgggaatcgaacccgtgacctcaaggttatgagcctcgtgagctaccaaactgctctactccgctctggagcgctggaaaccggtggacgaaaaaggttgaatacaggcctctaccatgtctagacaaatagaatagttattttatacagaannnnnnnnnnnnnnnnnnnnnnnnnnnnnnnnnnnnnnnnnnnnnnnaggggttatagtcgacgttggttgattattattaacgtctctaattcaaaaccgaacatgaaattttgatttcattcggctcctttatgggtattctcaccacttaacatctaagtcagcttttttgtctgaatggaaccaaggctctctgctttctagatgatccctaaagagtaggagatagaaatttgcctaaatctatctaatctaattacttcgttccctaatttcatttaagagatcctgagaaaagaattgggtttccaccgagctgaaacaatatgctgatggttctagtaaaccaaaactaccgttttttagctatttggcttccatttccttttttaacaaaagaagatttagttacgattggaaataaatttttttgtatctttatccatagatcctttactcatattttaaaaattggaatccttaatccaatgcaaaattatgcttcgcgactctgtactcataatccaaatcctatttgttttttggatgcaatttcaattagtctttgggtacaaatcgcgaaaatgcatattcttcctcaatatgctattgagagaaaaaggagtaaatcctttctaagaactaaagttttcatcggaatataaaaaaccttaaggacgccttaagtatatcatttcaaattcagttattaatagaacgaatcacacttttaccactaaactatacccgctacatgtaaattctgataccaacgctaccctttgtcaagggtagccattcgagaaagatgctaattccctcttagttaatgaaacagagaaggttcctcacagttagcggttggtacttcgatcgcgggcctttcctttactttcttttttgttcagaattgaacaaagaatttggggaagaaaacatcttcccccacttatcatgaaatctgggccatagagaaagagtgagatgtttttttttatttatcatagactttccctatggcttgagagaaacaataaataacttaaagaaaaaggcacataggagccgaaggatttacttgatgtaaagaagattctgaatgtctctgcttagtcgattctctccgtttaactttttcttctcttcttttccactcaattctagtttattagattcttgtttaaaagaatcaaagaagatgaatagaactaagaacacacaaaaaagagcatataggcccgagaccattaccaaaagttcttcccaataatcatattgggtatctgttcccttccttttcctattaggatggggcatgttgga

SEQ ID NO: 36842 - DNA, 773 bp, Oryza sativa
catggcgattggagggaggcagagagagcagtggtcctggaaggtgataccgtagctggcggtggtcgaccagaaaccatgatgtttttttgtccataggattgttgttttgttttgataggataagatgggctacataattttaggtatcgctaggatttaatttacactgtagacaaaacataaggccttttgtgtctaatagaagaaagaaagatggagagcatttgcccctgttggaacaattaatgtgctgcaggcaataacaatccagttggttggccattacgattcctgactcctgtgctgagtgatgagaattcagtgcctcctccctcactagaagggctgttaatccgtgaagcatgcgtgaatactggtgttgcaattggccgtctgcaactatctgtccacgcaagtaagcatccatcgatggaaaggccggcgaaatactagtaaatgcatatccatgtcagtcagattcagatcacatgaggttaggtccgcaatgcaaatgctactactgggtgaaatatctgagcaattagtaagtgaatgtcgctactgcattggcgttgcatggcctggcctgcctccatgtatctttgtcgcgcacttgcctgcgctttttcccaatattttaatccaaaattatctatcttaattagcttctttatctctgtctcagtagtgcaggtgctcccaacttaataaccttttaacacctgaaaaagaagatctcttttcagtcgagagagagagcagggcccagg

SEQ ID NO: 36843 - DNA, 180 bp, Oryza sativa
tgttattcctcaagcatagcggcacaacggcacaattttttcgccttaagatcaatgcacgtcgaagaaagaaagcaattcctaccctctgtcatgatggtgtctatgctaccactgaagaagataagctacaggctgcatacaactatttcctcaatattttggggacgcgtggagagc

SEQ ID NO: 36844 - DNA, 294 bp, Oryza sativa
taatatactgtctaacttcaacaggtgaccgtctcagattgagatctccccttggcctccctgccccgttaataattacagtattctattctctctctagcaaacaagtaggagtaattttcctctttctttattctactagtctagggaaaaaaaaaaagtagtcgatcgatcgatcgagaggtttaatctgtcctccctctcgccggtcgccgccctcgtccccgccgccgccgccgccgttagattgaagcagagctacaggcaggaggggcttctcctcgcgcgccgcca

SEQ ID NO: 36845 - DNA, 1371 bp, Oryza sativa
gctcaactgccccttaaacgaagaagacccctgggccgccttgcgaaatacttactgctcaaaagcgaagaaattaaaatgctttacctctctcttccgatgaatccacttcacataaacataataagtgttttggcatgccagcaagcggttgagactttcgttattccaaatttacgaagggaaggttccgaggtatcggaatgtggtaagccagctccacctagggacatcgccggacggtaggcatcggttgctctaaaacttctcacctggttttcctattgtcaactttccttacgcaagcggtcagtaaagaaaagccgagtcgagtacaagaaaaactaatagcttcctttcgttatctgcatctgctttcctcaaaaggtctagctttgccaaaatcaatagtttagttggttgggtcctgtcgatcaagttataggagctgcttgctatctatcaaagggtagaaaaataccacgtttgcattgaaggaatgtcgcaggaagctgccgatccgcgatttcaagtagttcgtgcttcggcggcaggggactataggccatgaaaacccaccccaggtatctccacctgtggattgagagtaaaaaccagtgaatttcgtatctcccgctggcacacgatttctattacttttcttgtttcccgtttcggagatccgataaaggaatggtaaatcgatatctgggctcgagccagggtacttatcctcccgtctataaatcaatgaccaataaaagaccaaaggggtgataaatcaaggggcggacaggagcagcatcgtagctaggagcaggtgtagcaccgtagctagtagaaagaagtccagcatagctacattccccttcgggttggcgcccgtcttctccaatagaaatttcatcatatcaagggctaagctatctgaaaacctactaccaatctgaatgtaaaagaagaactaaatactactatccatgagatcatcataacaaaaactagaattgcccagctaaataggaatagaaataaatccaggcaaatagagctcttgcacattttcgttaatccatgaacagaatctaggtatgtagacacatggatccatacatctcgatcggaaaagaatcaatagaaggagaatcggacgatatctttctcgaaacaaacaaaaaggaaaagaaagagaaaacagaaatcatgatcaactaagccctctcgggggcttgcttaagaataagaaagaggaatcttatggaaatagcatggaataaggtttgatcctattcatggggattccgtaaatatcccattccaaaaatcgaaacaatcgggacttttcggagattggatgcagttactaattca

SEQ ID NO: 36846 - DNA, 227 bp, Oryza sativa
ccaaccaaaacatcttactggcctttgattttcactattcagtctgcaaggaaacatctcgctggaaggattgatcgtgtggatatcagtttagatgaaacacaagaaattattgaagggacaagggatgaggttggaactgtttttccttttattttttgtgtttacttttatagtttttgatgcattttcggcgacctaatggcatttcatgactgacttgtagg

SEQ ID NO: 36847 - DNA, 861 bp, Oryza sativa
caagtgcgaagaggataactgctaaaagcatataagtagtcagcccaccccaagatgagtgctctctcctccgacttccctagagcctccggtagcacagccgagacagcgacgggttctccacccatacggggatggagcgacagaagcatggaaataggataaggtagcggcgagacgagccgtttaaataggtgtcaagtggaagtgcagtgatgtatgcagctgaggcatcctaacgaacgaacgatttgaaccttgttcctacacgacctgatcaaatcgatcaggcacttgccatctatcttcattgttcaactctttgatgaaaagatgaaaaaaccaaaaaaaagctctgcccttccatctcttggatagatagagagggagggcagaggcctttggtgtcccttccagtcaagaattggggcttcacaattactagccaatatttctctcatgcctttcctcgttcatggttcgatattctggtgtcctaggcgtagaggaaccacaccaatccatcctgaatttggtggttaaactctactgcggtgacgatactgtaggggaggtcctacggcaaaatagctcgatgccagaatgataaaaagcttaacacctcttatttgactttttcactattttgaaatacgaaaaagatccaaatccaaaatgcaaaggtcgtcttattcaaaacctcaatcatcacatcccctctctcccacttcacacctcggaacgcactgttcttatagagagaaaggggctttcccatcttcttaacccgaaatgaaatggctgaggagagggaggttccttttggggggtacccccgggaagagatccagtggagacggg

SEQ ID NO: 36848 - DNA, 1501 bp, Oryza sativa
agtcggccacgtcatccagccaacgtcgggctggagtctctggatcggggacgacgggcgggtgacgcaagagcgcgcccgcagcttggagcgtgccctggggcgtgctgccatcgccgtagacgaggaggcgacgctccccgtctcgccgtccttcttcatcgctcgtgggcggcgaagtcgcggatctttcgaccccctcgagcgcctcctcccgcctaagacttcggcgagaggggggcggtggagtacgagctcgacggcgcgggttctgctccccgtcgtcaccgctagcgctcggagagaggttgtgcgccactgcccgttcggccattgggctgagcgggagaagcttggcgcacacgaaagaggacgagggcttagaaaaacacacgcgccccctacctggcgcgccagatgacggagcgtggggctcctcaccgggagaccgcgcgggcccccctttgccggttcggccgggggcgctaggtgaggttctaagcactcgatctatggaatgtttcgtgagagagcaaatgcgcaagacacgggcgatgtagacaggttcgggccgctgagaagcgtaataccctactcctgtgttctggtggatctgtgtatgaaggagttacaaagagctggagagcaagagagttcaaactctagaaaccctcttcctctttctctcctctacgagctcaggtcttctcccccctctttccccagctcccccgttcttaagtgggcaaggtcctccttttatatctcaaggggatcccacctgcaccacttctacctactcttcttttgggtggggactcaccctatcttcccaaaaaagaaaaaactagcttgcgccttcgcctggaagctaaatcacagcttgtctttgagtgaggcccagcgtcatcactcgcctgacaccggggatctccctgttactccctcattaatgggcggagatttgccatggctgttgtccgaatgaccctctgatgggatgggccatacctacctccactccgccggaagcaggcgcaacgtgggagcacggttgtctgccgatgacgtgaccggcgtcagaccagtcacaaaccggtcattcttgtctaccacgcgtcagtttagcatgccacacgtcaacccttcttcataaaatgacttccttgtaatggttgcgatgaagcctggtatgaatctagccgggactgacgtgctaactccaggagtcagcacgcgggctccggctagggacgagtgcatataggctctcatcattcaacgggaacggggctaggcgtggaaaaggccgcctgttaccacctaaccctctatctgaccggtctatgaccggtcacacactgtgacctgtcacggaccgaacgagtgtgttgcgctgcattaaatagggcgtggggcgctcgtccaacccacaataaatgcggttaggtgagccccgctgtgctcacctaacccacacacgtggcgccaaacccacagg

SEQ ID NO: 36849 - DNA, 1501 bp, Oryza sativa
aaaaaaaagctctgcccttccatctcttggatagatagagagggagggcagaggcctttggtgtcccttccagtcaagaattggggcttcacaattactagccaatatttctctcatgcctttcctcgttcatggttcgatattctggtgtcctaggcgtagaggaaccacaccaatccatcctgaatttggtggttaaactctactgcggtgacgatactgtaggggaggtcctacggcaaaatagctcgatgccagaatgataaaaagcttaacacctcttatttgactttttcactattttgaaatacgaaaaagatccaaatccaaaatgcaaaggtcgtcttattcaaaacctcaatcatcacatcccctctctcccacttcacacctcggaacgcactgttcttatagagagaaaggggctttcccatcttcttaacccgaaatgaaatggctgaggagagggaggttccttttggggggtacccccgggaagagatccagtggagacggggtgggcctgtagctcagaggattagagcacgtggctacgaaccacggtgtcgggggttcgaatccctcctcgcccacagccttccaaaggggaagggcctttactttccccctgagggtaggaaaaccatgatcgggatagcggacgtaaagctattgaacttgggtatgctctttccttttgtcgaagtggaatcgtagaacagaatgtgatacgatgagataaaatgcaatagaaacaaggatagcgaacgggttacctactcctaagggtcaaagcaagccctttaattcaattctttattcttacattaaagaatgaatcaaatctccccaagtaggatctgaccgtaccaccagtcagttagcagccgcccgttctacctctgagctactgaggaacaagggggattcgacctcctagagttcaactcccgctctcaacccatgaacaatatgagtccgaagcttctttcgtaactcccggaatttcttcgtagtggctccgttccatgcctcatttcataggtaagcccagagtggctctatttcattctatttcacttcctagcacttcctatcatttaatatccatccctttggtcttattgacataagagatgtcatttatagtctatctctttctatatatggaaagtcaagaaattctcatcgaaacatcgagaaattgtgcatatagaaaattactactctaaaaccaatatagaatcttattaagattactattaatcttaaacttaaaccaatatagaataagtagtactgaagcctcttgggcgatgtagggcaaatcttactctccaagacgtccaccttcgtgctcagttcctgaaatgcagctcccaattcatccaccttcttctccacaactggaatgcgcgcttccacagtccgcttgagatccagatactccgcccgagtgcgctcatccgcctccacgcgcttcttctcattcccctctacg

SEQ ID NO: 36850 - DNA, 1501 bp, Oryza sativa
aaaacacctaatagaaaaagaaagacataaagtactattaggaaactaatcctaatagtacaacttcatcatgttgatttgcatagctatccaggacagatatgtacactaatccttctgcaatcattttataggtggaattccatctagtcggtggattaaaagaaaaacccaactttgaaggaagattcttcaagtttgctatagaattgaaatcttgcattcttgatgctgaagaatctaaatgcttcaacaactcacgtagcttgtgtattgttggtttaattatcttcataccatcctgaacccaaatatttaggatatgggcacaacatctaacatgcaaatgctgaccctcaaacatcaatgcatccttgtgattctttatcaactcttgacatgagaattgttattactggtattatctaaagttatagttatagtaaacaatttgtttctaatgcccaaatatgtcaagcaactcattatagcttcttcaatggcgaatcctgtgtggggatacttcaattccttaaagcttataattttcttcttcatgttaaactctctatcaatatagtgtgctgtgacaaccatgtcgcctatatttgaattgaagtccacatatcggatgtcagacatacacgcgaatcaagactgtaattcagcacgcaagtcttccctcatttgctcatacaagttaaaggcatcatcatgaagtgtttgacgccccacaactttgaaagttggctgcacggactccacccactccaaaaaataaggatcctcaattttattgaatggcacctctgcgtgaatgaagtatttgaccattagctcccagcttctcttgggatcaaacacgaaaccttccccagtctgtttcttaattgttgcaaggaagttgattctagcagcaccatcaatagctggacatgattcggctatgtgattaataaggtgacttctgcctgactttttggtggctgtcaatcttaagctacaatatttgcattgagtcttggggacaccatctatcatcacaacctcttgctgaaagtgttaccatactttagccctcatacgtgttcttgaagttgattattatttgtattattagtacctgaactctctgacatgacatatttattattgagtttgttcaattgtctgcatagaggaagaaatctaaaatgaagatagttgaaagaacatggtctataattatttttttcacacattgtacacgtgctacaagctaaaaattgcacactagaattccattgaccatagaattaatttgcatctcaaaatcatatcaagactcaatctgtaatgatttgttaaataatttgcatttatttcaacctatatttttgtatattatagaatgcactgtcaatcccagctctacctatttcatgggcaccttttagagcacatagtactattaacattctttattaaagaactcaaaactatcaggcagcaaatcaatata

SEQ ID NO: 36851 - DNA, 1501 bp, Oryza sativa
ttgcccggaacaatgcggcacttggagttggatgccaccaccacccgcaacgcaacgatggtcagctccttcttccccgtgacggccgagatcccgaccaccatgcggtacaccgtaacgtcggcggcggcggaggcgacggcgacgaagcggtggtcgtcgtcgctgccgagaggcaaggcctggccgtcgaaaggcaggttgctgtcgtgcaccatctcccactgctcggtgtccatgtcgaaggcgcaggtgcccttgtcttcttgctgctgctgcggctgcagctgctgcaccgagaccgacaggaggatgtgggagccgacgagggcgtacgccgcgacgcgcaacttgggcgggtcgaggaactccagcgggttgaggcggcacgggaagagcggcggcgatgggagttcgcgccacacggtgtggctgaggtcgtcgaggacgaagaaccatggctcgaaatccagcggcctcacgacggccggggtgcgggagagagcgtagagcgtgccgccgccgactacaccgccgccgtcgtcagagatcgagatgaggacggggttcaccttggggaagatgagtcgcgggccgccgcgctccgtggatgtctcggggtcgtagacggtggtcaactccacgccgacgcccacggtgcgtgtccccaccgcggcgaacgacatgccgcggccgcggccgcggccgctgccggtgttaagcagacggcgggcggcggcgcaggcggcgacctcgattacggagtgggtggtgggctcttcctcgactccgtgcgccaacaccatgtacaccggcggctgcttctcaggtgaggcccccttgttcttcttcttgttccctggacgaacgcggaggagacgaggtaccggctccggcgccggcgtcggcgtcggctccggctccgcgagtttcttcctcctcttcttgtccggcgtcaccatcttcttccctcgactggattcggatttacgtatcaaagacgtgatgaaaggaaaccctatcccagtggggttgctttcgtcggccggaggacagcatgggcctagccgagactgggccaaatgttacaactccactacttgagactgggccgccaaggcagtgcaacatgcgtctcacctactactaaactccccgtcgcaatcaggattttttttttctttttggaacgttcgattgcgagtgcaacaggcgaatgatagcattgctgcgttcttttttctggtttttaagcatgctcacttctacaactactacagaaacgaggacgacatccctccaaattacaggtatagaccataactgttcacgcatgaaaaaaaaaagttaacccgagagatggatcaaaggcttcttaaggactgcatgtaaaaaaactaattttgcatgcgggcaagtaggaaatagattttttttctgcaccttttttctcttcctccttctctccaccgcaccgtctactcttctccagaaccagggc

SEQ ID NO: 36852 - DNA, 1501 bp, Oryza sativa
attcgtggcatggaaaattactccatctagctcgcagataagtgaagtgttttttaatgtctgcagtcaatatgtttaaatcttgcccattcatattttttgtcatatctcaaatcattttttttaaaactgtcgtggccagatttatcttcaaaattagtttcaaataatattataactttgctatattttcatatgctttatactcctacttcttaacaatgaaactagtgttttggtgatcagttgctccgtccatactccatagtatcacttattcacgacaggaggtagtgtatcctatcttactaaaaggttacaacccattaaattctaaaactcaacatacaaaagatgttacatcattatgtactaacaattattacacttaaacattatgcatgctatattatctatattttgtaatttattaaattttggagttttaaaatagaagcatgttaaattatcatcgcacataattcacataatatttcaatatatctctccattattttttaaatatactatatacctatatagttcatcctcggttaatattatttttctctcctcttatcaagccatatcatcttaatttttttaacccgtagatgattaatctatactccatattatctatttctttttttctttcataaaaccacaccgacttacataaatttatgttgtttagctattttatacattatttttacttatcggatttgctataaaacttccaaaagtttttgcccccaaaacttttagataaatgaccatccgatcgcctcgacatttgtgcatgaagggaaaaaaattgctagaaataaattttcacacatgtcacgcgtaagattttagtgctagctaaccagggcatggttgaatgcaagtttattatatcgtagttacattgtagttacagtgcagtagttacgcttcaaatatagtatagttacacttacatcgaaagttttttactaaaaaaacttgtggcagttttttgatactacctttaattatttttatcattctaaattcccgcagtaacgcgcggggttttacctagtatgctaagtaatgctagatgtagaaccattaagatttgtcaaattgatcctcgtgggttgtggccaaaatgttttatgatgacatggtcaacgagagaaagtttgccagcagtttctttcatggattgttttaagagagagacagagagaacatgcatgggcatcaccagcaataattttaagattttcaacggttcttttttttttggatacggatcgacgtacaatactcttcacgtaggaaagtacgtgaacgtaccaaattagctgtcattcaaagaaaaaaaattaagacaattaattagctagtatcttatcttatataactggagggttgatctgctagctactgacagtcaaacgcagtgccaagatcattgacaagcatagatcaagaaagagcagagacagagagggattgatcgagg

SEQ ID NO: 36853 - DNA, 1501 bp, Oryza sativa
cataaaaagggggctaaataaattctgagaaattaaattcgcgggcttaataaattaaaataaaggcccaatcttatcaaaaagccggcccaaaacggaccggcccatttatgtgcgcgcgcggcgcttaggtggacgcggcccagattggcgcggcccatgaagacgatggcccgatgcgggagcgaggacagccgtctgatcaaacggatggccaagatttcgcctttgccactgaaatcgctgaacgggtcaaaccctaaccctagtccccatttctccccttctctcccccgatccaatctcccggcgagcaagcgagtggaatcggcggcgatcatggcggcgacggtgttccggcgaggcggcgcgcgcgtgcggcggcgagcgctgcagcggctccacctcggctggctggggggcgcgcccgagggcggccccaagccgtgtgctatggcgtcggcggtccgacaaggcggcgcgctagcgacggcaagcgtcgatgcggccggacctcgtcggcgggggggggggggggggggtaggcccgaaggcagccgccaagccgacgcttcccgaccccggtgagggacggtggagagacgaggtccaaggcggcgcgcacacggcggtcaaccggcgcgacctcgaggagtccggagagctccggcaagcttagggggtctaaatccagtaattaacccgaactcaaacctaattttgacttgaatttggatttaattcgggtatttgtgacttagggttcttcccaaaaaaaattagggttcttcatttggggatttagggccgattgtatctggcttattggggatttcggaaaatttcagtcttgtttatccccttttgcttaatagtggggaatttcaatctagtttatcccctatttcttggtttgctgagtgctagccgaaagattagcttcggtctaggaattcttagtgtgagaattgggaatttcaatcttgtttatcccgaacctcttctttctctcaaattctactactaagcaacgaaattaaactcttcattaattgtgtttctactgttggccgagacaaccagcataacatggcttaatacgcaaccaagacttaaggaaattaatctaatcttattcaaaattgcatcatgccgaatcaatcttgaactttgtaagggtggcttctaatcacagggatgatgtgattatgagggaacatgaaggctaagataaggctctgataccacaatgttgaaatttaatccaattaattaattgagtcttagcctaaacatgatcaccttctgcttatgcggaaattaatttatctaactgacgtgagatgaagccaatgaagccattgctcttcttctttcttctttttgtttcttctgttgtgagatacctcacgaacctctttcagtgtttaatcgatcggacgatttatttagggtttagggttagagagagttgagtcattacacagcctccctcctcttt

SEQ ID NO: 36854 - DNA, 1368 bp, Oryza sativa
cagagaaaaaacgaaggaattaatagatgagattacttataatcgaaaatcaagtcaccgttgggcagaaatgattagggaataaacattaatgtcttaagtcacatcaccaaaaggtagaagtgataaagtaaataatttaaaatcccaaatcaaatcaccatacggtagaaatgattaggaaatgatgccattagtgatgccatagaattaaaattaaaatccttagccatatcagcgttgggcagaaatggtaaaggaattaagcttacggatagattagatcctcgatcacatcaccgcaaggtagaagtgataaaaggagttaatgcactaatggcataaataaaaaatgacagagaaaataataattgataatactttgatttcttcccttaattacatcatcgttaggtagacaataattaaggaaataacaatcttaatgaaatcatttctttctagataaacttcccgttggttccatttatctagaaataatttactcagtattgcaactgatcttaaataataagcattgataattgcatataattagtttactatggcttaatcaatcatgtgcaaaataaacttagaatttcatagtcaaaacaccattggtcataaataattatgagtaatcttaaaattaattccttaattatatcaccatttggtagaaaatacctaaggaaaaaaaagtataattgacatgcatttataataatgtgggttaaatatatattcagatcttaacgttttctagtcgaatttctcgttggttcaattcgactataaataattaagttactaaggcaatgaccatcataatgatgttgacatgaaatcataaatactttctagttaaatttccattcaactagaaataaattaagtggcttaaggaaataataatcttgacatgaaatcatattaacgttggtctggctaaacttcccgttggttctatttaactagaaataattttttttgagtgatcaaataattgaccataaattgcgggcttaaaataataaatggcgggcttaaaataataatacggcccatcacttccatgaatttctttccagcaatttaaatggctaagaaagctcacaaatgaatttctggaaataaataaatcataaatggcgggcttaaaataataatacggcccatcacttcctaagccggcccataaaaagggggctaaataaattctgagaaattaaattcgcgggcttaataaattaaaataaaggcccaatcttatcaaaaagccggcccaaaacggaccggcccatttatgtgcgcgcgcggcgcttaggtggacgcggcccagattggcgcggcccatgaagacga

SEQ ID NO: 36855 - DNA, 1501 bp, Oryza sativa
gcttcaaggaaaggccgctattttttttttgcgattgattttatttaaactcttttctgaaacaactaagggagtgcttctcaaacgacacggatgagacagtgcgtctcgtccggtcggagtatgtgcaatgtttcagtcttttaaattgatcaagattggcacccggccaacagctttcaaacggccacccggggcctggctgatcccatcagccgcagattttccaaacatcaaacccattccacaacagcaaatttcacaaggcagtagtcaaacaaaactacgctaggaatcacctcacatccgcccatgaccgtgggcacggctgttcgaacagttttaataacctctacagagggggtacactttacccacacgatattactaacccagatcatccagcccgtgcagaacggccacgactagagaccttaaggctttcatgacaaggcatttcgaaagccgacataggttcaccatatgccaacgagaggggtcccagaccaacaccagattaggtcccagaccatactgtgccaggaagcccaggggtcctccccgacaccaccctggcgaatccacatgtctcttagcatcatggctcccccgataagctagttactcagccaggggtgtcccattccacccatgtggtcgtacttgtcttatgttcggatgaaattccaaggaaacggtccttaagtgcaagagcgggaaaccgtacacccggtacgttccccggtccgcggttttggaaattcatttagttcgcaagcaccgacccaggtgtcgggttttccaagtcttttgtaaaacccaagttttacccaagatgtttctcagattttaagtttgaaggtgaccgtcgatacccgtgcagagtgcacgattaccgaggcgcaactaggtgggtacaagggaacatggtataacaattacaatggaagggtcaaatgcaacaaattaggtaggtccgccaatctgccttgcagacgggacaagcagactaagtgcgatcctatcaatgcataatatttttcaagcaacataattaagttcgaatataggctcaagatgttcaaaggtggcttgcctcgctcgagatcttgagcttgatcctcgaaatcctcgcactgcgggtcttcgggctccgaaactacacgcgaaatgggacaactcagcaaacggcgaaattaaatccctattattgacctctaagcgtgccattagatagatctcgagatttgaggaattttggaagttgaatggagtcaaacggatttacggttgggaagatattgaatttctaagaatattggatttttggtctaaaggaaaaggatttatttaaatcctttttgaaaaagaaaagaaaagaaaagaaggagggagggaaattagacttccctcgggcggctagggcgcggcccgagagaatggggcggctcggccgagcttaatgggccggctggcccaagaaggcggcccaaggcgcaca

SEQ ID NO: 36856 - DNA, 1501 bp, Oryza sativa
ttgaggtgctccaaagagccggatctcaattaaccccttgccttacttgtgcaaagaacccagaagaagtccaaggctttcaattcaacactcctaggtcattttctagaatttgagtgatcaccaagatccaactcacaaatccttctagaaaagaccacaagtgcaagttgctctaactaggagaacctctaaaaactcagcacaagaatccttaatcacttacctcgtttccttgtggaggtgaggaaaaccttcacaaactttcccgggacatccacaagattttagaagctcgcgggcgacacctatccatctaggagaagatctccaagagtaataagccccaagtgatagcccacaagatatccaaagtgctcaaccacacctagtcttcaaagcttctccaaatcactcctacactctcatctattctcacaatctcacaagaaatgctctaaattttgagtggagaaagccaagggatcttgggagaggctagaacaaccgtaggggatgaaaaaactaaagtggaatagccaaaaggtgagctgggtgcgatctggatatatataacggctaggtgacgtcacctcgccgttactcacatttttgaactggaggaagtccggaagttcctgaccctcggaacttccggccaacacttaggcaaaattcatccagtgcagggtccggaagttccaggtccagagaacggaacttccagccagccttctctgtccggtctggacccatttgcaaaaatggctcccaaaaatattctatcattaggaacccactaagatcactttttatatctcagaaccccacttggaacccctcttaatagtacggattttcctaaaactcgatttcaaaaaataaactatcttattgaccttcgagcttcaaatccgcataaatgaagtttgtagggggggtctccaagcatttcttgatcacctaagatcacctcgggactaattacctgagtatctcaataaacacattagtcccttaaccttattcatcattaatcaccaaaacccactagaaggataaatgcaacttcatggttgaaattggaacgatatgacggaaaaattggaagtttgtgtgtgtaggaaagttttgatgtgatggaaaagttgaaagtttgaagaaaaaatttagaactaaactcggctttaattagaaaacatttggaattagtagtacatgtcaaatgagtagagagagagagagagagcaacaagttgcggtggttgtgctaacaccagtgcaagtgaggggaagggacgcgcaaaaacaagcaagataccatgagagagcgtttccatatacagcaaccagtagctttggggtcagggaaaaggtgcaggctaacacacaacacaatctcctcttgtaccacagttgtgattggtctacattatttcaccgtacccataccatgcattcgcatgcatgcatggcacacccaatcacagaatacaagaga

SEQ ID NO: 36857 - DNA, 314 bp, Oryza sativa
taaaactaccctcaattatttttgataagacgtagtctgcatgagaatttctcatttactcaagcgtcccctgggtatatataagggttatgacacaccaagggatcctattttatgatacggggattggcctgcaacagttgattagttagtaattctcttagttcttttgtcgcatatccaatttctaacagtggaaggtgctccatgctatgagtttctatatacacagaaaatcattgctttatagctccgttgtgctcaatgctatgagtttttctggatagacttataatggagctatcttcttcagg

SEQ ID NO: 36858 - DNA, 1501 bp, Oryza sativa
tgagcagataggtcgagcagatgatatagctagtacttagctggatgaaactggaacaagaacaatagtagtataaatggcatttgtatcactgcatttgcaatgcttgcattgctcgcatctcatctgctcgtctccttccttttatcgcctcgtgccatggccattcaggattcaggattcaggattcaggaaccctgaaacttactactgccacgaatgacaaattaatcactttccacagttctgaactctgaaggtcatcaagactcaagcactactcctatgcggtagatttttttttttttagtttttcttgcttttgatcgaaacagtcaagcaacgcgtgtgtacgagcagtccacatggatcaactaatcactgacaaaaaggttgggagaaaaattgcagagttttgactacgctgtactacccttcacatttaaagttaggctgcatttgttggaattaatgaatgggccttagcccactcgaagattaattctttggaaaatcacaaaagcccacctcatgggatggcatgcatgtggagtttagtaccaccttgcttattctaggagatggggaccttattaaaagggaggatgcctttctagtcacttgaagcatgtgtggtggagagaagaagggaaacacacgtgcgcgctcgctcgcctcgcctggcagggcaggcggcgcgcgtgcacaacgtacgcgtcgaatggtccgaaaaaatggctcctcaccctagcacagatgcaacctccttttgcagttttgttttgctgcaaattcggattcgtttttgttttggaaacgttccgaaaaatcccgtggcgtgcaaacggcgtggagtcccgacctgccgtcttcacccagcacacgaaaaatcaatctagggtttgcctcctactctgtattgcgccgtcgctcgtagactactccatcccaacgttccgaaaaatccggtgcgtgcaaacggcgtggagtcccgacctgccgtcttcacgcagcacacgaaaaatcaatctagggtttgcctcctactctgtactgcgccgtcgctcgtagactactccatcccgctcgccggcgtgcaccagcgatcgggagagcaggtctccggaacctctgtctttgacgtcctgcaccgggagaaggcggcaataaggtttttgggaagcgcttcgcgcgactgctccctgttcgttcgcgacggctcgccttcctcttcgctcgcgtgtttcgtgccttcgtagacacctgcgaaaagtttcgaccaagcagccggtcttttcgtcacctcggtacgtgttcaatatgttgcgcatatttgatctgttcatgttatactgtgtagtttacatgtgtagatctaatgatgcgttcatgctagttttcatctgtaatgtcatgatttatttatggaatagattaaatcattatatgtctataatctcaacaatccaaaaaccttattataggcactgtgattttacta

SEQ ID NO: 36859 - DNA, 283 bp, Oryza sativa
tccaacttttctatcacattatttcaattttaaccaaacttttaattttgaagtgaaataatcacacctcaattcaagaacagagtgcaacacatttgcgtcccaaacaccgccaccctcgcctccagtcaccgtgctgctcgtttttcacacggaaccggataaactaaggtcctgagaagaaaccccccgagtcccctggacggcgcatcccacattcccacacaccatggcgaagaacaacacgctcatcgcggctgcgctgctgctgctagtggcagcc

SEQ ID NO: 36860 - DNA, 1501 bp, Oryza sativa
actcgacgctaacctttgggggtacgttacagaatcgactaaaagccaagtaaacgacaaagccgcagccattaccgtattattgtttggatcacataaccgtcacacgattatccttgactggctctggtactaaattggcattatatggactgtttcacctatctaactaatcataatatcaagaaacatatttagtggcaattctaacctatacgagttgtttaaagtatattatccactcaagggcattaatgtctttgtttgtacgtattcaacgctgaccttcagggctacattacaaaatcgattgaaagcctatgaaacgacaaagccacgacagttaccgtattattgtttagatcacgtaaccgtcgtacgattatccttggctagatccggcacaaaattggcattaatatcgaccgtttcacttatccaaatagaaaagaaaacatttaagaaacacatgcagatatttttccaacctttccaactacaaccaatatgatcaacgagcggtgacactctctccaaacaaaaaccagcgacacttttgctcaaccggttagccctaaccaaagcgcataagtggtccccggtcctcgcgctagttttacccgtacaaatcttgactatacaaatcttctttgatcttcaaactaagattcatggccacatagagatgctaacaacaagatgaggaggagtgatggatggagttggaatgatgatagatgcaatgtggtctagtgtggtcacaatgaggaaaatgttgggtgtgaggatggtgtggggggtgcacatagggacaagggagttctggtgggtttgtcaaggctgcaagggacagagttccacccctgatagtggttgggttggagtcccaaacccacacgagcggcctctgaaacccaaaaaaaaaaaaagattcataaaaacaccccaagagaagaacagagatagaaatgaaaagaacacaagacaggaacaacaccatctctcttttccaacccttttgccatcgtcctcaaagtaagtgaaacccctccccacacaaaaaccaaatcctctcacatgaagataaaaaagaagaaccaccctaaccaaaccaaaacaattcagttcagagagagagagataagcacaatacagatagacataaatagagatatacacaaagattgttttttctttcaacaataaaaaaaactctacttttcttttaaggaggcctgtggcatttatgcatttctgttttgtttttgttggttgggagagtcgaagccaaagcccccctctcctctcttattcctatattagccccccctaccccattttgccgttcgctgcagaagcaacaacaccaacaaagctatagctgtctctttccttgcatctcctctcctcttctcttctcttatataggccaccgcgaggtcggtctccatccatccatccattccagcatttcttgaagcttgctgtggatcagagagga

SEQ ID NO: 36861 - DNA, 1501 bp, Oryza sativa
gatggcgatgacggcggggcggtttggagtggagcggcgacacgggcagcagacgcggggcaggtgcgacaggcactgatggcagcggcgactggccggtcggccaccacggcgcgcgcgcgcgcgcgggcggcgcggcgatttgggcggcatcggcgggaacgacagcgagagcggagagggaggagggctcggcgcggctcacgggcagagcggggagagagagagagagagagagagagccggggagggagggggagatgggccgagagggattcggcccatcgaacccgagggaggcgaatcagacttttgcggagggattgatttgggaaggatttggattcaggattgaacttgacgatagatcggggatttgagatctgagatggcacggacactagacaacaagcaaagaaacggatttcgcaaatagggtttttaagagagagttttcccgctagacgccacgacggaacgggcgctacaagataggtggggcctgggatgaactacccgttatctgtagccgatggatgtggatgaaaccgagttatgacgattattcaagggacagatgaataaattaaatagaaatattaaaaagttgatttaaggaagttttctaaaaatgctgatgaataattttttttaattacaccgtttagtagtttaggataattaatctataattcataatccccataagccaaaaataaaatgcgatctaatagtaagttgttcagttgtttagagaacacacacaaaaaaaaatcatactaaaagttgagttatacggtttgagctagttccctcgaaaccatactaaaactattcaaatccaagtaacgtgagtagattagtgcttacaccaatacatccatttcaagatccatataacaaataaaaaggtatagcctctaaattataaagtttatttaaattttaaaaacgtgcctatccctaacgaacacgtggccagataccctgacaaaattcaccagtactcctaatccacgccaccgcaaagtctccaccgagagagggaacatgtcctgaccatacggaagcgcgaacgaacgggcctctcaagattcgttccagagcccattcacaccaggaccggcccagttagaacgcgctgccaaccgtcaaccgacctgcttctatggaaacccgggctcggcgcgcgcgtcgcgccagcgtagattgcttttgccagcgcgtcgcgccgaggcaactcactgtcactggcaaggcaccacgcgcgcggcgcgccagttcgtccagcttttctaggaggccggcaccgggtggagaggaacacaagaggattagcttctatcctacgaccgtctcgccacgtcggagccaaggaaattcgcctccccacgtgacatcacggacgaattgtattagcggtggttcgtgtcatgtgcggaatcatcgctgacctggccccggtaggcgctatctctttcctgccctcccctgccaacct

SEQ ID NO: 36862 - DNA, 1501 bp, Oryza sativa
caaggttacagaaaacatgatgccaaaccttacgttattttttctccgaaaatcccatgaaatgagttgttacataagaatattctcaaaggatttggtagaagtcaatccttccaaacgaccaagtaggaatattactttctatacgatgttaatcctcaagattccctttgttttttcttttgttccaaagaagatctaaatcagtcgaaaacaaccaggaaaaccccctaacattttcattttcattttttttaaaacggaatcggaacggtagacccgaaaacggtaacgatattggtaatatattgtcggtgacatgggaccgggagtatcatgacttagagacttgaggcagacacgatcacccacgtggcctaaccccctcgggggggggggggtcgggcccgagggtgatacggccgcccttctctttgtctccccgaggggtcggaccgttcccgtctcggccccgagggccgaggcgccccgaccccttgtgggttttgcgccgcgtatatggggtaggtgagcatagcggggcatacctaaccacatttattgcggtttggacgagcgcgtcacgccgcatgtaacgcagtgcagcgcgctcgtttatccggtctgtgaccagtcacagactgatcagatcgtgggttaggtggcgacaggcggtctgacgcacgcctcgccccatcccgtcaggatgagagcctccaagcactcgtccctagccggagccggcgtgttaactcctggagatggcacgttggtcccggtcagatatataccaggcttcatcctaaccattacaagcaagacattgtatgaagaggggcgaacatgcagattgataaactgacgcgtggtgggcaagaatgaccgatttgtgaccggtctgacactgatcatgtcatcagcagacagccatgttcccactcgcgcctgcttccggcggaagtggaggtaggtatgggctgtcccatcagaaggtcattcggacggcaaccatacaagtctccgtctgtttatgaaaagataggataagtccccacaaaaaagagagagatggtgcatgtggtatccccttgaggtataaaaggaggaccttgcccacttagaagggggatggatttttggatccagaacgatcagagagggagagagtaagagctctctggttctccagctcttttgtagcttcttcatacatagatccacaaaaacacaggagtagggtattacgcttctcagcggcccgaacctgtatacatcgcccgtgtcttgtgtgtttccattctcgcgaaccttccacacacagactaggagcttagaatctcacccaggacccccggccgaaccggcaaaggggggcctgcgcggtctcccggtgaggagccccacgctccgtcatctggcgcgccaggtagggggctttgcgtgtgtttttctaagctctcgcattctttcgtgtgcgccaagcttttcctgttcagcccaa

SEQ ID NO: 36863 - DNA, 810 bp, Oryza sativa
aaagtttggaactaaataaaaccttggtgtggttttggcccgaaggagtagtaggtcctggtttagttcctaactttttctttaaactttcaactttttcatcacatcaaaactttcctacacacataaactttcaactttttcgtcatatcgttccaattttaaccaaacttctaattttgatgtgaactaaacacaccctacaactgaagcttcacacgaatttatcacccaagaacagtaatgctgctgatgcgattaggaaaggtaatctgcaagatttaaagacttgtgtttcttgagaacggggtatataaaactacccaaccgattgaaaccgattgaaacgattttatgcttgtctgaggcacgctgatcatgttatttgcccaaagtttcaatcggtcgtaacataatttcagtttgggactacaaaagccgaacgccatgtacagtttggtcggtggatcggtgcgcacgaagaatagtcgggcaccgtcaatttttcccctcagtataactgtaacccaaaactgattatccaaattggtcatggaatgatggaatcatcgggcatcaaaaatccctcgactggtatatactctatacgacgtcacggctgacgccttaaaggcaataataataatacattgatccgatgatccccatctatcactcacctatacagcccaggcgcatcgtactatcatagtaccacaagtctacaggcagcccaaacagcccaactcccagcacgcgcgcgggagctgcaatgggctaaaggccacaagaccgcaaggcacaggccca

SEQ ID NO: 36864 - DNA, 1501 bp, Oryza sativa
tcgtgcccaatgtttgactatccgtcttaaaaaattatgaaaaaattaaaaatatttagtcacacgtaaaatactattcatgttttatcatctaatagcaataaaaatactaatcataaaaattttcaaataagacgaacggttaaacattgaacatgaatagtgtaaaactgcacttattttgggacggatggagtaagtccttgttaatcccttttgtttaggtgatctgatgtgacgcgtattatcaactgaattggcattacgcttaattaatactcctactacttcaacatttgaagattggtctagtgacaatatatatttttttttcatccattcatcggagtcatctagtgtacacgtaagatcagcctctgccctcttgtgtggccggtgtaataaactttgctcactccggatccggtaatttagtttgtaactgttcaaatgattatagtgttagtagcacatgtggagtattataagtagtctcatcaatctatagtcttatagtgaccataaaagggcaacatctttctctctttaaatcgatttaaagtcgtatgtgtgtgtgtgtttttttttaaaaaaagcgagaggttcattttcccatccatccatacctatatatatactccctccattctgtattataagtcgtgtaacttttttttactagtcaaactttattaagtttgaccaagtttatagaaaaatttagtaacatctaaaatattaatttagttttattaaatctaacattgaatatattttgataatatgtttattttgtactgaaaatactactatatttttctatagttaaaaaagtttgactagaaaaaagtcaaatgacttataatatgaaacggatggagtatttatctacctatctatctatctatctattatttcatccgttaaaaaaaattcaaatcctaactaggaatctagatatgtgtttgtctaaattcatagtcatatttgattctttatagtaaggagtgtgtacgtcgataggacagatgataaagattcatcatgttcgctttagaagcttggtttcattgaagaaagagaaagattcacgatattgatttacaaacatttgcaaagtttttggctatcattgaaaatcacacatggctaaggctaaacttttggtgccatgcaatgtgcaaatttagttgttatatgtggttttactttagttttatctaagtttaatttttttcatgtaaatttgtaattttttacaagtttatttcatgcaatcttatacattttttatattagaatagtttattgtccagtagttggatatgatgtgataagtaataagttaataggtcagttatgagaatcattaaattatcatctaagggatgggaaaaaaaattaaaatttcatcgtaggcctaggttacaagaacaaatttaattaattgacataaatgtacacaatcattcctagaattgttgataaaaaaaatttaaga

SEQ ID NO: 36865 - DNA, 1501 bp, Oryza sativa
  unsure (1)..(1501): unsure at all n locations
aatttttaaataatcgagaaagtttgtgaatggatggaagcattctttgtcctgcctgcatcaaagttatgctgaggtgaagtgaacgcacggcatgttgaagttgaactaatccagatcaataattttcgaaaaaaaaatccagatcaataatggcgggtctcaaaatcgagctgttcatatatgcagaggaccatggccaccgtcgagcaggtctaggcgtgtagccgatcgaagatttcgtctctttatatgacagaaatttccatgcggcgccgagcgctccgcgttatatgctaggaagataatcacaacagctatgaacaggtctgtgtatatatccggccgtttgcaaagcatatatacgaacacgttttttttttttgggaaacatatacgaacacacttgcttaacaaatcatgggaactagaagatgcactcattcgagagttagagaaaggctaataatacagccgacctattggctacaaggttctttgtagcttttttttagcctacccatataatagttagctctttacaattaatacatagcccacttgtctctctcataaagttttttggttcttatgtccaagccggatgtaagtttatagcccgcttctcctctctctctcctctcttctctccttcactttagcatttagccggcttatagcctactattatacttgctctcacagcagatatgtcacgccccgaactagtcccgaccggaactagcccgtgacgctccaaattaacctgttaatcgataccagtcccaggaaacagtgctggtatcacaggaagacagaatatcacagcaacagaggtctctttattatagagtaggagtacagtcatgttaggctgcggacagatcccgagctcacacntgcatnacaaagggaaccgaaagccaagacttggaccaaacatcacaggcgcgacttgggaactaggccgaaaccctaaaactcatcgtagccggcttgctcctggaagaactcctcgtcagcgggatccgcttcatcttcttcagcaactgggggggattatttatatagagcaagggtgagtacgggagtactcagcaagccatgggaaataagtgtttaatgcaggcttcaaggaaaggttgttgtttttgtgattgattttatttaaactcttttctgaaacaactaagggagtgcttctcaaacgacacggatgagacagtgcgtctcgtccggtcggagtatgtgcaatgtatcagtcttttgaatcgatcaaggttggcacccggccaacagctttcaaacggccacccgagcctggctgatcccatcagccgcagattttccaaacatcaaacccattccacaacagcaaatttcacaaggcagtagtcaaacaaaactacgctaggaatcacctcacatctgcccatgaccgtgggcacggctgttcgaacagttttaataacctctgcagagggggtacactttacccaca

SEQ ID NO: 36866 - DNA, 1501 bp, Oryza sativa
cgccgccgtcgagcatcccccggcgaatccgagccattggctcgtctcccctcgtcctgtgcaacatcccggtgtgctcgccttcgcctgtatcgccatggttcgctccgccgcttgccgctgtcgtccgctatccgttccggccggcgtcgtcgtctacctcccgccggcccgcgtggcagccacgtaggcgccacgtcggcaccacctcggccgcgaccgggtcaagcagaccccggtccgccgcttccctccgccccctcgcgcgtgcggtccaccgcgagccgagaggctgcgcgtgggcccgccgcaccacgtcctccgcgaaccgcgcgcatgcgccgcgcctctctccccaaaccctagcacgccccgcgtgcacctcgctcacggtgagccgagtcgccgacaagcgggtcccacacgggaccacgcgggatggacccggcctaccggctctctctctcccctcccagcccgcatgtgcgccttgggccgccttcttgggccagccggcccattaagctcggccgagccgccccattctctcgggccgcgccctagccgcccgagggaagtctaatttccctccctccttcttttcttttcttttctttttcaaaaaggatttaaataaatccttttcctttagaccaaaaatccaatattcttagaaattcaatatcttcccaaccgtaaatccgtttgactccattcaacttccaaaattcctcaaatctcgagatctatctaatggcacgcttagaggtcaataatagggatttaatttcgccgtttgctgagttgtcccatttcgcgtgtagtttcggagcccgaagacccgcagtgcgaggatttcgaggatcaagctcaagatctcgagcgaggcaagccacctttgaacatcttgagcctatattcgaacttaattatgttgcttgaaaaatattatgcattgataggatcgcacttagtctgcttgtcccgtctgcaaggcagattggcggacctacctaatttgttgcatttgacccttccattgtaattgttataccatgttcccttgtacccacctagttgcgcctcggtaatcgtgcactctgcacgggtatcgacggtcaccttcaaacttaaaatctgagaaacatcttgggtaaaacttgggttttacaaaagacttggaaaacccgacacctgggtcggtgcttgcgaactaaatgaatttccaaaaccgcggaccggggaacgtaccgggtgtacggtttcccgctcttgcacttaaggaccgtttccttggaatttcatccgaacataagacaagtacgaccacatgggtggaatgggacacccctggctgagtaactagcttatcgggggagccatgatgctaagagacatgtggattcgccagggtggtgtcggggaggacccctgggcttcctggcacagtatggtctgggacctaatctggtgttggtctgggacccctctcgttggcata

SEQ ID NO: 36867 - DNA, 328 bp, Oryza sativa
tggaatgggtttgatgtttggaaaatctgcggctgatgggatcagccaggccccgggtggccgtttgaaagctgttggccgggtgccaatcttgatcaatttaaaagactgaaacattgcacatactccgaccggacgagacgcactgtctcatccgtgtcgtttgagaagcactcccttagttgtttcagaaaagagtttaaataaaatcaatcgcaaaaaaaaaatagcggcctttccttgaagcctgcattaaacacttatttcccatggcttgctgagtactcctgtactcacccttactctatataaataatcccccctcagt

SEQ ID NO: 36868 - DNA, 223 bp, Oryza sativa
catttcttgatgatggaacatataatggccaacatgtcaatcaatagcaggccccaaaggtagcaattgagaactgatcgagcttccaagaaattaaggtaggctatatggaccaatatattgcttgactgatagcaccgcttctccattcaggcatccactctgaccagctagcccattgagcaaaggcgagcaaacacattggttttatgatggcagcagt

SEQ ID NO: 36869 - DNA, 296 bp, Oryza sativa
aattcgagctcggtacccctccttccatatataaggggggtccgggtgcctctaggggcggatgttgattttctccaaatcatacaatcaataatacactcggcggattcatccccggacaggagtagggtattacttcttgaataagaaggcctgaacctgtataaatcctttgtctccaaacccatacacttttctagcttgatagccacccccttttattattgccgaaatctagtttcgacagttggcgcgccaggtaggggtagcgtcaagcttttcgccgatcagtgcaa

SEQ ID NO: 36870 - DNA, 693 bp, Oryza sativa
agttgtcatctaggctttcgtcgaagtcgtcgagatccgggtcgttgtagagagagctgaactcgtcgtattccacgatgtcggtggggcgcgagtcgacggtgggagagctgtagtagccatccagctgatccgtcgaaaccgtgccgagtggttggaggatgacgccgacttccctgaagctaggcgagatcggtgttgaagccgacttccgcctaggcctacgggatggagacgctgtcgtgatggagatggccgccaaatcatcggggagcttcatcaagaccggtgggtaagccccatcatcttgatctggtgtcgttggagaagatgcgatctcgcccgagtggtttgaagccgactcgattgagatggtcttggggtaacttttagccgcgtttgggagtccaaacgggactgaaatccggttctctcccgactggtttgaccccgagtcaaggagagagatcttgccgaagttgttggtgacgaagtcgaggctgccgaaccgaaacgtctgcccgggtgggaagacgaggtcgtcgatgccggagacggaacccattgcactgatcggcgaaaagcttgacgctacccctacctggcgcgccaactgtcgaaactagatttcggcaataataaaagggggtggctatcaagctagaaaagtgtatgggtttggagacaaaggat

SEQ ID NO: 36871 - DNA, 1183 bp, Oryza sativa
gcgtgcagaatgttgtgatagccttttttgtttcacttcactctgtttttttaaaatgcgttgttagaatgtgggttttattcttagtaacttctaattttatagttgggtgctctccaaaatatcccctgttagtgcaacttgtgctaatgtaacttatctaactcaactcagcttgcgctaatgtagctattctaaatcaagtcacgtagttcaactaaaatgtttggtaggtgttatacccaggacatgtatatagcggagatatgcagctaaagttttatgaaaacacatgccacttgagttgaattagactcatataataggtggatcctccacggttttccccaagctgcaatctcttagacacgtcaaacaaaaggggtgaattttgcgatgccaatgctcacttgtcagttcatgatgatatttcgattttctcatgaagtatatgttgtagggtttcccaaaccgccggccggggttaccatgccacggtaagtatggttaccgcgataactgtggaaaaccgtacaaaaccatacaaaatttattaaaattaaaattatttttaaaatttatttgaatttaaggaggttaccgtggtttttctattatcgtaccctgcggtaaccgcaaaaaccgcgcggttaccgacgtaatgcaaaccctgatatgtgttgtactccatatgaatgttgtcaaagtcgtgagtattgaattgctcctattacgctctagctctaaaataaaaatacgtcaaagattcaaaccctgtttctaatacaattctgatacagcacattcagtgacacgcacgattagaatatactccctccgtgtcatattacaaatcatttggttttttctagtcaaactttggtaagtttgaccaaatttatagaaaaaattagtaacatctaaaatatcaaattagtttcattaaatatcttatattaaatttattttgataatatatttattttatactaatatttttttataaactttgttcaatttaaagaagtttaatttgaaaaaaaatcaaacgaattataatatgaaacttataatatggaggggagggagctgattaaaaaaacaaaattaggattccgcgtagccacgtgtttgtatatataagcacgccttgtgaggcgacacgaagacgtagacacgtggt

SEQ ID NO: 36872 - DNA, 1330 bp, Oryza sativa
aaagtattgaccttaataagagatgcacgccacctaatccacctgaccactgacagaattacttggaaaaactagtaacagtactgtgaacgttagcatttatcactgaatggaaagaaggaaaaaattgccatcttaaagaatgagtatgtggttttgtctattcaacttcatttatgttgcataactcatgattgcttggacttcatgctttgcttataataacagaatcagtagaagaaaattagtcacagaaaaaaagaatggattatgaaaaagaaaggttaaggatgactggagaagttgcaaagacatccttatcagtagcacaaacattctatagcaaacctacgataaagcaatccatgaaaccactcatggaaaatctagtcgtaattacaacttaatataagtccagaaactaaagtatgccacattaataaaatattaaatatatatgaatcaaaactaatcaaggactatagccctaaaagataaccagcaattcgtgctatactggtcctaatctttgcaatgtgagtttcactcatgatccacatccagggtatgaaattgattgtttagatacatgcttgccaattcggtagattaggtcaagcttgtgaagggagggctaagaggaggatctttgtcattgtctcctgtagtatgtgcgcgactgcaaataatttttgttaaccttttagctgcttttgtgggaatttgccttgttgatcacttttggtatatccagttttgttctacagtaatatacctgaaattctgaacctgccttgctgttagcttcaacaggttgctaagcattaaacagtggagctgtatttgtttatattcatttaatttgaaccatcgggaaaagggaactgctatatctgcctgtgctcatagaattttttgattgtgctgtctgtttatatagaccttgtatgtgtttactcttgattttgttttctgaaatatgcacaacaagaccttgaccaggaaaaaacgttgccctggttctccagtcctagtattcacttttttggacaattttgtttgatgtgtttttccagagttccaagcattagcatgtaacaacatgcacaatccaccaaataaaatggaaattacttaacatttcttagatgttcccaatttttaatcatcaattggaaccccagaaacggcaaacaatccaaacaagcaagaataggcaacaaattcatctcgaatgctaatgctggaatcagtacaggtaaaaaataaaaataccctaatttcagccaagcaagcgaaaccgtactgatcaagattataggcgatatca

SEQ ID NO: 36873 - DNA, 1501 bp, Oryza sativa
tagatactagttgaatgcctatgctttgctacggataaaagaaaatatattataatattttctaaaataaataaaaatatcctcgcaaaataaataaataaataaataatatatttttcatgaaatgtgtaccaatttagattttattgtgttttatatgtagttatccatttagagttgattgtgttttcatattttaaaagttcagggataatttataaaatttacaattggagtatgtagagtgacaaatctactatcaccaccactatcttttcctttaaggatgtatataaaattgcacgattttttatgcaatatgtctgttaacagtgaaatttggtaagcccaaagttaccatcggcttagagtcagtatcggcttcaaagttctagaatcggccgatgagagtcaagtcgccacgatgtcgtgttcttggtggagtcggatcagtcaaaggaagcttatctagaagagtctgagttcaagaaggatgcgatatgacagtttatctattaattaggcatagtttgttagtttccttttatctttaggaaagtgtgtttagtgtccaataaggactttatcttttcctttttagtttctagctttcttgtccgacaaggactagtatctccctatgggtataaatatgtacacccggggtcattgtaatctatcttcacgattaatacaattcggcgcatcgccacctcttaccttttctgctttattttatcgtccggcaggacttggaacctgatgcggggctgcatcggtgttcgatctccggcgaaggggtaagtccaatgttccgtcggcccaggcaattgtatcgtctacgtcggcatcgttcaaggctacatcagtacattcgacctcttggattgctctagtttggatgatatatttgcctacctatttatcatatgtctttgttaatctatatcaatttagctctatcggctgcttctcgttttagggtttatgccggtatcggctaaatcgcattgctagattagattagcctaggcatctaccaccctgaaaactcagtcaacagcttgattgtctagatattatgtttcttttcatacttagtgctgcatcagttaagtttgatctactaagtcgagcttagaaccataatctctagccagcttcttgattgccaataagggtttcatcggggtttcaaccgatgagttatttggacgttgcatcggctcataaggattgcatatacatataagttggatttagccgatgacaacaaaggtttcactgtttaatctaatcttgtggatttcatgacatcggatctacagccgatgtgtgctttaaccttcggatcgatgcttatttatcatatcattgctagccgattggtttatactggactatattgttatttcattacatcgtcatcagtcgattgcctttatatcattatctacattagacattaagccgattgcttaaaccctatcgctatcggctg

SEQ ID NO: 36874 - DNA, 1501 bp, Oryza sativa
ccaaacatggctggcgtaatgcaaagcaccgtcacagtgctacacacacgacgcagcacacgggggtttgccggcaagcctctccgcgcaacccacctacgcccatgggaaaaccggccctgaaatcccctcgattattcccctatatatcgggctccgccggagagttccctctccggccaatataaatatcatcccatcggggtggcgcacacacgcggcaccggcaacaccgcgggacgaacgcaagccgcgggtgcacggacaattgccggcggccaacccacccctcgttttttaccccgtcgcggcgcttggctcgcgacttgaccgggcccagttgtgtgacacgatggaatttttgcctgaccccgacggctcaaagcgccgccttagacgaaacccagatggggtgctcgatcgatcggccccctttgtcgctgctccccaaccctaccctccgaagccggagttacagacctgcgctactaggcccggcgatcggagatgcgaagggcgcgcgctttatcgtcagcggcttccgatcgaaatggcgaggtgggacaaaaatgtagcggctgctactcgatcgagccaatcgggttcaaacttccgcggcttgatcatgccgctgtataagtctgcaacgctaagagccatggccattagggcagtcccaacccatagtgtccatatgtagtgtctatagtgccatgtcaataagacatcacaatagaaactacactctacaacccgtggtttcttaaagtgggccattaataaatacatcatctctcttctctaccaatcatatttattcttcatctattatgaagacactattctctcccaatgtaaaacttgatagtgtctaatgcataggttctcatgttgaagctgtgtcttgtatgagacccagtttcttcctctcttcactctctcttaattaaactagtgccacataagctaaaagtcctacatggcaatatatgctatagataccatcctagatggagggttgggactgcccttacttatttacttccaccagggtgatgaaatcggaatgcaagctagcgtgggattcccatgcatgtgctctagtttaggcagcgtcatgtgttcatatttcatcagtcgtatgggacacagaccgaaccacaggtttcagcctttcaaggcgcaaaatattggaatccaacgctgcaccaatgaacacggtcagttgctctaccagtccaccttatctaattacagaaaaactacctaacggcatcccgtggagacggaataagtggataaccatccattcttatccattgtctttctgtctctctctccccgatcctcgcttcgtcgtcatcctccgccccactctccctccgtaacttctcttttcgttcctagtaggggttgggacatgattccatggcaagccctttaacaagatcagaattgtccagtatttcatttgctaatgtcgcgtcgccgacggtggcca

SEQ ID NO: 36875 - DNA, 220 bp, Oryza sativa
caagaagcaattaattcattcaccatatgacaaaaccaatgaacatgcaaccaataagcattaaaatggcttcttgggttcctcaacaatttaatttagcacataatgactacaaataggagttagacttttggaaaaaccaaagaatgaaataggtcttagacttttggaaggagggagtatcacattgagggatttttccatatatatattgggtttg

SEQ ID NO: 36876 - DNA, 277 bp, Oryza sativa
ttattgaatcagaaggttaagtagaaacataaattaatgaaatatagatgtctccttagtgagctgcgctgaataataaaataatagcaaaaggtaaagaaacattacacgccttcaaaatcctagccatctcagatgcttgaaattccaagatatcagctttcgtaggcagcagaacttagcatttgagaagcatatctagccatcataggtgaattttatcgtgccctgcatttagttgtatttggagtataattttgaattgacatgatgttgt

SEQ ID NO: 36877 - DNA, 1501 bp, Oryza sativa
ttcttgcatgttatctaaaaagtatttatttttttaaaataagatatatctaataaatatgcaagtttaaattcgacttctataagttataaaaaaatagcaaatatagttgtaaattacacatagtactagttttaatttaatttgttcattttattataacatgtagaaatcgaatttaacattgtatattcatggaggagtgatatatctcacgttaatctatctcaatcaattattttttaaaaaattctataatatatatttatgcgacatgcatgtaagaaaaaagctctcgagatccgaaaatcccatatgctatgtttggcagccatacaaactacaattacaaaatcgatgcaagttgactatgtaaaatatcagccgcacacgcccataatatacaacttcttccatgttccaacacacacatcatggaataagatggacatggcaagccccgaaagctaaacccacaagagcacgtaaaagaagaggttaaatgatatcttccaaaaaaagagctctatatatatttctttgttctgttttttctccatctctattaatatacgaggtaaagcttttgccctctttaaaaaaaaaaaggaagaagacggaacaggggcaaaagtaagcggtcattgcatgagagcaaagttttttttccccccggggaacaaagagtttcttccatcaaaaaaggagctcaaaggttcttggtaggcaaatcgttgtctaagacccaaagctgcagcggcaggtttgttgatgtgcatgcttgaccaaaccgcaatattggtgagtactcgtgtctaaacctgattaaatttattgggagccaatgtcacactagaacatcaatcttgaacacttctcaaacgtgcaaccatgggaaaaggtgataaggaaggaatactgaatcctgttttatgatgtgaacaaagtggcatcaaaggaatctccggtatccatatatagagccatagaggtacaaactgcgtacacttcgattgacctcataacaccagttgaaattgatggcgattatttcagtctaataatttttatttatgtctttgcggcctttgttatgatgagggaccaatagatagggcccaaggtggcaggagagctaaaaagacaaggccggtacagccgacgtactcatcggcctaacagctgcacaaacaaattaaaatagaataagttcactttaggtcccttaatttgccgccgagtctaagatttgtccctaaccaaaataccaaatacaacaggttcctcaatttacaaaaccggatcatctaagatcctagacaatattatacccgattttagctgacgtggcaagccgagtcagcatggacccacatgtcagtgtctagtattctcttctcctctctcttctctctcccctctcccctctctctcatctcttcccacctaggtcacaaggacgggcggcggccggcctagcgcgctcacacgcaacggtttc

SEQ ID NO: 36878 - DNA, 239 bp, Oryza sativa
ggcgtggagctagtcggccgccttgtgcgccgccgcctccgcgcgctcctcgcggtttttctgcatggacgccattgatcagatgatcttggtatgcgtcaaagctaatcaaatcctctgggttggaaatcgattcgagcttgcttcgctctctgcttcttggaggatgaagaggaggaggggggtgggggataaaaaggagggcggcgagaggatcggaggaatcctctggagatgga

SEQ ID NO: 36879 - DNA, 1501 bp, Oryza sativa
gtggaacccctctcttttgccacaacttcgtagggaacacccattttgcgttcatctccagccatccattggtcaatgcgagcacaccaactacacttggtgtctctcatgcttgatctccatcacccttttgcatcggcccgtgcatagagctttggctgacacctgactcatacaaatagctccatcatgtcctgcttgcctatttgctgagctccagtcaccgcctacctcatgcgagtccattctgcagtggcattagcttgtagctgttgcccctagcttgttgaattctagctgccatctaagtaagcaaggtgttggtgcaatagattagttgctagagtacccgtgggcacatgatggagatcgagcgtagaggcattatcgacaactactggcgagatttggaggtgacaaaggataagggagaggaataacatgaggaaaggctgtatatgggtgcaaattcaatatttctaatgaagttacatcccattcagcttaaactatttttagggtaaacgtgtgtacaatgcacgaccctcaactcattagcaaatagaagtaagtagttttgagaaagcttgttccacctcttgacatgctatagcaatagatatgataggtcaaatagtgtgcgatggattataggctgattttgattagaaaggcttagatcggacaataggactagctagctaattagagagaaaatgttcatgacttttgtagcgtgcattgtagttacacacttacatgtatcgttatgctacgagcaatggcttttcttttatctctatttgctgtgttactctcgagttttagtttcacgccaatattcgtgcttccactctagaataataggacaatatttgttttgagcaaatacaattaaatgtcatttttggtatacgggaaatgcacataagtacaaaccacctatgcctatttgtcattgtcaccaatatcaattcaattagaatgacaatgtagaagtgctaaattatcaaatctcagaaccataaacatatcatgatacatcgaaattgatcatttaattttgtttttttatcgttgttgaaaaaagtgttgtcattttttaaagttatcttagaaaatacttaatcatctgcaagcatttataaaatacttacgagagactgaattcccttcgagctgttagatgacaaagctgactccacaacttttgttctagtagtatatttcttttagtggaaacctaacaattttttttttaaaacaagaacaagcccaattcgttgtacctcaatcaacttggaataagaacatccccgggcccacttgaaagcatcaattttattcatctttctcctccgcaagaaagaaagaaacccggggagcatcgtcgccgtcaacgcgccgtgggcccgggcaaatcccagccgtccgatccagatcgacggccgaataaatgggagaggacgcaggagaaaaagtctccccttccaccatcctc

SEQ ID NO: 36880 - DNA, 1501 bp, Oryza sativa
gacgcgccgtcgtcgtacggcagcgccagccacggcatgtcgctgcacgaccgcaggtacccgtcctcctccttgtccatggggatgtagattatctcaaagtcctcggccttgcccttcaggttgctgtatatggcggccagcttcgcggtgaacttgatgcacggcgcacaccggtgcgccgagaagtagagccctaccgtcttcccgactaggctcgagatgggaacctgcagcccttagccatggtgaggccaacagctggatgcattcatgctttggatcaacggcaatggtaatgcaagctcgatcttgtgccatgcaccgacgctcttaaacttgttagaataattgggctaggcccaacttataatattaaatctcaaaggcccataataaatgttgaggataataataccaccttagaatttaagcgagaaatatctcaacctaaatagggagttattggaggctccctgttgaccagttgaggtgagggtcggaatgccacgcgcgcgcgcgcgccgggccgtgggcgagggcgtggctggctggcggcgtgcgtcacgtcgctatccttttgcagccactaacccacgttcccacgattccctctgcaacactaacccacgttcccacgattccctccgcaacagcgcgtccacgttctttctcctgatagataaggaggccgcgagttcgatccgtcttcttcgcttctttcccggtgttagtttctccttctccgcgcctgagttgctctcgcttcctcgcttctgatctcttgcgcgcacgagagattggaaagagcagtgcctccgaaaccacaccttcgcctgagatctgcaccgggtaggcgggtgagcagtgcctccgaaaccacaccttcgcctgagatctgcaccgggtaggcgggtgatcaggtttttggggagtgcctcccgcacgactgctcgtcgccatgtctggagttgccgccgccactgccagcggaggtggtacgccgcgacaggagctggatccggatccggagctggtgcgccaggaggaggtgccgtgaacgacaacaacaacggaggcaattctgcctcaccatccagcggagggccattctcggggtataatcttctcctcctgctactgttgttagcgctatccatgttcccattgttagcgaactatgtgcgctatgttcttgttcctgttctacatgatgcctctagcatgttatcgcgttactggtatgttcctgtttctgacattcatgatgcgcatagtatgctactggttatgttaagatcaccctacgctgcttatgccatgatcattgtttcaatttcttggattaaaatatgccgattaatgactatattgccaacaatccaaaaacctgataggtcattttcggtagttggctttgctgctgcactgaaaccacatgcttttgatggttcaaactataagagatggaaagcacgtgcactattgtggttgacagcga

SEQ ID NO: 36881 - DNA, 915 bp, Oryza sativa
aatcattttctctcactgacatatgggccccaaatatttattttattattttagctgagtaggatgccacgtcagcaaaaccaggtatctatactgacttgggacctaaattagacggttttgtatagtttaggagtgaagatttctggttttgtggttaagggactttacaaaatcaaatctcactgttaagttgagggacctccgatgaacttattcctagtcaaaatcatgtgagggctgaaaagcccaagaaggccgaatgcctaaatttagctcggccgtgaggggagaacagctcggcacgttctaattcgccgcctcgcctaaccaaaacgcgtccctttcctcgctttcctcccgtttataagcgacgcgtggtggaggcggccggaagcgcccagaaccagaagagaggtctgccccgtggtcaagccgtgccgcgtcgtcgtctccctcgcctttcccctccgctccgcttcgccgatcaaggtgaccttccccttcccttctcttaccccgatcgatctggcttttccgcgtctgaagcacgagagatccttctgtggtgggagttcctcacgcgtttcgtgatctcgccacgagcgaagtggatctcgtaggtattggggggtggtcctgtcgttgatttggagatcgttttgtccgattgggtggtggtgtcgagggtctgggggagtggaaagtggtggtaggttaggttcattcgttattgcctcgacgcgaagatgctggatttttttagggcgaattcaggcgtcagatttggggaatttttagtgttaatagacgttacctgttttgttttgatctaatatgttcatacatcatgggctatgatcccgctattttagttagtgtccgtaaaagaggcatttcgatttcctgctgctt

SEQ ID NO: 36882 - DNA, 618 bp, Oryza sativa
atacttgtctattgttatatgaggaaaatgtgtggagtttaacaaatcataaaaataaatcttattaattttgtgagagtgagtattgttttttatttacaaattgcatctgaggtagacataaaaaatgaaagaagattagacaatgagggaaaaataataaaaaacaagagcggacaaggacatagaaaaaaaagccgaagggatagggcaagaatttgttttattatttaaacaattttaataagtaaatacccgtacgttgcaacaggttaactaaaattataacaaatataaaaataatggatcattaggatttagtttttacgatatgagcccttcaaaaaaaattccttatagaaataaaaaagttgtaaaaaaaaggcccattataccctatcggcctactattgcgcgtccaacacatgaagcgcgtgtggtgttgtggcccaatatggaggccggcccgacgcgggatcgatatgagccattcgttttgatggacggctcagattgattctaaatccatcaacaccctaaccctatccacacctacacccgaccgcgagctccaccttccgctcggctctccccctcccctcccctctcctgaccagc

SEQ ID NO: 36883 - DNA, 959 bp, Oryza sativa
caacggagataaggccaagcaggcgagctggcgagcatattgaaaggaaccgagccggcggggcccaccgaggagataaggacgagagcctgagatccctgattttctttctcgctctctcgtattcctctcctctctctcggtcctctctcgtttttctctcctctctctcggtcttctgtttcgctcactcccctctctctatcggagcggcggagccgaggcggcaggcagcggcgcaagaggggaggcggctggcgacgggtggcggcggcaggtggagacggtgcggcccagcggcgggaggcggcatcagcggcgatggtggcgccctcccctccacggcagcagcgtgcggcggcttcggcagcgtgtggcgggaggagtggcagccgcccggaggcgccatcccttcgccagatccgacgggaggaagggcttcagagccgcgccgccaccaaatgcgccggttgccttgatgctgtccctgccgccggcccgcgtcgagctcgtccacaagcccgacaaccacgccaagcacttctgccgccacacgtcgcctgtaacccgacatgcctcctgctgccttttgtttgccagcaaattcatatatgattgcctttgtttgactttctgtattgccggatcagattgggagggaggaaatacatgggtattaggtttattgtggggatcaaattcatgaggtcgagattaaatttggtattttcgtgttgtttttggttgtctggttgattaattgatttgggaatctatctcggggatttttttttaagacagactcggactcggggagggacggattgcacggacaggtgaaaattcgtgcatatggacgaaaatcatgtgacgaccggaaaaatactaatatttatattatatatatatatatatatatatatatatatatatatatatatatatatatatatatatga

SEQ ID NO: 36884 - DNA, 539 bp, Oryza sativa
gactcacagtcatgagcgctttggtgaagtgtcatgggtatagactctatgttttaaaatgtgaacatgtgactaggtttgaaattgataaaatgtgttgagttgtgtgagtgtgatgatatattatgacttgttgtgaaagatgacatcaagagattgattatgatggaaatatgatgaacttaatgttaaaacttaaaacatgtctttgttaattgaagcataaactcttttacaaaagaattgcgaaacaaaatttgctttatgctaaaattgaactacatattgccttcctttgaatatatgccttacatgtagtatgttaggattgacttgtgcttacatgtttaatgtactgactcttgctgttgatataaccttttgtttgcaggtttagaattagtctttgagtgatacgggtttcgattgcttcttttaggatgagaacttaacgggggtaaacccctagtcggtgtacttgtgattgggtagtcaagcttccgctgttctttaatatttatttggtcggtcggtctaga

SEQ ID NO: 36885 - DNA, 273 bp, Oryza sativa
cggacgatttatttagggtttagggttagagagagttgagtcattacacagcctccctcctctttctttatatagcgacactggtagggctcgggggtttatctcaatctaaaattcgaatctattttgtaccgatcacacaaaacagatttatctcttagtttgtatcttattaggatagaaaaacccgtaggattttaaccatatcctaactaaccggcattagccgataaaatcaaccaacagacaccggcagcggccgcggccgcggca

SEQ ID NO: 36886 - DNA, 1501 bp, Oryza sativa
ttcattgagtttttttgaattgaattcatgaaaataattaccaatttggatatctatgattgagcctgcaaactaaggtaccttggtatattagctctaaaattatgattctcataaattttgaattacaaattatgaaattatatcatatttattttcctgtgctaactatgcactttgaggtagtatgcatgttaatcaaattgctccaaccatgctttaataataacccgtgcaacgcacgggttgacgactagtctatctatctattatatactaaaagtccattaatcttcctacaaacgctcttaagccaccagttggcgctctaataaattagagaaatcaaagaaattctgagaaaaaagaaaagcatctatccgttgattttaaaatagtgggtccactattagaaaccgtcagattaactatattgatcttaaaacgtacaattccacaccatccgtaggtacgtacgtacgtacggttccatctccctccctcctttttcttttcatatatatataatcgagataacagttaatatagttaaattttatataatcataacttatatgattatattatgatatatctcttccaaaataaagtttacaccactatatttttacccattaaataaaggtatacgtgaaccctttatgtggagcattattttcaaataatacactatttaaataaagtttataaagtttatatcgttacattctgtacgcattaaactaacaaagaaatatattaactaatttatacttaaacgtgctattttagactttttaataaaggccggattaattttacgagtctttacaattatttgtaccataaattatatatctatttttatttttcaaataaatatataattttaatatctatattagatttattgcgttctagacctacatccatcttgagtgctccactaaataaaagaaaatattaaaatttgtcattgaaaatcaaaatatgctagctaattttttaatgaaactgttaaacccattaaaagtacattattagacatctaatgactttctaccaacttaattaatttcttcataaaaaaactttattaattcctcacaacatacacctgggggctatttacatatacgaattgatcttgatgcttttgtaaataaatgatattttaaatttaaaagataaataaacgatcttaaaatgatcatagcatctaaatcatacatatgattgctcctagcactcctaaacacttctaagtcgctatgtggcattctattaattacaaaaacactcatataatcgaccatcggtttccacttaaaccgatggacccaatttttataccatcatatctatcttttcggaaaaaacaaattctatcagaatctctgtctggctcactgcataacatgcatgtgtgcgctcctataccttttaaaccggtagaaccattgtttctaacaagtgtttattcatggtacatgacatttta

SEQ ID NO: 36887 - DNA, 177 bp, Oryza sativa
ccccccccccccgcgcgttcgatcgagcgagcgtgatttggttgatgatttttgtgttggggttggggttggactagtccgcgccccgttcgttccgcgggtgttgggagtctagggttgacgtgtgtttgtggtggtgcgcagggtagcagcaggaagagggaggaagggggggca

SEQ ID NO: 36888 - DNA, 1501 bp, Oryza sativa
atagaactgctccatgacatacagctcactgccggcgtcagagactccgaacttggcctcaagtgcatcccacatgtccttcccagaaggcatgtgcatgtacacgtccactatgttgtcagcgagtacactgatcaatgctccacggaacaggcaatccgaagcctcgaacatggcctcttcctcaggaaaaagaggtggttcacttcgtttgccccgtgaaacataaaagcactgcatcgctgtcaaccacaatagtgcacgtgctttccatctcttatagtttgaaccatcaaaagcatgtggtttcagtgcagcagcaaagccaactaccgaaaatgacctatcaggtttttggattgttggcaatatagtcattaatcggcatattttaatccaagaaattgaaacaatgatcatggcataagcagcgtagggtgatcttaacataaccagtagcatactatgcgcatcatgaatgtcagaaacaggaacataccagtaacgcgataacatgctagaggcatcatgtagaacaggaacaagaacatagcgcacatagttcgctaacaatgggaacatggatagcgctaacaacagtagcaggaggagaagattataccccgagaatggccctccgctggatggtgaggcagaattgcctccgttgttgttgtcgttcacggcacctcctcctggcgcaccagctccggatccggatccagctcctgtcgcggcgtaccacctccgctggcagtggcggcggcaactccagacatggcgacgagcagtcgtgcgggaggcactccccaaaaacctgatcacccgcctacccggtgcagatctcaggcgaaggtgtggtttcggaggcactgctcacccgcctacccggtgcagatctcaggcgaaggtgtggtttcggaggcactgctctttccaatctctcgtgcgcgcaagagatcagaagcgaggaagcgagagcaactcaggcgcggagaaggagaaactaacaccgggaaagaagcgaagaagacggatcgaactcgcggcctccttatctatcaggagaaagaacgtggacgcgctgttgcggagggaatcgtgggaacgtgggttagtgttgcagagggaatcgtgggaacgtgggttagtggctgcaaaaggatagcgacgtgacgcacgccgccagccagccacgccctcgcccacggcccggcgcgcgcgcgcgcgtggcattccgaccctcacctcaactggtcaacagggagcctccaataactccctatttaggttgagatatttctcgcttaaattctaaggtggtattattatcctcaacatttattatgggcctttgagatttaatattataagttgggcctagcccaattattctaacaagtttaagagcgtcggtgcatggcacaagatcgagcttgcattaccattgccgttgatccaaagcatgaatgcatccagctgttggcctcaccatggctaa

SEQ ID NO: 36889 - DNA, 1501 bp, Oryza sativa
tgacgaagattatgaggttgaggaggaggaagtggtgtctacaagcgattgatctgcctcgccgcgtagaattttggccatgtaatatataaacctgcgtctaatgctgtttccctgtccctggtcttttggagagatgctgaaatgcactgccagcagtggtatttcccgctgctacgctgactccgatcgatagtgaaactcatctcttggctcttgacccagatggccagaatagcttcatctcttcacgttttgtttattactctctttgttccaaaattagaaacctaataccggattagacatttcataccacgatgaatctggtaaatatctctatccggattcgtaatgctataaaatgtctaatccagtactagattcttacattttaagatgaaaggagtatctatcttctctgttcagattcattctgttaggaaatattctatcacatatgcaaatgagtagcgaaaaatcggaaagagtaaattacatggccgatccttaaacttgagcgaatgtgttacttatgtgcgtaaacttgaaaattacacattgaggtttaggatcttgttttaatgaaccatagctggtccaaagcgcgtttgactagagttgaccaactatgtggcgcttcacgtaggtagcattttgcatccaaccccttctgcatctcgacgtggcggtaattctgttcttacctcttgttgctacagtagtcaccgaaaatctctcaaatcctttgatccctttgcatcccctctcgagatgtgaagggggccagatgtaaaatgctgcctacgtggaatgctacgtatgcggtcagatatggttaaacgttttttggaccgaccatgtttcattaaaacaagatcatgaaccttattgtgcaaattttcagtttacgatcctacgtaacacctctgctcaagtttaagcaccgctcatgcattttactcaatcggaaacattatcttggtcttgtggaaatgagcggagaaagcgtccctttgcctgtatatcgaaacgttggatcgctaatttgtggtatcactcgaaatagcatagaatattaacaaaggaaattgttgtacatacgaactaattatcagagtcacgtgcgactgaatttgatcattagacttatgtacgactgaatttgatcaactgttgtaaacagtacatgtgaacatatactttttgattgatctatggtaacatgtttttagctgtacatgagtttgaacagctagttcgtgtgtatagcagtaccgatgaacaaatttgtatttgggatcgattgatccattctttttactatattcataaaattcactcgctggtgagtaaaaaaaagcgttaaacctactcctactaggcagactagctaaaggctgaccgtcgctagagatcagcatcccgcaacgcttctccttccccccactctccctccccacttctcctcattcgccgcagaaaaaaaaaaaacaacctc

SEQ ID NO: 36890 - DNA, 467 bp, Oryza sativa
gtcgtgtgtttccttgcttgtgtgtgtagcgcgtggtttgcatcagtggggtgtgatgtaaccatgctaggttgtttgcttaatcaacttgcagaataagcctaacatacatcataacagcaaaagacttagatctgttaaggtcctatccttagtttctaatctgtctctcccctttgttttccctctctccctctccaaacctttgcaaagatggctgacaatgagaaaggcaataaggtcagaagtcaggacattggtacctcaagctcccgagtgaatgaagcaccagacaccagttgtgcggcagtggtccaacacctgattaaccagaacaaattgcttatagagatactacagcagcatcggatgccgattttgaacccgagtcagatgcaaccctcaagtgcagttggaggcagtccaagcattcacaccacaagtcagcgcaccgccaacatcccaga

SEQ ID NO: 36891 - DNA, 683 bp, Oryza sativa
gtaaatcgaacaaccatagacaatcagtctagatgtgggtcattccaatcttaataacaagcaaaatcagtgtcagtgatatagccaatagctgaacggagactatgcaagtcgaagtcttaatgtactaaaatcagttacaatgatgtactcattgtatttctgcaaaatctatttgatcacgagctccccttcaatgttcttttcttactctactatgtatggatctaatcttttgatttatttatttattttggtgcagcagtcacaaatagaaagacaccatccaattcgttcagagcagataccagcacaatgctccattcgttcagttccaagagaggagacattcagttctttcagaaacgactccccagcagcagtccaacacacattggcacgaaaggagcctgttaaccattcaattcataggggggaatcatgcaatgagacacttgataaaaccactgcaaggtctagttcaaggaaggctagattgcaggcaggtgttgaatctatatatattgaaaaactacaaccagagcgtcctattcaggaaagcacaccacaggcacaagcttgccctccgagtaattcagttcgtggggaccacgcacaagggcagcaacctcttgttgacatttcaagtcgtgaacagcgggcaaaaaatgtctcaagtacta

SEQ ID NO: 36892 - DNA, 1501 bp, Oryza sativa
ggtgatgtcggagatcttgttacgttgttcagaaaatcgccggatgtaatctcgaagggattctccggacttctgaataacgttgtagaggtcgtattgtgtgccgggacgctcgaaggtgccttggaagttggcgatgaagtggtcgcgtaattcagcccaagatccaattgtaccatggggcaatccatggagccaagatcgggcggaatctgctaaagccactggtaaatagttcgccatggccttgttgtctcctcctgctgcgcggattgcgagaccgtagacggtaagccacgattcggggttagtggtaccgtcgtacttctctattccagtcggcttgaagccggctggccaatccactcgacgcaggtcatcggtgaaggctgctactccgtcaaggtcgtcgtcgtggcggtccggcgaatgatgatggcctcgagctgctcggcgttgtatgattgtgtcgcgaagatcgacggggcggcgacgaggtggtgagcgaggccgttccactcggcgctccctatgatgatcgggaggcgagtgaatggaccgctcgtcgtgacccctgctcctgcgattggatcctgcgccggtgatgctgaggcttggatgacggtagtcatgagatcggaagtggggaactcggctgccagtcggcgtgtagacgctttcggagttgactgggactgaagccgcgatcatggtcttcgtctggttcaagatgttgacgacgtgatcagattgattgagctcgttttctttgaggagggtgtcgaggagggtgatcgcggcaaccgcattctgttgaggggtgcggaaaaccggcgttccttcaacatcttgttggccgatgagatcacgcgctcggcgccctgcttccaaagctcgctgccgtcgatcctcagcctccttcgcggtccgctcacgctcctgctgctcacgccgttgccgttcttgttcttgtgcttgatgctcctcctccagtcggcgacgctcagtctcgcgacgtgcttcggtctcccgggcttggcgttgctcctccgtctcgttattggccatgaagacgccgaagaagagaggggtgtagttgtcatctaggctttcgtcgaagtcgtcgagatccgggtcgttgtagagagagctgaactcgtcgtattccacgatgtcggtggggcgcgagtcgacggtgggagagctgtagtagccatccagctgatccgtcgaaaccgtgccgagtggttggaggatgacgccgacttccctgaagctaggcgagatcggtgttgaagccgacttccgcctaggcctacgggatggagacgctgtcgtgatggagatggccgccaaatcatcggggagcttcatcaagaccggtgggtaagccccatcatcttgatctggtgtcgttggagaagatgcgatctcgcccgagtggtttgaagccgactcgattgagatggtcttggggtaacttttagccgcgtttgggagt

SEQ ID NO: 36893 - DNA, 167 bp, Oryza sativa
atcggagtaaatgatttactacgataaaaataacttctttgcttccggtatatattctatttttcccatacccaaccaaccactcttgccccccacttcatttttttcccttttttttcgtatatgaatcgatccaccatcccaacccagagatcggtgacacacca

SEQ ID NO: 36894 - DNA, 174 bp, Oryza sativa
tgttcacggccatggctcgatcaattcctctctctctctctcgctcgctctttcttgatctatgcttgtcaatgatcttggcactgcgtttgaatgtcagtagctagcagatcaaccctccagttatataacataagatactagctaattaattgttctttttttttctttaga

SEQ ID NO: 36895 - DNA, 583 bp, Oryza sativa
gctcggtacccggttgtcatgcatgtgcccggcggttagaacaatggtgggattatgttgtgatggttagccggtgaacagcagaaggcagcaacatcatcatagtcattattcgtggcatggaaaatactccatctagctagttgcagataagtgatgtgtttttaaatgtctgcagtcaatatttgtttaaatctttcccattcatatttcttttcacatttcaattcaatttttttaaactatcgttgccagatttatcttcaaaattagtttcaaataatattataaatttgctatatttttcatatatatgttttatactcttgttaataaagaaactagctaggtgttttggtgatcatgttgctctgtccatacttcatatataccactccctttgtttcaggttacaacacgttttgactttggttaaacttaaactatttcaaatttgactaagtttatagacaaatataataatatttataatactataaattagtgccatcaaatcaataactgaatatatttactagaactactattaggagcgcgctcctaatatttcaagcgccaaaca

SEQ ID NO: 36896 - DNA, 1501 bp, Oryza sativa
aaaggatttagacaggtttaggccctctcaatgagaggtaataccctactcctgtttggggatttgaatccgccgggtgtagtatagatctgacgatctagttgtatctcatgctccctagagggcctcctacccaccttatataggatgggggcaggattacaagatagaaaccttaatcaatacggtatcggtttcctaaatctactttacaatcttatcaaaccaggactttaggccattccataatatacgggaaaacgtaatacccaagtcatgatctgttacatatttcatagatataagttatcccctataaccagtcggataaccatgccgtgtgggtatgtggtacccataatctccacacctgggattccgtatccaacgtttgaccgtccgtattatttgaaaaaaattatgaaaaaaattaaaaagacaagtcacgcataaagtattaatcatgttttatcatctaacaacaatgaaaatactaattataaaaaaatttcatataagacggatagtcaaacgttggatacgaaaacccagtatttgccttttttttcgatggagggagtatatgatatgtcacatcgtactacgagtttgattttttttacggagagagtgctagcaagaaaaactcacgcacaagggtaggatcgcagttgcgttgcgcgattcttttttttcttgaaaagacgcgtacgggagaactgcatcagtttctattttttggatgtgcgctcgttagcactcacgcgatagtacaacgcacgacgtacgcaaaccacgaagaatccgatgaaatcgatcggctgcggcagattcttgagaattttgcatttgacacacgagccgacatctaagtcgtggagtttagctggacgcaacggcacgcacacgcctgatcgaactggaaattggctgttgcattgttgtactactatatactccctccataaaaaaaaaaaaataaacgctgagtctccgtatccaatgtttgactctctctcttatatgaattttttttataattagtatttttattattgttagatgataaaatatgattgatattttatgtgtgacttgtttttttaatttttttcataattttttcaaataagacggacggtcaaacgttggacacgaaaacacatggtttggtttgtttttttgggacggagggagtaccacattgactgatagatatatgcttaaattcttatctctactttcccaactcactttcctcgattttcacgcatatgtttttcaaaccgttaaatagtgtattttttataaaaatctatattaaagttgttttaaaaaacatattaatcatttttaaaaattattttagttaatacttaattaattatgcgctaaatgcggctttgtttagagtgctactccctaacacagccatagttgacgtgaataacgtcttgccataaataaatgttatattttctcatgaaaaataaataagatc

SEQ ID NO: 36897 - DNA, 1501 bp, Oryza sativa
tgccgatcggcaccacggggacggcgccctccaccgcggcggacgacaggaggtagtgccggagccgcgcggtgtcgacggcgagctcggcggcgcagatggggcaggcgcagcgcgccagcccgacgggcacgctgagcagcgccccgcaggcgccgcaggggagccgcgcgccgcggacgtcggcggcgccgcggggcaggggcagcgccttcctccgtggcggcggcggcggcatgagctccgggggcagcgactgcggcatggcgcagtcggggcagatgaactccgtcagtcccggctccacctccagcgtctccccgcaccccgcgcaccgcacctccagcggctccggcgagcctccctccgccgccgccgacgccgcagcgcgccctggcgccattggcgcaggtgggaagaggtttcgaggttgttttttttttttctgcggcgaatgaggagaagtggggagggagagtggggggaaggagaagcgttgcgggatgctgatctctagcgacggtcagcctttagctagtctgcctagtaggagtaggtttaacgcttttttttactcaccagcgagtgaattttatgaatatagtaaaaagaatggatcaatcgatcccaaatacaaatttgttcatcggtactgctatacacacgaactagctgttcaaactcatgtacagctaaaaacatgttaccatagatcaatcaaaaagtatatgttcacatgtactgtttacaacagttgatcaaattcagtcgtacataagtctaatgatcaaattcagtcgcacgtgactctgataattagttcgtatgtacaacaatttcctttgttaatattctatgctatttcgagtgataccacaaattagcgatccaacgtttcgatatacaggcaaagggacgctttctccgctcatttccacaagaccaagataatgtttccgattgagtaaaatgcatgagcggtgcttaaacttgagcagaggtgttacgtaggatcgtaaactgaaaatttgcacaataaggttcatgatcttgttttaatgaaacatggtcggtccaaaaaacgtttaaccatatctgaccgcatacgtagcattccacgtaggcagcattttacatctggcccccttcacatctcgagaggggatgcaaagggatcaaaggatttgagagattttcggtgactactgtagcaacaagaggtaagaacagaattaccgccacgtcgagatgcagaaggggttggatgcaaaatgctacctacgtgaagcgccacatagttggtcaactctagtcaaacgcgctttggaccagctatggttcattaaaacaagatcctaaacctcaatgtgtaattttcaagtttacgcacataagtaacacattcgctcaagtttaaggatcggccatgtaatttactctttccgatttttcgctactcatttgcatatgtgatagaatatttcctaacagaatgaatctg

SEQ ID NO: 36898 - DNA, 1501 bp, Oryza sativa
tagctgaacaaactaagcgtatagtcaaggaataaataatccaaccaaccgagtggttttgataattgtaatcaaccaaatgacttgatatatagcatatgcggtgtgaatccccgaataacatgatccaagtgatataccgattgctttgtaaaaattgatgagagcaacctaaagttgactacatcattgaaaatacacatagcaaaacagctataaaaaagcttgaatgttgtgaataaagaaatttccaaagtattgggcatacgccatgcgcacactgctttaacagatgtgcttaagtccctaaaagacacatggtttcaccacacccggaaatatacggcatatgtggtgtaaaatccgagtaaataaactcataaaggatttaccaaccgcctggaaaatgaccaagatatataatcagcctaagccataatattggtcaataaaaacgcacacttacgtggcaaaaagcaatgatattgtatccaatcgattgcttaaaaacccaaacaacaccttgacttatataaaaaagtcagcggaacagctatataaagctttactgtttgacaccttttaagatgcattgtaccaactcctaaaaagttgagtaactgcggtataaaaggattttaagatattgggcacttgatcacgcacactttggcctaagcaaaaagtgcctaagtccctaaaagaacgtgacaggccacacatgaaaatatgggctgcaaacatattaggcctaggccaaaaaaaaatgccttcgacaccctttaaaggatgacgcatataacatgctcccgagtaataaatcttccgggtaatatagaccaagtgtagctcatatgaatagcttctgatctgagtgattatcccttatgggatactccaaaatagatataaaaattgaatcccgactggcgcaagtattcggttgatagcccttacggagaataatgattggttcagtcttcgagcatagaaaataatctcagaacaaaatccaacttgaaggtatgatcctagtgtttgagttgataagcccctgagaatatatagcttgtccttctgtcatagtcaaaattgtccattggcaatagctgatgcagtcgacatggagacgaaatgactaacatgaagatgatatcacccatcaaagctgacgaagatgttggtggtggtaaagacaatgataccaatcaaaggtaatgaagtcgcatagccatggaggcgaagaaaccagtcggcggcagacagatcaactaacaattaagatgaaggcacccagcaatagcgacggagttttgtagccatggtgacgaaataattagtcggagacagacgagacagccggtgaagaagacaaagacgcccatcagtaaaggcataataagccagccgtgaaagcgaagacaccatgggcggcggcggaggcaagccggtggtgaaaacgtagacgctcatcaatggcaatggcgaaatccatcaatca

SEQ ID NO: 36899 - DNA, 1501 bp, Oryza sativa
ggcaaagggacgctttctccgctcatttccacaagaccaagataatgtttccgattgagtaaaatgcatgagcggtgcttaaacttgagcagaggtgttacgtaggatcgtaaactgaaaatttgcacaataaggttcatgatcttgttttaatgaaacatggtcggtccaaaaaacgtttaaccatatctgaccgcatacgtagcattccacgtaggcagcattttacatctggcccccttcacatctcgagaggggatgcaaagggatcaaaggatttgagagattttcggtgactactgtagcaacaagaggtaagaacagaattaccgccacgtcgagatgcagaaggggttggatgcaaaatgctacctacgtgaagcgccacatagttggtcaactctagtcaaacgcgctttggaccagctatggttcattaaaacaagatcctaaacctcaatgtgtaattttcaagtttacgcacataagtaacacattcgctcaagtttaaggatcggccatgtaatttactctttccgatttttcgctactcatttgcatatgtgatagaatatttcctaacagaatgaatctgaacagagaagatagatactcctttcatcttaaaatgtaagaatctagtactggattagacattttatagcattacgaatccggatagagatatttaccagattcatcgtggtatgaaatgtctaatccggtattaggtttctaattttggaacaaagagagtaataaacaaaacgtgaagagatgaagctattctggccatctgggtcaagagccaagagatgagtttcactatcgatcggagtcagcgtagcagcgggaaataccactgctggcagtgcatttcagcatctctccaaaagaccagggacagggaaacagcattagacgcaggtttatatattacatggccaaaattctacgcggcgaggcagatcaatcgcttgtagacaccacttcctcctcctcaacctcataatcttcgtcatcgtcgtcgtcatcgtcgtcgtggtgtctcgcagattgacgcctttcaacatgctgtttgtctgattcgtcctgcaaaacgttacaaaacaagatcgctgcttagtcgcttcaacgaacaagctacaaaagatggttggaaagcatgatcaaatgtatgtgcagcagcaagattaagtgggtcaactcacaaacccacttatagactaatcaaatggattgaccagcgggttacgcacttatttgatctataagtgatttggcgggtcaatccacttacacccttagctggtaagcatgacctctagtagattttcctttgcttttgggaaaaaaagggaattcatcatctacctgatgttttgactggtcctgttgaacatctcctccagctgccgaagacccaggggcatgctgcagagtcaccagatcaatctcttgggtctagtttggaaaaggaattaagtgaaaccatttactt

SEQ ID NO: 36900 - DNA, 755 bp, Oryza sativa
actgatcagaccttgcctccatccatcaccaccttccacgtgtaggctctggatcacctcccaatgacaattgtggtgctccgacctccacaaccgtcattggaggctataaaagaaggagctcactcatttccaaaatgcacaacaaaatggagtacaacttaagttcatatcttagacatcactttagtagtgtggaggaaataggtaaagagtgaggagaaggtctagaggagtgccagagctatcgtcactctcttctctcttttacctcaacggatgcttctttaataaagtaaggctctgttcgttctggggagataggggagattgattcttgttttccgcgtgcacgcttttcaaactactaaacggtgcattttttgcaaaaaaaattctataggaaagttgctttaaaaatcatattaatctatttttgaaatttaaaatagttaatactcaattaatcatgagctaatggctcacctcgttttgcgtatctccccaatctcctcaaacacaccctaagtattcgtgatttctcttttggtatttaatttacttgcttaagtgagatacattcccatcgttgcgggttcgtcgcttagtattattattgagtgctttagtactaggattcttcacaaagaagaaagtaaccatctatctgttaacaaccaaatttggtaattcaagtatcggagatggagttaaatcgaggcggaatccaagatagagatcgttccggaaacaga

SEQ ID NO: 36901 - DNA, 282 bp, Oryza sativa
ggtgtcacaagtcatattactacataaatgaacttggcagctgattgcatggtttctacgcccaaaccctttttttctggaacatctaataatgtttgtccccactattcatgaaagagttactggaatacttttgatactttatgcatcactttctttcatgtcaccttttcaattggttgtttcgacatatgtaatatttttagtagtttcggcatacttcgtatgtttaatggctcatttatgtgcttaatttcacatgtaagcctgtccttttacagg

SEQ ID NO: 36902 - DNA, 1280 bp, Oryza sativa
aaagctaaccaattgaattacacactttatgttttgaggagtaatttagattgatggtcaggtttttttaaaaaggaaatattaaaaacgaatatacaataggcacaaatgacgtcatttccctttattgtaatataatatttctgtcacttgtgatctcatctcaaacttagttaaccaagaaatgccataatttcaaagtttttcaagacaaactttatatatctctttttttgagggcaattggattggcgatatggaaataatatgtttttagaaatatagaaaaaaaagcttcattcagtacacaatgataccatctaaatacttcagcgtttagaaatttaacattttgtcaccttctttccatgttttcctgcattggagtttttctcgttcttacgaatgcaaaatatcttcattgccttttattgactcaatatatttccctcacctttgtgctaagctctattcctctccccttggcctatgccgccatatccacctcctttatgatttccacctcctacccttgattccaaccttttatcgtcaattcccaccagttgacaacgttgattttcactgctttcacctgacactgatcaggccaacctatgctatccgaggttgattctaactacggcatgcatgttgattcccaccactgtcaacggctactactgcatgtcaattcccaccgccacacgttgattcatgccaacgcactgctttaatcttgttgatctgctacacgactggttggaacaatgtgaaaaaggtgttagaatttgttgcagctataaccatcatataacatgacatggcaaaatgtctttgttagattaggtgtcgaatatactagtcctatttggttacagttggacttgaagttgtaataggtgttagggggtggagttagagtcggactctgtaacccgtcatctctcttaaatagagaggggggcacctcaatgtaaccatggcgactacaatgtagcatagacacgcagggagaggatgacggcgtggccatggacttgtagcggctacgagctatattggttggggaggagcgctcataatcagagccccggggatgtaggcttcgactgaacctcgttaacaaatatcgtgtgttcctgtgtcgtcatctggcatgtcttgggtgatcaatgagtgaagcgatcgggagggttagtcgtctttccgctatatcaactaacttttataacaagtggtatcagagcagaaggtttcagtattggatcaagaagaca

SEQ ID NO: 36903 - DNA, 1501 bp, Oryza sativa; identical to SEQ ID NO: 22984

SEQ ID NO: 36904 - DNA, 1111 bp, Oryza sativa
gtttcctcttctcgcttccccgcccttgtcctttcggtgtcgccccgtacccgttgtccggtcgtcgaccccggtacccgtgttccggtgtcggtagttgttcacgcgtccgggtggtgcccgtgtagtgtccgcgttagtgtgcccgctcggtacccgcgtggtttccacgtgtgcaacccgggtggtgtctagtggagtccgtttatcggccactcgcctcggttgacacacggggtccgcttccgtcgacccgtggaccgtctctgtgtacccggtctaccgtggtcctttaggttgacatgtggggtccgcatgtcaacggcgcagccttcctgtcttttccaggctagcgcttacacatgttttataattgcaaagcttaattataataattcgcaaatctccatataacagcattaaacttcggatgatcatatcttggtcatacgaactctgaatcgacccgttcaagtctcctaatgtttgttataacctaaagaaccctgtgctttctttttatgtgttgttattgcttctttataggcttttagctttgcttgtgtgcttcgcgtagcttctgtcgttccggaggttcccgaagcgtggttcgtggtcgtcgccgaaggttcggaaggccgttatctctgagcaaggcaagtcacatcatccttgaacatattgaatcccagtttgtaaaattatgttgatttaaattattgcattatcgctttatttaaattcccgcgttatcactgttttatttagccatgcctattcacctttgttatgacattattattgctattgttattattaccttgttcaccctagaataaacaaaaccccaactagtgggtactctattcctggttccactagtatgaatttaggtagatgcttcgctgattaataggacaacattaggtggtttttataactttagacttgggaaattctcatatcatttggacactatggaatggttggcttatgttggaattggacacacacctctcttcctctttcaaaacccctaaaacctgttttcggtggggtttgggtgcatgccagttgtgggaagtagcaccccggccactataaggattaa

SEQ ID NO: 36905 - DNA, 1501 bp, Oryza sativa
aagaagattacaacataaggacaaataccccgcgaagagattcgagttatatcctctgctcccgtgtagtcgaacacggggtgagcacgggcttgtagcggttggatccgaccgctgacaaagtccttaatgacttcatagccggtcaatccttgctctcgaaggtcgctcacagcgttgacaaaggcttggagagagggtgtcaacggaggtttagaagtccagttctcggaatgctccggctgaacctcgggtatgacaagaaccggttcaagttctttgagctctagatagaaccatctcgacctccattggctccgggatgtgtggcattggaaagagatgtatcttgccttcatgccatcacgaaggcgaaaccatcaacatcttgaaacccgattggcttccatccaccggagttcatagaaaaagcaaaaaagatctaagaaaggcactacctcgatgtaggcctcgcaaaggtgagcaaatatgctcaaaaaggcagtggagttggggtttagatgcaagagagaaaggccgtaaaagttcaagatcaataaaaggaatttagaaggaggaggcaaaaaaccacagcggacgaaatcctctagagctaccatgcgacctaggatgggggaaggatcaatacctcttgcttcccaagccatggtctgcttcagagggacggccccctcggtgtacagcttcttcagcgcgccgcatcggagaaagattggtcgaggtccgccatcggaagaagatcgtcggaacaagatcgccagtgggagacgtggaagattagggattttagggaaatggaaagtccgaggaagccgaggaacagtgagggttttttggcaaacagacttgaaatggatcccagaattccattaaataggcgcaccacctaacggttcgtattttgaggaaaggagagagattgccgccgaaaatttctaaggcccgttggaggtagttgttcagacttcaatttaaattcaaattttgcaccgttggactccctctagcgttgtcgatagctccatgtctctacggtcagtaaccgagatcgacctagcgagcacgacgagacgctattaggagaagtcgtgggcgacaacatgaattcatttaagttgaagtcgggggctactgtcagggttaccgataaggcataccttctatcctacgacttatggaatataccaataaggcataccttcacgtacatggattgtttccctatacgtcgttaggaatttgtcttaaattacggaaaatatccctacgagttaaagaaactaccaaagtcctactcggaggggatagaatctctgttatattgtatcatattacatacctccaggccttacttgcgggtcaagataatccacggtataaaagtggacccctagggggaggtgaaggacatctaatatcatcgccaacacacccaccatagcttacgaagccagagtattcggagccaagtcgccgggag

SEQ ID NO: 36906 - DNA, 346 bp, Oryza sativa
gaattcgagctcggtaccctttttgggtattacatcagacgtttgaccagatgtcggaaggggttttgcagtttagaaccttttgcctcaggaatgtacgtttgcttatgtttgtatgaactttcatacttgttgttttgttgtgtgaatgatcaatatgtattctggtggatataattaccttgtgtctgcaagaaatatatgatttaacactgtgcccatgtgggttaatggcttagtgctgaacagcatcacaagcatttttggtggccaaattttgccgttgatttctgcatatgctggagtggatatattacttttgatgattataacagttggaaaatta

SEQ ID NO: 36907 - DNA, 1501 bp, Oryza sativa
actgcatcagctattgccaatggacaattttgactatgacagaaggacaagctatatattctcaggggcttatcaactcaaacactaggatcataccttcaagttggattttgttctgagattattttctatgctcgaagactgaaccaatcattattctccgtaagggctatcaaccgaatacttgcgccagtcgggattcaatttttatatctattttggagtatcccataagggataatcactcagatcagaagctattcatatgagctacacttggtctatattacccggaagatttattactcgggagcatgttatatgcgtcatcctttaaagggtgtcgaaggcatttttttttggcctaggcctaatatgtttgcagcccatattttcatgtgtggcctgtcacgttcttttagggacttaggcactttttgcttaggccaaagtgtgcgtgatcaagtgcccaatatcttaaaatccttttataccgcagttactcaactttttaggagttggtacaatgcatcttaaaaggtgtcaaacagtaaagctttatatagctgttccgctgacttttttatataagtcaaggtgttgtttgggtttttaagcaatcgattggatacaatatcattgctttttgccacgtaagtgtgcgtttttattgaccaatattatggcttaggctgattatatatcttggtcattttccaggcggttggtaaatcctttatgagtttatttactcggattttacaccacatatgccgtatatttccgggtgtggtgaaaccatgtgtcttttagggacttaagcacatctgttaaagcagtgtgcgcatggcgtatgcccaatactttggaaatttctttattcacaacattcaagcttttttatagctgttttgctatgtgtattttcaatgatgtagtcaactttaggttgctctcatcaatttttacaaagcaatcggtatatcacttggatcatgttattcggggattcacaccgcatatgctatatatcaagtcatttggttgattacaattatcaaaaccactcggttggttggattatttattccttgactatacgcttagtttgttcagctaaccacatagtcggaggctacacctattaggtgcatctagtcgatgcacctaactttattttccaaccctccacagtctagtcgaagattatcttttcgactatgaaggtctcaagggctactatggagattatgggtaccccatacccacacggcgtggttatccgactggttataggggataacttatatctatgaaatatgtaacagatcatgacttgggtattacgtttccctgtatattatggaacggcctaaagtcctggtttgataagattgtaaagtagatttaggaaaccgataccgtattggttaaggtttctatcttgtaatcctgccccccatcctatataaggtggacaggaggccctctagggggcatg

SEQ ID NO: 36908 - DNA, 1501 bp, Oryza sativa
  unsure (1)..(1501): unsure at all n locations
gtcctttggcttgctgcctttccgtgaaaccttgaagtgtttcgccaaaagctatactaactgtcgttgcctttgatccgaaaaggacgcatctgtaactcttagtccaaacaaatgtctctttggttaatcacttgatttttcttttccatcctcaggttggttattagctcgaggttagaatatagttcctctggcacgagaccctaggtctcctttgtcagtaaacaattatacacatgatcacatatccgcatcttccaaaagaatcctcttagaacttgtttttattaccaatttctcccatattacatgaatacaaggcactgtcttaaacaaaaagggaaggtgcttaacatcggtacattgtttctactatgggttagaattaacatgaggcctcacaggtacggcgtttgctccagtgaccacaaggcgagtgacttgtcttcttcttgcataatggccggagtgatgacgcaggttacgcttcggctgtggacaatctctggagaaatgacctggttctttgctctgataccagcttgtcgcgaccgggaaaattgccttttcccgaacgctagtgtattaatccccgtcccaggaaaagccggggtacaccacacaaacatgatataaaagacacatctttattatatcgataatatttacattattacaaaggcgcttcaggcctgacaatcaaaaataaacagcagcggactagcgggcctacggctccatcttcacaggcgctcaactggggtataagccaggactccgcctaagacatcttctccaaagcttctcttactgaaggggggaaagattgagcaagaatgagtacaaccacagtactcagcaagtcacaccggcagatgcatggttaatgcaagggggtacaaggagtaataatataggggttaagttttgcagaaaagcagcatttataagtcacttagttgcccaaagctattttataaaggcgatcctagagctacacagtgttattaacagncccgtgaccctcacgaacctccttaaccaaggcntacgatattcagaccgaactggcaacccaccctgggtcccagctcgtcccaagccaacccatgccaaccattccatattttagttgttgagcaaattttaagaattaaaacactgacttgggtacattgctcggcttgcccataaccgagggcgcggctattcgaatagattatactctgatcagaggtgtacatctttacccacaagacacatcttcctcacgtgtaaccacgtgccacataccaccacggtatacgggcgaaagacgtgacatagtttccaacccatcctagccttagacaagagtaccgacccaatcccacctacggccgggatacccgggacaggcaggcagaactgagcccctagcagcagggcaccaaccctctgccatatgacatctcgactaccgggccgcagctcgtgtagccttcatttgccctggaga

SEQ ID NO: 36909 - DNA, 1501 bp, Oryza sativa
caatcgttgacaggaacatcatgtaatttgtggcatgacagattaattatctgtcagccagacaggtcacaatagcaacagggtaggaggtgattatcaacaccttgaactgaaattccaaacatcacacatgttttcagtaacacacaattgtgttgaacgaaacgagaaattggacattctgccactaccaaaagagggtttcgctcaaatgccattccacggattggattcgttaaaaggccatccctaggcgataccaaaccttttctttgccatatttgccaattcactggatttccaccattttttcacttgggttgaccaatataccccttcagtcgggttcttctacctcagccctcctggccactcgttgagcttaggaaaggggactaaattcagttaattttagaatctaccattgcaggatacaataccgcactactagtaaatagagatcatagggagaccatctcttacaacaatattctaagtcatctcttattcagataaaatataaacaaataaaaaaggatgccagcactaatattagtcagaacacaacatcgatggtagtagcattagatatgtgacattttgatcagtgagggatcatttggagttgcactttcccattgctgcccttatttgcatagccattggcatcgccgacgtgtggcactacctccacacctgtaaacacggtaatttgttcatccccaaagtcactgttgctgcggaagaacctagcgatgcagaacctgcctgagccaaggttaacaagttgaggatccttgcattccctccattcctctggcaggttgagttccttccaagggcccactagctgtggctaggagtccatggcagagaggtcagccgcagccaagcgacgggcctcagcagagaggccaaaccagaggttgaactcaggcacataatcaatcctgccatggaacggcagtgtccacttgccaacttggctccatgtgtggcttgctgtctccaggcagtaggtgccgatgccattgacagataagcaaatgtgtgagccaccgccaagcacagcgtaggagctgatctctgggttgctgcagctgtgccagtgcttgggttcacggacaaaaggcgggggtgggagttgatggcagtgccaggcctttgtgtagttggatattgtaggcttgcggtatatgaaggcctcaaactgatcgctgttgaagcccaactccggtttgggaatcctctccatgacaaagaggctgctgccatagccatcatggtcatagtcattgtcagccttggcattggggacgaagacggccaagggcatcgacttgggcttgtgaagactgggcatggttcctacctggcacgcatcagcgtcgacgaggaacgcgcggccagactgatccatgcaaatcacctcgccgccagcaagcgggaaacagtccatcctcgattggccgttgacgttgagagctgaagctcggaaggt

SEQ ID NO: 36910 - DNA, 1501 bp, Oryza sativa
  unsure (1)..(1501): unsure at all n locations
agcggactagcgggcctacggctccatcttcacaggcgctcaactggggtataagccaggactccgcctaagacatcttctccaaagcttctcttactgaaggggggaaagattgagcaagaatgagtacaaccacagtactcagcaagtcacaccggcagatgcatggttaatgcaagggggtacaaggagtaataatataggggttaagttttgcagaaaagcagcatttataagtcacttagttgcccaaagctattttataaaggcgatcctagagctacacagtgttattaacagncccgtgaccctcacgaacctccttaaccaaggcntacgatattcagaccgaactggcaacccaccctgggtcccagctcgtcccaagccaacccatgccaaccattccatattttagttgttgagcaaattttaagaattaaaacactgacttgggtacattgctcggcttgcccataaccgagggcgcggctattcgaatagattatactctgatcagaggtgtacatctttacccacaagacacatcttcctcacgtgtaaccacgtgccacataccaccacggtatacgggcgaaagacgtgacatagtttccaacccatcctagccttagacaagagtaccgacccaatcccacctacggccgggatacccgggacaggcaggcagaactgagcccctagcagcagggcaccaaccctctgccatatgacatctcgactaccgggccgcagctcgtgtagccttcatttgccctggagaatgtccatcgacacccgacttcatccatctccaatccgtgtacttttgtttatgactagactgagccacaaactaagccttacccattagacatgtggaagtacggtagtgctttgcaacagaggcccgagcttaatccttatagtggccggggtgctacttcccacaactggcatgcacccaaaccccaccgaaaacaggttttaggggttttgaaagaggaagagaggtgtgtgtccaattccaacataagccaaccattccatagtgtccaaatgatatgagaatttcccaagtctaaagttataaaaaccacctaatgttgtcctattaatcagcgaagcatctacctaaattcatactagtggaaccaggaatagagtacccactagttggggttttgtttattctagggtgaacaaggtaataataacaatagcaataataatgtcataacaaaggtgaataggcatggctaaataaaacagtgataacgcgggaatttaaataaagcgataatgcaataatttaaatcaacataattttacaaactgggattcaatatgttcaaggatgatgtgacttgccttgctcagagataacggccttccgaaccttcggcgacgaccacgaaccacgcttcgggaacctccggaacgacagaagctacgcgaagcacacaagcaaagctaaaagcctataaagaagcaataacaa

SEQ ID NO: 36911 - DNA, 322 bp, Oryza sativa
ttattggattaagttggatcatgcatgcatgcaatctcgttggacacaatcatttctatatatgtaactttagtaattataaaaacgagaaatcatcatgtactccctctaacgagggcatcactcctcttatacgcacgctacttctcaagttatttcgcaaggtccaatcactagagctcacgcccgatagtaatttacagatgagctcgtttataagtacttctttatgtgctcttgagaatagattgctacctaatgatttaattatgattaggaactatggatataaccatggagcacttggagagaggctaagaaa

SEQ ID NO: 36912 - DNA, 1501 bp, Oryza sativa
tcggttgtgaaacattaaccgtgccaaccacaagccagcatgggcaacggctttatcttttgtatcgcatggttcattgcggagcaccagactgagaagtggcggagataagcccacgggggtcgctggggagtccatgccttgtttataagggggtgattatgatccaggaaggtgcgctgcagtggattgtgttgtataaggggtattgtcacaactcctttccgatgtaccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtttcacacttctcatcatagtaaatgatgctatatactggtaataatttgattagctcctggtttggaatggtacattcctggtttggagatagaactgtgcagccggggtggttgttcagaatggttgggcctatacaacagggtatgttgtatagcgttggattaatattgtttaattattacttaactgttttgttaaattctcaaatgtttgctaaatgctgcttttgcaaatgaaaccctattatgccatcctttgttatcctgtgcacttgcatatttgctgcgtggcttgctgagtatgtcatatactcaccttgcaatcattcatcagaggaagagttctacaatgaagctgatggtgtggaggattaggtgtagccttggtcaagctgcctgtggagtggagccgtctgcgccgtttatttattttccgctgcttagaactttattgattgagaggaactatctacctctgtaatgacattctattcgcttattaattagagtaatatttgtactctattatcaatttgttattgtgtgcctcggctgattcctggacgagggttcacacacatctaagcgtttggaattttggatagaaattccgggcgtgacaagttggtatcagagcccctttgaccctaggttatgccaaatggttatccatagaagccctctaaaaatattggaaaagtagaactgttctcctccctttctcttttaattaaccaaactaatggcacatgcacttcataatctcttttaatggttctcattcaaaatttattccagtgttattagtactgtacatctattactgtactaatggctcatttatcagcaaaagttttacaatattgttttatttaatcttgctgcaataaaataaatttaccatattgattttataattttctttcatttcttttgaaaccagttattcaaaattacaaaaattgtgacctcgtttccaactgttttaatttatttcgcaaagcttggtttactttatttacttacctttttattctgattttctacctttattcaaattaatccaaaaacttgtgctattaattggatagatgtcttaactccctcctttcacttgtctttaga

SEQ ID NO: 36913 - DNA, 209 bp, Oryza sativa
caacgctgtgcccggctcctcgcttctcgcgcccactatttcgccccctcgtttctcgcgcccacgcttccactaatcccattcgcccgcttgcggcgcatgaagtggatatgcggttgtggcaatcgagatagatcatatcgtgcgcgcgttaattacgctgccgaccgaagcgacgttaccatatcttcagacgaaacgaatcgcca

SEQ ID NO: 36914 - DNA, 262 bp, Oryza sativa
agcaatacagagaacttgaagtctactcgctaggaatttcgtcgaagccatctcgacaaggatctcgtcggtaactttgggatcagttgttctctcttataatctatggatttccatatcaatctcatataaactggattatgactattaacttacgagtggtccaaaacagtataatccatgtcttcttatttgcttgatgtcgaatcgtgtagattttcgtaccaacgtaccccaatacccatactattcggtttacagg

SEQ ID NO: 36915 - DNA, 1501 bp, Oryza sativa
tttgacagtggatggtacatttggtgggaaaggaggcaaatggtgaaatgattcagatgattgctacatcagctatatctattgttgctcttacactaaattataaaatggtaaggaaaaacatggatgcaaaccacatatgaaggatgtagatgcttcttttggtattgtttcgagtagaggaggagccggagcaatcatacaagacgcacaaggaaattttatagctggttcttgcatgtacttacctcatactatttgatgtagccatggtagaagactaaaggctacgtcctcagggaaggatacattcttacctagcaaattagcaaattggttgtcaaaatattattacccaaacatactacttgcaagtgggggaaacgatgtaacccgaatatttttggacaacgttttttaatgtgatattataaaagtctttgtcgagcgctataatagggaagctaattttctagcaaatatacttaaacatacgtctattttaaagtgttcttgattaggttgatgagcctcataattttttttgctaaacattctagctaacgatgtaactgtattttcatacaataaaacgcgccaagtggctttcctaaggaatatgaaaaagtactaccaaaaataggagtacaacagcaaagcttccaacaccgtccgattctcatagcgaagatcagaagcagcataaagccactatctcccaagcgagatttttctttaccagaagcggttaaaaaaatgcagaaacagtaaaaaaaaagaagggaaaaaaaacaataaaccggagcgggtgaaacaaacccgctttagttcaaagcgttccccctgttcatttcaacctcttttttcctctcccgtcgtcgtctcccccgtctccggttagggtttcggccgttcgccgccttcgcttccgcttccgcttccgccgccgccgttcgccagggggagcccttttaacctaaccgttcccgtttttctctccccgtcgaccccgacgggctacggttctacaccctccccggctcggttcgtgtctgttcgcccgcggggacgctgtttccggcgggcggaggcgcggccgcggcgtcgcggctcctcctcggaggcacggtgcgggcgacggccctcctcctctccttccccgaccctctctctctatctcactctctctgccctagccttctacgctgtgtggaggcgtcgtcgcgcgcgcgcgcccggacggcgagcatctggatttgagcctaattgaaggtattttgttcatcctcctatgcgatatgggcttggatttatttgtttctctctaattaacacttccaattcgttcgatttgcttaattttgttgcatgcgtggtgtggtgctaatggcagtttgtttgtttccaaaaataattttggggtacagctgaacccccatggcccagtttaggtctgcgcctgtggaaagcgaggcggagccaggcgccgatggccctgtgg

SEQ ID NO: 36916 - DNA, 1501 bp, Oryza sativa
atacttccttatctcaaataaatcccagaaaaatctaggaattaaagaattaagcaaagtatttaatgaaattttatctggcccaattttatattggaatttattaattaaacttagattttcttttcaagacttttaaaattatttctaaaaattccatttaaacaacaatttatatattttgaattttcagggtgtgacaacgcatcacacaccacatcctacaacaccagttaactatcaactaaaagccctggtaaggtgctctctattagtaggataaataaatccaaaccgttgatctgtttttatttaagggaccggatttaattataccaccaccttaatcaataatagtagtataaatatgagagagcataatcgtccatagaaatataagcgtggacggtcacactcgtaattttgcagatcagcgtattggctttgtatttccgtgatacacgtatcccctagttatgatgttctcatccactgttctaggatgtcgtcgttcgtacttccgcagtcgacaaacgcgatagttcgctgccatttcgcgccattgacacaagcgatgcatctcgcagcatcttcgcttgtggtgccgcactgccacctacccatccgtcgtcgacgcagatgatccttcgaggcctcgtaccgtagaaacaactatgaatgcaaactccggcagaaccttgccaacaaccatggcgccttgacaatgaagcatgcattaatgactaatgaacactgaaaattccggtttgtcctgtatgtattgcgatgagttcttgaaaatcctagatatcaacatgctagcacacttctagaaaattgatttttcatgacatcaccctatttttttttctctagtggttatacgtggaaaccgctagcataaatattacgaggggtgggaggctacgaaccgccagcgaaaatagatttttactggcggccagattaagaggaccgctagcaaaaatatacctattttcgctagcggctcacttaaacaaccgcttgcgaaaataggattttcgttggcggttattttcaaaggcggccgataagaggaccgccaggaaaactaaattccccatattaaaaccgtccaaactcgcaacctagctagtcctctccttttcttcctccctctccctctgtcttcttttttttttttttgcgcagctaagtcctcttcatcttcctcctccctctcagtcgccggcgcgccccgtctcctccttcctccctctccctcagtcaccgaatccgccacaggtgaccacgagcacgagcgcgggcggaggagctcgggcgtgggcggggagggcggatctgccaccgtcgagccgcggggagggcagatccgccgctgccgggccgcgggaagggcgcctccaacctcgtctttcgggccgcgccatccaccaccaccggtacgtccgtctcctcctccttcctccctctcggcctctccctcagccgccgaatc

SEQ ID NO: 36917 - DNA, 1501 bp, Oryza sativa
ataatagggttccatttgcaaaagcagcatttagcaaacatttgagaatttaacaaaacagttaagtaataattaaacaatattaatccaacgctatacaacataccctgttgtataggcccaaccatttctgaacaaccaccccggctgcacagttctatctccaaaccaggaatgtaccattccaaaccaggagctaatcaaattattaccagttatagcatcttttactatgatgagaggtgtgagactaatcacgaaagacattgttagacccgcccataaccgcgggcacggctattcgaatagttttactctggccagaggtgtaccactgtacccacaagacacaacccacatcatgttaccatgtgcctcaataccaccacggtatctcggaaaggagttgtgacaatacccctcgcataacacaatccactgcagcgcaccatcctggatcataatcacccccttataaaacaaggcatggactccccagcgacccccgtgggcttatctccgccacttctcagtctggtgccccgcaatgaaccatgctatacaaaagataaagccgttgcccatgctggcttgtggttggcacgataaatgtttcacaaccgaaactcgtgaaccggtccttaattgtcatgagcacgaccatcaaaaccatgtgcccacaacccaccattatcaggttttagttggcacattaattaattaactaatcacgatcgaccatcgtgaactatcattaagccatcatgaaataatagtaaatcattagttatcccataaatgtgctaatgtttctaagcagggctaagcaattatatctaatatctagttgaaccaatataaataaagttcaaccagtcaaattgtaataacccaaggtatcaaggaataaggtaatcaagtacaaaagggccataacaaagaataggtcaattccacccaatgacattcgaaaatagatgcaatagttgaatagaaacaatagctttaaataggatcaacatgctcaaagggttgtttgggatctgtgtgacttgccttgctggccttggaactcttcaaactcttcttccgcgaaaacggactctccggaaacgacggaatctaagcaaaaagaagcaaaatcaccaaaacagcacataaacaagcatgaacagtacatgtggatatttttaatgtgtagatctcaattttagaaaaatttagggacttgaaccaactaaatcggagctaagatgaattagttatgaatttttaaagattaaatcggattaaaacacttaaatcggtttaaattgaattatgacgcaataatgaattatttttgaaaaggaaaaggggatttattgcgtcagcggctagggtttgggtggaccggcgcatgggcggcggttcacgcgaacggacggccgagatttaaccgatccaagatggacggccgagatcgatcggtctacgaccggctcacagcgaacggccccga

SEQ ID NO: 36918 - DNA, 305 bp, Oryza sativa
cagtacacagaaaaaggggatttttgattctttggcttgtgatccattattgattaaggaatatgatgttgggcaggtacatgggccatttgccctcttttggaggtaacacctgggttagttcagtttatgaatgaaggaccagttacctttcaaaatctgatctttcctgtttgtttccctgtcatgccaacatagatgcttctaaggtcatatgcttgaaaaatgattatgtaatcgctcttgattatatctatggattataacttgtaggtctggagcagaaagctaaaataaatcaagtg

SEQ ID NO: 36919 - DNA, 1309 bp, Oryza sativa
agagagaggaagagtgagaagagtgaggagagtgagagagagaagagagagaagagcgtatgacatgtaggccccacaattttttatatatatagaatgctgactggactgccacatgtacgtcacgtagaccaaaaccaccgcagattgggtcgaggggagtaattcgtccggtttgtatagttcgggatgaaaaatgtccggttttgtggttcagggggtaattcatacgccgcgatagttcgaggggtaattcgtactttttactaagtgaaaactttaagttagatatggtccaatgtgaaacttaggtaagaaaaagtagtccaatgtggaatttactcaaaattctattataataagagaaacaaaaatggttaaacacggttaaaacaaaggagcattttacatctgacaagcattctagatggatttttttagatagtggaatttattcctgacaatgtggtgcctttatttgttcctcgtagcggtcggacaagccatcggaggaagccgaagaggaccgggacgggaacgggaaccgccggctgtggctgcagcgacgttgttgttgtccccctggtcggacgccgcggcggcggcggcggcggggagaagccgcagcggcggcattgcttggtggccgcggagtggtccccgtcgcccctcggcatgttgacgccggcgctagccatcaccatcaccaatcatgtcatgcgagcagcagcagaagcagcatccaccatgggaagagagatgcgttggaggaggcgagaggaagaagaagaggtggccgtgtggctaaggcccaaacacaagggcccatgagcataaccagttccttccgttacattaaaccctagacgctcctcctctcctgcccgcgcgcagttctgctgcttgctgctccggcgctggccctctcttctcccttctccgaccttgcgcctccctcaggttccccgcttgttgatctgcctcatcttcttcctatttgatcgaaagccaatttgcttatctgtgaatttatttcgctagccttttctgatgccatctttggctcttggatttgaaggctgaagatcgattacatcgcaggacaggacgcgcaatcgactttgcaggtactcttccttccttcctcacaattgtctcctggatcttggtatgtactactgcttaaatcgcctctcgacaaacggatcccctcgtttccttctgctctgcaaataatccacccgctttttttttaattatttccctagctttgaagatattttaagtatgtctccgtcgacgattgatt

SEQ ID NO: 36920 - DNA, 365 bp, Oryza sativa
aattcatggcaaacaagccggcagttcctaaattacaagcaaggccgtactcgctacatgatattcaataaagcatacctaaatcacaagcatctagaatggaacatgcatgtgtgtcagcagcagccaacagtactggaagagattcttgcccagtcatgatcattgagatacaactgaaccgaacagggccacatgaaactattccatagtttcataaattgagtaaaatgtggtctaatatttagtttacttggggtatacttttgcttatcaagtaaaaaaaataacaaacttcgaggaagggcaaggagggtgaattaaaaaaaaacaaaatgttaatctagatttcactcttcttctca

SEQ ID NO: 36921 - DNA, 1501 bp, Oryza sativa
tgatatccttataacttctgatttgaggtattactatattaggttgtttgaaactgtgccatttgtatctaaatcagaattgctatttatctttttacatcaaagggccaaaatgcatcgagctctcgtgatgatttgcagtccccctatattgattactctgtgctgtacaaccctaactcttctagccaacaaactcgatgattgcctcacgggtaatgtaatatcaagctctcaattattcagtgtaaatatgaaactcaaactagcaaggtttctagaggatgtcatttactactgtctttaccacgttccattttcaggttgaacctggttggtggatgctcgagtacacagtggaagtattactcacatcctagcatgctgatcgtgcaggcgtcgcaaggatctcagatatgctgcatctgcgttttccatttagttggttggtcacgcatgatagcagctttctttggtccttctttgagttgttaggagagtaattgggagagtaatgtggttggtcttccactgtgttccatttcacttccaatcttgcagatggcatgtttgaaatttgaaaacaacaatatgtgttcgtgtgtgttggtgtcaccgtgtcagcatcttcaaaacaacagtcccttttcttatatcgtaatttcaaactgtatatgtagtcacctggatgttgtataatttgcggagatggggtagacaaagggtgtaagtggctaacccacgaaacacacttataaatcaaaataagacacttatccatttattttgacttataaatgactctatggtttagccacttacacccttacatggacagaggtcctctaacaatcttttatgtagggtcatctaattaactagacctaggtatgaactaagtaatacggtagtgcgttaggtcttctccaagtctcttggcttttatctaagctaaatcttggcttcgttcttctccaagtctcttggcttttatctaagctaaatattggcttcgttacgtactccctccgttaaataaaaaaaagcttaatctaggaaccccttggttaagtattttttgacgaaagaagtacatgtgataaaattgtcgtattatctaaattgaaacaactctccatttccttttccatttttgtgaaagaacaaaaatggagcctctctttgaaaaaacaaaatggttaccatatggtcaaagtttgaactattaaaaattaaaaaagaacccttaaaaacaactccggcaacaaaaagaacagaggtaaaaatgtaactaaaattcaagcaccaaaatcccctcttatttgacgctagcagtaaaaatttacaattggcagcaggaaatcttttaattctcggaccagaagaccaaccgaccaacccactcgctcctccggctctgccgtttcggtttcctcccccctcttgctcctgcttctccatagcgagcaaggaaaggaacccgacctgcccccctcttcct

SEQ ID NO: 36922 - DNA, 1501 bp, Oryza sativa
cgtcaggtgccaaattccgccggttgataaagtaaaaatctcaggaaagagggtggcgatgcgccgagaatagttacattgatcgagagattgataaattacatagaccctgggtgtacatatttatacacatgggttgatacaagtccttgtcggacaagaaagaaactatcctaaagataaaaggaaaacataaagtccttatcggacactaaacatactttcctaaagataaaaggaaactaacaaactattcctaattaatagataacttgccatgccgcatccttcttgaactcggtctcttctagataagcttccttgaatagatcaatttccttaaccaaatcctccaagaatccgactgctggcgacttaataactctcgtcggctgattccgagatgctaaagccgatactgactctaagccgatgatgactctgggcttaccaaatttcgtcgttaacaccatgccatttttctttttgttgtgcatatatacaactaatttctatagtgaacctcactaaggctgtgtttggcagctcctcttcccaacccatctccctcgttttctgcgcgcacgcttttcaaactgctaaacgctgcgttttttgttaaagatttatatactaaagtttcttaaaaaaatcaaattaatccatatttggaaaaaaaattagcaaatatttaattaatcacccgctaatcgctgctccatttttcgtgcgggcacttagtgttgggaaccaggggttccgaacacaccctaaattcgtttatggtttctatggttttgactttgtcaggtaaagtcatacacacacagaaactacattaagtcacattgttataacttatgttgcaatgtaacccccatagcctgagtttctgttcctttggtatgtgtaactaagttctaactcataccaatgtcgcttctcttaatacatatttcctccgtccctaaaagagtattattgacgggctatacctgacaacggtattttttttaaatataggggacgttaataccaggatatacgcgagatagcggtaaagtagatgggagacagtgatttttatacttgttcaggcccctgaggtgggtaatatccttaatccaaattatatgaatggctcttaaatgtatctcacatcaattacaatgggggagaaagctagctaatctagcctaccaactagtattcgtcgagaactaatccgatgacttaagagtcagtgactagctattggcttcatcctagcttgtattcgatgtggtttgtggctatggatcatgattcgatgccctcttcctgagggctatatatttatacgtgtaggcaatttcttgtccaagtagaaatcgaacagttcatgtaggatacgagcatatatgacattgccttccctaggccgaaagcacttcctcctgcactcctgatggtggttgtgggtggttaccgacaaacaaacatcataagcaatcgtcatcag

SEQ ID NO: 36923 - DNA, 1501 bp, Oryza sativa
ataatagggtttcatttgcaaaagcagcatttagcaaacatttgagaatttaacaaaacagttaagtaataattaaacaatattaatccaacgctatacaacataccctgttgtataggcccaaccattctgaacaaccaccccggctgcacagttctatctccaaaccaggaatgtaccattccaaaccaggagctaatcaaattattaccagtatatagcatcatttactatgatgagaagtgtgaaactaatcacgaaagacattgttagacccgcccataaccgcgggcacggctattcgaatagttttactctgatcagaggtgtaccactgtacccacaagacacaaccccacatcatgtcaccatgtgcctcaataccaccacggtacatcggaaaggagttgtgacaataccccttatacaacacaatccactgcagcgcaccttcctggatcataatcacccccttataaacaaggcatggactccccagcgacccccgtgggcttatctccgccacttctcagtctggtgctccgcaatgaaccatgcgatacaaaagataaagccgttgcccatgctggcttgtggttggcacggttaatgtttcacaaccgaaactcgtgaaccggtccttaattgtcatgagcacgaccatcaaaaccatgtgctcacaacccaccattatcaggttttagttggcacattaattaattaactaatcacgattgaccatcgtgaactatcattaaaccatcattaaataataatgaatcattagttatcccaaaagtgagctaatgtttctaagcagggctaagcaattatatctaatatcttgttgaaccaatatataaagctcaactagtcaagttataataacccaaggtatcaaggaataaggtaaacaagaacaaaaggggctataacaatgaataggttaattccacccaatgacattcgaaaataaatgcaatagttgaatagaaacaatagctttaaataggatcaacatgctcaaagggttgtttgggatctgtgtgacttgccttgctggccttggaattcttcaaactattctccgacgaaaacggactctccggaaacgacggaatctaagcagaaaagaataaaatcaccaaaacagcacataaacaagcatgaacagtacatgtggatatttttaatgtgtagatctcaattttagaaaaatttagagacttgaaccaactaaattggagctaagatgaattagttatgaatttttaaagattaaaccggattaaaacacttaaatcggcttaaattgaattatgacgcaataatgaattatttttgaaaaggaaaaggggatttattgcgtcagcggctagggtttcggtggaccgggcgcacgggcggcggttcacgcgaacggacggccgagatctaaccgacccaagatggacggccgagatcgatcgggtccacggcggttcacggcggacggacccga

SEQ ID NO: 36924 - DNA, 301 bp, Oryza sativa
cagcggctttctttcctctgcgtttcttggattgcagcaaaatcgatcccccccccccccacccccccgtaccatttttggtggtggattgcagttcttgtgccatcgatttgggtgggattcgggcgccgcgtggaaggaaaggtttcttctggggtgcccagttgggctaaatttctgggtagctcccgccattgtcgaagctcttcagttcttttgcgtttcttgggccttgtatcagatccgtgcccttgcgatttcttgtaattggaggtgagagagagagagagagagagaggtc

SEQ ID NO: 36925 - DNA, 1501 bp, Oryza sativa
gggaagaggggtcatcgtcggaaggcagtcttgcaggcatccttcaaggaagctgaggaggctaaaagaaaggctgaagacgaggcagcgacgctgaggaagaagatggtggcaatggaagaaagtcagaagaaactgcaagaggatttggcgaatatgaagagtacagttagtgctatgcagaagacgacgtcaactggtgacctatcggatggtcaaacgcaaaactttccacaggtaaatggagtatccagctataatccattttgcacctccagaaagtatctatcattgtaacagcttatcccactgtttctgatccggaatccatgcttcctcctcatccattccaggtccaaaattcacgaagcgctcatgagattttgcagccatatcttgactactctgcactgtacgatccttctgcctcccctagtccacgatttcgatgataatcgcaccacagacaatgccaatatgcatggttgattccatcttgatcgtggaatggtgtatgaaacgaagaggtttagacgtttagttggccgttcatgtgtaatgttggctctctaaacccggagcccagtgcttgtactcttctgttttattggctactgtaacaggatactctcttctgttttgtttacactgactagaactacttcacttcgcatttcccttcctgtgaaatgattttgggcgtgtttagtgaagcttgagattctgagaagcagttaattggtagccagtttctgagaatatagaaaagttgggtttctcagcttctgccttcgagcttatagttcattttctggattctatatctacaacttctcagaatctgtaccaaaacatagactatttaagggagcttttggttatgggagaagttgcagcagctagaaactcccccaaacatactctctatagggttataccttgtgttttctaattgtactacgagttgaattggcaaaaacgcgacgaattttctgtgcttcaagggctgttttggattgaagccaaaatgcgctctaccaaaattttggtaactttgaatagtaaacatgctagtttgaattgaaaccaaacaattggtaatgcccatactcaatttgatcacattctagaaacttcttcaccatactaaactttggtttaatattggtatcaaaccaaacatgggctagcctactttaccctaccagaaaaaattagtattagtaccaaaatttacctagatttgggtgtaggtgtagggtagagaaccatataggcggagaagtttagggaaagttggtagtttgaaaaaaaaagttgggagtttatgtctgtaggaaagttttgaatgtgatgtgatgtgatgtgatggaaagttgggagttgggggaagtttggtgtgaactaaacacaccccaagtgatgtttgtttgccttttagtgacgacctgacgtctcgacggcccaaacgttcgcctccacactccgacgctactgcgct

SEQ ID NO: 36926 - DNA, 1501 bp, Oryza sativa
atgaaccaagcggtggaaagaatgcacggaggaggattcgcttccgttaccgcagtaacgacgcaatcaatgagtattgaatcgcctgcccgtgcccgttacagaggtaatctcgtggagttgaattctgaaccgatgcaaaaggagagagagacgagacgccacaccacggctcggcgcgcgcgcggggctttccgatccccatctcaaccggtcaatatggagcctccaataactccctatttaagttgagttactccacttttaattcccaaggtggtattattatctttaatatttattatgggcccttgagatttaatagaaataaatcgggcctaacccatttattctaacagcgcctattacatgctatagatttacgagcatatttaagtacagtatggtttttttgaaaaaatatatcagtttcttataatagtattttaaattaactttcaactttgtagtatttaattcatttatttgtgcccacaaaatgtattaattaaaaagtcagatgatcagataaaaagactacacaccgagtcaattcaggttgaagaattagtgcttaaggactacctttaaccgcctttgagcttttgaaatatgacccttttttgctggaaagcacagtgagcatgacacgagagatgctcggcgaagggagaacaaaacctttgttcaaaaccattttcggtaggattccatagtagaggattttctctaatctcttactcttcttacaagaagacgggttttaaaaagaagaggctattcgcttatacgatacctttttttcttacaaaactttcatttggtatgccgtgactaaatatagattttattttcttttagaaacacagacattcacaacgtgttacgctcatcactgtgaacatgtgcatgtacatgtaccctaccctcaagagtaacttcggaagactgagttggtaacttgagattgataaagtctgatatatatctcgctgtggatgaatatctagttgatcaaatgattgtgaactttgtttgtgttatggagtataagatttttattaaaagttcatgtagcagttctctttttttaaaaaaaaatgcgacatacatattgtcctttcttcttgtcctaaaatagaaactccattagtgtttgtgaatactccggatgccagttatacctgatcgatgttgattaaagttttgaccgtttcattataagcacaaaataccgtaactgtagaatattagtattttagttttctttatgagaaaattaagctgtcctaaacacttagaactttcaaacaccatcgatcaaagcttgttaattgagtcaagataaataaatcatcaagaaagcaaagtattagggcaatccaacccaaaaaatagagtaaattgcatcgccggtgtatcaacttggcatgtgggtgcaaaatagtgcaagaacttgagaaatgagcaatctagtgtaacaacttggtagataggtgta

SEQ ID NO: 36927 - DNA, 1501 bp, Oryza sativa
ggtgttttcagcctatgcaacttatatactccatccatttgaccaagcttgtttaaaaaagtagtaacatttttaacccaagacaaatatattatgaaatatattcaattatagatttaataaacttacttggtgaagtcaaacgacttcaagtttgatcaagtttgtagataaatgtagtaatatttgcaacactaaataagttcattaaatctataattgaatatatttcataatatatttgtcttgagttaaaaatattactactttttttaacaagcttggtcaaattagagtagtttgactttgaccaaagtccaaaacaacttctaatctgaaacggagggagtagaatatcaaggcaccgtgttaatttcaattcggagtttcggggtgtggcaccatgttaaactagttgatgcccgcgctttactgcgggatatgtggatgaatgtatattatacattataaaaaatgatagacgtatatatgtttagataatgtgaagatggtgatttaacattgcttgcgtgataagttcaaacaaaattttttcgtcaaaaaaagttcaaactaaattacaaatgatatatcatgttggcatgaaatctagaatactctgtataataattgctagtgagtgatgatatggcacacttgcatgttaaactttaaaagttagtgggtatcagctatatataaagtatagttgtctttggtataagagcaggtacaataagatccttttgccggtgacaacggctccacgttggttttgattgtgcgctggaggagagagaacgcgtcagcgagcgactaattagtcaccgagctatatgcgtgttccgagaaattgtgggcccaagcatatgagagttgcgggagccgggaggataggatgatcgatgcagcatcacgatcatgcggaataaaataaatatatgatgcatcatgattatagcccatttattgtactatatttgcctcttaagtttgatgaagatgatgtggaagaaattggagtaagcaatgggctacactattaaacttcctctaagtatgattaaccatgttaaatgtgtttgcacacgagacacgactaaccatgtaacgagtaatcttttgacctgtgccacgtcatctcaatctttggcccccctgctctcgcaagctcatgccatggccgccgtcgctgccaccgcgccggcgacctccgtgaccgccgctaccttctcgccatccctcccattgctctctcgctaccaactcccccgcgcccaccgggccgcgtccaccgtggcgttcgccgcgcgccgcttccgcggcgtaaaccctagcagcgaccgcccccgcgggaggcgcgcctccgtcccggccgctcccaccacctccgccgcccgcgacgacggcggcggcggcggcggcatcgatgccctcgaggcggagctctggcgcctccatcgccgggcggagctgcgccttcaccgcctcgccgccgagg

SEQ ID NO: 36928 - DNA, 1501 bp, Oryza sativa
aggtcgaatatccacggcctcagagtcacagttaaaacccatgaggtttttgttttttgttgaacaaaaacccatgaagttagcaagacatcgatgtgtagtagtggttggggtcttaggagaggagacactcaaacacgggaggtagacaatgtgcaagaaaaatcaaagaattataagagacctcgtcctctagaacttttttttacttaactctagaaccatttcaaatcgtggcaaagaggtcatataagatctcacccacaaattaattatatgtatattgctacgcgttacaacataatcctttacataactagttgtaaacttaattatcagtgcacaacgaccttggtgtacttcgtcatgtcagtggtggctcgcccgtcagtcttgagcggaaaatagaaggggtaaatctcgtagcgcacccaacaggtgctgtattcgatctgacatccctccgcggcgttgcagatgtcgccgaagtcggacactgccgtcgacaggcattgggcacatgccagcggtgctagatcccgcgtgcactgcgacagcccgtagatgttcacaaacgtcatgtatttttccttcacccttcccaatgcggcactccccgcggtcgccaccgcctggggtatttgtccatcgtcttcgccaccaccttttggaacgtcttagggttgtccatgttttcttctttcctaattcttacgctggcgtccaccctcgtgtccacctgtccaatgaagttggcgttcttgtaccgcatgaagcagtagtcatacctgaaattacatatgtatgtacgtcacacacaacacatgatataagttcgtcataaaaaaaacagtcgtgcataatcgtagtttttaaaagaaaatcttataggccttcttatatttaaactaggtgataccaagtgctttgctgcgaaacgcatagatgaatatatgttaaatattatataaataatgaatattgaaatattgtgaaaatgatgtgagaaagatgatttgacatatttacatgttaaacactacaatattatactctagaatagtacttgtcggtgacatggggctgggggtatcgtgactagaggcttggatagccgcggtcacccacgtggcctgaccccctcgggggggtcgggcccgaggatgacgtggccacccctccctctgtctccccgaggggtcggaccgctcccgtttcggccccgagggctggggcgcccccgtttcggccccgagggctggggcgccccgaccccctgcggttttggcgccacatgtgtgggttaggtgagcacagcggggctcacctaaccgcatttatagcaggttggacgagcgcaccacgctgcattcaatgcggcgcagcgcacgcttatccggtccgtgaccagtcgcggtgtgtgaccggtcacagatcggtcagatcgcgggttaggtggcaacaggcggcctgtcacacgcctcgccccgtcccgtcggaa

SEQ ID NO: 36929 - DNA, 569 bp, Oryza sativa
ccaacgctttccaaagggattaggccgaagattccaaaggagaaaaggtagagaagatcccgaagatcatttcccctctattaatcgggcgggagaagaaaagaggcggccggatttggaagaaaacagcggcggcggctcggcggcggcacgatagggtttcggcccgaggaagacgacgggcctgacaggtgggacccacctgtcagcggctgcaagggcgcgcgcgcgcgcggctggctgcggactgggccggctgggccgagaagagagagaaggcggttttgggccgactttcggcccaaagccaaaagaagactttttaaaactttttcaatttaaattatttcttaaatgcaattccatttattaaaaatacttccttagctcaaataaatcccagaaaaatctaggaattatagaattaagcaaagtatttaatgaaattttatctggcccaattttatattggaatttattaattagaattagattttcttttcaagacttttaaaataaattctagaaattccatttaaacaacaatttatatattttgaattttcagg

SEQ ID NO: 36930 - DNA, 337 bp, Oryza sativa
attcagtcctatattcgtcttctagggttttacattcttcctctcgggtcctatattcattttctgggctcctgtatttgttctccgagtctttctctcgattcctatattcgtcctctagggtcctatatctaaatttaacaattctcaaatcctttttatcatttttgtatcgtgggttgtcaaaataagcaactatagtatttctacgtaaaacacccataaagggtatttcaatcgaaatcccaaaaacaggatattggttctttcgcttgctcttgatgatactgtttcttcgcattttggctaacaaatctgaattattttgaagaataga

SEQ ID NO: 36931 - DNA, 365 bp, Oryza sativa
gtgtgtgaaaccttcgatggaccggaggtggttggtccttgctaggggaatagatacttgggttgacaccaagagagatccaatattgcaaaaaaaaaaaaaattctaacatagctgctctattgcgtccatagatgttagtggacatataaatatgcctgctagtatgttaagcatgctccatttggaggtagtaactggtaaggtctcagcttttgtattcaaatttggaacctaacttgcataatttcttgaagcatcaatcgacgatatatgccaatcgctgaattcgccaatgtagctatccggcctttcttagctggagcacaaaacctaaccccagttcactcctgacgctttgcagg

SEQ ID NO: 36932 - DNA, 1501 bp, Oryza sativa
agagataaaagtaatgataacaaaccgtgctctctgtgctctcagcgctctcagccgctgatttgagcagggaaaaagatcgtcgaatcatattcgagtgtacatttggagcaactgtcacgggacagcggggaatgtggttactgttagagttttgggcctaagcccaaatagaaattgtgaacggcataacatgagctaaacactccaggtaagacgttatccacggacagtacagtaaaatcgaaacggaaagattgttttcacgatccaagttcatgtgcaacatgctgaaccattgaatgcttttgttaagattcgtcctgtactgaaaagaaaagaaagtacaataatgtgatttatgacatatatacatgaatctcaaaaatctcaaagtaagcgacaaatgttcaacttagaatgacaacatgacatcaacaagggaacacactgatcacacaccctcgtcaagtcgatccgtcgaccgatgaccgttgatcgataaaacgtactactacgatggatggatggttaggagccacggagaataatactcccccgttccataacatagtaacctagctgtcccattcaatattaggttgctatattaagagatggagggagtaatttcctcgatcaccagacatctggccaacccgcggctaatcgcaatcgcaaaataaagaaacaagaagagattatcgccccgacaacgggagaagatttgggagttggtgattccacgtatatatacacgagagaactggccggagagcaatagttgaagtcactcatccatgcattgcgcttgcgcatacgcgacaccgatcgccggtggattgacggcttccgctgtagtcgacgcgattgatagatagctcggcagtgggcagataaagcggccacacgtacactaacgtaggtgcgcttgaatgggcaaaacacgcacactgcagtgcagtactctctcccttacattaaaaaatcaatctagctttaaacatgatatatctgagtaatataattttagacagagatatatttaaatttataatagtattaagttatgtcatatttaatactattgttttttttacgaaagagattgcactaggaatacgagtagtagtactagtttggttgacagggcacccgatggatggagacatacacgcatgcgcctgcctggatcctgtcgacgcagtcgctcgcacatgcagaggaggatttcccggagggaagaaacgacagcatagctagagagcattactagatgattttgattgaaaatacaggaaacatgcacgagaaaaggtgaaaaggccggccggctcagctcaggctgcgcgctgggcttctacagatatgtgtgcatttctctggcccagttttgttttgcatgttctcggcacgaatttctgccggatgaaacttattactatgtagtacttctattatcctataatataaaacacaaccacttttttctcatgtttta

SEQ ID NO: 36933 - DNA, 202 bp, Oryza sativa
cccccccccccccccccccgtgcgcgcatggatcaggcgggctgggttctccccctttgtgtggatcccgccgcctctcctcttccctcacacatggtagggagggaacgacaaccgaggtggcatggagagcccaccaaatctgcagatgacaccagtgggagggtggatctggcaggctctccccctcttgtgtggatca

SEQ ID NO: 36934 - DNA, 1501 bp, Oryza sativa
ctcctcaagacctagacctcctcatccctctcctctgtgtgtggccatggtgacccggtgaagcagccgttgcagccgcttcactcctgtgcaatggttaaaacaaaattttgatagctctatcaatccctttaccatttccccttcctttctcttttcatttttccttcctccttccaatcttctttctgttcaagttcttctagaccaagagatacccgactcctcccttctttgcaccatgtggctaggaggcgagttgcccccatctctcggcggctccgtcatcaccgccattaactcgacctagccttgcatgcacccgttccgacccccatatgcgaagaagcgacgccgcactaaagcactgaatggccaacgccacgccacaacctttccgcaaaatccatatgcctctgtgctacaatagccccagcaaaatccagccgcatctgcattttttttattgctgtagtcgcgtgagggagggagaggatcccgtgccaatctcttggaacgggataccgactaaatgcattttcgattatatatcctggtatgtatatcctaagtaaattgatactgttttatattataagattcagatttttgatttatcatgatttatccttagtattaatacttccatgacatatatatactcacatgttgataaactttacgaactttttataaattaatattaaagatagaaatgttttattttacgacaaaactagaataaaacaagtgatttgaaatggagggagtacaaataatttttcacaaacgcaagttcaaataaagaattttgtgtcacaaaatttgactgtttgggtgctaattaagttgattgcatgaatgttccaacagggaatttttttttttgcggggatccaacagggaaattaaatattcttactagtttcttactgaacttttgtatgtgaccatcacacatccaaatgtctcgatccatatatataaagttacgcaagatttttgtgctggtaccgcgtccaataattgggtgtgtcacatcgatcatttttttcgtcataccgtaaatgtggttgggagctaaaatatatggcagccagaaaggcacgatcggattgaaaaggccaaattgggtggaaagaatgtctttaacacatgcgcagggggcacgcaattgaaaaatgcacgagcaagcgattggaggggctccggccacgacggctccaagagaaagggagggctgctgtataacctgaccctgaaagcatgcgtgtacatgtggctgcctgtaccgacaagactcgcaaaatggggcagagtcgccatgcaaccttgccggcgcatgcagggtttggactgaccggccggccggctggccacgagcgcgatcatcacgatcatatattcatattcaggggtcaaagccacttctggcagatgctgagagttactagcatatgcatttcagcgtatgcatgtgctcttttgatcaggagtaagt

SEQ ID NO: 36935 - DNA, 1501 bp, Oryza sativa
caggaagtggctccaacagcataaaattcatcatgcaataacccatcccacacaagttaagaatttagagtctagccaagtgtaatacatgtcccggtgctcagtaaccgcgagcacggctattcgaatagatttggtttactcacactgcagtggatgtacactttacccgcactccgtgactgcccaacacatgagcctcgtcccaacacatgagacgcgtcacggcaaagcttttcgataacctcgcattggcagtacccgctccatgaacttaaatcctcatgcactctaggcgtacacggtttctagcagtgagaggagttctggcgcacccggggaggaaagactcacacatgcattaagttgtaattatgttcaaattctcacatggtagtcctactgatggcgacaccactgtagacacccgcctcgcggttctaccaatgactgccccaccgtagagcccctaccgcacacatcaagaaaccactatgcatggatactgcctccgctcagctatctattccgctaggtctatacccatacgagaagtgcggttgtacgggggtcgtttcatgcttaacttcatggctcggtccttaattgaccagggacggcactaaccttttcccggacaccacccaagtcctccagccgccccagtcgaaaacagttgttttactttattttcctttcacaaatcatgtcatcaatatcatggcaatgtggcgctcatgtctccacatgccgcatctcaattaccttcccaaaggtaattgcccaagcatatagcatttgataaatatgagtatgcatgaatctaaaatagcatttctaagcaagtgtcatagttgactaaggactcgtacgtatctatggttacaaagatttaaaggtgaacaatagtcaaggcatggtataatcacaagtaggatgttcataattgcatgcaattttatttgtaaacaaaacaatttcgcaattgggatcaacatgttcaaagaatagtgatgacttgcctgctcaggataatccctattctcgatataatcttgatcaaccttcaccttctggaagttgcagacgttgcctcacgactaaccgatacacaaagtctataatacgcgagaaaaaccaatattcaagcaacaatcaaatatgcacagacaaaatatatttgctgaggtcgaacctaaggttgcttatattattcgcgcttgctaatggactctaatcaagctaagagctaaggtttcttagtctttctgttgtcatggtggttcagtctagctaatggctaaggaagggttatggttacacatgcatctatctaaatagaacggttatacactagaggttctgttgccggatggattttggatcggtcaaataattactgtgaatcatttgtattattattttattaatggaggctttattttaattatgtacatatttcacttctcaaaataaattataaaaggttaacaattaccca

SEQ ID NO: 36936 - DNA, 502 bp, Oryza sativa
gaagataaatgtgcatctgctgttttagatgcacttggttctgtccagggaagattaactgtggatctttagttactgaaacatttggaacagctggctattaaaaccacaaattcacaagctatattacttaagtgctgcttgtgaattttggttaactttgacacctgaaggatcttaccttgaagataaatgcgcatctgctattttagatgcacttggttctgttcagggaagattaactgtggattctttacttactgattattagtctttacagtctagcgtgtaaaaccgtgaatgccacttctgtgtttcattcacttgtgttcaggttttagcaaacataattcagattggtctggatggcatagcatatgaatgattattgaagctgccagtagttgaataatgctttgaccataagtagcaccccgaatatgttatatgcaggattatcagtacttgttgcgtatgttgcaccgtctttcatttttgtagc

SEQ ID NO: 36937 - DNA, 1501 bp, Oryza sativa
acggttgggtcggttacaaaggcggatcgattaatttggctggtcctacgtaaccgtgtatgggccggagcggaggggcgcatgccgccacttcgcgtagggtatggccgggtatgaatattcatggccgagcagttaaaatttcctctttgcgattattgtctaccaggaataaaggggagaaagaaaaagacaaacgtcgttgttgccgtgttagattctgtcaatcagtatgtgcttgggttaatttaccaatcgctattcttagtggaacctttttgtgttttctctggctcagttggtctggttttgttttgtcggcacatgaagacatgcaaatgttttgaagcaattctcctacgtactgttggaattagatggtcgcaaggtcgcttctcccaatagctagctataacacgttgcatgccgggctaccatagttagtttgtaatacaaacaagaaagatttttgcacgttcttccgaatattgcgtttctttatggactaacgataagaaagaaaaaaaaagaaaaaaatgcaatgtgaaaaaaaatcaatatattggtaaataaaaatagtcattgatcagcataagggaaaatggatcctctaagtctgtgttcgctaatggggttgggaacccatcttctccgcacggaaaacagattagtctattagcgcgtgattaattaagtattagatttttttaaaaaaaatagattaatttgagttttttaagtaattttcgtatagaatttttttttttaaaaaacgtatcgtttatcagtttgaaaagtgcgtgcgtgaaaaagagggagagtggttgggaacccaggacaaagaatacaaccttagctagctagagtaaccgtagcagagctctgttactggttacttagttgtggattgcgttagccgttggatagatctccaactgaccataccaagcatggtttatatattttctcgcaatgacatgatgtaaagccgtagaggtatgtgtttctctcgtcctccctctacctttccgtctctaattagttgcttgcatcactagatctgccagttcccaatccacacagcaccaatacatttgtattttactgcaacaattgttgtttctaaatacgcaaacgacacaataatgatgagcaagaagaggaacaaatattcatcaatcatgacagtaggcaggctgcatgctattgatggagaagtcacgcgcttttcgcaattaggcgactgctcaatccgatgatcatatattagacattttccattacgacaaatgccagaaaaaactagaatagcattctcacgtagtccaccaagccggtaggtatatatgaatgttaattagtagctgccatttagctaggtacttaaataaaataattattgtgcattaaaattgagatgagctaacgcatcatgcactaatagaaaaacgatttttccaaacattacgatttatttttccaagcgaccataaaatcaatg

SEQ ID NO: 36938 - DNA, 1501 bp, Oryza sativa
tgttgaaaagtattgtcagttgtcacccttctttgaattcaacgtatcttgcatttgattggtccacatctcaaatgagagatgcagcaaacaaggcaaaaaaaaaaaaaatgcaacagcataacactagaacagtttcagactttcagtggaacaatggataactcaaatcagaggatgacggcttaatcattcgtcaggacaaaattctatcaacgcatccaacaactcacaatatccaaaccggcaactggttttacatcatcacgcatgcttgctagggccagagccagccacgggtcctgggctccggcgccgcagggtgatgcgcgcggtcgctgcgccgcggtggtctgtgcacgactccacccttcgcggatcgcgagcagccaggcgtacagcggcagcgcgctcggcgggcgacgaacgacggggatcggagaggcgcagctgcggaggctacgaggacaccggcggcgtacgtgcgcgaggtcacgcgcgtcagcgcaccagctgcagcgacttccaacgacccaaccctagcgcctacctgacctccaccacacctccccaccctcccaacgcttgagcagtagcgaggtgtctctaccctactcgtctatcccgtctttgcctgctctcaccgtcgagacggattgtgatcttctgacgttggagtcaaaggaacgtgctgactgacatgtgaactccaccgctcgtaggtctactcaggaggagttcacgttagatgatccgcttcccgtcgagactcaacaccatcactacccttgtggccaaaccactctaaaatctgatgctcctgccgcctcatccttctcccatcctcttctccaagtccgaaaatcctaactcgaagaaaagccatctgggatttgggtgccagcgccactggcggccaaggctagctcgccgtcgtcgtcgtcgcggttgagtcctcgctatctccttccttcctatctcttcgaattcctgcccgcctccttgtggaacttgaaagtgactgaaattcctagcatttccattttggtttttgtcatcttgacacatccatcccgtcgtagagtagttgccaactaacgttccatcaacattgcgcgtttctgcacttctttacgtgcaacgtacaaagattaatagatttcgaatagatttcgttaattacatgacactttctagttattacagtgacattgcatggactgttattttattttttttcacacacactgtttcatgccaagattgatgtatctggcgatatcacacggtactccacccttaacacactactactcccatacgacgatagtcgatagttgatacacattctcttattcgaaagaaaaaaaaagatagacacgttataattagacattaattattttgtcgtgcatggccttgtcaaccgaacacgtagctgttgtccagcgacctgaacacggtgggctcctcatccatcgccaccgccaactccggcgac

SEQ ID NO: 36939 - DNA, 1501 bp, Oryza sativa
tatagactattcttttaatatttcttatttttttatttctaatttcaattgtttcaaaattgtattcctacttaaactctcttttttatttttctaattttttattttatttgatttttttattttgaattttaattaacatcatattggtttcttatatggactcttattttaatattgtttattttcaaattgtattcctacgtgaactctccttttatttttctaattttggattttattttatttttatttcgaattttaattaatctcgtattgggttattatatggactgttctttcaatatcccttatttttaattccgaatttcagttattttaaaattgtattcctacttggactcttcttcttttttttttctttttttttgctaattttggattttattttatttttattctgaatttggattaatctcgtattaggttcttatatggactcttctttcaatattacttaattttaattccgaatttcaggtatttttagattgtatttctacttggactcttcttttttttttctccgattaatgtggaaatttctaaccttcacagcgaacgtggtgtctgctttcaaagctattttaataatataatagatagatagatagatagatagatataatacgtccctatataaaaagagaaggaagggaatatatctttcccacattgtaggtagcccatctcacgggtacttttttgttttggcattctttattttaaggctcctttccagctaggctgatatcatgacatgacatagtaatgatgtaatcaagagtctaatatgtgtcattagtacacaataacaagttggagcaagaacatgtatatgttaattactcccttcagtcagaaatatttgacgccgcccaagaaggccgacaggctagtagaaactagaaagcagaagtgaaatatcacatagtaatacattagcacgctgcagtgggcatatatttttatttcttcatctcgaataattggacaattcctttcttgtccacttaaaaattcgcatatgtgcaccctttcttcgtcttcaccaaagatgggaaaaggaaagctgccttgcttgcaaagcagacaatgcacatgtaatatggacgtcattcggaaaagcgtaatcacaactcacaatccacgcgagtatttaaaccaacaattgaaacatgcaaattaaagcgcactgaaatcaatcagcgtcaccaggatgtcgtgctcgtgccagcgtcagtcgccgtcgtcgggaggccgcggccgcgccgtccccgtcgccgacgcggccccgggcgagctggcggcgccggaggccatcaacctagtccccaacgggaagcgcggcatgccggtgctgatcacgccgtcgctaccgcagcagcagggcggcgcgtcggcggcggcgttccatggcatcatcgtgctcaaggaggagagcgaggacccggtggcgctgcggaacaagtggttcagg

SEQ ID NO: 36940 - DNA, 199 bp, Oryza sativa
aaagacagttgttgtctctaatatggagtacttcacatcacctatattgtcttgtagatagtttggagagctgtgtccgagacaaatatttttccactcaacactagcaaaattctatattcattgcctttaaaaacgctcctagcaatctgtttgatcccagtttgcatatgtcagtagccaaaacaacattcttttc

SEQ ID NO: 36941 - DNA, 1501 bp, Oryza sativa
gatagcggagaagtattttgcccaaagggaattctttctttgattctagggcttcggctacaaactgccagttggttatagggccacagctggatccacagaagaggaacttttccagccacataagcaagaaagctacatgctctcgaggggtaacggatccttggcccatatatgccgccacatagccagactaaccacctatgcttttggtcttgaagtcaaattggttcttagtgttcatactcatggggttagccgatgaagtcacatctaatccagtaatcatggtgatgtcgattaaagttggagtcatcggcccttggttgaataagaaagcattgatggtattcgaccagaagtaggtggtggcagccatcagaggttcatccttaacagaattggctatggtgagagcaagtgcttggccgattccaatctcatcccagtgaactttcttactagccgatacgcgttggtaccaggtggtccagctcttatcaggtgtgggtttttcgagatatggccaagacttgaaggtattcttccagtgacccaagtcagggttggctagcctgaaggggatccggttggtttcaccaatgatgaaatcagtggggtcgagattgccgattgggctgagaaaatagtggtttttgtgtgaaaggctgggaatcgcgacttggtttgagagatgctacaaatccaagacaaccgagagaaagagagcgatgtaagataggagaaaatcgatctgctgctaagaaaggggatctagccgatggggacttacctcagcatactcggctgatggcgcattagatggattggtggaagacgacatcgctacaggcggaggtctcgtcggagatgaagtcgcccgggagtcgcttttgcgtcggaggaatcgccggagagagagaggataaagtttcgcttgagcggtgaaaacggaagtcacggtgtgagattcctcgagggtgacggttagtatttaaagcacggcaataatggtcggaaaacggcaaagtgtgaaacttgctcggagttgatttacagcaaatccgaaacattaccaaatattccggacttagggggcatgtgttaacaaccaaatttggtaatatcggcattggaaaggaagattagattgaagcgaagtcggaggcagagatcgagttcgaaaacagagcagggatcggctggagtccagatcggctacgatgagatcggctgagtctgggtcggactaggtaagctgatgtagccgatcctagcaatacaacttgatgtgtgatgtcgggttggattgaggtacttcaaggtgattgccgcacatggataaagtcctgaggaggcaattgtatctattaattaggatgttttatgtaatttccttagagatatgattgggcaaaagtctgccgcaaagacttatagtatcttagagtttgttagagacagtagtcgtgtccgttatggacatatcttgtaattctcg

SEQ ID NO: 36942 - DNA, 1501 bp, Oryza sativa
agtttaaaaattttgttgaaattgatacgatgtgatagaaaagttgtgtgtgtatgaaaggtttgatgtgatggaaagttggaagtttggaaaaaaaaacttttgaactaaacagggcctaactgagaagacgggctaagctacacaagtaatgagaaacgtttaggggtttttcagctagcttcataagatggtggacagtggtggactagttggtttgggttcgaagtctcaccccattctatttatttgatattaggccattccataaatttgtggtttttacacaattaataaagacaaactaatttctatacgcatagggcttggttgtcacatcggatatacggacacacatttgaagtattaaacgtagtctaataacaaaaaattacagattccaccagaaaaccgcgagacaaatttattaagcctaattaatccgttattagtaaatgtttgctgtagcaccacattgtcaaatcatggtgcaattaggctcaaaagattcgtcttgcaatttccgtcagaactgtgtaattggtttgttttttttcacatttaggacttgtttagttggggaaaaattttagatttagttgtcacattagatatacgggcacacatttaaagtattagatgtagtctaataacaaagcaaattacagattccgtcaggaaactacgagacaaatttattaagcctcattaatccatcattagcaaatgcttactgtagcaccacattatcaaatcatggcgcaattagacttaaaagattcatctcgcaatttacgtgcaaactgtgtaattgttttttttttgtccaaaattaatactccatgtatgttctaaaacattcgatatgatgggtgaaaagtttttgttctagaaactaaataagtccttaatactccatacatacatctaaacattcgatgtgatgagtgaaaagtttttttttgaaactaagggccagttcactttgatgccattttcaaccttaataaattttgataaagttgccaaaaaatagctacatttagtttgctaccaattttttggtaactatataagaaatcatgccaaaatttgataagttgccaaaatttttataatgccaaaatttggtaggtttttttttcatcaaagtgaataggccctaaacgagcccattaagttggtcatgctattattaagcaaaaggtacagtatctacttataatctgaaggagaatcagatgttgggctggtggctgctgctggttctcagctcacccgccgtggtggtggggactttctagaagaagacggcaagtgtcaagacttgtagtttactccgttgatctgctccaaccaaacctcccatctccctcccccctcccctgccacctccacctccactctccccttccaaccacaaccccccatcagcgcgagctcccccagatctccccccacctccactgccgatgacctccgccgcctagcttcccatcca

SEQ ID NO: 36943 - DNA, 1501 bp, Oryza sativa
  unsure (1)..(1501): unsure at all n locations
ttcaaccatatggagtagggcaatgcgattgtgctttggattatagggctggtttggtttgtggcctaaattggccttaccaatttttgtcaatgtcaaattttggcaatttttggcatggctaattttggtaaaggtaaaattgtgtttggattgaagccaaaatagcctaaattaactgtttgaatggcctattttcttaggcatgctaaaatttggctccaaaccaaatagacaataaacactattgaaattgacaaatattggtaaagccaatttagaccttaaaccaaaccagctcatagtccaaatttatcttgaatttgaaagcttaattttgaagtacaataagacagatttttttcatgtcttcgtggtattatgaaaatattatgaaaacagatgacgtcgataaataaaattctaaacttgagaatcaacttggcattaaagcacaataaagcattgcatgtaacgctgagcttgctccacccccaagctccatcacatcctttttttttcacctatactatataaaggtggaggatttaatagaattaatttaacgtatagatgttattatattttaaattttataaagtttaacttaagacaaaaccaaaactatcttacattgtgaaacagggaagcaggatatatataaatcaatttagccatgaaggatatttcgttgaaggtaaagcaattatattacaaataccttggcaccaagaaaatttcagggatcaatttataaaaataagattttttaaaaggactaaaatatacataaaaaaccccccaactaaaacaccaactaaaacaggcgagtaggatatactaccttcaattatattaatagataatgccgttgtcacatgtttaaccatccgtcttattttaaaaaaaatacataatttattttgttgtgagttgttatatcacttaaagtattttaaacatgatttatatctgatacgttttaataaaaaaatttagcaaggaaggagatattttgcaattacagatacagaaaagcacagaagcagaaacagaaaaaagatcatccaggctgagagagtccatataaaatccaaataacaataattaatcagcacgagacaagtccctatccaacccaaaaaaatataaaatccccaaaccaccctctctctccccttctcttcgcgtgatctttcttcgcacgcagttggcaccaactccccaccacttcgcttcgcttcccttccctcctcacctctcccgcgcgcgcgagtttaaccgcttaattataaccgccttcggattagcgcggctataataccgcgcgcgattggctgattagccctaggcaacgctcgctaacacgccaccacctcggcttcgctgtttgctgtttgctgctgctgcttctagggttagggtttggggtggggaggggtggatgcgcgtgggctggtggtggtggtggngatgacgccgcagcggtctccggcggcgg

SEQ ID NO: 36944 - DNA, 182 bp, Oryza sativa
aataaatacttaagattgtgtttagacacaattttttttatgaaaaacatgatacacattaccataaaaaattgggcctctatattataatttgcaccggtccctaaaaactcaggaccagcgctggctgcgattagtggatctaggtccttggcaatgaggtagggtgcgtggacacgcca

SEQ ID NO: 36945 - DNA, 254 bp, Oryza sativa
aaaaaaaaaaaaaaaaaaaaaaaaaaagagagagagagagagagaaagaaacaacaccactacgaagtaacgcgaaatttagtcttgtagtaccatactgttacagttctgaatcgtcaagagcacattagcctattaacatcagataactcggtagcattaacctgagcaggaaagatccaagtcagagctaacatggatgatggatggatagttcttatttttgagctggaaacatgcatatcattaacatg

SEQ ID NO: 36946 - DNA, 533 bp, Oryza sativa
tttgaataagacgaatggtcaaacatgtaagaaaaagtcaacggcgtcatctattaaaaaacggagggagtatctcgtaggtatcacgttatcatgttaccttcggtactagacatgataccctgtgtcaaggttatggataccacatacctaataatagttgattaaatctcggcaggacccaccacataccatgtcctatacggaaacaatctgcggatatagcaggagttccggataaggaaggacaaccagagttctacatggaaacgacgaggactactcggattgtatgcatattggtttccctagttctacttagacaaggggacacctatgggtataaatacaaagccccctaggaggagaggagacacacccaccatagaagacacaatcaacagacacgggcaacatagacgccacaaagccacaagccaatacaagccaacatacgtcaagacaagacgccggatatcgacttcggagataggcacggctaatcccctacggtgtctccggatactgatagg

SEQ ID NO: 36947 - DNA, 1501 bp, Oryza sativa
acgtcatgtagattaagtacacgataagttgtagtttaacgaagtgcacctactcaatcgatctgtactgcttaattggttacgacttgcaagcaagcctaactctctctggaggcaattaacctactatctagaccacaaaaagtattgcacatataattcactacctaacaatgtccgaccgtaccgatctggtaatgcatttgcttgcatcagagcatcatcgacacacctgcatctgcatgcccttctttcctacctagcttgataagcatatacacatctggctaatgcatgtaaggaagtgatggcatgtgtgtcagtgagcaattatattaattagcatgttatgatctgctctgaccaacttcaggtttaaaaacattgcgttggcattgagcccttttcttggtgatcttccaactgaacccaatatatttgcctgttacatcttactactaggctttgattgacaagaaaggaaggggttcaagtgatgatgcattaccttgtatataccttcttgttgcaactagagagattataatctcagattaattaatattagcccactccttaactagttgagtgtggttgcttgttacttcggcactggctttctggtctctttgctctgaccacattccttcttcaccttctgttgaaaagagcctgacttcctgccttcccggtcaccaaattatcttgttttttcatgtgcgacgttttcatcagtgcatgcaagatgtaacctgtttaggtggtgattagctcaagcatcgtgtcactgtggttggtaggatgtccatgaacagtggactgaaagatcagccatgcatgcagcattgatcagaagttcataaccactttactgagacacatcaagccctaaaccttagaaggattaatcgaacaagacctaggaaatattcctgacctctgcataactaatatgcatcatcagtgaaacagaggaaactatgattctctgctacatctattcagcagcttcagtattcaccagcaggtttgaccgaggtcaactgagacaaaaaagctgcagtgcctgaacttgatggatggcgccggcgcatcaaaggtgtctgcgaatgtgtaatcttcctgtaatttgctccctagatgatccacaagatcacaagtaaaagcagtatagttatcgaggccgacttcatcaggatgcttaattagctcgtggaatgatcgtcgccgttgccgtttttcttccaaacctgatcgacggcagtttgtcgcctgtgcaactcgtgcagtttgtcaacaagattcttcagatagctagcttaggcaatggtgcgactaagctagcatttcttcagattcttcagtttgtcaagtaattacttcttgcttggttgactgatgaagtgatatgattgtaagtttgtaacactcccaattgagcaatgataatgacggagttaatccttttcaggaaggcttgacaaatgcttttgttgctttt

SEQ ID NO: 36948 - DNA, 355 bp, Oryza sativa
ggaaaaagtacaccgaaggtccttcaacttgttagtcagatacaaaatcgtcccccaaccgtaaaaccggacatccggcgtccctcaacttacaaaaccagtcacaatagatccctcggcggttgtgatcccggttttgtcccacgtggtggctgactcagcgtgggacccagatgtcaggatgccacgtcatccctcccttcctcctctctctccctctctcacttctctcctcatgggcaggtcatgccgtgacgcgcgtcgagtgccgcggccaccaccactgtgacctgtggcagcgaggggcaggcgcagcggagcgggacggtgaggttgtcgccggcaacgaagccga

SEQ ID NO: 36949 - DNA, 1501 bp, Oryza sativa
ctcaatctcactataatggctcaagatttgggtggaggaagcaaaaggatcttgggagaggctagaaacagctaggaggtgaaagaacaaaagtgaaatggccaaagagtgagcgggagatgaaatccatatatatataacgggtaggtgacgccatctagccgttactcacatttttgaactggaatactacctggaagttccagactggggtgccaggaacatccggccaacacttaggaaaaatctcaatttcacctagtggcccagaagttccggacaagagtgccaaaacttccgggtgggactctctgtcctgggaggggctattttcaaaaataactcccaaaaatagttcaatgagttgaagagcctaagagcacttagggaacctcagagcatcacttgaaacccctcttaatagtacagtttttttcctaaactcgaagcgaaaaataaaactagcctaaaccggctccggttcttctcaccacattgaatctgaagaactggtggggggggtctccaagcgtcctagccacctcgtaagcaacctgggactaatctcttgtacttaagctcaataaaatgcattagttcatttaaccatttagtcattaatcaccaaaacccactagggggttagatgcactttcaacgtcggcatcggagtcagagaagccagggaggttgatgcagcgcgggctacaggagaggatgcagatctaacaacgatgacgaaaaacgtgacgacgatggtatggttctatttcacaaaattccaatggcacgtaggagatatcacgaatagtaatagcatttttataatatagtaattttgcaatggcatgatccaattaaccccttttaataaggattcttttattaataagatgtttatgagtcttaaaaaaagtccgaggctgagccacacgtgtttctatagagagcatatgattgatgaggcattaaaaaggttttttttttgttatgcttcgaacggtatataacctacttaagggattcctttaagaaaggatgtagccagaagtagaaatagaattggaaattcacctttgtatccgctcttgagtttttcgttagtctttgagaggtgcataccattactactaggaggtatatatctattgattagaactacaaagtatatattcctttttacactacaaaaggtgttttgcagagggcttccacggcgaggttgtgtggtggcgtgttgggacgaagtcgaagctgcttgtcggaagtggcaaaatcagcaatgataacccttttctgctttgtctcggcaccgttatggacttgtggcggctttagtgtagttgaaaaagagggggaactggctgaaagccgcacatgtttttttactagtgccaatgacgctgtgacacccataggcgtcatcctccttcttgaaggtgtatttatttgctctcttccttctccttgccccgccgatagttcacactctaagtctagt

SEQ ID NO: 36950 - DNA, 1501 bp, Oryza sativa
catcctattgtagaggtatgtttttttttaaaatttgttcaatttcatataggctgcaggtaggtgactaatacgataaagtaaaagaataacagtcgcctgatgaataaaaaatgtttatcattaatcaaaagctataattttttaaagaaatttattctatttttctatatctatactatgtaaaatgttagtagtggtggtgtccattcccacaccacccctacaactgacatgtgagccccacaatctatattattacatagtcttttaaagagttatctctcatttcactattgattttcctcaaattttaaaatcatttggttgttcaataaggaaaataatattattacttggactaaataagctaattgattttttttttacgaaaaaccagcaggagaggctcctactgaaatgcattgccaatagaagatatttacaatcccaaaaagtttctgagagggagaagaagaaaaaaagaaaatagaacttaaaagaacaattaattgatttagcctagttaattgatttaccttattgattgatttagtaaggtagaaactcaatttgttttccgttgcaacgcacgggctttagcctagtatgatttaaatttcattgtgacatatcagaatttgatcttgtctaaatagctcgagatgcagagaagcagctggtgattagccaccaggtagaacattgggtttctcatattatggcttgtattattattattattattattattattattattattattattattattattattattattattattattattattattatgtaactatggaatgtcagaatttagatgataatctgaactagttaggagtgttggagattctataaaaaggaagatagaagctctcctaaatagggtattcaactggtacatcgttgaaaaaagtaagctatatattgtaactggacattggcttattttttctctctctctctctctctctcatgtttatgataatttgtaaatagttactactccagtctacaatatgaaagcaaggatcatctaaagcatctcgcaatacttgtacatccagatataagaactaattaagcacaactgcgacgcaggaaacatcataaaactaactttagtaacgctacccttgacccaatttcaaacaagtttcaacagaagcagagatatgaagcttcaagagttgaaatataggtcaggtgaccatgacttctatgattctcttccaagctctttcactgtgaacctgaacagagatttgttggcaggaaagctagagaaactgcaggaaatggaaaaccatcttatagaagtaatatttatctacctaatatctatgcagtgtttctaaaaaaaaaatctatgcagtgtttacagcgtcacttatcttaattctccccaactaaaagagattccatctatcctactcatgatataaggcattgtcttcaaaactaatttttgagttataatctt

SEQ ID NO: 36951 - DNA, 1501 bp, Oryza sativa
tttctctattggccttgcatatatgcaaattttataattaggtactaagaacaaaaataatttaatctcatcaacaatttcaaaaatcaatataattagtacttttaaaaaagaaagttaccgaaaaaagcgttaagagtggattttaaaaagatcataattaggtactcggctttggagtcaactttttcccccaattcaataatttataaatttaaaatgaataaataaatgggatttaactcttaattaaaaagcataattataaagttgtgactgtgctcattttcgatttagttaattaacctgttatgattcaggtgtgtcctcatttgctccaatattatgcactatcgagcgaggtttgaatacaattggtcccatcttttcgcttatgtttatgcttatcaaccaaaatttaaattttcaacattaaatttgaagctgattttgaggtttttcatcgaagtttatttttcaacctttgcttttaggtcactaagaacacgtaaataaaagttttattcacaattatttatcgtttgcaaatatgacgtttagcttattcctggggcggaacatgtttatcatgaagatctgaaaattaccatattaatcgaattagaaaaagaaagaagatgcacacttaggccaacttgagctattcggtagcttgagctgcggttggggtgtagcccaacgccaacggtgtcgcaagcatcatataaacgttgggttgtgcagccgtaaccttctgaacacccccttatatcgtgatggtccatattatgacatctagtgattttttatgcaaattttttgcaaagctatataaaagtaaaattgaatttgatatacaactcttagcttctattttaataaatacaagtatattttttataatgtattttgaaaaaaaaacataattggatatcatatacaattgttagcttttgttttcatatatacagtgtggtttgtatacaatgaaaaacactcagggatcttccggctagcttcaaaagatggtgggctagtcgacttgggttcaaagccctactctttttaattatttgatattatgtcattccctaatattcatatttttagtttgtatacaatagttttgaaagtagagttcgattagatatgcaattatgatttttttatatatatatacaagtattttgtgtacaacttatgatttacgtacgaaacaatctacacatcatctgaacccatcatgatctaacggcacaaatatttaattaatgtgaaattttgtatgtctctagaacgaatatggtagctccttttagatctatattgacaatatatatagatagatagataggtatatatttatttatttgtatacgaagtataattttacatagaaaaaaagggaaagataagtactgtatatcaaatcaagttgcactttcaaatatattacatatataacacaattctatagggataaaagttgagtaaatttcta

SEQ ID NO: 36952 - DNA, 1501 bp, Oryza sativa
acaatccgtctcgacggtgagagcaggcaaagacgggatagacgagtagggtagagacacctcgctactgctcaagcgttgggagggtggggaggtgtggtggaggtcaggtaggcgctagggttgggtcgttggaagtcgctgcagctggtgcgctgacgcgcgtgacctcgcgcacgtacgccgccggtgtcctcgtagcctccgcagctgcgcctctccgatccccgtcgttcgtcgcccgccgagcgcgctgccgctgtacgcctggctgctcgcgatccgcgaagggtggagtcgtgcacagaccaccgcggcgcagcgaccgcgcgcatcaccctgcggcgccggagcccaggacccgtggctggctctggccctagcaagcatgcgtgatgatgtaaaaccagttgccggtttggatattgtgagttgttggatgcgttgatagaattttgtcctgacgaatgattaagccgtcatcctctgatttgagttatccattgttccactgaaagtctgaaactgttctagtgttatgctgttgcattttttttttttttgccttgtttgctgcatctctcatttgagatgtggaccaatcaaatgcaagatacgttgaattcaaagaagggtgacaactgacaatacttttcaacaaaagggcttctctgtgcaatcgactgttattctcaggttaattttgcatctctgcttcttgtgctatatgggcttgtgggaaatgtcaagagggttgcatgatcaaatgtaactacagttcaacatagtatgaacaattccatgtagtctactgagcctttgtttagcctttgtttagttccaaactttttcttcaaacttctaacttttccatcacatcaaaacttttctacacacataaacttctaacttttccgtcacattgttccaattttaacgtgaactaaacacaccctgattttcttttaaaaaaatgtttgtgaacttgcttttaagttagtcgattattgatgatttgacattacaaggcactattgctatatttgtatcgcccttttactaaatttgtacttatgcatgggtattacggtgttaaataattagttatgtatgtgaacttgcagtggccgatcaaaataagttctagagcctggctaatattattaagtatttgctacgaagattttgcttctaattcatcgaaaaacattcaaatttcattgtgcagggttgtcgagcagtaaatccacccctgcgaacttgtgaagtagaactatccaatgaaaaatttttagctacaccactagagagagagtaggtggcacgtgcagcgagaggaaaaggttgtcttgcacgaaaatttacgcaatctgaactgctcaaggcaactaaatttataggtattttcaagtttttctcaaaaatactacaaaacagcatatcgttccaacgttcaacgaaataactgttgtcatgatgacgtcagcatgatacctacagg

SEQ ID NO: 36953 - DNA, 1501 bp, Oryza sativa
taccttcatccaagccacgcgatctggttcgtccgcttgcatagtaccacgtcgccccgtcgtcgtggccattcatcaaccgcaggattccagcgacccgccccacgcaacggtggtccaaggccctgccggtagaggcggccccacctgtcggcgatacggtccgtgcgctttgcggacgcgggcgagcaggtgtcacattcttctcaacgcctccgcgagcttactgcgtgtgctccctagctactaccccgtcccgttgattccagaacgttccaccacctcccggatgcactgctccagccacagctccctgcccaaccgtgtggccacacccagaatttctgggccagaaacataggatcagcctactgcgaggtttttaccggttcagagcaggtacaatagcaggcttaagaaagagaaagaaaagcagcgggctacagatttatagtcagctacagcacggactccaagacgtcatgtgtgtatgagatgtgggaccaagtattaatagtatagtaaacaactattgtatgaattgactattacgttggctatagttgatttggagctagtagttggctatactattaaacttcctctaagagaacactagttggcagggattgatatggaataatggtatgcatttactaattatcactaaccaaattttacaaaagttctagatactatgttgtctcaaaatgttgctactaggatgattcttagatgtaatattttgagactaaagtgtttgaaaagtccttatcaccaaatgattaaaatttatgacttacaataaataagtggatacattttctaatatactcccttcaactctaatcgacaacgtcctaacatcaaatactccctccgtttcaaaatgtttgacaccgttgacttttcagtacgtgtttgaccacatatttttttaataagacgaacggtcaaacatgtgctaaaaaatcaactgtgtcaaatattttgaaacggagggagtactacttttattgaccggagcaaatatcttttcttatcttatatcataataaataaaaattgaagctaaatttaaattatctgattataaatatatgtcacaacatggtattggtaaaaaaaaatgatacttgtaaaagaaaaaaaatctcatgtacaagtatatcagataaaaattgatgtggtacgttgtgattgaatcttcatttcattttcacatagactaactagggtgatattatttgtaacatgtgtagcattactctaatctaagtattattactggagtgatatgaactgaagtgatttaccaccacaaccatagtaaaaatccaagggaagaaagaagaggccacaggctggcctccaaagtgtggtggccacacgcgaagtctataaaaccctccctccccttccttatccttcccccaacctctcgccatttctcccccaatctctcaaaaaacccaccactcgaatccaccacgaccttctc

SEQ ID NO: 36954 - DNA, 507 bp, Oryza sativa
atatggaaatacaacccattcttgtggtagagcattttccagtcatggctagaaaatgacatccttctacaccagccagagtagtacccttttttctgatatggttacctgttaatgcattcaaatattactcctttttatgtgcttaactctggatgagatcacacatgaatatgattgttagggtgtcatgctctctgttattatcctgaaaacaccgtcattattgaaactgaggtagtcaagaccctgctggtttaaacaaagtgcggtgtgcatggtgttatgtgatagtttcgaattataactttttaattaagtagatctggacacacatagacttacaatctccataatggctataatcctttgtagaagtaccttctattccaggtttcaccatatcagtataaatgctttatgcatagacaaatcaaactaactaatcatgcacatggttaaaatgatggcaaagcagaataagcattcttctgatattatgtcttc

SEQ ID NO: 36955 - DNA, 1501 bp, Oryza sativa
gaaaaatttagtacgtatagcattgctccctacttaagcttgtaaccttgctgtaccaaaccagaccagttcatgcaaatcattagccttatctgtggttatcggaatgatggcggtagttgtcttcaagcaatcagattatgatattagtgcccttgtttttatattttaatgttatgtgtttctgtctgtttatgaacccaaacaagaaagaaaactgtcatctgttcttgcctgccttgggaaagttgcctcttggtgtgtgtagttgataattggtttctcaggatttgattacactgtggttaatgacgtgcaagagtcagtaacttgcggtgctagacacctgttttcacatgcttacgagtgttatgagttcagacctggaccacccgtaaagtagctcttgaagtatccctattgcagatatcgagcagaggttgggggattatcggcatgatcctcaggatttgatcatgtgcgttgtctactaagttaggagattacatcacctttggaaacaaaaaaggatgaatactactcgtctatcgcctatgaagtctaatattacctgcaaattgtgattttattcttgtttgtttttcagttctatgccgtggccccccacttggaccttagaaaatgtcctgttgttcatctaataaatgttttgcagaatattgtttcggaataatatagctgctccttgcatacattataccactttacagatagtgatgttctccgaatagtttggcaataggaaggctagtactggaccatgtgcttttatctaaaaaaaaatatgctattgactatttctgtcaatttgtgcaaaacattttctgacaaaatacattctatgttttagaactacaaaaatggtgaaaatgttatattactattctcagcaatcacaatccgcagtcttcattgatgaaaatggaactttcctgttcctatgaatagtctattactattattttcagggatggattattctccttttttaaatcatggtttgagatttcttacatttgtctatcagcggcaaaaatgttatttgtcatacatagagacaactagacattgctgatttatcaaggtcataacttgtttaccaaaaaaactctgatttgcccacaatttcaaatgaaagttcaaagccaaggaaaatggtgttccacaagactagttttttctgttcttattcattaacacgaacaatactgtgaatgctgctatttgatacgattacaaccttcaaccttgtttgtacagtgaactatttttttctttaagtttttgagaacttgtgcatgctgattttggtgccattttcatggaatcctcacacctcctttcttcattggtcttgtttgggttatcatcagtgtgtactgacattaatttggtttgcctgatttgtgtatggtcttaaagagtgcaacatgccttaattcgtcatctaccgataccggcaaggggaggagtaagcagt

SEQ ID NO: 36956 - DNA, 1501 bp, Oryza sativa
tggcctttgcatttttgtggagtgctgttgatcaagcttaatgtgaatcgtcagttaacctaaactccgttaataattttctaattctcctcatgggtatcgcggatgataagagaaacaacaattaatagaagatgccgctcccaagttggcaacactggccctaatctcggcgctctagataatgagggaaacaacaagaagaagcgcagattgcactatgcaatgcagtttggaccataatcctatgatatgcgtccctgggctggtatggataccttcgaggacagtagtggtgccttggcagtgaccagattgcgtgtactccctccggtttcattttaattgacgttttagacaatgacacggtctacaagatacatctttgatcttttttttctgttataatatatataataaataaatgcatgtttatttttattatagtactttaaaagacaaatctatatatgttgttctagttcctttaaactaaatatttttaaagttattaatagtctaagttataaaagtttgacctcaaccttatccaaaacatcaattaatatagaaccggagggagtaaccgcttagaggagaagatcaacggtgtgcctgcgtggaggggctcagattgtagaactttgccaaattgcaaaaatcttatgttagccctagtccactttcaaagtttggtaaaaaaaaagcctaatatctaatttgcttttttttattataatttatttttcagcatttgctttttcttatcaatgtgtgactcctaatcgtgcgttactcccctgtgttgcgctaaacgacaccttccttgatgatatatgatgtgagcaatggttttatacatagtagccgtgatcacgtcatcctaccttttttttcatgaaataccatcctttgttttatattcatgtgatggttgccccataatacatgatcttacccatagaaatacgcaaatgaaaagaattacaagaaactttcattatgtaatatcatcaattcttttgcaaatagaatgatcctctaaagaaacaaatgaacctaggaatagggatgaacaacaaaggttgtagatactacactaaaatcattctcctgctcatcttgcaccccttcatcagaagcgaagtactcacatgatgcatttagagggtgtcaacaaggatcgtaaagtttcggcgtgtcacatcgggtattatatagggtgtcgcatagggtgttcaggcactaataaaaaactaattacagaatccatcagtaaaccgcgagatgaatttattaagcctaactaattcgtcattagcaaatgtttattgtagcaccacattgttaaatcattgagcaattaggcttacaaaattcgtctcgcaaattagtcgcaatatatgcaattagttatttatttaacctatatttaatactttatgtatgtgtatacaattgtaaaagaactttttagattgaaacagtgagagaggtactt

SEQ ID NO: 36957 - DNA, 1501 bp, Oryza sativa
ctggcttgagagaatcatacattccaaagtacagcccacgatagacaatgataccaacacaggagatgttgaatccacggtacagaccagcaataccatcagacgcaagggtcttgcggtaaacatcaacaagtccattgaattgcctcccaccacccttctttgcagccttggcatcattagccagacgagtacgagcataatccagagaatacacaaagaagagagagcaagcaccagcagctcctccagaagccaggtttccagcaaaccacttccagtaaccatccttgtccttcttaaagttgaacatgcgcttgaaatggtctttgaaggcaaagttcaaggcctaagcaaatgtacaatataagtcaacatccaaggggagaataaataaaaaacagacagtaggatgcagtacctgggtaggaaagtaacggatgacattagcagtgttccctctccacagtgcaatcacaccttcatccttaattgtgcggccaaagcagtccgcaatacctttgtatgggtgagagagcctaccactcttgatcatttcatcctggttttgaatgagaagcttgattcgctcaatgggagcagcagcagtcttggagacagcagctgaaactccacccatcatgaagtcaatcataaacccagaaagacctttctcctttggggcagaagcaaagactggggatacagatgtgacagatgagaacccattgttcccatccatcccattgtatgacttcagaggcacactgtaagaagtgttggcattgtagagtgcgggattcttcatcaaagaataaggtgagatcttgctgaacatcatggactgcccatgtatcttctggagcacagtgggagggcccaaatcgtcagccatcttcagaaaacaacctatgaaaaagcaatttcaggacatggatttcagttaggtggaaaactggatacgataatgacatgcaaaaatttgccaagctgtaaaacgttagaatgctctactgacaaatagttagaacgaacaagtagaatattcaaaataagtacaaaggtagttaattactacttcctccgtttcataatgtaagttattctagcattgcccacattcacatagatgctatgtctagatttattaacatctatatgaatgtggacaatgctagaataacttacattatgaaacggagggagtataatactcaattaaaataatctgaacaaacaatgaatatcaattaccacaagaccacaatgacaacgtaaaatctaaataaatctggaaccctctttcacacaacgtcttgtcatataaaaggaaacagatatagctacatcacctaaaaagataaaatatacaacaaagagatgtaaccaacaaatcaacgaaattacagaaaccaaacatattcttccatttcaggtagaacctttcatccaactcgtgtgaattatgcatcatccagatgaacaaacagttcacacacga

SEQ ID NO: 36958 - DNA, 279 bp, Oryza sativa
tgagtggatgtttcgataaacacggatattaatcagatgctaaaaaaacgaagctcctttcaatcaggcaggcaccagcacatcaaagagggtaaacgaagttaaaaaaaatcaaaaattttgctacgcagccaagaattgaaccgcatgaagacaactcaaaatagtcaaattaaagaaaaaaaaaggtaggaaaaaaaagaagaggcgcacgcaggcaggcagggaaacatacccggatcatgttgagtatgtcgggccgcttcttgcccccgcagg

SEQ ID NO: 36959 - DNA, 1501 bp, Oryza sativa
tttgaaaatacaaaaggaggggtataagaaatcctttttaaaaaaaccccacatgctaacttgaagtgaagtcagactactaattgcagctcatgattttcttaaaaaaaatatccaagcgaaatttcacagtgaatttaccctagctaaaccgcataacaataataagattaaaatagaattcacccgttgtaacgcacagacgttttttctagtaaaaaataaaaattagaaaagttcaaaaaccgaataaaaaaatccctcgcgcctttgtaattgtagccgaatgcgatcctcgtatcggaacgggtggtggtggcggtgtccgggccccgccgcgcggtggccggccggccagggcacaggccacaggccctgcacgccccgccggcccggccggctagctactagctgcttgtcctcgcgtacgtcgttctgaccggcaggctaccgtccaccaccgcgcgtccgcgcccgcgacacagcagcagcggcagcctgtgtccccacgcgcgcggtagtagacgacgacgggtgatccgactgtttctggcgcgggtcaaccggcaacagaagaagccaacgcagcgcatggtccccttcccctccccccgtcgccctgctgtgctgtgctgcgctgctgaccctgccaacgccaacgccatgccatgcgtaccaacgctccgccgttctccatacgtgcgcactgtaccggtgtacagcactcggtactcccggtacttcctccatttctttgagatgtgtgatgtgatacggttgatttttttttctcaaacttagaccacaaatatttattcgattattatttactccatccgttttaaaatatatagagttttgattgaataggacgtatttttaatactataaatctgtcccatacaaccaattttttttatattttggaatggaggaaatattttatttgttttagaaaaaatagcgaatagagtatcttgtgatactatcagaaaaaaaaatgctttggttatgcctagtatgtttatttatttgcataaatatctaaagaaataaatagataaacgaattagaagattctgatgtgtcatatattggaaaaaacaaaggtaacatcccctttatattagagagtcatttatactgtacgtttgtacaacggggttactcatcttccggaacagatctacccactgctactcatacattttctttgtttttttcttttttattacaattaagatgtatacatatagatagggaaagacccggaaaaccatcaaactatcaaagccaaggatgaactaataatttgcttaacaatcttaatatgtatacgatttacaatggaatcttaaaggattaagaaaacaggtctatggctggactcttaattgtcctatgcttgtcttcgcaactgttgtcggtgatatgggcccgaggatatcatgtttaggggagtcaggctcgaggtggggtggcggccactccttcccaaaga

SEQ ID NO: 36960 - DNA, 1501 bp, Oryza sativa
aagacataatacaacggtggaacaacagcgcttgatatgttattaccaaaatgtataatacgaacattgaactttttgtcattttttttagtaacatttacagtcaacaacgtttactcagtatccttatatatagtagcaaagtcattttgatgccaataaatattcctcatttctcgtatgtcatttaaattaaataggtatgacaaattttcacatgcaagaaaggataagagagatagacttaaaagaaaaattttcaataggtaaaaactcacgctaactcttctttaaaatctacgtgtattgagccattccttagaaatttcataggatttgagaaactacaactctttttttgaaaggattcatataagatttgaatcttgtagaatttctcaacaaatcatttgtttcaaatagggcctgaagatgtcagtttgccctttgcagtattgttctctccaatcagttaccacaacgtttgacaactgtcacatttggcgcgagctcaataacgaagtttgagaaatcacacatgtgctcacatttactcctatttattctttcagtggtaggcgacatacccgtcgacagcgagacgtctatggtgacttcatcaatataaaaatatgccgaccgattccttcgaaggtgctcatagggatagggtgtacgtgcgtttttaagggtgggtgtgcgtgtgttgcgtgtgttctaagcacctacgtttctaactttgtactgtgtttctaaaagaaaagctagtgcactactgtaacaaatcagatcagttcatactggtgaagcctgaaaggtccaagccgcaggatcttcttcccctttgggtgacattgacgcgagcccgctgaagtctagacgttgttgcagtgccaatttgccattagcactgacccaacatatctgatcgttgcgtgcattgaccgatgccggaggcttttgtggcgttgtgggctcgttagctgctgcatcctgcatttcagcattcactgtaattatctgatcgcgccaagctcgttggatttgctcaacgtctgaaactctgaatccttgtttagaaaaaaaaaaaaacctgttgtattgcacttgtaacactgaacttcattgaaacccatcgatgattttctgttagaagactcagtcgtgtaagttcagttctaaacgggctgggcttgtaatggagagagaagccgcccagttaggcccaccaggcccatttatcgttatattccatgacaggccgggcccacgatcggctaagtacacccgagtccgagtcgatcgagtgctccgctcgtcttctccgattcggaagctggccattggcaacacgccaaaacccagcagtatataatcaccacgctgctcctccaccagcagcgaacgagcacgactgcacgagcaccaaccgtacgtgcagcaacagagatcaagcagacgagacgcgtgcaccaacgagctctccctcccctgcagctag

SEQ ID NO: 36961 - DNA, 1501 bp, Oryza sativa
agcaaaaattcaaaatcctttatattatgagacggaggagtattatgcatttggtgactacccataattattctctttttttttctagaacacaataattatgacgacccacacttctcattatgtgccaacaataatgccgtacactataatgggatccgaagaaataggaaataattacttatgggagaaggtgggcatgtttggttttttatgtttgttttttccctttgtgcgcggtatggtgggaggggatgtgcaaagggcgactgtgtgaataggatgtgcagacactccacatgttaaattttaaggctgtgttcgtttccacaagaaacacggaaaatgaaatattccattagcgcataattaattaattattagctatttttttaaataaagtggatcaatatgattttttaaacaacttttatatagaaactttttgaaaaaaaacgtaccgtttaaaagtttgaaaagtgtgtgcgtggaaaacgagggagaggggttaggaatcatgagaaacgaactcagcctaagtctcaagtttggttgtggctagaaaccaaataaacttcatggttttactattggtcctttacatattaaaggtttcttcgaaacacgtgattaagaaaacgaaggaataagaaaaaaaatatagttgtgcaatacagaaaaagaaaagaaaaaaataatcgtttgattgaaccataaaaaaaacattagaattggataagagagatagatccattcgaaacttttcatgagactgaatcttatgttaaaaaatccttcaaaacttatgtggatagagggcatttcttagaaatttcatatgatctaacaaattgttatttccaaggatcatataaaaaaaatccaatatgatatgtttttacttcgaattaaaaatggtctaattaggggttctcgagatgtgaacctgcagtgctatccttatcctctgtcccaaataattatactcgtctctatccagttcagtttttgaaaaaaaaaaagatcactatccagtcccaatcagctgctacaacatttgtcaactctcacgttctgcacaggctcaataaccagtttgtctggtgagttaattaatcagtgctgctcgaagtagactaaaggtgacatcggctggccaattgctgaaactatatcgtttaacgtattagcagaaaagataatttagaatttaaacttttacatacatattcttaattatttaagcgttaatattaaaaaagaaaactacaatgaaacaaaacctttaaaattaatctcaaaattaacttgtataagacttaaattttgatatccatgcgacataatatagtagaactagcacactaccggtagacggtagtactacaactctacaagccacagacaggaaacaggatttctcctcttgggtgacactgacacgagctaaccgaagtctagacgtcgtgctgtagcagcagttgtaccatagcaatgttgg

SEQ ID NO: 36962 - DNA, 834 bp, Oryza sativa
atcagagatatgtctagatacaaatgaacaaaaagaattataagcatctgagttctcatccatatacgaatcatgttccttgccatccttggccccagcaagaatgctagagtgctagacattcccaacttccaaaatgagcaaccaactactacatacgaactaagctggtgggaacccttctccccagcacgcaaaacaaagcatatattattgtatgattaattaagtatttactaattttttttaaaaaaggattaatatgactttttaaagcaactttcgtatataaattttttgcaaaaaacacaccgtttagtagtttgaaagcgtacacttggaaaacaatggagagatgttggaaagggaggtaaccaactgagccagtgtatccatttgctaatcatgcgtagaaaaccattttcaccgaccaatttgtgttgaattctgaggcgggcttcggattctacaggcccatgtcacaacacccaaaccgagctgatccggcccaaccagcccattatcatctggcctacttggctacttgtccaaactagcctaggaaaagtttcactgggccttctaactcggcaaactctgacaaactctgggagccccgaatccgagtcgactgtcaagcgagccatgctgcctgcctactcggattctccgactcaaaacttgtccgactcggagcttggcattgttggcaatggcacaacgcgcgcgccgcggcctagctatataatccccacgcttctcctccaccaaagccaaccaaaaccaacaccaacagccaacgatcacgagctcgcgagctcgatcgtgcaacca

SEQ ID NO: 36963 - DNA, 158 bp, Oryza sativa
tcgtaataagatgcatggtctttttagtgttaatcctttgtgaaatgtaagaaattgtaggcttcaattataagagtgtatggtcttttcaactataagatgttttccgtaatcaaagatgttctagttagacaataatctaatagtatgtgttatga

SEQ ID NO: 36964 - DNA, 1501 bp, Oryza sativa
  unsure (1)..(1501): unsure at all n locations
attagtttcctttcattgtggataaacgattgcaacatcacttattcaactcctgaacgtgtgttggccatgccaaagtcagtgactggagtacttgagaagctgtgtattttaagctgtgatgggttgacagctttcatgggcctagaaacattcttaaggttaagcacaatagaaattgcaagttgccccaagttaacgtcagtgccagactttaggtgtcttccagccctccagaacttgatcataaagaattgccctgagctcaaggaactacctgaaaatggtaacctaacaacattaactgcactggttgtggaacactgcaacgcgctaatatcactgaggaacctgcgagacctttctttcctctcaaaactggtggtcagaaattgtatgaagttaatggctttgcctcagatgattagtttctcttccctcagagtcttgatcataaaaaactgccctgaagtagtttctttaccagaagatggtcttcctgtgtcccttaattgtttgtatttggctggatgccatccagtgctggaggaacagtttgaccagaaaaatggtagtgaatgggagaagtatgaagtgttgccgttttgtttctttgctgataaatcaatagaagatatcgaaggtaaacatctcccatcctcggattgctgtctgtgaaattcaggcacataatatttgaattttgatgatgatgaatctacaatttctttgttgcaaaaataaaacgtcaattgactgactcctattgattccaatctactgcagagatagccaaagaagtacttatggcggatgatcttaccaggatttccattcagggcaatcgagttcatgcaactgattctgcagcaagctcgtccagtttcccttagtaagctctccgagggtaatatgagctgttgtgatatgttgatcattttgcatcatggccctnnnnnnnnnnnnnnnnnnnnnnnnnnnnnnnnnnnnntgtatatttgttccattttaaaccggactcgtttttcctaaaagacaggaaatcgaacatcgtattaccaatttatcatgctggtgcatttacggatgttaacacattggatgcaccacacactgttcaaccgaataatgattgtgcaactcattaaagttagtcacggttattcctcatcaaggaaattattttttattcttgaaggataacttgattgtgattctggaagaacacattggatgcaccacacacgttgcaacttatgctttattagtatcagttgatgtaacagccctatagaaccgcgtagcctagcccaaccgacgggtgggcccaattacacataccatttcacacttacattttcgtcctcgcttcgtgtaaaagggttaacccgagagtggcatggttgaagagacaaggcttataagttggtttcacctttactaaattagcaatgtgttaataaacatacgcacacagctctcatgggccacacatgccgca

SEQ ID NO: 36965 - DNA, 1501 bp, Oryza sativa
  unsure (1)..(1501): unsure at all n locations
ccaattgctactacgcttcaaattactgaatcaaattccttcttcgtagatcatagcttcaaattatgtaagtattctcattaactgaatcaactaccgttgcaactgaacatctcctccatgagagatcaaaccagcttgcagcctcccagccaactgccgttcaagcacttccagtttttctaccttctttgcttttggaggttgtggaatcatacctgcggtccctcgctaggtttataacaaaatgtgtagatgatgctatgcggctctaagctgagcatctgaaatacgattgcaggattgtagttacaccctgtgaagaaatttcatctcccctttatgctccattgtaaatcaatgaaccttgtattatcctccctacttataatcaattcagatgaagaaaccttcacctagtgatcggtctaagaaaactactgctccctgtgtattttaatgtatgacgccgttgattttttatcaacgttaaaaagtcaacggcgtcctacagtatggagggagtattgtattgctagtttgtaattaacactttgcctgctagtattacgcaaatgaatttaacggcacctgtacgggaatatcgttatgcaagtaaatttaacggcacctgtacgggaatatcgtgaagagcgagcaggtactaaggtttcataaaagtacacttttcacttcccttatataaacacaaaagtacacttgttgcagattgttttagaaaactaaactttgcaacaaacaggtgcagtttcgtaaacaagattggaacaaacgtgtagtttggagccgggnnnaaaaatcaaatgcagttgttggaggaaaaatcatgtctgtgcaataaacaattagccacggattagtctccgtcgaatttcgttaaacttgtcctaatccgtcttacattccgtgccgccatcgcccatcattagagcattaaagcaagtacaataacaggctataaaccagctgcaaacatattttaagaagataaatgaggagagaggaaagcagcgggctacagatttatagacagctgtagcacggactccaagacacagtgtgtatgacaggtgggaccaggtattaatagtgtagtatgtaactattgtatgaatgagctattagattagctatagatgaattggagccagtagttggctatactattaaacttgctcttatgacaacatatatacatttattatcacctttatatactttagcgatgataattttattcgcttctgaaggctgaaaaagacaggagcagcctagtgttagtgtatagaaatcgcaagtagagctagcagtgtgccacaagaatcacattctttagcaacacacacgcccccacgcgatctactactacaaggtatcatgataccaaattgcgtggaatattcgccaataccatgatctgtcacatgatccagaaaaagatatcgacacatttacgcatactacgtgaccaaggttatgt

SEQ ID NO: 36966 - DNA, 156 bp, Oryza sativa
tttggtagggtttcagattctgtgattctaattctgattcttcctgaatcagatactgaagagaatcagaatcagttaatttaggtgtttggctagaaacattaagatcctaatgggggaagccaaagacgtccttggtctatataacctctgtac

SEQ ID NO: 36967 - DNA, 1501 bp, Oryza sativa
agtatctacaacctttgttgttcatccctattcctaggttcatttgtttctttagaggatcattctatttgcaaaagaattgatgatattacataatgaaagtttcttgtaattcttttcatttgcgtatttctatgggtaagatcatgtattatggggcaaccatcacatgaatataaaacaaaggatggtatttcatgaaaaaaaaggtaggatgacgtgatcacggctactatgtataaaaccattgctcacatcatatatcatcaaggaaggtgtcgtttagcgcaacacaggggagtaacgcacgattaggagtcacacattgataagaaaaagcaaatgctgaaaaataaattataataaaaaaaagcaaattagatattaggctttttttttaccaaactttgaaagtggactagggctaacataagatttttgcaatttggcaaagttctacaatctgagcccctccacgcaggcacaccgttgatcttctcctctaagcggttactccctccggttctatattaattgatgttttggataaggttgaggtcaaacttttataacttagactattaataactttaaaaatatttagtttaaaggaactagaacaacatatatagatttgtcttttaaagtactataataaaaataaacatgcatttatttattatatatattataacagaaaaaaaagatcaaagatgtatcttgtagaccgtgtcattgtctaaaacgtcaattaaaatgaaaccggagggagtacacgcaatctggtcactgccaaggcaccactactgtcctcgaaggtatccataccagcccagggacgcatatcataggattatggtccaaactgcattgcatagtgcaatctgcgcttcttcttgttgtttccctcattatctagagcgccgagattagggccagtgttgccaacttgggagcggcatcttctattaattgttgtttctcttatcatccgcgatacccatgaggagaattagaaaattattaacggagtttaggttaactgacgattcacattaagcttgatcaacagcactccacaaaaatgcaaaggccatatgttagaggacaagtcacgtcatggcaataatcaggacaccataggaagagattagctctcaatgtgagccaccggtccaacttaaagacttttatagtacaaaacctgaaaacattgtctacggagtagtgcattgcaatgggaaaactaatgttatgataataatatatgttatgataataatctatctattaacttagtaaagtaatagaaaaatgagcattcttatggtttagaaattattatcatattaattggagtaaaataaaaaaataaggagaattcattgtagacaaggactctttcattttctttttttctaaaaaaaacaaatacgttatatatgtgtagtgtccaatcggacagctgcataaaacaaatcttttgcaaggaaaaaaaacc

SEQ ID NO: 36968 - DNA, 1501 bp, Oryza sativa
acacaaggaaaaacaaaaaactagatttgaggctgatatacaaatttcctccggaattggtactacataggaaagcattctaaaagaaaagttatgaacctatattcctatatgttccaaaaagcctagttagaaaaagtttccaaaggatccgaagcttccaaattctcgtgaaaatcattcaatcctgtaaagcctgagatagcttaaaaaatgtttcctttcaatatgttttactagactatatgggatttgtttggcaggatttcaactcctaaataactccacgagtggagtcagtagagctacggagcggtccgaactcttgtgcaccactctagtttattttttcacatcactccaacccatttcatctcccttttaggttgagttgaaattgtttagttgagctccagctctagaatgctatgtgccaaacaggcaatcgttgtttgatctttaatatatacatgggcttcaaatcgggactttgggacagagcgtattaaaaccattatatcttttttgagagggaaaagtccatttgcctccctcaactataggggcaagtctacatttcatcccccaaacttaaagcaaacatacaacctccttcaattaggaggatggggcggtggtcggcaagccggcggagggagcttttccaagcaagcttgagctcgcctccacacgtatcagcatatgtaatactggctatggagacaaataagggtgtgttcggtggtgggtgttgggaacctatcacctacgcacggaaaacggaacggtccattagcgcgtgattaattaagtattagctaatttttttaaaaaaatagatcaatttgttttttaagcaactttcatataaaattttttttgcaaaaaacacactgttacagtttgaaaagcgtgcgtgcggaaaacgagggagaagggttggaaacaaggggttgcaaacacagccttaggcgcggtaaaggggaagaagaaagccagtgtgtcgattgtgatatgggacacgctgcatttttttacacttttttgggttgatgtaataccgtgtaggataaaaaccgctatcaaaactacttggaattccaagataaattgaacaggtattactagttggaggaggcaaaatattattactagtcgcaagatattgcggttagcactatagttgtgggagacgaaatgaacttattcctcttgagaaaggaaaactaaaaatggccaagcccaaaacatattggcccatcatatctcttggattccccaatctgcattccccctggaacgcgtagaacccgttacgctttcgcgtaccagaagtagtgcaacagtcgacatacgtaaacgtcacgcgaaggcggaaaaccgataatccgctttcgcagctaacacaacacagtgccgtgcaggatgcccgagtggataacccgttaaaccccccgatgccgctcgccgccgccgtcgccgcctcggcggtcgtgccgcc

SEQ ID NO: 36969 - DNA, 1501 bp, Oryza sativa
gttttggtctgatctatggaatgataagattaggcaaaggagttatcctagagctttctcttttgcaaggaaccaaaaagactcgagaaaatcccttgtatacccctgaattttaagctaatcccttctatgcctctgaattttgcttacttccttgtatacctccaaaatttaattttgatccctttcatacccctgccatcagttgaccgtctaatttctaaaaatgattattttaccctctggatgaacatagaaatttattaattatattactaaaaatgtaaaagtttgtcgcatgagactattatagttatgagtttgttgtgtgatgcattatttatcacaaaatttatttttagatatgaaataaaaaatatgtatttatttttgaaacaaagtcatcaaaaagaggagcattcctacaaacataggactaccaatgctcacaataatttttttatgaatgctcccgataaaaaaatccattatcctattaaaatttcaaatagaaattttaatttattacatttgtttttattttcaaaatttagtctcattagtttcataaaatgcacatattgtgcactcaaacaaaaatttcaatttttttcaagcttatattcaaacctaaagcatcaagggcaaaaaagacatttgcaatcaaacgtaatagtgaaatgaatgaaaatgtagcggtaggggcataaaagggatcaagttgaaatttcaggggtatataagggatcgggtaaatttcaggggcatgaaagggatagagtgagttttcagggggtacatagggaatttactcaaaagactcagttcatctgacttccttaatggacttgtcttagacttttaccctccctttgtctaaacaggcttttcaagagtatctttcaatgctttctacagataccttagatcagctgtcggatgaatttgataaatggtcttatgtttggggtaatgataagtattcatcccagaaagtttgtgctacaaatttcatgcatgtgcaggcacctgcctacttaaagtggagctggaagagtaactatactatgaaagtttaggtttttggttggctttttatgattgataggttaaacacttgggatatgcttgacaaaaagttttgtgcccttgttggaagtaatttaaattgtgtgttatgttcatctggagaaagggaaaccccttatcatcttttttcaagtgctctttcagtacagagtgttgggtgcagtttggtattgtatgggatctctctttgtcctttaaaaatatgttgaaccatgcaaatacatcttatcgatcttcacattttctggagaaggttttatatgcggcctagaacatttggaagcaacgaaatggatttatttgttataatgtttcgccctttgttccttcttggatgacattctttaggaacgatctatcccttctagtttttcgcttaaattagatgagagatcaactttactctcctggt

SEQ ID NO: 36970 - DNA, 401 bp, Oryza sativa
tagaaaatgctatttgcacaaggacccgaatgcacaaaacggactagagaactcttttaaagcgaagtcagcagcagtagtcagttccactcctactagtacttctctccaccgtacgcgagccgagccgatcccgatcccgagcctgagccgagccgaggagctaaagcctccaaaactcgcccagtctccaaagcgagagacagctcatcgcccattcgccctcgcgccgcgccgcgccgcccgccgccgcctcgccttgcctcctccgccgccaccggcgctagagccgacgctgctgcagcggagagtgcggtgccctcctcctcctcctcccccgcgcgcgcggcggcggcggcgggggtttccggagttaatgcgcccgtgaagaggcggccgcg

SEQ ID NO: 36971 - DNA, 1501 bp, Oryza sativa
gcttcataggccttcaccagctagccttggcgtgtggtgtgatgtcttctatcccgacgcacctcgacgagacgtccttgacgttggcgttgtcggagctggcgggcgagatggaggtcatcccgtcgcggcatactgccaaggtctcgaaggaaatctccaacgggattcacacagggcgtgtcacgtcctcgcgtgcgtgaagctggctctccctgtcaccgatctcaaggagatcttgtcgaagggggcagcagatgccacgcgcgaggacatgtctctagtgtgatggatctcggggagtgcgtcctccccctttatgaggagtaaacttttttttaccttgtattgtagtttttgtacaagtacttctgttaatctcctaggcggagtgacttccttctcttcacgtcacttgttaatctgtagcgtcttttattcttcatagctgtgtggattccgaggatgtccagcaatgcggatgtcccgatgtcgcgatgatcgacttgccctctttgggcgatatgcctgctcccgatgtcgttacggatgcggttgtgctcggaggcgtgggcgcggcctctggcccgtttagtccgggcatagtcgggctccctcgcgagaactcaggtgtgatgtcatagagaaattgtccctttgagcttattatcttattaaggaggcaacatctcctacatccttgtccttcgcagatctcgaaggtgtcatcgccgaacgagacaaacgcatcgcttcttggaggacaaagtttgaggtcaccgaacttgggctatcgctcgtggtcgtgaaaaaagacaaggccgtggaggctctccgaggtcgcgaggtctggatgaactcgtacctcaagagctgttgtaatgccatggccgacatctaccaccagctgagggtcgatcgcgcggaccccgaggagaacacgacgggctacttgttctagctgaggggggcgtgtgtgttggtatttcttaacgacattactagaaatataattcccagcaatggcgcagaaatacttctggtatattatggttacagagttcatccgcaagcgcatggatataccattgtagcatttcgcctgagagtattccaagggtatcgtattcattttatcccgtgggaagatcacgtagagagaactcaactaataatttatataatacttgtgataatcatattctaagtaggggttaagataatccaagggtagagtgacacacatgcattactactcataataaataatctaagctaggcgaaaagaaaagagaaagagaatctatttctatacttttaatatacatagtatacatacattctagttaactgatatactagctaataccttctatccgatgccctcctggtacttcgagaagccacccctgactgcctagttccttacgacagctcgtcatgaccatccaactggggctaaatatggaggagtaccctccccaggaaattaacttaggat

SEQ ID NO: 36972 - DNA, 306 bp, Oryza sativa
cgctagctctacaacttattattaagatgttttgtcaattttactcgtacatggagtccttatatgccatggagtcctttctcatggttcatgaatatcatgatgcctcttcccctctcgatctctataaaacccgtatgggcatgagagaaaggtgtgttatctaagcagccgatcaatgataaaaaaaataattattgttcaggaaaaaatattattttaacttgtccgggtgtataattaattagaaataagttttaattttgacttaaaaaacttgaggcagatactccctttctttaaaga

SEQ ID NO: 36973 - DNA, 1501 bp, Oryza sativa; identical to SEQ ID NO: 36896

SEQ ID NO: 36974 - DNA, 1501 bp, Oryza sativa; identical to SEQ ID NO: 36898

SEQ ID NO: 36975 - DNA, 154 bp, Oryza sativa
ttgtaatattcttggtgccctaatgtactctccggaattttccgtgaattttcggagctcgagaaatagttttaaagtcacaaagatcatttaaccaattaaaataaaaagaaaacaaataaaatcctccctcctctctttgggcccctttcgg

SEQ ID NO: 36976 - DNA, 1501 bp, Oryza sativa; identical to SEQ ID NO: 36907

SEQ ID NO: 36977 - DNA, 638 bp, Oryza sativa
ttgagtcagggttcataccaagctataattgttggacatcccacggagagcaaggtgttgaaatggaagaagatgaagtggaagacgacaatattccggactttgctcagtacttggatttgaaggaaatcaaacgggcgaggaggaaagggatgctgatggtaactacgttgcggatgatcttggtcagatattgcaggacgccaaggaggactgcgaaagtgaaaagggggcccataaattggacaagatgttagaggaccacagaacttcgttgtacccaggttgcgagcaggggcacaaaaagttagataccactctggagttcttgcagtgggaggcaaaaaatggggttagtgacaaggcatttggcgatttattgaaactcgtcaagaacattcttccggagggaaacaaattgcccgagacaacgtacgaggctaagaagatagtctgcccgctaggactggaagttcagaagattcacgcatgtccgaatgattgtatcttatatcgcggtgaggagtatgagaacctagaagcatgccctgtttgcaaagcactacgatacaagattatacgagacgatccaggagaagttgacgggcagctaacaaagaagagaattcctgctaagg

SEQ ID NO: 36978 - DNA, 755 bp, Oryza sativa
atcacctgtccgccgcctcccgcttcttcgccgccgttcgcctcgcccgcctcgtccacctgtccgttgccgcccgcctacctttccgcctcgtcgacgctgtcgacctcgccacgggacgcgcggagcggtacacggtgaggtacctcgtcgcccacccccgtgcgcgtggccgcgacgccgccgtccgccgtccgcccccgtgcgccgcctccgctcggcctttgccgcgacggcgccgtccaccgtccgccgtccgcccccgtgccccgccttccgccggccgccggcccgctcctccagtggtctcccgccgccgccgatagagtgaatcagtgaagagtgagatagagtgagagagaagagaggaagagtgagagaggggggaaagtgaagactgacatacgggtcccacaatttttttattagaaaacgctaactgggatacgacttagatcaaaactactgcggattagatcgagggggttaattcgtccggtttacatagtttgaggtgaagaatgtccggttttgtggttcaggaggtaattcggacgaccgtgatagttcgggggtaattcgtactttttctaataaaatattatattatgtttatattattaatagaaatgtagaagactctatcctgttcagacgagacaattaataaccatataaacatctattgtactttatgcgcattctccatcctctccccctttccctcccacccacatggctctctctccccgaaa

SEQ ID NO: 36979 - DNA, 1501 bp, Oryza sativa
tggattatttattccttgactatacgcttagtttgttcagctaaccacatagtcggaggctacacctattaggtgcatctagtcgatgcacctaactttattttccaaccctccacagtctagtcgaagattatcttttcgactatgaaggtctcaagggctactatggagattatgggtaccccatacccacacggcgtggttatccgactggttataggggataacttatatctatgaaatatgtaacagatcatgacttgggtattacgtttccctgtatattatggaacggcctaaagtcctggtttgataagattgtaaagtagatttaggaaaccgataccgtattggttaaggtttctatcttgtaatcctgccccccatcctatataaggtggacaggaggccctctagggggcatgagacacaactagatcgtcatatctatactacacccggcggattcaaatcctcaaacaggagtagggtattacctctcattgagaggacctgaacctgtctaaatcctttgtctccgcatccatccacttttagatctcgtgcgctacccccttttattattgcataattcatgtttcgacaccagagtttgtcttttttttttggaatggagggagtgttcagattcattgtactagtcacattatagtactagggcctcgtttagttccccaatttttttcccaaaaacattacatcgaatctttgacacatgcatggaacattaattatagattattttaaaaaaactaattgcacagttagaggggaaatcgcgagacgaatcttttgagcctaattagtctatgattagccataagtgctacagtaacctacatgtgctacagtaacccacatgtgctaatgatggattaattaggctcaaaagattcgtctcgcagttttcaggcgagttatgaaattagtactttcattcctgtccgaaaactccttccgacatccggtcaaacattcgatgtgatatctaaaaattttctttgcgcgaactaaacaggccctagttgtctattttttttgggacggaggaagtacttgcttgtgagcctttttgttgctatagcccaaattaccccgtgtccgtggcccatgaaaaccagtcgcttccgtcctcctctgtgtgtcgggcatcatgtaggaagtctaggaacgtatttacacggtgcacaaaacactcatcaattctaattagtgcacacattgtttaacaaaaaagatatagcatatcttgtcatcaatacaacgaatctagacaacgggtagtctagattcgttattctaagaggggtcgtatccccttagagattgagttttctttagaacggaggaaataggtggcagtagaaggccaaaaagaagagggaggtggttcagcccatccattgaagcccatgtttgtcagccaccaaatctatgaagccaagagtaaaagattattatctgtcttatagtccatgca

SEQ ID NO: 36980 - DNA, 1501 bp, Oryza sativa
tacatgggcgttctgaagaagtatgttcgtaaccgtgctcgtccagaggcaagcatcgccaagggttatggaacagaggaggtcatcgaattttgcgtagaatttatcgaagatcttcgcccaatcggggtacctgaatcacgccatgaagggagactacggggaaagggaactctcggaaggaaagcaataatgacggtagacaacaatttattccgtaaagcccatttcatggttctgcaacaatcttcattggtagctccttacatcgaggagcacttggctctagttcgcgccaggaacatcggtaagtccgatgcatggattacacgacatcacattgatactttccccgcgtggctacgacaacatcttatgggtaacaagtcgatcaaccaacaacttaccttcctggcgaggggatcgtctgggtcgatcgcaacattccagggatatgagatcaatgggtacacattctacacgagagcccaagacatgaagagcacgaaccaaaacagcgctgttcgtgtcgatgccatgggacacgatggaacaactggcacgtattacggtgccatcgaggacatatgggaacttgactatggtcctctcaaggtccctctgttccggtgccaatggtttaggttgactggtggaggcgtaatgattggtgacagtgggatgacaacggttgaccttaacaaggttggatactcggacgaaccttttgtcattgccaatgatgtaacgcaagtctttttcgtgaaggacatatctagcaaaggaaagaagagcagagggcctgacgagcctaagcgtcacgtggttctcccaggcaaaagaaaaatcgtcggagttgaggacaagactgacgaggattacgatcagttggatgggcaacccactttcacggtgacgattgaccctagcatcctcctatcaaatgaagacaccccttactcacgtagcgatcacaaggagggaacaatagtgaggagaaagtacgtgcggtcaaccgtcaccgcgatctattgctgtaattattatgtacacgatgtaaactattttggatgtattgattatccatgtaaatcaattgatgtatggatatgttacttacgcacgattattagaggttttaacaagtttaaatcatgtatatgctagttatatgcgatacttacaatttttaaaagttttaaatcacgcaggtggcaatttcatatgttaattagagtttttaacatttaatttactatcattcatatgctaattatatatgactatttgaatttttaaaatttttaaatcatgcatgtggcatttacatatgttaattagagtttttaacaattaatttaatataattcctatgctaagtatatatgatgattacaatttttattaattttaaatcatgccgtatgtatttgagttttaatataagattgttaaaacataaatgtctcatgacttagcagatgtttcctgtatgaacaga

SEQ ID NO: 36981 - DNA, 258 bp, Oryza sativa
tgcgacgaagcggcttggcaagcgcggccgatgggttgaaatctaaaccaaggagacaaggatagacgtctcaccgatccaaaatgatcggagagggagggatgatgacaacgttccgatagcaacacatggagacgacaacgacgctagggccaaaccagattagattaaattggatcaagacccgatggataaactacaccatgaacgacatcggagagaggaaagctcactgagggacggcgtgacgatggatga

SEQ ID NO: 36982 - DNA, 368 bp, Oryza sativa
ctgcagccccaattcgacctgtggaatttgtacataaagcatcactatcttgcgctgcctgatatgtagatgctggggggggtaattcatctacttcagaccattctgagatgaaaaaaaaatatggtattatatgggatatgaattgatcaaccgctaggacaagggctaggctacattccaactgtctatttggactctgcagatgtaaattctcactgacgcgtgaacatactggttagcttacatgttaactgacatgtttcggtcaacatgggcaggggctgagaagactagggtgaacagcaatgcaatactaatggaaccttatgcgcccaaggatgccaatgggaatgtaatatgagaac

SEQ ID NO: 36983 - DNA, 1501 bp, Oryza sativa
tcatgaatcagagcgaacggtggggtccactcatatgcttctcacaccctgcacacccgccccgtatgttttagccggaatttttgtcattctgctattaaaagaaatagtaaatattccatgacgtgtcatgagcaggatatcatgtcttgatcatatgcctattataactagcatacccacttatctagtctagaaaaacctttggctgcctaatatattctaaattaagaaataacaatactccctccgtcccaaaaaaagtgcagttttgtactattcatctccaacgtttgaccgttcgtcttatttgaaaaaaacttatgattactatttttattgttattagatgataaaacatgaatagtactttatgtgtgactaattttttaaaaaaaatttataaatttttcaaataagacggatggtcaaacgttggacacggattttcacggctgcacttattttgtgacggaggtagtagtaaacaccttcccctgaatcgagtggacctagagtattaataagggggtagtccaacccctctcgttgaaacctatgttatttaacaattagatatactcatctactttatctttgtattaatatctttgctgtataattgatgcaatatcttcacatattatatatatatattttttcaaatggtcccgatatataaaaacaataattcttcactaaagataagtcaaaaataaatttctatctacctactttaaataagtagatagttggtaggcccactgacgcacaccccctcacacctcatgagtcatgacgaggaagagcaaacggtgggacccactcatatacctctcgcaccccgcacacccacccatccgctttagctggacctttggccgctctaccgtcaaaccaagcaagctgtcaaaggaaatagtaggaaataacagcagcaacaacagctcacacagacacacacctcctccccctttgacaattgacaccccctcctcttccttccacgcgcgttagcgggccgcgcggcgccgcgcattgcttcacctccgctccgcgcggctgaaaccgaaaaaaacccaatttggatcgaagcggggagagaggacttgaggagacgcgtcgtggagggaagtttttgaaaaaaattttccccaacccgctgggcgcgatgccgtcatgatcccccccctcgcctcgctgcccaaaaatttttcaatctctctcgcccacattaatcaccttcctcacgaggccaacgagcagaaatcccatttcatcatcattcataccaatcctctcggtttcttccgcgtccccggattcagtttcctcctcctctccccccctctcgatccctcctcctcttcccctcgttccagcgcgctcgccgtcgcccgccgccgtccgccgaccatggaagcagctggagtggaggtgaacggaggaggaggaggcgacgtcgtggtggtggtgccgcagcagcatgaggtggcggcga

SEQ ID NO: 36984 - DNA, 1501 bp, Oryza sativa
  unsure (1)..(1501): unsure at all n locations
ggaggacgcctaggtgcaagattttaagcttgattcacaatcatctatcgcagtcgacctcgtcgaacagctagtcgcactgtgggaagcggtccgaaatgtgcacttagatgttggagaaccggatcagattacttggaagttcacaaacaacgggcactacacggcctcctcggcttaccatgcgcagtgctgcggggcgccgagtacaaacttcaattccttgatttggaaaccctgggcgccggggaaatgcaaatttcatgcttggctcatcatcagaacagagtctggactttagaccggcttgcgaccaggggatggcagaacaatggttgttgccctctttgccgccgcgagactgagacggcattgcaccacgttgccacttgtagatacaccaagaggatctggcacctcgtctctgcatgggtgggctatcagcagatggacccaacggaatgggaggaagcccagtcagtcaaacagtggtgggagaacattgcaaacacgcctagtgtcccgaaaaaaggacttcgatcgctcattctgttagtcgtctgggaaatttggaaagagaggaatcggcgatttttgatcacaaagaggtggcaacgaacttcctactaatgaaaatcaaagaggaggcgagcctttgggctttagcaggagctaagcggttgcgtgagttaatcccacactctgtatagtgtacagctatagtggttctccgtttttcttttcccctaagggtttgtatttctcctgctctattcgatgaaaaggcactctagtgctgttttccgttcanaaaaaaaaagaaaaaggaaaggatttgatccgcgaaatggaaaagaattccatatanacttttggggatttctttgggaaaaagaaaaggagattgagaggattcccattcccgcactaatttggaaaaaggagcaacggggaggccggattggtgggaggaggcggcggcactgtgcacgagcacggctggctcggctctgtctggaggaggaagatggagtactgtagcgatagggaggtaaatcagactttggctgggctgagaggaagggagagaatgggctgaattcggcccaagctgaggaggaggatttttattacttttccaataaattaaccaatgagatgatctttcaattgttaaaaatactttcaatgctcaaataattccaagaaaaatcttgaacatacttggacactcaaagtatttaacaatattaaaaccagaccatttaatgattaatttgttaattaaataattgctaaactattctttgtattattaaaattaaaattgagctctgagaaattcgagaaaattccaaagagtataattaatcatggagaatttaatacaaattaaatccatccatgctttatatttaggaaattttatttcccacatttaacttcacttgtaaattaatgaacatttaatatatattctattaataatttattaaataat

SEQ ID NO: 36985 - DNA, 1501 bp, Oryza sativa
atattgcgatctcatatcgactaaggacttgcatccgtccttcacctaaaatgatgttattgctctccatgtgcgtatcttatgagatcttaatacttgctccttctacatcaacggcggtttgaagttttaacatgtgaattttaaaatctttacgggaaggttccaatataagtattgttttggaaaatgggagtttcacaagaaaacattttaactcaacgtgaaatgagaaagttccccacatatgctaaacaaggctttaacaatttaggggtgttttgatgggttgtgaagggtgggattgagaaatagagatgaatgaagggttaggacgaaattagctgagaaatatggatagttcatattaaaacttgctatagtgggtggttatttattcgaagaacccattaaccaaacatgccatcatttatgtgaaaatcggaaaaacaaaattgtaagatcgttaaaatgggccaaactatagtatagaggcaagggtaaccgcaatgcgaaaagggctatagcacaaaagggctatagcacaaacatttgcttgactaggccccacacgaacacacacgcttttaatatttggcaccacatgatttctatttctaataagtttgtatacctaaaagtttatactcccaaattttatagggactaaaaaaatgcccgtgcgttgcaacgggtaaaatgcccgtcatccgtggcgggtgccataactaatctcgtttgactcatatgctgggccaaacctatctatgatgggccttatgcttagtccgattgagataattatcattcgtgacggtcaaatacccgattaagataacttctcacatcagtgacttttgcttagcgatggtagcccttcctgacactgattgagacctatcccgtgctagtgaatccaacggctcacagaaggtcgcagcacaatcggacctctgcatcgtgactccgtggccgtgggatgagcaacagccagtcacctccccattgcagaaggttgctattgatccgatccgatttatcaaaaaatcggagagaaagatttttttttttctgaaacaagatggcatccagtaatgaacttcaggggaaaagttgatatttcacatgaactgtaccataaaaacagttttgcaaccaaaaaagactaaaatttgctcaacaattaacccaccgtacaacaaaatcgcaatcagttccttcaagcaaggttgtcccgattcgtatcctagtatcttacgatactacgatcctatcaagccgaaacgataccgatcccacctagtatccaaattttcgtagtatctcgatcctactattcattactacacgatccaacaaaattttaggtggtatcccgattctacaatccctacgatactacaaaatattatttaaaataacatggtttgaaaataatgtaactaaatatgctcaaatttatataaaaatcagttaaatatatcaaaaccaacgtggtttc

SEQ ID NO: 36986 - DNA, 1501 bp, Oryza sativa
gaagttcctcttgttcttgtcaatgactgaaaattgtctttactcctgcagatcaaaagtgcccaatgggcaacctaaatggctattgacaataatcccaaattacccaatgctgaatttcatgctcacaactgctatatatgttgcagtaagtagatcttccctgtgactttgaagagtttagaccttacaggcaacctgcttatgttataacttattcctacaggtctcccataggctatttgagttgactaacaccttgaagatcgcatttgtgcctagtcgtgacaacaagcgcctctcgtacaattttgtggcgggaattgcaatttcagtggcgctatattctttatcatttcttatagttggcgttgcaggatactagcaagtcctatagttggccttatgtggcatctgcaaagctgatttgattaccttcacggcttggagacttccattgtttcaccctgagcttcgttttttatgagtgttacatggtgaaaaggagtcgggatgcagaacaaaaaatgatcagggagagtgtaacatgtagcattaaaccccaaatgggaatataatgaagtagatatatgcctgtatagccgttgaaaattgaaatgcatatgtaagcgagctcgttggctatagaaacttctctctcttggcctcttggcccgttgagattgagatttgaaataggatagtggaaacatgtaagaatattattcttttgacccttctcgaaataacgttgttagcttggtgcaagctgggtaaatattttgttcgcctgcgttttgagttgttattttgtattgaatcatgtacacatgataaccaaatatttcgtctcgtaccaaacgtccaaactatacttctattgggaaatttaagacagaggggagcctgaaaactattcaatccttcctccttcctcatgaatattcgcatgctgacaagctattatttctacgatttctactattaacattttttttattaacatgattttacttctgaaaaaacattttcatcttgcgcggttccgcttctctaatgtggtaataaagctcatgaatattcgcatgctgacaagctattatttctacgatttctactattaacatttttgtttttttattaacatgattttacttctgaaaacacattttcatcttgcgctgttccgcttctctaatgtggtaataaagcaacaagcagcatatcttgattctctttagagcaaattgaatggtacagtcaactatcaactccaaatcatctataactaatatatctcctacatcattaatacatgatctcatctatcatacactcagcgttttgaaatatgtatctatcatacactcagcgttttgaaatctgtgttccgggttgtagttggctgcaaagtgtaacaaagataaaattacctggtccaaagtgaaaacccaatcaagtaaaaatattagtttaaaggtgattcaaaatgaaacatcgg

SEQ ID NO: 36987 - DNA, 347 bp, Oryza sativa
caccccctcccgcattgtgccacagccagtggggcccacgtgccggcgccccctctctctcttgagccgctgacaagcggggcccacctgtcggcgcagccgccccccccttagatgacgccagccctgggatttattgcgcgataaattatttaaggactttttgttatagtaataaacacagataatcttctaaaaattatatctaattcatccgagctccgattaagtccattcaagtctcattaaattcataaaaatgcatagaatccattaaaaatggttttgtttcctgtttcagtagtcttatagcctgctttgcttgtgtgctttgtttgtcgcgtaga

SEQ ID NO: 36988 - DNA, 1501 bp, Oryza sativa
agacgtgtcacgatcttgcgtcggccgattctcgtagcttgacgccatggctatggcttgtaacttcgttcaccgaaaagctagacagatccagttgggacggctgcaagtagcactactccaatggtgaaacatgcagttcacattttttttcacaaaaaagctagtagaaatcttttgcagttcacatcgacgtttgtctagtacgagtcgtactagcagagacgagaagattgtctgttgaaagtacatgcccatcaggaggacatctctgttttttttttcttccatggacaggctttcatttttagctttaggttaacgatccatgcaaaatataataaaatgcaattgtcccaccaacgaccgaaggattgatccacttttactcctcccaaagccaagaaaagtgtcaggatccggagacgcttggatgttgctagtgatcattaccatgacagattaataagaagctaatttatcagagtgaccgaattacctacggtatcttctcgactaatcatccgagacaatcgggccccactcgtcagcgacttgtacggtccagtgtgacgactaatctgcattgcccaatcttcagttttgtacaaaagataggagaaagatatgagttaggtagctaagcttggttttagtagtctctgctgtatgaaacaccggtttttggctagtgactctgcctttccgctgtgtcgcgatggatgtgtgattgccgaccaaaccggcagctacgcagccttataaattgcccgcctgcgtgcgtctcatctctcacacagtcggtctcacttgccaccggaacccagcagccaaaagcacaaacgctagctgagacttgctgcagattcagagttttcccctcgcactccttcggtccatatggcgttcaccgaggtatgtgatgctctcagctttgcaagttctcaactgtcagctactcagcttaattagagcttaattaccatgtctgactgctctctactagattgtaacacaccaattcttacagtggttggtggcaaagtttgcaatattactgccagagctgagagctcactggcaaacctgcttgttgtttagttcttctctgggactctggcaacctgaaaattaaaactttattgcaacttcaatggtcttgtgaattcatggcacaaaagtaggtgcattgtaggtgcattccaattctcttgagaattcagagtagttatgcccttgtaggtgcattccaattctctgctttaaagccaagcaaaactacacgagctggagtagctcgttacagatgtctcacataaattagctgtctgatcctgacaagtgacaataagctagccagtgcgtcacccatatcgaactgctataggatttcttcttcaaccacacccatttcgcgccagcaatctctgaatggtgttccgcgacatgtgtctttctctgacactagtgtacaccatgtgttgttggcgcccgcaggaga

SEQ ID NO: 36989 - DNA, 1501 bp, Oryza sativa
aacataagacaagtacgaccacatgggtggaatgggacacccctggttgagtaactagcttatcaggggagccttgatgccgagagacatgtggattcgccggggtggtgtcggggaggacctctgggcttcttggcacagtatggtctgggacctaacctgttgttggtctgggacccctctcatcggcatatggtaaacctgtgtcggctttggaaatgccttgtcatgaaagcttggaggtctcccgacgtggctgatccccacgggctgggtgatccgggttagtaatgtcgtgtgggtaaagtgtaccccctctgcagaggtcaacaaactgttcgaacagccgtgcccacggtcatgggcggatgtgaggtgattcctagcgtagttttgtttgactactgccttgtgaaattgctgtcgtgaaaaggggatcgttgtttggaaaatctgcagctgatgggatcagctaggcccgggtggccgtttgaaagttgttggcccgggtggccgtttgaaagttgttggccgggtgccaatcttgatcaattttaaagactgatacattgcacatactccgaccggacgagacgcactgtctcatccgtgtcgtttgagaagcactcacttagttgttttcagaaaagagttcaaataaaatcaattgcaaaaacaacagccctttctttgaagcctgcattaaacacttatttcccatggcttgctgagtactcccgtactcacccttgctctatataaataatccccccagttgctgaagaagatgaagcggatcccgctgacgaggagttcttccaggagcaagccggctacgatgagttttagggtttcggcctagttcccaagtcgcgcctgtgttgtttggtccaagtcttggcttccgcctcccttttgtaatgcagttgtgagctcgggatctgtccgcagcccgacttgattgtactcctactctataataaagagacctctgttgctgtgataatctgtcttcctgtgataccagcactgtttcctgggactggtatcgattaacaggttaatttggagcgtcatgggctagttccggtcgggactagttcggggcgtgacaccgcccgccctcccctggcggcggccgccgcctccccccggacccccgggcgtccctgtcctcgacgcgctcccgctcgtcggcccggccccgcacaccgacctggcgtcgctagcgcgcaagtacgggcccatcatgtacctcaagatgggcacctgcggcgtcgtcgccgtgcgcggcgagggctttcttgccggtgcgccacaatgaggttgcccggctgctgcacggcagggcggaggcgtcatccgccggccgtcccgtcgtcatcccgccgccaccgaccactcctgctggccacacaaacaggggagaaagagatgagggagagagaaggaggaggaagatctggcctcgccgccgccgctgccgaccactccctcgacc

SEQ ID NO: 36990 - DNA, 1501 bp, Oryza sativa
tctgcgaacactgtaaagattgcacctgaacatacatcggaacaagttcactagcacatgaacagccatcgaaaactggtgcattttaactcatgcatgccaatgaggtaaaaattttctggatagctcactgcaagaacaccacattggtgatgtccgggaacttctccttgatggccgccttgatcccgctcccgatggactcggggccttcgtacctcaccaggcagtcctcgccgtcgacggcgaccacctccacgctcccgccgtagttggcgatcgccggccgcagtatgtccaggtggccgttcaccgcctgcaacatccagccaatgagcattggtagctccaaatttacagagtcttggggatccttggcaaaattatgacctggggcgttggctccgccggctgctgatcgtcgtcgaacacctggcggatatcttttacggcgtcgccgaacttctccttgagcacgcgctcgatgcccatcttcatcgtcgtcgtcgagctggggcagctgccgcacgctcctggatagatgccgtagcaaaaccacaaattagtaagtggtaagcatagcaagatttggtctcgcagccatgattctggccaagaattggtgacgcgcgcaaggggattaagaaaaatctaggggttcaccttcgagcttgagggagatgacgccgtcctcgacggacgcgacggtgacgtcgccgccgtcggcgatgaggtaggggcgcacgtcgtccaggacgcggtcgacgttctccgccgtcagctcgtaggtctccgccgagtacaggccgcctcccgccgccggtggcgtggacgcgggggccgccgcaaggtgggcccgggcgccggaggtctggatcttggagggtccggattggagccgccgagggggcatcagaggggtcgcttgggtgattcgaaggcggatttgcggccgcagagacaaggcggccgcgccggcgccggcgacggtgagtgacgcctccatggcttgtgtggagtgtggtcgcgtcgatgtggtgggtggacgccgatggcttcgtgccgtccacgaagttacggttgacgaaggaagaaatatcaattaaatttctggctcaggtcggtaatttttccctgaaaaaagaaaaacgttcctatgaattgcgaaaacagttatgctgtgcaacaataagcagatctgcagatagcagtgttttcttttgattcctcagctgattatttttttctttaaaaaaatacatgtagcatgtaccttgtgtcaacaccaaaagaataagtcctatgattcttcttcaaagtaatttggtattttcaaccgattttattggggttaagtccgatttatctcctcaataattgcaaaactgtaatttactctctaaacaaggatatttgacacccctaacctattgaatccaaatgaattaacaacccttcaatcccctcctccctccaacccacatacacactcaaaacatag

SEQ ID NO: 36991 - DNA, 1501 bp, Oryza sativa
ccgcgggctacaaagtggggatctctaatttcacagcgttagtacgtgactacgtgctaactatcttgagatttggagcatttggcccaagtcaaggtcttttcctacgtgtaacgcgtactcccatgccaatcagccgccgatgcgccatggcaagtaaccgcgtggcccaccatgcaggttactacttgtactgatttcatttttattctggtctttctcgaggacttgtattttatactaccagcaaactactaaaatcattgttgtttagttaaatccatcttgagagagagagagagagagagaggtccatctctgcgattgtcatggctacaggtctagtcatgcttccaagttccaactgtagcgtagactggagtgttattttttttaattagatgatgaagtgttgtttggggttgtacttgcaatgggctagttgcattaacaaaagacatttcaaagatcaaagagtgatcgagatactaaaatggcggttaaaacgcgtctttcatgcgccacttgcatcaccagaatatgaggaagatgcctaccacgacatgcttgttctagatttcagaaatttaaaccaaatctcagtatttgatcactatccctctttagcacaagttgacacaaccacacagcaatgatgatggattatggaatattcagattgtagagttagtactccaaatgagtactaacatgcttcactagatcatgttattgcttaaaacatgctttatttttaatggtcatttgtgattcaacggttcaggcatatcataccaccggtagtagttgcatgtagatggagcagacttttgtgaggctgtcagttactccatctttgtctgttgacaagaccatcagttagtttagttaaatcggtagcagatccagaatatgccataatgaaccttaattgaaaacacttgttaatttaccaggaaatgggtcctgcttcaggagcagcattttttgtcaactgctctagccgaaattccacctccaaattcaaaagttttcttgcttggacaccttcttgacaatttaccagttttggtgtttgtgtgcttggactcatgtttgttattgtccattttaaatgtcgactacatcagcccctgtaatcgccaaattttcaactctgtttagagagacagacagtttgcttctctgtatcacagaaataaggttcatgtatatgcagatgtacaaatgtaggagtacaatgcaagtagcgaacagtttacacaaagagaaacatttgtttaccaatcattacgatggtttcttatcatattcaacacccaaatcccatcgttcttgtattctccactagtcttgggtcatccattcttcagacagttttgtcagaaaagcaacaaagctaagaacaaatactaatgcaatccagagacaaatttaattttcctagaatcatcaataaaagtacattaggaatcctgttctttctgtactgtctacatga

SEQ ID NO: 36992 - DNA, 222 bp, Oryza sativa
cagtcttttgaattgatcaagattggcacccggccaacagctttcaatcggccacccgggcctggctgatcccatcagccgcagatttttcaaacatcaaacccattccacaacagcaaatttcacaaggcagtagtcaaacaaaactacgctaggaatcacctcacatccgcccatgaccgtgggcacggctgttcaaacagttttaataacctctgcaga

SEQ ID NO: 36993 - DNA, 169 bp, Oryza sativa
agtaaataagaattatttggtgtaatattttataatttttgtatgaataatgatatgtcatttttgtatgactgttgaaagagtttgtaattattttataattattgaatgactgtcattattgttagaataattatttatgtacgattttttttcatgtcacgtagat

SEQ ID NO: 36994 - DNA, 1501 bp, Oryza sativa
gtgtttaatgcaggcttcaaagaaagggctgttgtttttgcaattgattttatttgaactcttttctgaaaacaactaagtgagtgcttctcaaacgacacggatgagacagtgcgtctcgtccggtcggagtatgtgcaatgtatcagtctttaaaattgatcaagattggcacccggccaacaactttcaaacggccacccgggccaacaactttcaaacggccacccgggcctagctgatcccatcagctgcagattttccaaacaacgatccccttttcacgacagcaatttcacaaggcagtagtcaaacaaaactacgctaggaatcacctcacatccgcccatgaccgtgggcacggctgttcgaacagtttgttgacctctgcagagggggtacactttacccacacgacattactaacccggatcacccagcccgtggggatcagccacgtcgggagacctccaagctttcatgacaaggcatttccaaagccgacacaggtttaccatatgccgatgagaggggtcccagaccaacaacaggttaggtcccagaccatactgtgccaagaagcccagaggtcctccccgacaccaccccggcgaatccacatgtctctcggcatcaaggctcccctgataagctagttactcaaccaggggtgtcccattccacccatgtggtcgtacttgtcttatgttcggatgaaattccaaggaaacggtccttaagtgcaagagcgggaaaccgtacacccgatacgttccccggtccgcggttttggaaattcatttagttcgcaagcactgacccaggtgtcgggttttccaagccttttgtaaaacccaagttttacccaagaagtttttcagattttaagtttgaaggcgaccgtcgatactcgcatagggtgcacgaatatcgaggcgcaactagatggttacaaggggacatgatataacaattaacaaaggaaggatcaaatgcaacaaattaggtaagtccgccaatctgccttgcagacgggacaaacagattaagtgcgatcctatcaatgcataatatttttcaagcaacataattaaattcaaatataggctcaagatgttcaaaggtggcttgccttgctcgagatctggagcttgatcctcgaaatcctcgcactgcgggtcttcggactccaaaactatacgcaaaacgggacaactcaacaaacggcgaaaataaagccctattaatgacctctaagcgtgccattagatagatctcgagatttgaggaattttggaagttgaacggagtcaaacggacttacggttgggaagatattgaatttctaagattattggatttttggtctaaaggaaaaggatttaattaaatcctttttgaaaaagaaaagaaaagaaaagaaaagagggagggaaattagacttccctcgggcggctagggtgcggcccgggagaaaaggggcggctcggccgagcttaa

SEQ ID NO: 36995 - DNA, 1501 bp, Oryza sativa
atccctcgcgtaagcccaaagtgccccaaagcacgcatcacacatactgtctttcggggatatgagatcgagcgaggtgtgcgatgagaaggttcgtggatgcttccatgggaatttgaggctccggttcggctgggttccacatgccaacgacgacgcctagcttagcttacggccttagcttggcgcgcgcggaagtcacgagcccagccggcctcctcgcggtctcagccactagctttggctaatagcgcctatacctatctagtactagtaggagggagtagcaatcgagctgcagaatactctcgtatgtgcctctccacatctcagtaggttcaggcgccacgatacagtgcgcggtgttcccacacgccaaggaaaatcctacctgcccgtcgaccgcatgcatgtgcgcgcacacacgccggatttctccggcaaccgcgcgcgcgagatcgatcagacgcggtggcgaggtaaatgtgcgcgggcacgcgcgcgcgcgcggggggtgggggcttgggatgaagttgcatggctttgccttcggcagcagggcaccatgcgatgggatgcgatgggatgagatgcgatttgatctcaggtgggcaacttgaccacgtaccgacttgcgtacggccttcggggatgtgggatcggcgcgccatgcatgcataattgattgacagtacgcgtaccacactcactgaaacgatcgagctagcgcgcgcacgtttagttttgtgtgcggtgatcatatacgtatgtatcgagagtgatcgatatatcaacgtcagtacttcacttcggagaggagcatcaatcgatcgatctcctcgcggtgctcaacagctcgaacgtgtcgccgtagtacgcactttggcacgcgcgtcgagtccggccgggggtccgtgcagtctaaaacgattagaggcttaactggtggaattaattattatgtgatccaagacctatgtagagaataatttctatgagaatattaaaatcccaacccatgagatacatgcatgcaaacttttaataacacctttgctagttctaaaagagtgagctactttaaaaagataagtgctcacctagccagttgagcaattgatgtgaatagggacagttccagaaaaaacattatatgggaactaatctccttcttcctccttcactccccccctcccctcccctcccctcccctccttttttttcccttctctctgttagatcttatcatatcttatcattctctgtatggatatgcacggatgcatgttggttcggatagatagaggataggactctaatcccttgtaattaggatcaccgaaccaacacatctgcatgcatatatatatctgtaaactcagcacgtttttgcgtattgtgaatcaacacgaaaccctgcgtccaccgtgacgctttcctgcatacacctgagttttatatggtatcagagcctcaaagtccggcgtgatctgcaagtccg

SEQ ID NO: 36996 - DNA, 1501 bp, Oryza sativa
cctcggattcgtttggaaaccctcccgcgaacttcgccggcgcatcaatggcggccggatcttccgcggccgattcctcctcatccggtcgccctctctcactcccaacactatataaacactccccgtgcctatctccaccgtttccgccgctcgccgctctctctccccgtcggaatcgagctcgcgccgtcgtcctctctctccgccgtcgccgccgagctccggtccgccgccgtcgtcgcaccggacctcctcccgcttcggcatcgcctccttcggcttcgccgcgtcctcgccgacctcgtccaccccttcgtttcgaccgccgaccaccggaacgccgccgtcctcgtcgacccgagccgcgccgccgcctctctccgcttcggttgccgttcccgtcgtcgccgtcgacccggggtgagccatggaccgcccatttcgtttcccccttccctcccctctctcggccgccgctccgccgtgcctatggccgccgccggcgaccataggggcgcgggcgcgccgcatcccgtcggccgtgccggcgaggccgtcttcgggcgcgccccgcggctgccatgtggggcccggccgtcagccgcccgcgccctcgggtgcggctgacgcgtgggacccacggcgccggccggcgcaagccgcgtgcacccggtccaccgtggaccgtgaggctgacacgtgggccccactcccgtggacccggtccgcgcacccctcccctcggctgacgcaataaatccgattttaaattaaaatttaaatgaagaaattcgcaaatattcatttaaagagcatataaacttcaaatggccataacttggccatttgaactcggaattggaccgttcaagtctctaattttttcctaagaagtcaagaacccatttttgtgctttgtttctgcttgttatatggagtttattagagtaaaagccttttcttttccgttggtcgtgtagacgctgcagcttcggaagatctgctcttcgtggaagttgaagccgacgtttgggaaagcgagcaaggcaagtcacatcatctttgaacatattgaatcccagtttgcaaaattatgttgatttaaattatcgcattatcgctttatttaaattcccgcgttatcattgttttgtttagccatgcctatttacctttgttacgaccttattattattgttattgttattatttccttgttcaccctagagtaaacaaaaccccaactagtggacactctactcatggcaccactagtttaattttaggtagatgcttcgcaatttaattaggtaacattaggtggttttacaactctagactttgggaatattcatatcaccttgacattttggaactgttggattattgtggaattggattcacaccgccccctctattcaaaatccccaaaatggttttaggctgggctcggggtgcatggttttgatagtagcacctcggccatataaggaccggt

SEQ ID NO: 36997 - DNA, 460 bp, Oryza sativa
agggagtacaaaggagttatacaataaagggttagggtttgcagtaaacagcatttaaaggtaattagttgctcaaagctattttgtaaacgcgaatctagaactataccatattgtttatcaaggccgtgaacccacacgaacctgccttaacccaaggcctacgatgattcagaccgaactggcaacccgaccctgggtcccagctcgtcccaagccaacccaggccaaccattccacattttagttgctaagcaggttttaagaattaaaacactaacttgggtacattactcggcttgcccataaccgagggcgcggctattcgaatagattatactctgatcagaggtgtacatctttacccacaagacacatcttcctcacgtgtaaccacgtgccacataccaccacggtatacagacggaagacgtgacatagtttccaacccatcctagcc

SEQ ID NO: 36998 - DNA, 161 bp, Oryza sativa
attgtgtgtggtgttcataaggtcagaggtatatagaattgtttcgaatttctttgatccactaatattcttcttagtatgattctaaatatactatatctagagtttttctcatttctattgtctgcggatatttatatttttacctttcactttttgta

SEQ ID NO: 36999 - DNA, 1501 bp, Oryza sativa
ggttttgtttactctagggtgaacaaggaaataataacaataacaataataataaggtcgtaacaaaggtaaataggcatggctaaacaaaacaatgataacgcgggaatttaaataaagcgataatgcgataatttaaatcaacataattttgcaaactgggattcaatatgttcaaagatgatgtgacttgccttgctcgctttcccaaacgtcggcttcaacttccacgaagagcagatcttccgaagctgcagcgtctacacgaccaacggaaaagaaaaggcttttactctaataaactccatataacaagcagaaacaaagcacaaaaatgggttcttgacttcttaggaaaaaattagagacttgaacggtccaattccgagttcaaatggccaagttatggccatttgaagtttatatgctctttaaatgaatatttgcgaatttcttcatttaaattttaatttaaaatcggatttattgcgtcagccgaggggaggggtgcgcggaccgggtccacgggagtggggcccacgtgtcagcctcacggtccacggtggaccgggtgcacgcggcttgcgccggccggcgccgtgggtcccacgcgtcagccgcacccgagggcgcgggcggctgacggccgggccccacatggcagccgcggggcgcgcccgaagacggcctcgccggcacggccgacgggatgcggcgcgcccgcgcccctatggtcgccggcggcggccataggcacggcggagcggcggccgagagaggggagggaagggggaaacgaaatgggcggtccatggctcaccccgggtcgacggcgacgacgggaacggcaaccgaagcggagagaggcggcggcgcggctcgggtcgacgaggacggcggcgttccggtggtcggcggtcgaaacgaaggggtggacgaggtcggcgaggacgcggcgaagccgaaggaggcgatgccgaagcgggaggaggtccggtgcgacgacggcggcggaccggagctcggcggcgacggcggagagagaggacgacggcgcgagctcgattccgacggggagagagagcggcgagcggcggaaacggtggagataggcacggggagtgtttatatagtgttgggagtgagagagggcgaccggatgaggaggaatcggccgcggaagatccggccgccattgatgcgccggcgaagttcgcgggagggtttccaaacgaatccgagggagagagagagggaaaagtggggggggaaagagagagggaatcacggggagtgatttccccctctttattgcgcgcgggggcggcgggatgcggcgaaatctgcggcggcggcggcgctagggcacgggcgaggcggcgggtgcggcgcgaggtaggggatgacgggtgggccccacccgtcagcgaaaagaaaagaaaagaaaagagggagggaaaatagacttttctcgggcggctagggtgcggcccaggagaat

SEQ ID NO: 37000 - DNA, 284 bp, Oryza sativa
tcaccatgcctttgcaaaccctttatttcgagctttcactacatgtcaggtcacacattgtggagtaaaacacaaaagttagtgggatggcattgagttagcagtatccctacttgtggtcttcgttgatgaatagacagtgctggatatgcataagctcatcaattagagatgaaaagaatggatcgcatcaaatgcagtatcggagacttagaatgttgcagcagaatacctgtttaaaaaatccatggattaaggcaacagtccacgttgtattcttgaga

SEQ ID NO: 37001 - DNA, 267 bp, Oryza sativa
ggagaagcaggtggctgatagtaaggacttgacagagggcagtgcaaagggtaatatggttggctgtctcccatggttggcacaggggaataaaaactgtacatcacctgaacatttgcatatcaaggagattacattagtaactgacccttcttgtaaaatcatggtagcagaacaagatggtgaaagcattaagaaagaggggaggtgtataataaccatgtacttacaggagatgcagcatcagttccatctgcactggcaaca

SEQ ID NO: 37002 - DNA, 1501 bp, Oryza sativa
aaaaacctatatcacatttgcaacctaccataattcagaagagacaatgctctgaacctctttgccatgaagaataccatacgtttcgcctctctttaaccaccacgttgaatgaaaatccatgtgttaattaggcgacaagacgaacggtatcaccgatcggtgagatggaaaggacgatgccgtagatccccaaatctgaaagaaccctgccaaaaactaatcaagtcaatgctgctgctgctcctgccattgccaaccgccagaagaaaaatgattagagcagcaatcacacaggctagctggttaagcagagctgaactgatgcagaaaatggagtagtttataatgcattagccggtacagcattattgttaagtgcgtgatcacatgttagaaggctcaacagccatgttctgatgtgaaacctatcctctgctccatcagccattgacatgctggattcctggccgtccaaaactgcaaaggatctgaaaatgtgaactgctgtagatctgtttcagaagcagagaaaattgtcaaatgccaactagccattgatttgaagcaataatgattggcaatggagtttaacagatttgtttgactgaatattttcaggtgaaggcagtatatgttttagatccaatttcttaggatctgaaaatctccaacccatgcttaacagactttttcagttatccgaaacagaaaaggcgaacagaatcgcctcattgactgaatcacgtaacactatctactttccataactcctaaaaatcatggtctacttaagctgatgaagataaagaaaaaaggttcactgcttaaccatttaaagccgaatgttgaccgtctcaattagcaaagatatttgttttctgccactagcttgttcaatcatctcatatttgcaaaattaattagtcatagtgctctaataaacatattgttttttttgccacttaacttgttcaatcatctcatatattccaaattaattagtcatacagctctaataaacataactgtagccctatgattatatataaaagaaaaatgaatttgcagggctattgctctgaagatctgcattaagccagactctggccagcattttccccaagatggcattagcaatcagaaatctattcagattccccgaactggcaaccccttttctttactgacctacctgcagaaacctctaatcaattaattattcagttaacaccattagttactcctagatcagaagaagggaaaaaacacatagaaaaataattaattagactattgtaaggtgggccccacacaagctccctccctataaattacccctccatgaacgcctccaaagcttcatcactgcacaaacgcaacaaacgaagcccaaaacgccaaagagagaagaaaaaaaacacgaaaaatttccccaaaaaagttagcgaccaagaaaccgcagaaatggaggagcagcagcatctgcatcccggcggcg

SEQ ID NO: 37003 - DNA, 622 bp, Oryza sativa
aaaaaaagaactgaaaggcataacgcaagctactgaatagaatgaccagaatatgcttaggctggacttcaactaacagagcatcagagtggagtactttcaggtaatagtgcgagcatccatatggcattcttttattcaaatactgacaagaatgactgtgggttcatgcaagatgccatctcttgaaaaagtttgaagcacacaaaggaagtacttcaacttattttccttgtgaaaagctgcatatccatccaataataattagattaagataatccccttttcaatatgcaattgttgcagaatagcatgtaccccatgaagcatatgaatattccactaggaggaactgttcttaccaaatctatcattggcacaatttacggtctatcaggattcaggtataactacttaaattaaaaacgaagtttttgttccctttacatgtgtggagtgaacagcatcaccggtctattctccaggaccactcaccctttcatcacccaactctcaaattgcagcagatgtgttcaagaaaacgaacatcgtccagaatagtctaccaaattaatgagccagtgtacgtgcattttctttttctttcatttctttttttagt

SEQ ID NO: 37004 - DNA, 1501 bp, Oryza sativa
ctaagtgctttggatttttgagctctctccctctctatctcaaatcccccttgttctttatgacttggatctttgtgtgtgaatttggagtttgggagcctagtgtgtgtttctcttaatcttgagcactaggatttgtccaagagttgtgtggtgtttattactcttggaggttgaggactcctagacggctaggtgtcgttcttgggccaccgatctacgtgtggttggccaagagaagtttgtgaaggccggatcttgcctccgcaaggaaagagatacccttagtggaaggaggagtgcatttgtgcaacctcacgaggatagggttgaaaaagacccggctctttgcgagcccctcaacggagactagaatcccctcaaggatttgaactccgggaaatacatcggagcataaacctcggtgatatcctcactttctttaccttcttgttccattgctttgtgctatgctaatattgttgttggtcgagctctcctctttgcttgtggattgaatctagatctcttaggttgttctcttgtttgtattgttgttgtgcaggtcagatagtctgatctcagtttagactatctgatcacataggactatccgacctgatatcagacaatccgaccctgttttgttttagcttccgcatttatttttaaaaccgcctacttgcaatcttgtttttgctaaaagtgagattttacctcaaatctaaatctattgagtttttgaaaaagttgcctatttaaaacttttagggttggtcatttcaaacatatctttagttcaaagcttttgtaaaagaccaaccattctaatgttgcagccttacaaagttcatcaaaaatcttgatttgaccatatttggccaaaacttgcatatggtgggttgaacaatttgagccaaaattctttgtgaataatggcatgaattagtatctctaacccatctaaggctttccaaatgtcaaacttcataaaaatcttatttggatgtgatttgacactttggttgagatttattgacttgaatggcctacaaaactctctttgacatttctcttgaaagaaaaatcttttttgagaaattctttttggaaaattttctattaagtgaaaagatcatttctgcaaggtttcgatttaaattggaaagaatttgactttttctcaccttgctcaagttgctgaaattttcagaaaattcatggtttttgactgatttgtgatttttacatctcaaaataggttgcaaactggaatgagtttatataatgacttttgttcctctatggttggacttcacatctaaatttacttggatttttctatagtcatttgaatatttttatgatgccctttccaagctctttttgagttccaaattctgaaaatcctgaaactttcagttttctaaatttttgtgtttttttgtggcttctaattgtttgagaattgggtaaaactcccaaaatgaaaaatatgcaa

SEQ ID NO: 37005 - DNA, 457 bp, Oryza sativa
actatgttttaaaatatgtgcagctaagccctcgaaatcttaaccttctaatgtatgcagacctatttatatgtgaaaatgcagaaccgtcatgaaatacttccatacctatatatgacaatgtttttgatgaatatatgattaaaaatattagttaccaaacatgtgcattggtcgttatttggtcgtaaataccaagtaaaaaagaacaggaggtgtacaaaccttctcccactcaaaaaattccaaccaccacatgcttttggaaagcaaaagcttgtcgtttcattaatatctgataaatgttttctcctttctataccagaaggattatttgaagaagagatcagaggtccatcaattcgattcaaatggaaatattggtattttctttctctacttcagattgcataatttatatctataataaatagttcttgctctatttaagaggaca

SEQ ID NO: 37006 - DNA, 1501 bp, Oryza sativa
atttatatttttaaggtttgacttaaacattgtcctaaacgacttcctttacgagtatggagggagtatgggcctagaactgtggcttggttcaaacctaggaacctttttgcatattggtctcactgacctgtggacccaacctatttaaaatttggaaaaaatctaaatgaagtacctaaagcttttatattttcaacagaaaaacatgtaaacttctaaaaaccataacaaattgaaaacaacacattttagagtaaatcaaatttctgtgaactcatcaaattatgaactttaatgttatggaataaaaacttggcactcacagtacaaattttgcctctaaaactcatctaaactaaatcacacataaggcttgcacaaacttataaaatgcatagagaattcaatttaagtcattttggaacaaactcagtttctatagatccaccaacttatgttcttctataaagtaaaataaaatagtatacgtacttcacatcaaatgcccctaaaaatactatctacaaaatgattagttttagataagctgaactttagaaattcatataaaatgcatttcaactcctttttttagtaaatttaagctcggtagaaatcacacccaaatcgataaaaccacatgctgcaggggacaaaatgggaagggaatgaatgggggagggatgaggtgtacctgcacatattcagttccggccaaccaaaacgacagctgcgaagccctagagcggagcccaaccttgccgccccctgcatcgcctttctggttgccccaacttgtctagggttttagtcggtttggaagcatgcacgattgagagagtgaggggggagcgcatccgtgttgaccagggttgttgaaacccgtgctgactcaacttgttgaccagaaaccaccccacaatattattatggtagttgttttgtaccggtttaaataattgagggatgtgaaatactcggttggagggctccaatcatactcggcccatggtcgagggagtcaaatatacttttttccttatggatttattgaccccgagaaggcttaaaaatctgacccatcatgtacaaggccttgagtagattgggcctccagctagaaagcataaagtgggcctagtcttgccaagggccgtgggctgggctcccaagttgaaaacaacgaaaccaagggaccgggatgcaaaatgatgagacggtggcagcgcgcgggaaaacccccgcctcgccgccccggacttggcgcccatttcatttcgccgccccacccaaaacccaaatctgatctagggttccttccttctccccgttcccccccacacacaacagcacgagcggaggctgcagagccgagcggcgcaggcgattctcctcctctccccgcgccccgcgtaccgcgcgcgcgcgctggggagcatgggcggcggcggtggcggcgatggtcgccgccgaagcccgtcggccgaaggagaagaag

SEQ ID NO: 37007 - DNA, 1501 bp, Oryza sativa
tactcctttctattttacagctatgaccggtcaaagaaaacactagaccccgatgattgtttcgttaaagctcaactggtggcaagaaacgatactattatcagctagcaaatagaaaattagttagcaattgtgattatatgtcagtctacatagatatatatatacgttttagactggcgctcataaagtgacccttatttaggattaattgctccagtagccaactaatcctattattatttcttgattatcatcacaatttggttgaacctagtctcttaagtctgaatttgaggaaattagagttttgaaatataaacgtttgatttttcaagttcagttacatgatcatgaggcatgagccgggggaatataacaaaggtgattttcaccatataagaggttgttatattcttttcccaaatatagtaatctagtacaataacgatgtggttgtaattgagtccctgtttagttcctacacaaaaaatttacaccatatcacatcgaacgtttaacacctgcatgaagtattaaatataggctaaaaattaactaattgcacatattgcgactaatttgtgagacgaatcttttaagcctaattgctccatgatttgataatgttgtgctacggtagacactttctaatgacagattaattaggcttaataaattcgtctcgttgtttactgacggattatgtaattaattttttatattagtgcccgatcaccccatgtgataccctatataatatccgatgtgacatgccaaaactttacacccctaatctaaacaccccctgatatgtaaaaggtaaccactactacaacaataaccttaaaattattagaagctatagccaattgttaggatcgttaattaatagtgaccccggtgacaacctatcctggcttcgcccctgggaggcactcaggcacatgcgtcctggttcccacatgcacgccgcgtgaactcaaactcgtcgcaaaagaaaaaacagagcaaatctatcatcacttggcgccgatcatcccgagttcccgacagcgatcatggattcatggttcacgatggccagggcactccatctcaaaaagaaaaaaaaattaacagaaagatcaaaagagaggaagaaaaattatcgtgattctgtgttcatgcattggcaatcaagccaatcgtacaccatgttttcctatctactgtagctaggttgcaaaattatcgtttacatgtatcgtctcaattcaagtttatagctaccaagtttgagctttacacttactagtagtagcataataaaccgcgccgcccgttgctagctgacacctgcaagagtgccagtgagtatatactagtactactacggcagtaacctatgagccgtttgctacaggcgaaaccgagccagccctcttgcgagactgcgacgcgcgcgatcgtcaatcatgcagacgatcgatcacatgcgtgatcgcgctggacatctgac

SEQ ID NO: 37008 - DNA, 1501 bp, Oryza sativa
attcaagctagaaataatcccagagagagggcttaccggggagaaggtcaggagccatccgagccggcgctcgctgtcggtgtagggcgcaaagccaagcctgctctccaggagctcctccgctccgagccgcagccgctggtccttcgccgccgacgacccagaccttcaaccgccttccctttccccttccccttcttctccttcggccgacgggcttcggcggcgaccatcgccgccaccgccgccgcccatgctccccagcgcgcgcgcgcggtacgcggggcgcggggagaggaggagaatcgcctgcgccgctcggctctgcagcctccgctcgtgctgttgtgtgtgggggggaacggggagaaggaaggaaccctagatcagatttgggttttgggtggggcggcgaaatgaaatgggcgccaagtccggggcggcgaggcgggggttttcccgcgcgctgccaccgtctcatcattttgcatcccggtcccttggtttcgttgttttcaacttgggagcccagcccacggcccttggcaagactaggcccactttatgctttctagctggaggcccaatctactcaaggccttgtacatgatgggtcagatttttaagccttctcggggtcaataaatccataaggaaaaaagtatatttgactccctcgaccatgggccgagtatgattggagccctccaaccgagtatttcacatccctcaattatttaaaccggtacaaaacaactaccataataatattgtggggtggtttctggtcaacaagttgagtcagcacgggtttcaacaaccctggtcaacacggatgcgctcccccctcactctctcaatcgtgcatgcttccaaaccgactaaaaccctagacaagttggggcaaccagaaaggcgatgcagggggcggcaaggttgggctccgctctagggcttcgcagctgtcgttttggttggccggaactgaatatgtgcaggtacacctcatccctcccccattcattcccttcccattttgtcccctgcagcatgtggttttatcgatttgggtgtgatttctaccgagcttaaatttactaaaaaaaggagttgaaatgcattttatatgaatttctaaagttcagcttatctaaaactaatcattttgtagatagtatttttaggggcatttgatgtgaagtacgtatactattttattttactttatagaagaacataagttggtggatctatagaaactgagtttgttccaaaatgacttaaattgaattctctatgcattttataagtttgtgcaagccttatgtgtgatttagtttagatgagttttagaggcaaaatttgtactgtgagtgccaagtttttattccataacattaaagttcataatttgatgagttcacagaaatttgatttactctaaaatgtgttgttttcaatttgttatggtttttagaagtttacatgtttttctgttgaa

SEQ ID NO: 37009 - DNA, 1501 bp, Oryza sativa
gcaagcagtgggtcgctgattaatcattcgtcgttgtgcagaagcatctcgtcttgcagctacctgattaagtatatgtgattaacactggacaaatctggaacaaaaattaaatccggctggtctttctaaatactccagtttaatacagtacacatcaaatctaagtaggcaatcattgatttcatccagaccagcacttgggagtgtggagactagtctggactgggaagcaaagccttttctagaagggagcagatcaaatcaggagcaccgaaacaaaagtagatgactcgagacgcctcaagaacgtccattgcgcagctcccggacaaatcctataaatatgtgcaccgctcttgtgctgaaacccaccgaggaacacacaacaaacaagacttgcatacgtcccaaactcccaaatcgccctctttgcaatcgcttcttccgttccatttcagtagcccacaacttcgcatcagaaagcgaaagatagagcaaccatgtcgctggtgaggcgcagcaacgtgttcgacccattctccctcgacctctgggaccccttcgacagcgtgttccgctccgtcgtcccggccacctccgacaacgacaccgccgccttcgccaacgcccgcatcgactggaaggagacgccggagtcgcacgtcttcaaggccgacctccccggcgtcaagaaggaggaggtgaaggtggaggtggaggaaggcaacgtgctggtgatcagcggccagcgcagcaaggagaaggaggacaagaacgacaagtggcaccgcgtggagcgcagcagcgggcagttcatgcggcggttcaggctgccggagaacgccaaggtggaccaggtgaaggccggactggagaacggcgtgctcactgtcaccgtgcccaaggccgaggtcaagaagcctgaggtgaaggccattgagatctccggttaagctcctgaagatgtgatcggtgagggaagaagtcatgtttggtgtcagtaattcagtatttcagtgtgtgtttgtttggtcgtgcaagtatggtctgctgctggtgtgtcgtacccgttgggagtccgagtggctgagtcggccggtttcatgtattcctttgtgagtacttgtgtaatcgccttcttagttcttgctcgttgaggaataaataaagagcttttcaggttgcaaacatcatgcaaacgtttttgaattccgatgttatatatactgtgttatactagcttttgacaacagttatactcctaggtgtgcggtggtctgatttgaaacttcagccgaagaaatggaatgtgataagagtcgataagtttcaggtcactatatttttaagtaaatttaataaaactcacgatttatataaggtttaagttacaaaaaacaacatcatattatacctagaatgcaacttcaaccataaaacttttaagagatcagttttgacaccttatcgtttagtacattttgaaacgtttagtaga

SEQ ID NO: 37010 - DNA, 1501 bp, Oryza sativa
gaatttaatacggtcaatttaatcatgagtctcttaaccgaattaacattagctaaaactcagataaatattttttcgtcccaaaaaaaaatagtacgggatggtatatatgtatgagacgaaggaagtatcatgcttgaaaaaaaaaattaaaaccactatattggttacttggtgttatatataatttgttgttgtgattgttcacttttgaaatatgtcctaaaacaagatttattgttgattgcgtttcttttagtatcctcaaattttgatcatgacccaagaccgaaccaaatgtatgcccagttgcccacccctaacgttattatggggtgaaaagatggttttgcccttaagagcaggtataatagcaagcttaagtcagctataaacatattttaaagagataaaaaaagatagagaagagcagcgggctacagatctgtagtcagctgcagcacggacttcaatacgtaatgtatgtatgataggtgggaccaggtattaatagtacagtaagcaactattgtatgaattgactattacattggctatagatgattttaagttagtagtgggctatactattaaacttgctctaattgttttatgccagagccataattttatcctttcttttgaggaataaattttatactacggagtaacttattacgcgattcacggttgaatatctgtttacttatctttttacttatacttatatttatcaatcaaaatttaaaatttcaactttaaatttgaagttgattttgggggttttgatcaaaattcatttttcagtctttgctttaagatcactaaaaacacgtatatacaagttttattaataaattattcttttttggcaaatatgctgtttgcaaatgtgttataggcttgtagtaacggggtgtgatacaaaatcctttaaacgtccgtatttatcatgctgaatgaataggttggcaagtgtttaaaaaaaaataggttggcaagcagtgggtcgctgattaatcattcgtcgttgtgcagaagcatctcgtcttgcagctacctgattaagtatatgtgattaacactggacaaatctggaacaaaaattaaatccggctggtctttctaaatactccagtttaatacagtacacatcaaatctaagtaggcaatcattgatttcatccagaccagcacttgggagtgtggagactagtctggactgggaagcaaagccttttctagaagggagcagatcaaatcaggagcaccgaaacaaaagtagatgactcgagacgcctcaagaacgtccattgcgcagctcccggacaaatcctataaatatgtgcaccgctcttgtgctgaaacccaccgaggaacacacaacaaacaagacttgcatacgtcccaaactcccaaatcgccctctttgcaatcgcttcttccgttccatttcagtagcccacaacttcgcatcagaaagcgaaagatagagcaacca

SEQ ID NO: 37011 - DNA, 649 bp, Oryza sativa
tgttgctcggtttctttctttgttcgttgcttgctgcagtatgtgactatactagctattgatgcttctatcactgttctgtaatcatcaacgatgtcggtgcataacagcatacttgaacatgtccagtgtctttgctgtgaagcaaaattgcaaccctgctactctgtttttcacttatcgttgaaattatgaaagcatctctagaaataaatctaaaaaatattttttttaaaaaaaatctacggatagttttaaagtaaaaggaagctaaattttaaaatttttcgcggcacagattcgtagaaaaaggaaacgaagtacagtgaagcgatctgctgctcggtctttgacaaatccaattgatcattgggagcttttgatactctcgagatattcttagattgaatttaaaattttcaaaatgatgtgacgtagcaccttggcaccttggcaatgtgctatacaaccaaaagctatgctggctagctttgcttttagcacgagaactgccaaggatggcaggaaatctgggtcatgtctgtttggatttgcctgcatgctccaactgctttcggctggaccttgactgagctattaggcagcagctagcacaaaatgccagtttcacctgatgatttcgtttaga

SEQ ID NO: 37012 - DNA, 1501 bp, Oryza sativa
tgctcgttcattccaaggcccatatgcctcgcacagtctcagagatcgagtcccactcgagccccgattgatcactctgcccaattgttcgttcttggccgcaaccagacagcatcaaaccgctaaaccagaaaacaatctttttcttaattagtagacggtgactaaccactaaaattaatggcactagtactactagtgtactgtactgctactggcactggcaggcagctccatcggttaacgcatggcgattgccttggttggagcgtgcgaccgtgcgtgcgtgtgcgtgtgcatctgcaggtcaaaccaagcgaaggcaggcggccgcgcgcccggccgcccggccggctcgcgctcggtgtcctcggtgattaggccccgcgcgagcgatgcgttgcacgatggtggtggcgcgggcggagtagtcgtcgctagggaggatgagttttttttataatcgggtggtgcacgagcaagtggtggtgttggtggtgcacgtgaagccctatgcggttcggcgttgggattccaacaaaatattttcgcgggaatggcgctcggatccgcccatttacgccgcgcggagcggacgggggccggggcccctttatttccgttgccgaacggcggcacgggacggacggatggatggatggatggaacggccggggcggcgccggcgcggctttggtttcactgcgtcacacagcgagaagggacgtttctacagcgggggagggtagtttaggctgtgtttagttcagcgtaaagtttggattttgattgaaattagagatgatgtgattgaaaagttgtgtgtgtatgacaggttgatgtgattgaaaaggactgaagtttggatccaaactttgaatctaaacgcagccttactgcctaccaccggtcaagccgtatgcgatggtttttcgtcggtgactgtattgttttaattaccccggttttagttgcggtgctggtttgggccagatgtgaccacgtcggtgtgttaaggtttctgtatttttttaaacatgacctaggtggagcaatcttaatagtactcccttcattctaaaatattaacgtaactgtgtatccagatttatagttaaacgttgttatattttatgattgagagcgtgagccgtgaggcggcaaatttaacctaaccgtgcccaatccaacgccaaccatatgaccggatcaccccggatcttcaaccgaagcagctgccttgctcggcccttttttactgcacttgcgttgctctcggactattcataccaagtgctcgggaagctcacacgctagagaccactaggccagcgcgagcgcccagctatagcccatcgatctcttggaaaagcctgagatcaaatcccagcttaactccccaaagatttcctgactccaaatctccatccgctccgcagctaccttctccccatatatacacgcgcactccctcccccctctccagcctccatgacccctc

SEQ ID NO: 37013 - DNA, 344 bp, Oryza sativa
ggagaaggcgcgcgggccgcgggagaggaaagaagacttgggccgaaaaggggcccaaagagaggaagggggaaattttatttgttttctttttattttaattggttaaatgatcttcgtgactttaaaactatttctcgagctccgaaaattcacggaaaattccggagagtacattagggcacaaagaatattacaaaatattcccggccaatgatttttaagggaaaattttaattctcccattatttcacttgattaaattgcttaactttttattcaatttctaggaaatgcattattaaatgatttttaatcccgaacgaaaatcggggcgttacagt

SEQ ID NO: 37014 - DNA, 1501 bp, Oryza sativa
gtggacttatccctttcagtccaacgcagaacaaacatttcggcccaacgacaagagctcaagaagcatttcggcgaacggaaaatcatattccaaatttaattggcacatccgcacatgaaagcatctcacaacgaggtggtgcatttccctcgtcagccacagcatctgacagataagcagatcacttacctgcatcactgcatgtacattgacaatctgggcaaactgaataaaatgtactggtagtagctacagattacactgcatcttgagatcaatatctaaccagagaggttaatgacagaagttatgctgacaagattgcatactacttactgcagataattgaccaggtacaaaactatgtggttaaaggagtggacgtgaagaaccaaaattcagtagtgatggccagtcaagtagatgtagcagccttttctggccggtgcctgcatgcatatgcaattgacattgctgcctgagatagactgaaggtttcagagggctaatggattttgaggcataacaaattggactctgctttttatggtagccttcttctagatcatggaagctggttgctttgaaaattgtcggatggcggtgatccaacagagatgcagagtaacagaaatctactctgccgtagactgtataatctcccgtgtttgttgaactaactaccatatctcaaatctgaatgtataatctgccagtgtcaactgcgtgcttccatttcaacccgaggtgtaacatgtgcacacaaaagctcttctctgaattccgcaaataaactctgcttaatttgcagatgagttcgtagttgtcactgttaccgctatgaaccccgtgtggatggtgggggaaattgacaggcgtcgtcactcgtcagtgccgtgaagaagaattaaccaaaactcaatctgcatgcaagtgtccatggttgcctatttgttgctcttctagaagtagtggcacttgttgctcttgcttgccagttgccacctcgatcctctagtacaatgttactagcattggtgctttgcttacttttgaatcttttgtggcttcacaatggccgtcaagatcataaaaatagagggccgttttggattgaagccaaaacggtgccttaccaaaattttagtaatttaaatagtaaatatgttagtttggtttgaagccaaacccatacacaatttggccatattctagaatcttcttcaccatactactaaattttggctccatgttggtatcaaaccaaaagtaggctaattaactttaccctaccaccaaaatttacctagattttgtcacactaccaataaatagttagggtaccaataaatagttagggtagagaaccaaataggccaagaatccacaaaccacacaaaggaaatactcaaacacaaaaactgaagtatgacgagatgagctttgtggaagagaagatgaccagcaattctgtcattaaaagttcggccaaatctta

SEQ ID NO: 37015 - DNA, 1501 bp, Oryza sativa
ttgtgatcattgatcgaccactcgccgttagaagaatgttgatgaagtggaaatccggtccatttccccctttttatatatatcgtaatgttttatccactaatgcggcgcattccaacggaaattaaagaaaaaaaattcatagttaccattcttaatattaatctaagaattcatatccatgttggaattttatatcttctcctcatgctactgtagttgaaataaatattcaccgtttgatggttatatgtaggagatagtggtggtagctagctatggtaggagatgataattcatcattcaccattaccacttatctctcccttcgaaaatataatcatttttagatttcgacacggtcttcgagatactactttgaccaataatatgtatagaagtaaaatattttaaataaaaagagttgcatattatgataatttgtttaataataaatctagtaatatcaattttacatgatagatcttttctatttttttacttttaatagtcaaagttaaaaatatttgacttggcactatactaaaatacttatattttgggacggagagagtaagtcttttcaaggagtacaaatttttctagtttatgctttatcgtccatcaaatatttacagaagtggttaaaaaataatgtatatgtagcaatgataatcgaaattcctatctctcaacgctgataaagtgaaggatgatgtaatgtagggtgaaatttatttattttttcttttgtagaggtggggaggacaacgacgacatgggtgagctcgtgatctacctcttctcgaacgtggtatggtcgtgggaaggagaagataagacgataacgttactatttatgcacaaatcttgatgcagtttacaaaatcaagtgaaaatttgcggtatttttgggtgaaactagacagtaaaaaaaaaaaaacttatactgctacgcgctactacctacaggatgattccaagtttgtcgccccattttaatgatcaataacacacagtgagtccgctagtttcttagccttaaactaaggaaagtatcatgtatggcctgtcttttgtgcaacctatagctagctcgtgtgttccattggcaaggcgacagctccggtctcaaaagagccctccaaggacaaggagagccggccgcaatggcgatcgaatagtaccgtccattattgtagagtatacatgtactatctcctaaactactattgctacttccatagctgaagttaaagtgaagccacaattagtttttttttttcatggcaatcgtaacccacgttttcgaatcccagaactaaaaaaaaagtacaatataatctcgctgaaaaactaatcgtcgtggcctcatataaatcaggcacgattgcgtcggcgacgagtaaattaaaataaagagtgcagagacagagagagagagatgcatggctagctcgtgcttagctttttcgtcagtgttatgttgcagctagctata

SEQ ID NO: 37016 - DNA, 1501 bp, Oryza sativa
cgtgccatctgatcaaagaatggacaattcggaccgggcacggtggaaaaacatggctgtctgaaacctaccgttttggctgaattattggctctgtctccctgtttctttcttggactctctagggccttctactacggctttgtttagttcaagctaaagtttaaaatttggttgatattgaagacgatgtgaccgaaaagttatatgtgtatgacaggttgatgtgatgaaaaaaaaagcaaagtttggatctaaacacaaactactactcagctgcttcctgagagggccaggaaggttcatgaatgaaaaacacatgctacttgccttacttgcagcttggaccagcgtcgtcttctttcttctacgaagtattctcttctgaaaattgttgtttgattcgcatcatctgagtgtactgagtccctccgattcaccgaacaagtcgcaatttgcacatatcagtcaaaactttgcagctgaacatatattttgcagcggtttagtacgtaaccgcaagagcaagctactgaaacggggagtttgaaaacgataaagcaagcaagtgacgcagatgattacaagacatttactgcttttctgcctaacacaaaattgatgatgcacctaccggtccggtaacaatacttttctgaaatgaaagctccggtaatactactactcaaacaagataagctcagagaccaatagccctagaaatcttctgcaatagtaacaagggagatgtgattgacgacgcaggattcagacgcgcacgtggtgaccggagcttgcacaagacgccggagagaaagtgtgaacgaattcgacatcacccccatcaaaacccttaactgacggagagcgacgccgcaacaccacatccatcacttgcctgcagatttgcatctcatactgtccggggacacgaggggggcacacctatcaaatgtagggtagtactaccttgcagctgagctacagtacagcggagatcgatatatcgcgacgtgtacggccacgtcacgaccgatcgattcatcgagagggctagatgacgcagaaatgtgaacaaaaaacttaattaaacgtcgtcttcgcgagggtccaaaaggcagtatttaggtgccgtacagtgactgcacgactgtgggggcctcgctgtttcgatcgtttcacacgctggagaagaagaaggaatggcgccgatcgccgccgtcgatcggtgggaggaaggtgaagccgtgcccgagctttcgtcgtctctcgttggaaagctactgttttgacccgttcacaccactacgcttccagctataggcagtatgtacggtgccacgcacggctctcgtcctttatataaaccaactacctcgccattgccaccaccagcagcagctcgccatccaagcatcaaagcttctaaactgaagcttaatctatatataaggagagttcattttgattttggtgaggaagaagtagtagaagtgaatta

SEQ ID NO: 37017 - DNA, 1501 bp, Oryza sativa
aaactaagtttaggataacccgacggactaagtttaggataacccgacggactggtttcaccacaagaaatctaattagtcaatatagtaaataaaactataataaaaaaataaattataaccctgaccggcgataaaccaacgagtaggcgatgagccgttgaggccaagttctttccaccatggtccatacactggtcccagcgcggtacacgaattattaatactacggctgtacgggttatttggtacttggaagagcatggttcatttatatggtagtagtacaaccgtgcacgtcagttgttatgtgcctgcctgcctgagcgtatgtgtcaatccatttggtgccgcattgataaacccatcaaacacgaataatgccttctctcttaaaagaaaatacgagtactgaacaaatctgccaaaataaccactccctccgttcaaaaaaaaaactcaacctaacctcttgtaagacaacaaatttagatttgtccccttttagattgattttttttactgggggagtagcgacgaaaagaagtccttcaggtctggtgacgtcatgatatatcatgatatacatttatcctgcagttataacccaacagccaatagataaatgacacggaatgggcctttaacttgtatctccacctaccatatggtccaacatgaagttgtgggccagatagaaatatggtccattcactactgctcttttaccgaatttttttatttttaatttttttattaaaagttatacaaaaataattttccattttgaaaattgacggaagtagtcgcctaccgccctctgggagggcgatttttaaaaatcgccatcccagagggcggcgaaaatgacgtggcggatggccgttcgctctcgggcgacggccgttaacgaaatttgcaggcggcccccttgccgccctccgctagggcgattttgtactgtgcggggggccgcctgcaaatgggcggcgagggggcatgggaatttgcaggcggcccccttgccgccctgggggagggcgatttttgcctcccccctataaagcccagtcccccctctctgaaatttcattatattcactaaaaatccaaaaaaaacgaaagagagagaggagagggcagcagaaggggagcggcgaagccctgctggttcgctcacttcatcacaggtttgctcccatacatcttttgcatttgtactaatatgttatgtttgagtatatatattgcgttttagttttagttccatatattttagcatatctgtagcacacagcacatatgtgtagatccagagcatagaatataatagtataaattgagacatagacagtagtgttaattgtaagatgtagtttagtttgatctggagaatgtaacctacttttagaattttggagaacaatattgtagagaatgtaacttagggcgtagtacagaaatgcgaggttaacgcagttattgttttcatcaggcacaa

SEQ ID NO: 37018 - DNA, 1501 bp, Oryza sativa
ggccatttgaagccatggattatccgcatcaatcatttgagaaatagaagatgaaatgtcaaagatcaagaagatgagatcttcccgatgatcaaatggccttgacgttggtaaccctccaagtgaagaaacaatatgatgtgaaggtactcctattggtttaactttgctttttaaatttgagtttaggaagccgtactattaagagcgttgagctttgtgctaagtgctttggatttttgagctctctccctctctatctcaaatctcccttgttctttgtgacttggatctttgtgtgtgaatttggagtttgggagcctagtatgtgtttctcttaatcttgagcactaggatttgtccaagagttgtgtggtgtttattactcttggaggttgagaactcctagacggctaggtgtcgttcttgggccaccgatctacgtgtggttggccaagagaagtttgtgaaggccggatctcacctccgcaaggaaagagatacccttagtggaaggaggagtgcatttgtgcaacctcacgaggatagggttgaaaaagacccggctctttgcgagcccctcaacggagactagaatcccctcaaggatttgaactccgggaaatacatcggagcataaacctcggtgatatcctcactttctttaccttcttgttccattgctttgtgctatgctaatattgttgttggtcgagctctcctctttgcttgtggattgaatctagatctcttaggttgttctcttgtttgtattgttgttgtgcaggtcagatagtctgatctcagtttagactatctgatcacataggactatccgacctgatatcagacaatccgaccctgttttgttttagcttccgcatttatttttaaaaccgcctacttgcaatcttgtttttgctaaaagtgagattttacctcaaatctaaatctattgagtttttgaaaaagttgcctatttaaaacttttagggttggtcatttcaaacatatctttagttcaaagcttttgtaaaagaccaaccattctaatgttgcagccttacaaagttcatcaaaaatcttgatttgaccatatttggccaaaacttgcatatggtgggttgaacaatttgagccaaaattctttgtgaataatggcatgaattagtatctctaacccatctaaggctttccaaatgtcaaacttcataaaaatcttatttggatgtgatttgacactttggttgagatttattgacttgaatggcctacaaaactctctttgacatttctcttgaaagaaaaatcttttttgagaaattctttttggaaaattttctattaagtgaaaagatcatttctgcaaggtttcgatttaaattggaaagaatttgactttttctcaccttgctcaagttgctgaaattttcagaaaattcatggtttttgactgatttgtgatttttacatctcaaaataggttgcaaactggaatgag

SEQ ID NO: 37019 - DNA, 1501 bp, Oryza sativa
atacctcatctcaataatcttttgtttggctctccaggcctttgcatagcttatggtgtacttgaatttattctcgatgtgcctaataattgattttggtttaaagccaatgttaccaacaacactgctgtacatctcacttgccacaaaagcttaagtgatgtttcggtgatacttctccaccccttgtaagtagcacttgtgctcggtcacaatgctaactttccaataatcattccatttacccttatatgcatggacacgccacggacaatcttccttcatgcacctcacttcatacacataatttgttgacttgaccaccctaaactctctctgcaaggaaactgcccaatgcttcaccgcctccttcatctcatccttatgagcataccttgcaccctcaattacctcgttctccttatactcccagggtacatgatcaccctctgatataacaagtccagagaagtcctcatttgcccaatcagtggccattacatcaccttcctcatcggatgatgcgtcgtcgtccacttcctcattatccgaatcttccttctccatttcatcaacaattataccgactctctccccctcatccgccatgcccatggcctgctcctcccttggttgattttcctcattttgcatcgatggtccaacaacatcccttgcattgataggaccctctacatcttcggtttgcattgagacatttatatctttctcttgtaccgacacaaatataacgaggggccatgaccgttcaaaagccatttccacataccgtctccaagcagcagtgctgtccatcggcattagttcccaaaaataaccttctgttgcacgactcactacaactgatactgacattgtgtagacttcttggtctattctaaatcctctcaacaactaactataaattgactgaaatgttttctccgcaggcctatcgatacccttagatgtcattacaaaatctgacagatcaacaccatctggaccaaatctaatatttccttcaccatgaactatctgaaatgtgaccttatttgacattgtgcctgatgaaaacaataactgcgttaacctcgcatttctgtactacgccctaagttacattctctacaatattgttctccaaaattctaaaagtaggttacattctccagatcaaactaaactacatcttacaattaacactactgtctatgtctcaatttatactattatattctatgctctggatctacacatatgtgctgtgtgctacagatatgctaaaatatatggaactaaaactaaaacgcaatatatatactcaaacataacatattagtacaaatgcaaaagatgtatgggagcaaacctgtgatgaagtgagcgaaccagcagggcttcgccgctccccttctgctgccctctcctctctctctttcgttttttttggatttttagtgaatataatgaaatttcagagaggggggactgggcttta

SEQ ID NO: 37020 - DNA, 1501 bp, Oryza sativa
tatatggtgggggagtggcaccgatcatagcgtgcagccgcagaagaggaagaagcagcacaccatggagaagagcgcgacggactcgatggcggtgacgaggccccagagcacggcgtccacgacgggggaaaagtcctgcacgagctccggccaccgccgcaccgccgagccgagccgctccggccaccagtgctgccagtgccacccgcggagggccggcgcgcccgcgtagtggccggccgccgacgacggcagcagcgccgccaggctcggcacgccgaggtccggcggccaccgcagcatggacaccaggctgccccccatatcgtcgatcgagcggccgctaattaacctgctcttcccggcgaggccgcgacggccggtcgccgccgagtgtttctcccgctgtgtgggcttatgctttgacgggttggggcctggggggatgccggtgtaacgtgttacttactgctgctttgctattagctagtagtcgcgtgtggaatgtagttgtacccgcgcgtctcttctcgtgctctcgtggtgcatagcaccggtgtccggtgtcacgatgtggcggagacgcggggtcatgggcggtttgggtcttttcttttttttctcggcaaagtgctgggactgggagttgtagccctgtaggtcgtcatgcgactatgcttcgcactcaggcatatgccgcacatggcggtgagtgggtttaacggacgggcgttcgcgcgtctagatcatgcacgcgcgtgagagtgtgagatacttgaaatgattctggcttagcctatggatccatccgtagctttcgattatgcaacatctaacaggtaggggtgaaaacggtacggaaactttccggattcgaacctatttttcgaaaacggaatatgtcggtcggaattttttcggaaacggaaataaattcggaaatattttctcggaaacggaatcggaaatgataagggcagtttctgtcggaactcggaatcggtcggaaattttctcggaattaccagaaattttgtgaaagaaataccctggattctttttttaagcactgaatagtgaataccatggtgtttggctattttttttaaaaaaatatttgttatgcaaactaaaattacataagaatatttttttgtcctacatggggatttatcaacaacattactcttttaaacatacataatttattcaattggatttatcagtttgagggagtttttattccgataaattttcgttaccgtattcgcgccggtttgttttcgctccgttttcagtttcgataatattcgattccattttcgtatccggggtttccgattccgattccgaataaaatatgaaaacgaaaacgataaagatggtttccgtccgtttctgtaccgttttcacccctactaacaggtatgtctaagtagggttcacaactctgacgaaaaccagtcgaattctgcgaaatttaaaggtttcgacaagg

SEQ ID NO: 37021 - DNA, 1023 bp, Oryza sativa
tgggagaagaggtattggtgggccttaattacaggataaagttttcactatttcgctaacttgcgagcttgcctttttcgattttgttcacgtatagtggactatgatattgtacaattatctctatctctaaatatcagtgattttatccatgtagataatgataatagtactaagcacatcttccatggtccccacttcaacattatcagacaagttctttcattaagacgacacaccattcccatgtcacatgggaacaaagtcacagagcgacttgctcgaatgaacgcgtcaaatcaccccatcaccccccaacgcataaatcgatgcttttgtttcgtccaaatctcactgggatccgaagatgacatgcatacactggtgtaataagcagagggggagactcccccgatgattcgaacagtatcgcaccaaatttcgcgcgtcttttagcgcccgggcagttagcgcctgacggtgatgctgatgcgacgtactctcccgcgcatttttctttctttctttttggacgctggatcagcagacaactcccgcgtcttcctctcgtagcctccatatggcagcctgctgcgtattgcggctctcacaagccactcctaaactatgaaatcgtcacgtagaatacagtatatttcatgactgattttacagatttcaccttggcataagaaaggtgtctaagaaagtgtgaagctatacattcaggggtggcgtgataacattattcctgaagttgaggtctagcacggacagatgacataggaataataaaagaattccatatggcaaattttaaagacggtaaagcacaattcgaggattagctccagaatcccagatcatctccaagtgagcaacagtatctcagggctaccaaccagctgaaaaattaagtgagagagaatactagtactactagctagctgctaggagtagtatataactgtactgtcctagctgagatcggcagcaggagcgacctggaggctggaggataga

SEQ ID NO: 37022 - DNA, 186 bp, Oryza sativa
tgtgattgcttcagtgaaccacagtagaagaacgtcctgtgtaaactccacttgatgaatggttccatataaagaatattgacagaagcatttatattgttttcacaatacattacggtattgatgctgcatgtacaacatagatttttgtgagttttctttctgctgacacttctccttaacagg

SEQ ID NO: 37023 - DNA, 1501 bp, Oryza sativa
tggtgcggtccattagcacgtgattaattaagtattaactagttatttttttcaaaaatagaacaatatgatttaagcaacttttttttaaaaaaacacgccatttatcagtttgaaaagcatacatgtggaacacgaaggagttgagttgggaaatttggggaaagaactcagccttaatgatgaacataaaggtcaattttcttccagatattttgatttctaaatgctagaaatgcacttattatggtacgcatatgtagcagttatgttgttgatagaatacatcatgatactcctaaacaaatgtttcgagtttaattttttaagacttcataagaaaccctatagagctaaaaaaaaaagaaaagggaaaaactctacggatcctcccacaattacccattttgctcctgccaaagccgtcgccagtcgccacctccattagtttaattaattagacctctgaatactctctgcatttttttatacattccccttggtcggcaagcatcaatgtcagctgagcaatgcttgtaaaagatgctggctgaattgatcaaaatcattttgttgaaaataaaaaggatcaaaattagattctaattaacagctgcctgctaaccagtgaccacgcagtgtgtaaatggaacatggtagaaagtgtcagatgtcagaaaaatcggcacttttcttgtaccgctacctcatcgatcatattcatccctgcattcaacttgattgagactccaaccttaagatgataaaatcccataaataaacatttatacctctttttgggtatcgccgggaaggccgaaggaggccatccaagtatattaagaagaaataaagttacaagaaaaaactcgacagagactgtcgaggtcgaaggtgcatcgaaatgcacaaccaaagccacatgctaatcacacaagcacaacccactgagagaaaaacctagcaccgagacgacccccgctatgcgtggccgatcgccgccgggccaacgacaacaccacaaagacgagactctaaaagcgatgcccccaaggaggtcacgacatcaaggatgccgccatcgcccatctaaggagatgtggttttcacctagagaaaactcgccaagggagaaaggtatccttgccagcgccctcaaggaggttacgacgcccaaaagcgtagccgctgccagcccgatgaatcatcaggcgaggctttcacccggaaacctttcaaccttgcttgaggttcgtcgcccatcaactcaggaaccacctcacaagcagatcagcacgaggcctccaccacaccgcgccggcgcccctccaccggccgaccaccacacttgctgcatagagctgccgctaccctgggaactggcccagacctcctccgtcccgccacccgccagcctccttgccagctttggccgaaggagaacccggaattggacggcgtcgcgttggcggtctgagctcccctcgctaaccggctgccg

SEQ ID NO: 37024 - DNA, 490 bp, Oryza sativa
ccgcctggaaaaattgattttcgcaggcggacggtgagctccaccccggtttacattttcctatatggacatttagctccgatggtcatatccgtctggaaaaaaaaaatctcccatcgtatgtgaaaatgctttttctagtagtaggtgtgttattgctaggccctgtttagttcgcgaaaagaaaaattttaggtatcatatcggacgtttgaccggatgttggaaggggtttttggacacgaatgaaaaaactaagttcataactcggctgaaaaccgcgagacgaatttattgagcctaattaatccgatattagcatatgtgggttactgtagcacttatagctaatcatagactaattaggcttaaaaggttcgtctcgcaatttctatgcaaactgtgtaattagtttttctttttaatgctacatgcatatgtcaaaagattcaatgtgatgtttttgaagaaaaaaattgggaactaaaca

SEQ ID NO: 37025 - DNA, 1501 bp, Oryza sativa
tattataaaaatactttaagcataacttttcgttttttatatttgtacaaattttttaaataagatgagtgatcaaacagtaaaaaaaacttaaaatgcttggacggagggagtacatacactgcggacaccccgtgggtttcgggggttctcctgggctctcctgctgccgtgcacgtagtcggcgctaggcgcagccgcgcaggttagtcgaggtcgacccgtcccctcccccgcggggcccgccgccgtcgtcgtcgattgatggccgcacgccgacagggaggccgctcagtgaggagatgcgctgcatgcagccgcgacgtacgacgtgattgaggtgagagatcgtacgtgctatgctactcctcgatatcgcttcggacgcacggcggtagccgggggcgtgcagcggccaccgggaccggggtagcaagcgggggcttcttctcccggtcaaagggccactcaatcaagccggccgcctttcttttcttctcccttttcattactgcccccctcctcctctcctgccgttgtccagggcttttcgattagttgtttggcacgtgacacgagtttgctcttcttcccggctggatatgcagatcggcggcgattcactgtgtattgcactgcacggttatactatgggaaagcaaaatggtcgtttcatatccctaaatttttacgtaggctatatttagttcacaccaaacttttctccaaatctcaactttccatcacatcacatcacatctaaaactttcctacacacataaactcccaacttttttttccaaactaccaatttttcctaaacttctccccaatttcaaaaactaaacacagccacgaaaacgaaactcagtaaactttagttaaccggaaactgatcatccttaaatttccgataccgcgtttacttacataaataaagttcagggatgaaaagtgtcagatttccaagcttagagataatctttagactttcatggaaaatttagtgttgtaccttttcctatagaaaactaaaatttaagtttgtaatgataaaattttggcaatcaagcaatgttgctacaaattaacctttcggttagcctggttggtaggacagcattgtatttggtctgttaccaacaacaatggcagttatataatttgatattacatgggtttggtttaagaataattattataataaatagccttaccaaattttgattagcgttttcatttagccattatactagtatacatattatatataagagagaatcccttatatgtcactctaaattaactggctctcttatatgccacttcaaattggcttctcccttttatgccaccggttcaagtttctcctcccttttatgccattgccgtcagtccaccgtcagttaaccgttaacttcattgtaaaaatacgcatttgcccttgagaattagtatacaaccaataataggtattttagtactaatatagctactggat

SEQ ID NO: 37026 - DNA, 215 bp, Oryza sativa
gaaagttttagatttgtattgaaggtctttgacatctggctaacttcgtctatgatttgccggcctagtgaaaaggccataatgttaacagcacctggcccacttaatcgaaggcgttgtaatgggcctagaagtaagtccatccagcccacggattacagcaagcgcttcaaagcgccgccgcgtcgtctccacgcctcgggcctagggcacgc

SEQ ID NO: 37027 - DNA, 355 bp, Oryza sativa
agcttttatttatataattattttttaagtagtctatatttaatagactaaattagtatctaaatgatccaaataccacctaaagttccaattcaagtcaggttcttaaacgaaacctaacaacattgtttatacttttgtttttgtcctgtactaggcattagatgatctcagccctttccctgctgaagctggacaaatggtaaatcccttgatcggtctatcccagcctcccaggctcgccgctaaacaactttaattaatttatctaaaataaagaggaagcatatcatcaactgctatcctcgtcacctctcccctcccgagttgacttcccctctcacgcgtattcagg

SEQ ID NO: 37028 - DNA, 1501 bp, Oryza sativa
ctgcgaggccgccgttgacgcttgccccgtttgcgccgccaccaagatcgcctccgtccatgtcctcctttcctgaagtcactcacatgtgccacaccagctactgcatggagtaggagatttcgatagcgcaacagctgtggccagaccgaaaccaggcatccgtcagccaactccggtgtcaagcaagctaacaacaatcatcctgtcccaagttacatggaaattcatgctagggaagccacagttctgtgcatcagcgatctccgggccatgcgagttttgtcggtggaaacaacagtgttcggtgcggtgaattgaatggttgattgcctatctcatcttccgcaggtaccattgcttcgaatatttggcagcccggataggcatgcacgccgtcccgtctccccgtcggccgctgctcgtcggttgtcctccccatcagctgcctcccgtcctggcaccccttctccccgccgatcctcgcctgtcgacgacgtcccggcgccgctccccatccgccggccaccgcagctccgcgcctccgcttcgccggccgccgcgcgctcacacgctgcctccgccgtccgccgctcaacccccctcgccgtccggtcgtctgctccctacccgtcggccagcctgcaagagaagagtgcgagagagaggggggaggaagggagagaagaagaggggaaaggggaattgacgtggcaagcccacatgtgggtcccacgcgccacgtaggctaaaacagggtcaaaaccactaaaggatctcgggtgactggttttgtatagttaagggacacctcatatctggttttgcggtttgaggatgtttttgtatccgatgacaagttgagggaccttcggtgtactttttccgccggaattccccggggtgcctcagccctcatgcctaggcccaggcacggcacggcacggtacgccagcctgtgggtcatgccggcacggctcatttgccactaccgtgcttgggccggcgcttcagatgatgggccggcacgaaaccttgtgggtcagcccgcaaaatttgatgggccagcatgggtcaactaaagtcggtaagtccaaaaccttaaagcatgttcacactgccgagtactgaccatctcccttcccatccacgttcggccacttcctcctttctcaagctctctctcctctcctcgcagtcgcagcgcagtagtctctagggttttagcgggcggttgtcctccacccgctcgccgcgtggccgccgccttctccccgcgccaccgccgatggacgtcgactccgacccagccgccgcgggcaagcccacccagatggacctcgaggaccaggcatgccgccgccgccgccgcccgactcctccccacggggattctaccttcagtttttgattgtgactgttttttttttgcccctgatgatggaccctgtgcagactgacgcgaaggggaaggggaagagcgaggagctcgcggactcca

SEQ ID NO: 37029 - DNA, 1501 bp, Oryza sativa
gacgggacgcgcgttctcgcacgaaggtaatgcgaaagcgccgcgcagtctcgcgcggtgggaatgcgatagcgccacgcggcggtctcgcggaatgggaatgcgatagtgcacagcacaggctcgcccctgcgccgaacacgagcgatgtgacagcgctgtcgcttgtctgatttgcgagaccgcgcttcgctttccaaattagccagacggaatcagtaatgtactgattattaagttaattacaattttatatttgcatgaattaacaacatgtgataataacatttgttttaaggctcgttagtaaatatatatgagaaaccttctgtatatgtactagaaatataactaccattatttaaacttttcatttgttagacacaacattggccatctatataaaataaaaaatcacatgagctacaaattaattgtaacttacaattagtacaaattaattgtaactttaatttaattttttttaccatataaattaattatgtctatctaatttttaaacccgaaccgactctaacccatataacagaaactacctctgttattattatcctacttaataataatatactatacattattaatattttatatttattaatttcatattttatatttgttgtttgccctaaggaccatgtagctttgcttcacggaagaggccgttgtcttgttcaaaatataaaatttaccggtctcgcaattctaacaagcgatcgagatcgctggctccacgcgcgttgttgcattgctaatgtgcgaaaccgtgccggactaagcaccaaccagaaaatcaccatgggacccactccacagtggctctcgtgctacgaaagcgcggtgccgaggccgctctcgcgcttcaggcatgcgagaccatgggtctcacgcacatctctcgcgcgccagtaatgccacaccacgggccccacaacgctactcctctcgcgcattgaaaaagcgataccgatcccggtctcgcgagggcaatcagcgagaccgttgggtccattcctgctctctctcccaaatcgcaagaccggattaggtcatctctacgtggtgctctcgctcaagggaaaagcgatactgcatcggtatcgcttacccaataagcgataccggagctgacgtcacgctttcgcttattgatattgtgataccgtgtcggtatctctcaatcctcttgcgaacctcggtatcgcgctttcctcccgcgatttcaatagtatatttgtgtaagtcgaccaacatctggtatatttatgaaaaaaatatttatgaacagtatattttcaaatttttttcagacaggagaagcatacacacaggtcacaagagacaggtcgaggtctatatcgtgcttgtgtcggagcagcttcttccctgctccctgcttagccatatatgcgggtcgtgcgcggcttccgccgatgaccgcgcgcagcggcttggatatgctactttcctgcgacacctt

SEQ ID NO: 37030 - DNA, 1501 bp, Oryza sativa
gattcttgtttgcatccgtgcaagcggagggtggagtggactttggagagatgaagagagcgaaccaccgctgctgctgcttcggtcacaactcgcggccatatactttgaccgtgaattcattcgctccctgtttttgttcgcacctaagctagctctctccatcctctgtggtgagtttgcctgaaacgataggtaaaggtagaagttaatggaccatattatcattgaccgacccttagaacatggctcgacaaattctagccaggcactccaagctccaagagaaagtccgacgcaagttccacggcatcaattattggtcttctggtttccatttcagcattcaacacacaggctgtatatgtgaccactttttgaatggatgagtatttgaatatgattgatgaaaattctatgctgctaccagtaaattagacctaaaagttttcgatcatatccttttgctggcccttttgctaaagcaaggtactgcttcgaaactaatcattgtaaaaactgaagatgctcacaaggcacaactattgtgttctcatcaaactagtctggagactttggtgtcgtcggcgtcaacagagaaaaatgatgcaccggaatttctctttctgcagataaaatggctatctgaaactgaaaaaggttcagaggctgaaaactatgtacgcgaagcttacgtcggaggatgcagtctccatcacttcttccgtagctacgacggcgccatggcatcgaagtccttgtccatccattcgcatggctccatccgctccagcgaaaaatctcttcgccgtgatctctgcaagcgtgcattatcctaactgctacatggaaataatacaatagtgttggatcgactttttgtttacctgtggaaaatcgagcttcgttacagagaaaactggcatttaggaagtaacttgcatatgaggtcaccttccggctctggctttctttcatgaaaggtatacgcgttgacctgctaggcagtgtagtaaattaaataaatacctgtattttcttattgagctcttacaggagagtgacacgtaagaaggcctacataagctaaaaaaggaagtacacttgttaattacataaatatttgccaagcaaataggataaaaactatgcagcaatagggcacactacggttgcaagtctggaaaggaagacagattgccactgaaaatacaggcaagtagtgtcacagagtattgagttggccaccaaccatttcagctaaaagattgttattgatgaaaggtggaaacggaaaatatttcaacatagcaaaaggttcatctttgaacttggtagactcttaccattaaactacatctagagcaggcttgaattgttagaaaacgacaggtaaacaacaaagctttttcaagaactaaacatgcagatttttatggtacagaaccattataaggaaaaaaaaaaggtgcaccaactattctagtgtggattacatgaa

SEQ ID NO: 37031 - DNA, 327 bp, Oryza sativa
acatctactcttgatcatggtacccttaatggttttgttggtcattggggttttagttgttttagaacaaatttattgcttgaaagaagtccacattgaaatggaaaccacactcatccaactaaaatgaacacatgaactgaaacgcacactcttggacttctttttcccccctataaacagctgctgggatgagttgaaatcttttccacctgttgttactcttggctcgtggttaacattctctggctccctgttattctgtttgatctattcatcatgtatggctgctagattaataatcatgtggaactgtacttcttccca

SEQ ID NO: 37032 - DNA, 1501 bp, Oryza sativa
gatcaatccttctccaggttatagaatagcgtgtaccaaaagcacgaatctaatcacggattataatggtgcatttacaataaaacaatataatcgttgtttccattcaagtttcggcacgaaaaatacttataatgttttacatgaggagttatgatatttgtggcacgaaaagcaggactatactatgatactattaacttctctcgctacaatcaatttttttatagtagcactatctagcacatacataagaatatggtgagctaaaatcgacccatactactatcttagaagtttaaaaaactacaaccatcctagagtagcaattttgttgagataggacctattcggtgacaccaacagtgccgtatgcaggagtatactttcttcgtacttataaagagagtcgtttatgacagcgacacggtctccaaaacataactttgacttcttgtttatataaaaatatttattaaaaagtgatatatgtatacttttatgaaagcatttttcaagacaaatctattcatataatttttatattttcaaactcaacatcttgagagttattcatgatttatattttcaaggtttgacttaaacattgtcctaaacaattttctttatgagtacggagggagtagtctgcagccggcttgcagaatagttccataaacatcattttttttttgtcagcagctgttgccgtttgtacccatgccgggtcacgcgtaccctacgccccctaccggtgctccaccacgtcagcggctcgcgctcgccccccctccacccatcgcacacggcaaacacagcgcaaaacccccgtgtccgttggcaccaccaacccccgctatataaacccccccgtctcctgtcgttgccacaccgtcttctctcttctcctccgccctgcctcgactcttttctcccccattttccccttcccaactccccccaatacacaacctctcaactcaaaaccccctcgaggcctcgagcctttttttttctgcctcgaaacaactgaaaacgcggggggttctctcgacgtccccccggccgcggccaacaccaccgcgcgcggcgacgcggaccggcgtggcctcgccggccccgggcaatgtcccgcagcagccgcggcggcaggcagtcggcctcgtcggccacccggatggcgtccagggcccgaccgggtttccccgtggcgccaccaccacccatgggcccgccgccgcccccgccgatgcccccggtcccggtgatgtatctccggggggtcccgccgcccccgccgtggctcccgcagcacctgatcatctgcgggctcgatcccgcggccgccgagcggactgacgctttccggagcaaatccctcctcaacgtgagcaccgggggcgtttaagcttcgtacgcttcatcgtatggtcctatggtgtttgatctcgtggctaattttggggggatcttcttgtttttttttacgaggtttagttca

SEQ ID NO: 37033 - DNA, 1501 bp, Oryza sativa
atatattaaaaaagaaaatgaggaaatgagcgcatctctaaccacgtcactagatagggatacatatggtgtgatgttagcatgggtcgtgccgaatgggtcattcggactattcatatattatatatagagagaattacttatatgccactacaatttgaccagtttctttatatgccacttaaaattggcttctcccttatataccactagttcaagtttttctacccttttatgccactcccaccactataatgttagttgactgttagtcaaaggttagttttttttcgtaaatgaccaatatgccctctcaactaaaaaatgtgtaaacttctttttgagtgaacaaaattttgtcagaaccagtgaaaaatgctctttatattaaaaatattgttggaaaactgcatgtttcatgcttatattgaaaatttatttgtgatggtaatggctaaaattgcatgtgatgcagaaaaaaatcaatttttatatgttgtatccagtagctatattagtactaaaatacctattattggttgtatactaattctcaagggcaaatgcgtatttttacaatgaagttaacggttaactgacggtggactgacggcaatggcataaaagggaggagaaacttgaaccggtggcataaaagggagaagccaatttgaagtggcatataagagagccagttaatttagagtgacatataagggattctctcttatatataatatgtatactagtataatggctaaatgaaaacgctaatcaaaatttggtaaggctatttattataataattattcttaaaccaaacccatgtaatatcaaattatataactgccattgttgttggtaacagaccaaatacaatgctgtcctaccaaccaggctaaccgaaaggttaatttgtagcaacattgcttgattgccaaaattttatcattacaaacttaaattttagttttctataggaaaaggtacaacactaaattttccatgaaagtctaaagattatctctaagcttggaaatctgacacttttcatccctgaactttatttatgtaagtaaacgcggtatcggaaatttaaggatgatcagtttccggttaactaaagtttactgagtttcgttttcgtggctgtgtttagtttttgaaattggggagaagtttaggaaaaattggtagtttggaaaaaaaagttgggagtttatgtgtgtaggaaagttttagatgtgatgtgatgtgatggaaagttgagatttggagaaaagtttggtgtgaactaaatatagcctacgtaaaaatttagggatatgaaacgaccattttgctttcccatagtataaccgtgcagtgcaatacacagtgaatcgccgccgatctgcatatccagccgggaagaagagcaaactcgtgtcacgtgccaaacaactaatcgaaaagccctggacaacggcaggagaggaggaggggggcagtaatgaaaagg

SEQ ID NO: 37034 - DNA, 1501 bp, Oryza sativa
cagcaagccatgggaaataagtgtttaatgcaggcttcaaggaaaggctggtgtttttgcaattaattttatttgaactcttttctgaaacaactaagtgagtgcttctcaaacgacacggatgagacagtgcgtctcgtccggtcggagtatgtgcaatgtatcagtctttagaatttaaacaagattggcacccggccaacagctttttcaacggccacccgggccaacaacttttcaaacggccacccgggcctagctgatcccatcagctgcagatttttcaaacaccgaaccccttttcacacagcaatttcacaagcagtagtcaaaccaaactacgctaggaatcacctcacatccgcccatgaccgtgggcacgactgttcgaacagtttgttaacctctgcagagggggtacactttacccacacgacattactaaccccgatcacccagcccgtggggatcagccacgtcgggagacctccaagctttcatgacaaggcatttccaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaattccaaggaatcggtccttaagtgcgagagcgggaaaccgtacacccggtacgtttcccggtctgcggttttggaaattcatttagttcgcaagcaccgacccaggtgtcgggttttccaagtcttttgtaaaactccagttttacccaagttgttactcagattttaagtttgaaggcgaccgtcgatactggcacagggtgcacgaatatcgaggcgcaactggatggttacaaggggaaatggtatagcaattaacaatggaaggatcaaatgcaacaagttaggtaggtctgccaatctgccttgcagacggaacaacagattaagtgcaatcctatcaatgcataatattttgcaagcaatataattagatttcaaatataggctcaagatgttcaaaggtggcttgccttgctcgagatctggagcttgatcctcgaaatcctcgcactgcgggtcttcgggctccgaaactatacgcaaaacgggataactcaacaaacggcgaaaataaagccctattaatgacctctaagcgtgccattagatagatctcgagatttgagaaattttggaattcgaacggagtcaaacggatttacggttgggaagatattgaatttctaagattattggatttttggtctaaaggaaaaggatttaattaaatctctttttttttggaaaagaaaaagaaaagaaaaggggagagggagggaatatagactttcctcgggcggctagggcgcggcccgagaga

SEQ ID NO: 37035 - DNA, 679 bp, Oryza sativa
ctgcgaatcactagtttgtgttaaaattgctaatttattatatataattctatattattaaagggtgtctcactctgccactctctgtttgcttcttctgttccttgggtgaaattttgaattttagtcattagtctggacaagtggaaactctcatgtctctatttttttcccacaaacactcatctgtctatttgatttacatttggtatattcatattttcactatgctcaagtacctttctcatactaagaggtccactgttattcattgactacggatcttgacaaagcaaatttatacactgtatagtctacgcaggctaatccagcaaaacccatattatatggtggcaaaataacactgtttctttctcactccagatcagttctattagctgaaagaatctattaaaacgtccatcaatgcaaatagcattctagcagtccagcatttcattgccaacatcagataccttattaccattagtatctaaataggttcgtatcctacacaagattacatattcctgggatttgccaagatatgatttagactagctcatgatctgccacattagttgacacatttggcacaaaatatttgttgagagttaattcccacttcaattttctgaagcgcagaacactgatttgacgttactttttttgttacaga

SEQ ID NO: 37036 - DNA, 1501 bp, Oryza sativa
catctcttccccctagctttcggtagtagctcaagtagactccccgtagttagccggcgtcgccccgaccgttgccgtcgctcgccgcgtgctcgccgccgtcgccgctcgagctccgtagcacccacacgtcgccagcctcgctcggcgtagctccgtccaatccgacgctagcatcgagttcccgaaaccgcgtagatgctctcaccgccgggaatcgacccctcgtggcctcgccgccgtttccctcttccctccccgccggttgtcgccgccgcgattcgccgccgtcaagcttcctccggcaaatccgagccgttggctcgtctcccctcatcacgagcaaccgcccggtgtgctcgcttttgtccgtatcgccgtggttcgctccgccactcggcgccgccacccgccgtccattcgcggccgggtcgtcgtctacctcccgccggcccgcgtggcagccacgtaggcgccacgtcggcgccagctcagcctagaccgggtcgagccgaccccggtctgtccctccccgtgcgcgcgttccaccgcgagccgtgaggctgcgcgtgggcccgccgcatccgcgtccaccgcgaaccgcgcgcgtgcaccgcgtccctcccccgcccgcgcgcatgagccgcgtactccctccgcacggtgagccgagccactgacaagcgggtcccacccgggaccgcgcatggtgagcccggtccaccggctctctctctcctccctcccgcgcgcgcgcgtcttgggccgctttgggccgccttcttgggccggccggcccgttaagctcggccgagccgccctttctctcgggccgcgccctagccgcccgaggaaagtctatattccctccctctccccttttcttttctttttcttttccaaaaaaaaagagatttaattaaatccttttcctttagaccaaaaatccaataatcttagaaattcaatatcttcccaaccgtaaatccgtttgactccgttcgaattccaaaatttctcaaatctcgagatctatctaatggcacgcttagaggtcattaatagggctttattttcgccgtttgttgagttatcccgttttgcgtatagtttcggagcccgaagacccgcagtgcgaggatttcgaggatcaagctccagatctcgagcaaggcaagccacctttgaacatcttgagcctatatttgaaatctaattatattgcttgcaaaatattatgcattgataggattgcacttaatctgttgttccgtctgcaaggcagattggcagacctacctaacttgttgcatttgatccttccattgttaattgctataccatttccccttgtaaccatccagttgcgcctcgatattcgtgcaccctgtgccagtatcgacggtcgccttcaaacttaaaatctgagtaacaacttgggtaaaactggagttttacaaaagacttggaaaacccgacacctgggtcggtgcttgcgaac

SEQ ID NO: 37037 - DNA, 993 bp, Oryza sativa
gttttttacaaatgtttgaccattcgttttatttaaaatttttatgcaaatataaaaaaaataagtcatacgtaatgaacatttaacgataaatcaaggcataatgaaataaataataattacatattttttttaaataagatgaatattcaaacttataaaaaatcaatgatgttatatattaaaatacggagggagtaataattgtgaacttttttttgacgggtctacggcaacattacactaagcataatttcacaatcagtgacatttgaaatgcttcagaaggatccaaagtaagatttaatcagtaacttggatgttgccttaatgaattgatggagaattaactaagaacgaagagtagaaacttgccagctctaataaattatggcgatagttacaactgcaatataagaagtcctagtattgtactattttgacagtttagtcttttagaaaatttctgaagcttctctccataaatactctacataaatgagacctcaaatgcagtagtatagactaaggccttatttagatcacctgttaaaatttttcacccaatcacatcgaatatttggacacatgaatgcatggagtattaaatataaacgaaaaaatgactaattacacagattgcgtgtaaattgcgagacgaatcttttaaacctaattgctccatgatctgacaatgtggtgctacagtaaacatttgctaatgacggattattaggcttaataaattcgtctcacagtttacaggaggattttgtaatttgttttgttattagtctatgtttaatactttaaatatgtatccgtatatccgatgtgacacactaaaactttacacctctgatctaaacacagcctaaaagtatgcggatgattttcttttgtagtagttagagaccacataagaacacaccaagaccattgacctttgtacgacaagttgcactcataactaaagtcaattttgtaaccaaa

SEQ ID NO: 37038 - DNA, 322 bp, Oryza sativa
taaatgaggtcactatgcaaggtttatgttgagaattgagcttaagagtttatgcaaaccttcactgctagccatctaacatatccagatctcctgattgcatgcattgatggagcataacaggtacaagcgggcctcattttcacagaagaggaagttgagtacagagtgcgcaatgttctggccagtgttgaatcatctctctctaatgcatcatacctatcgggaaaccctcctgagatagtggtttggagtgcctcattgtatgactacaaggtaattttttatctcaggttatcattccctattgctatcctctagc

SEQ ID NO: 37039 - DNA, 441 bp, Oryza sativa
cccccaggggtcgatgggccgggaggaaatcggcccatcgacccccgggggaggcaaaatagacttttgcggaggaatttgatttggaaggattggattcgaaattggactcgacgatagatcggggattgagatcttgagatggcacggacactagacaacaagcaaagaaataaatttcgcaattagggtttttaagagataattttcccgctaggcgccacgacggaacgggcgctacacggttggtacctggtacctggtacctttggtaccgactaggtatcgatcgatgcctgatgcctagtacccaagatactgggtggtacctagatatcagaccttggtacaaggtatcaagcatgatacttgtggggtatcagagggtaccgtaaaaaagagagggaaacgtgagggagggagcgctgcaacggcggagga

SEQ ID NO: 37040 - DNA, 344 bp, Oryza sativa
aacttcatctgttgatggcaccattcgtgtttggacctaaaagtgggaattgctgttgtgctggactcatatcctgacaacattgcttatgtggcattattctccaattcatctatttttgaagcagagaggattgaaaaggatagatgttcgcaagttcaaccctaactggaaccaaggagctgggtgttaagataagattgtgctacttggcagtagttctggacacggtcaaggcagcaatttgctagtgaggatgaactatatccaccaagctaagtcttctgcgcagcaagctccgacatgtgaaatacagtctgccgatgtaccatggccattacagc

SEQ ID NO: 37041 - DNA, 1501 bp, Oryza sativa
aacttttacttctttaggcctacacactcgcttaggtgtcattcgaggctctaaattattacatgttttgttctccacatcttcggcctctttttcttttttacctatggcccgaagacgttgtagcctcttcttttgagagcgagataagccagaaggtatccacttcggctgtggttgttttccaggagctaaataatgattcttaatatttttggtcgaaatagaagctcctgtgttgctctcgattttcccgctcacctttaatgccccttggtctgatcggcctctgggcccggtcaaaccggttgcaagccgtcggtcagaccggccaggagggtcggtcagactggctgtagacaggcggttagatcggccagctgtctcggttagaccgccaatgttgacagttatggcgtcagcttcgatgtcctttgcttgcatggtttccacggcatctccagtaggtacatgaacatcttgagactcctccttgacaacaacgacctccggagctttggcttcttttctcacccacaccttcttcacctttttcaccttttgtcgcgaccgagaaaattaccttttcccgaacgctactgtattaatccccgtcccaggaaaagccggggtacaccaaacaaacatgatacaaaaggcacatctttattatatcgattatatttacattattacaaaggcactttaggcctgacaatcaaaaataaacagcagcggactagcgggcctacggctccatcttcacaggcgctcaactgggatataagccaggactccacctaagacttcttctccaaagcttctcttactgaaggggggaaagattgagtaagaatgagtacaaccaccgtactcagcaagtcacaccgggagatgcatgattaatgcaagggagtacaaggggtaataatataggggttaagttttgcagtaaacagcatttaaaagtcacttagttgcccaaagctattttgtaaacacgatcctagagctatacaatattattaatcaaggccgtggacccacacgaacctgccttaacccaaggcctacgatgattcagaccgaactggcaacccgaccctgggtcccagctcgtcccaagccaacccaggccaaccattccacattttagttattaagcaggttttaagaatttaaaacactaagttgggtatattgctaggcttgcccataaccgagggcgcggctattcgaatagattatactctgatcagatgtgtacatctttacccacaagacacatcttcctcacgtgtaaccacgtgccacataccaccacggcatacggacgaaagacgtgacatagttcccaacccatcctagccatagacaagagtaccgacccaaccccacctacggccggaacctccgggacaggtaggcaggactgagcccctggcagcaggacaccagccctgtgccatgacatctcgactaccgggccgcagctcgtgta

SEQ ID NO: 37042 - DNA, 1501 bp, Oryza sativa
agcttgacagcttcaaaccatccctgcatgtttagaactatgattaagtatacaaacttggcacatagcagaatgaaaaagtatgatgcttcaattaggaattccatcttacaggtattaacaaaagatcgatcaaatcaaaccattgtatatatgttcacccccatgataggcaaggaacccacgtgcttattgtttcaaaacaaaatatgcatgattttatgaacatgacaaaggaattacctgaaaacaccagcaaatgcaagtgcagtgtattctcataagctgagactgcatgcgacatctacagagtcaattacattttggtctcaatcacgtgcacgcagtgcttctacagctgcaaggctggtacttcctccatttcgcaatgtaagactttttagcattgcccatgttcatttagatattaatgaatctagacatatgtatgtgtttagattcattaacatctatatgtatgtgggcaatgctagaaaattttacattatgaaacggaggaagtcccatacatagatggctaaaaaaagtattgttctaccataagaattcaacttttttaactgacaataaccggaaccatatctgaaatatgtcatacttggcactcaaacaattgttgataaaatcatagctgggaattctcaaaaaaattgtgggctagacttctagcagaaattgcaagatgaaaatatagaggtgtttaactaggggctgttcagattatagccaaaataaacattatcaaattttggcaatgctagaatgttggtaagttatcaatattgccaagtttttgcaggattccttatgtatttagcaatatttggtacaaaactaaatgtatgcacatctttggtaactttagaaaatttggtatggtttaaaatgtcatcaatctaaacaacccctagattcatcaacaaacctaattgaatcaagcttttcttttggtccattgattcaaagatccaacaaattttggtccattgatttaaaaacattagcatgatcactatttttttcaactttggagtagagcacagaaacttggtaacatggcagaacaagtactctgaaacaggtgaaatcacattgatagaataaaaggttgggggatacccagtacatcattggccttaatcaaatagtttggcagttgctggaacattcagtgcttctgcaaccattccaacaatctgagcaccctgaaaagtgaataaagaaagaataaacacatagaagtaatgcagtagatacactgcaaatgtttatttaccctaaaattgtgcatatggttaaactgggaatgtctctacaccatactatcgcacaggggtttaattcagtttggatcacatggattaaacagcttttggaatccggcaaagtacacatcatgattaatggaacaacactaatcaaataccaacgaagagtcagggtgacccttgttaaaaatatacatattgatttaatttat

SEQ ID NO: 37043 - DNA, 1501 bp, Oryza sativa
aaggaatgttccagaatctctcttatgctttgtttagttcctggtccaaaatattttttaaagtatacggacacatattaaatcgaacgtagattaataataaaataaattatagattttgtctgtaaactgcaaaacaaatttattaaatctaattaattcattattagcaaatatttactgtagcaccacattgtcaaatcatgatgtaattaggctcaaaagattcttctcgtgatttacatgtaaactgtataattggtttttttccgatcacatttaatgcttatgtatgtgtctaaatatttgatacgacgaaaaaattaaaagttttttaaaaaaatgaatctaaacgcggccttagcttccctcctccgctccactgactgtaaattggaaggttttttaaaaaaatgaatctaaacacgggcttagcttccctcctccgctccactgactgtaggcccatgtaactgggggccacacttcgtgacgtgacgtaacgtgaccactcactctccgtggggaccagcgaggccctcgcagagttgcacacgtacgggtagaggagaaaatgcgcgtatcacatgacactgacaagtggagtctagtgtaatacttcctctatattttaatatatgacgctgttgatattttatccaacgtttgaccattcgtcttatataaaatatttatgtaattatcatttattttattgtgacttgattcgtcattaaatatttttaaaatatgatataaatattttcatatttacaaaaaaatttaaataaaacgaatggttaaacgttggttgaaaaatcaataatgttatatattaaaatatggagagagtacttaccccgacgtgtcagccaaaaatacctttcatcccgtttataaaaaatccgtagttataaaatccaaaaagcaaattaatatcactatctccacttcagtcgttttaatctttttagttctaatcaaatttataaaaaagtaatatttttacaaaaaatataaaaatattaatatccaatttaataaaataaattgatactataaatattacaataattttctataaatttagttaatattttaaaaaatagctttaataaggtcaaaactacttcagaacggagggggtattattgagaagctagaaaaaaaatacagtgttctaaaaaaaaaagaaaaacaaattcagcctttattttcatcggcttctcagactcggtctcgacttcagactagtctgtctgaacgaggtcgagtcggaggagttgcatcgctagcttaacccgaccgctttttaaatcgaaatcccgcagttaaatcagagatttatgcagacaaaagaaaaacacacacacagcaattactattctccaacccaacacgccccccgcaccttccgtcctcataaacgcgagtgggtttaaactcgagttgtttttttgttcgttaatcctcgccccctctttctctctaatctccgcca

SEQ ID NO: 37044 - DNA, 1501 bp, Oryza sativa
catagtgtcaatgaagttaaatatttgtagctttgactaataatagcaaaaaaaatagaaaagatcaaacatgtaaaattgatgttactagatttatcattaaacaaactatcacaatatgcaactcttttatttaaagcattttacttttatagatatcatcaaagtagcatctcgaagactgtatcgaagtctaaaagtgtttatattttggaatggagggagtagtagaaaattattttggatccaggttgtgcgcgcattggtacattcatggtatggctccacagcgtgtgctgtatctagtctagaactagaaggataccctctgcttttgcctggtgaaggcagaggttgtcgtaccctccattcacctttcatgttagtccaatagcatggagttgcatgcatgtctggacttctacaataatggccagtatatatctcgtcatggcctatgtttaaaaggtaatctttaccattcttgagaaagtattagaagaggtattacattttttatataaaatttggtatctcgagggtatcaaaatttttagtgtaaaatttaggtacctcgatgttttggttagagcaattgtatggtcctagatgaggtactaaaaatttaatgtaaaatttggtatctaggtagcaagaggtaccaaatttataataaaagagcaatcttacgattcttgaggaggtaccatgaggtaaaaaaaggggcatttgcaaatttgccacctgttttttcaatattgcaaggatgccattcgaatgacagttctagcggcatttttgcaattttctagtggcagttttacaataacgatttaaagtagtggtaaatttgcaattgtccaaaaaaattagtgtaaaatttgggagatttgcttcggtccaacaaaaagtatctcgaggtaccggtatctcacggtaccaaatcatttgctatcattggatctaacaatgctcatcctgcccagctagatccaacgatcgaaaactatttgataccttgaggtaccggtacctcaagatactttttgctggaccggagtaaatctcaaaatttgatatctcatagtacctaggtaccaaaagatactaaagattgtacaattgctctttggattatgttttataagatgtacagattttttccaaagtaaaataaatgcgaacaatagagagcgataaagttgcattaaggtatgagagaaatttgacttcatttagtttttcacttagaacccgataaggcaggaagtcgcataacaaaatggcacaatattaagtcaaaaaacaaaatagcacaataacggaatgaaacaactgaaagagatgggctagctttattatattgtatatacaatttttctagtttcataaaacatataaatatgaaccaagacagtttgtatatacataaatctctcttccaagtgcattcacatcgtcttgataaacccatgtaccaacttaccaagtggtagtgagg

SEQ ID NO: 37045 - DNA, 467 bp, Oryza sativa
gattgatacatgcaggcgacccgttttgcccaggagcgccattgcatcctccttctgttcctcttcctcgtagctaccgtgccagtggtgccacccgtcctcgttggcttttactcgctccgttttaaaatatttgacaccattgactttttatacgtgtttgaccattcgtcttattcaaaaaatttaagtaattatttattctttttatattatttgattcattgttaaatatactttcatgtacacatatagttttacatatttcacaatttttttaataagacgaacggtcaaacatgtgctaaaaaatcaacggtgtcaaatattttgaaacggagggagtacagcatacttacatcgctataagctttgagatctgtggcgctgtgcagtttgaaacgacagccgcatcaacctagctatggccatggctaactaactcatcaccagtattctggtcgaga

SEQ ID NO: 37046 - DNA, 320 bp, Oryza sativa
gagtatatatgaacctacagggtcgcacggttaatgggccggaataaggggattggatagagatccaatatgagcttaattcggatagggatccgaataggagtcctacgggccttggaggcccgagtgatggatcctatatattcgtgagaggtgtgaccggcggaggcatttgcatcacgtaagaaaccctagccgtcactgttctccccgagcaaaaccctagccgcgcgcgggtgctagcacatctgcacgtggcgatccgtccctgtacgtgtggataccggtagaggcaccgctggtttgcggtgctgatcagc

SEQ ID NO: 37047 - DNA, 1501 bp, Oryza sativa
aacaaacaaagaaactatattccgagactaagttatctccaacttgactcattagcagcaaacaatagtattacatacgtatagtatccatctagaagtcataatcatgaaataaacttggatatccaaataaacaacccgaaaccgaaaccgatacagtgtcggccggtcagaccgcgggctgcgccggtctgaccgcgcattacacgccggtctgaccggctaccagagcccagtctgaccggtccacataaaatgataaccctgcgattcacctgtaaatccaatcatctccaaaaccacttcgtgaataaattccaaataacaaaaccaataatctccaatgcccaattgttcatcacagaataataatcaaaaacacctttgattttacagagacgtgggttgtcctccagatggagctctccctgctgtacgacatcatgtacaccaaggctggcgtcatccacacgtggcatggctactgcatccgtgtcttttcgccgctggccaccgccggtgccttggtgatgttccatctcagcctccacggcgcccttgggcatggggctatgctagtcgacgtggccatcacctacacattgctggttggcgccgtccttgtagacacatggtggctgctcatggcagccgggtcgacctgggcgtacgccttcttgatccgcatgccgctgcggggttggctgtaccacgcggcggtctgcagcggacgatggcgccaggtcggccgcgcgctcacgtggatccgctggcttgtcaatgcggaggacagcagaaggtggtccggcaccatctggcagcacaacatgttgcagtactgcacacgcgacggctccaaggacgtctggtacgaccttgccaagaagatacatgtcaagtggcgcaagaaagacaacacctactccggcaccacggtcattcctgatcgtgtcatggagcaggtgttcagctatttgctagatataataagaatcgacgtcgacgtacaataaggattgcgagatcgataataaggataaattaagatgatcaagatgcagcaccaacggggcaaccgggtatcccattggactcgacggggttgctcaaggcagaaatgtacgacttgttcttgaggttagttcgcgacgagatccagcagcaaatcattatctggcacatcgcgacggacatctacctccgcacctccgacaaggcagagaccaccgagtatgttgaagcaatcaatcttatttccaactacatgatgttcctagttctggaacgtccctacatggtacctggccttgcactacgcactatttacagtgaaaccatccgagatatcaacaaaattaggatctagtcatccgtccagaaaacacagagccttgccaagcagctgggagtcaccgaccgggaccccagtaaggtctcgctcaatgctctgccgcttgccctccttctagtcaaaaagctcaacaaatacgacggggccagt

SEQ ID NO: 37048 - DNA, 1501 bp, Oryza sativa
taagtctgcagaagggatcgagagaggaggccacctgccgaatttggaccaggccggcccagcccatggtttggccgaatcattgggttcagccgaacccaccgtggctccgttcgatgcagggtttggatgggcggtcaggattgctcccctatggcggttggagggtattactgacctttccaaccgtcataaccgtcattctcaagctatataaagccctctcatcctccatttcaagacacacctcaagcaagaagttcatttcatctctcaagtttagcatagtttctagagtataatggaatagaaatagaataaaatcttcagtcctcagagtcttcggaagaattcgtgtatggctctagtagcttttccttttttcttttttttatgacttgtactttatttagaatactcttctttatactactttggtattgtattactttccgagtatatgaataccaactttactatatgttcgagttatatttattatgatgctagcttatctgggagatgcaatggtgtgggtataataatcgtatttatgataactctatgtcatgacgatgatattagatagtatttggtaatttaagcgtagtgtttagattactagatatcattatttggggttatatgctgtggaagcgaggtgggccgctgatggtgacagctcagtatgggtattcctccacgaatgtatatagtcctaagatactttcctggggagggtactccaccgtatttagtcccggttgtatagtcatgacggattgtcgtaaggaactcgacaatcaggggtggcttctcgaagcaccagcagggcatcggatggagggtattagctaagtaatactataactaggatgtatatataatatgtatgtaaattagaagtataggaataggatctttctatattctttccacttagcttagataatcacgagtaagaggatgaatgcttctacttagtgttattgtaccctatgaattatattaacccctgcttagactttggttataaattattcgtacagtaatatataaattattagtactgttctctctattataatcttcccacgggattaaacaaatacgatacctttggaatactctcaggtgaaatgctacaatggtatattcatgcgcttgcggatgaactctgtaaccataatataccagaagtatttttgcgccattactgggaattaaatttctagtaatgtcgttaagaaataccaacaagcatttctggcaccattgccagggaagatttataaaagagattaccattactaatactttatatttacctctatataatcattgtactttgcaggctaaccatggttgttttcacttttattgtggaaacagggtagtacatgactggtttcaacttgccggaaaactctaaggaaaatccagaggctttctttcggagcgtaagccacgagtcgtcgctctgcagtaaactcttccgaca

SEQ ID NO: 37049 - DNA, 1501 bp, Oryza sativa; identical to SEQ ID NO: 36642

SEQ ID NO: 37050 - DNA, 1191 bp, Oryza sativa
aaatgcaattccatttattaaaaatactcctttagctcaaataaatcccagaaaaatctaggaattatagaattaagcaaagtatttaacaaaattttatctagcccaattttatattgagatttagcaaattaaattagatcttctcctttaggcttttaaaatcatttctaattattccttttaaacaacaatttataatttaaggattttaaaccagaaaagctcttaacaattataattagatcattaatgatcaaataattactgaactgttctttgtattatttaagaattgagctctgaaaaatccgagaaaatttcagagagtataattaaccatggagaatcaaataattactgaactgttctttgtattatttaagaattgagctctgaaaaatccgagaaaatttcagagagtataattaaccatggagaatttaataaaaattaaatccatccatgctttatatttaggaaattttatttcccacatttaacttcacttgtaaattaaagatcatttaatataaattatattattaatttattaaataatttataaatcctgaaacaaaaaatcaggatgtgacaaactaccccccttacaaagaatctcgtcccgagattcggaacggctagaaagaaaaagggaataggcaaactgcagtctatcttattccatcactccgataattattctaaggctttaaagaaaactactgctgctttgaaactggtggctgagttgtaacacttgaagacacaactcttgaagacgcaactggcactgcattggctcctgtgacgacaatgttgttgacttgaccttgtggctgcggatgcttcggcttcggacactctctagcaaagtggcctggcttgtaacagttgaagcatacctgctgctcccttccactactgttattcgactgatcctgctgaactggcaccgactgattagcttgctcgatgttaagttcattgctttcattagtctctaatttgatctcaccaccgatgttcaactgctgcgactgtccttgaccagcggaagaggattcaccaatttggagtggcttgatacgctgcctctggctactaccttgtgcctcctggaaaacagtcattttccttttacggttatccatcctgttcttcttgtcttcaagtcgaattgctttgtca

SEQ ID NO: 37051 - DNA, 1501 bp, Oryza sativa
gccgacgccaccgtgggtggtgctcccttccttcgctctgtatctttgtcctcgacctccacggaggctagtcgacgccggatgacgtccagtagcgtgaggcgcctccccaacaccaccgcggtaggagccagcttgcggcgaccaccgccctcgccctcatcctcgtcctcatcgcagaggttggacaacgtgaccatctgcgcggctaacatgatgcctcgttgcggcgacgtcatcacccacacctttatctcctcctgtgcgaattgttccttgaggttgccggtggacccccgtcaccattgaccagggaggagtaggcggcggctacttggcagccgacgaagcacacggctcatgtgacaaggacaaagtgacgtcggcatggggtgttggtggctcgtggtgaggtcgtggtggtggaactggtggaactacggcttgacggtggtgtgccctaacccaacggccatggacgaaggcagtggcctcgtcgcccttgactggtcagacggtgaggaagacccacccacccccctgcatccatatctctttctcctccctcccctttctccccctacatctccctcggcacagttcctctcgtcatgtgggcagcccggcacatgacagggatcgcgtccaccgacacataactctcttctcctcccccaatgtcgttgctgccaagcaagccgaagcactgtgtggctactcgctcttccggcattctaccgtgagaggacatcacgctggtgttgctgctcgcctcgttgctcttcctcgcgatagatgtgttcagccgtcagcccagcgacgttgatgcttttccctggccattgccaccacgacatgggctaaccttgtgaatggaggtgggctcggggctcgcagcggcccgcgcgaaggacagggacagcgacatgctacggcacctcgtcgttgcttgcgcctcctctcgagggaagaggaggagctcaaccacggcggcatggccctgctacgatggggagatgtggtggtggaggaggagcccgccatatttgactacgcaggatatcgttggtgcccgcaccatcgcctacccaccggagaggtgtgtgaaggaggagagagagagagaggaggacatgtaggtcccacacgctggctcagctgattagactatgtcaatgatccatgtcatcgaaatccaccctcagaaccaccgagagagtcattttgctccggtttcgacagttggggggtcaatatatctggtattgcagctaatttgagggactcaatgtagacttaccgcgctgcaaaacgcaggaccgagcctgcccggcccgattgggctgccgggtcgggcggcccacgagcaggtctagccgcccggtctcctctcctccacgatgagacgaggagccgaggagaggaagggtttaaagcgcttcttcactcgatctcgccgcgagagacccaccgatctgccctccgccccccaacatggcga

SEQ ID NO: 37052 - DNA, 1130 bp, Oryza sativa
gccgccccgatgccgccacaccgccgttaacgaacgagaacgagaacgatcgaacgaacgagagcgagaacgaacacgtcaacgtacgttgccgcgagaacgtgaacgagaacgagaactatcgaacgaacaagagcgagaacgagaacgatcgaacgaagacaagcgagaacgagggaacgaacgtgaatgagaacaagcgaacgaacgtgaatgagaacgagcgaacgaacgtgaacgagcaaacgaacgaggacgaacgttaacgtgaaatgcaatatatatatatatatatatatatatatatatatatatatatatatgttacttcgcatttatcctaatacatctttttgtatcttgcagaaaagacgtgttgtcggagtcgtccgtcaagcctgagtggaagagctagccctagaaggaattggagcaggcaagtgacgtaataatataaatgattgttatatttgtaatgcaattaattaagattattcgacctgtaattagacttatcatataagattgtgtagtgttcttatattatttgagttttaatataagattattttattgcaaattagacttagtatgacattattgactacggaattggtgcgactcctagcaattgactattgtagtcttaattagacttagcatatacgcacgaaacacttagcatacatgactattttagacttagcatgtaatattatttgagttttaatataagattactttatttgtaattagacttagtatgtaattattgactacggaattggtgcgacaagtagcaattgactattgtagtcttaattagacttagcatatacgcacgaaacacttagcatatacatgactattttagtcttagcatgtaatattatttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacaga

SEQ ID NO: 37053 - DNA, 1501 bp, Oryza sativa
ccacgtgcatcaactctagcctaagtattccacatgatctctgaccaccacggacgtcgtcttatccccaagccgactcccggtccgtcaccgcaaatactctcccaaggcatcgagtcacctacacatggaataaacaaagaaaccatattccgagaccaagctatctccaacttgactcattagtagcaaacaacagtattacataagtatagtatccatctagaagccagaatcatgaaataatcacggatatccaaactaataacccgaaaccgaaaccgacacagcgtcggccggtcaaaccgtaggctgcactggtctaaccgcgtgatacacgccggtctgactggctaccagagcccggtctgaccgatcacataaaataatagaacctgcgattcacctgtaaatccaatcatctccaaaaccactttgtgaataaattccaaataacaaaaccaataatctccaatgccaattgttcatcatagaataataatcaaaaacacctttgattttacacttataactagggggtgcataaccacttataacacaaggtggtgcactatgctctgggctggccttgggtgctagctgctgtgcacagtattctatctcctcatgaagaaaattataagtgttctttcggaacaaatggttcttcgatgaatttaggaggatttcaggtctatgaaaattttccatatgcagttcattctatccagcaatcttaaaaattcctttacattagctcaaagcacaaggattttagactaattttaacatgaagtctaacctcttgaaaaaagaatcttttgtgtctatgtctcttgtgatttatgcgtttttttctatgtgctccatatcgatctttgcgtcgaattggagcaatcggtacatgtaccgaatctacaacggctccatgtcagtgcatggagcggcaattatttggatcagtgataggcaccaatacaagtttcagatgctaattctatatttcaagagtacatatgaacctacagggtcgcacgcttaatgggccggaataaggggattggatagagatccaatatgagcttaattcggatagggatccgaataggagtcctacgggccttggaggcccgagtgatggatcctatatattcgtgaggggtgtgaccggcggaggcatttgcatcacgtaagaaaccctacccgtcacttttggaccttggggcatagattgggttggacatggagatgtcaccaaaacagcacaagagtcacatatgatgtgattagcaaggcgttgcttacctattttgatagttgtctagctgtgattccaaagctcactagacactaataataaaatgaggatcttgactcactatgttactagagggaattttgtttcacaatacatagtgggagtatcttttgttaaattgtttaatcaaaggttaaatgtaaatatgatgctgattttgcatacatatatttctattgtaga

SEQ ID NO: 37054 - DNA, 1501 bp, Oryza sativa
atttccgatggataatggccttaccatatttgttcctgtttctgaaaagattatattagtattcgtttccatttccggtaccatctgaaaattatccattttcatctaaactagtagggtggcccgctcaattgtgtggttagcacccatacgaaattatctattcattcttctcggatctattttaattaatcttgtattgtgttttatatggtctcttttaatattcattatttttattttaaatttcagttgtttcaaaattgtatttctacttgaactttcttttttattttctaattttggatttattttttattttaaattttaattaatctcgtattgggtttttatattgactcttctttcaaatttgcttatttttaatttcgaatttcagtagtttttaaattttattcctacttaaacccttatattgtttttatttataattttcgattttattttattttgtattccaaattttatttaatcttgtatgggcaagaaagagaaagaaaaagttctcacgggagagaaaatttccctccaacagtccaagtccttttgactgaggacagataacaaagaaacagtcttaactctcctacctcctcgattactgcatctctgaaaagctacaagcactgaagcacctctgttctcacaccacccacctaccagtacaccatatgcttgctaggtataaggaaaatccccaaatcttgtcttatcttagttcggtggacaccacaacccaacccagaagatcaacggcagtttagctcttcttcgtcggtcctctgcgcaggtgaccaccggagcgaggcggccaagggaagtgggctgcgcagcagcagcctgcaagcgtgggcgcgcagcgcgtggccgtgcaggcgtgcaggtgtgccggccggacaaaccagtaggcaggagccaaggaagagctgctaccagcttgctcgttgccccaacttgactcattgcctgccacattgcttcttgcggcatgaggcttgcttgcatccagtgagtgagctctattctgttctttattgtatagtgacaaatgaggttgtgaggagatttgtatatgatttactggtatatttgcaaattgcaatggagaagaaaatagcattgcttaattactttacaaaggattttttatgctttaaattttttattcattcatatctcatttgctaggcgccaactctgaatccttagtttctttgggtaaaccatttccctgaagcccgttggattgagcttctagacaagcctgctgccctgcagcttgtctggtcctgttatggagacaagggctaaaggatccaagcaccaatccaccaggtatggtttccctccccatgtattcttgcatttcgatagtcaacaagaacactggttcttcatctgtgtttggatgcacttgttggtttttctaccacgcttgccctatttgaataagtactatatttttttaaacacagggaat

SEQ ID NO: 37055 - DNA, 190 bp, Oryza sativa
acgcgtgtagaattagaatcaatctctagctagggcctttacatgcaaacagactcaaaagagttttgtccgatttcctaaaccaattaactagagttagagatgaattaggctataatacacatatataaataaagcagcgggcaacgaaccactgtagaaccgtaatttggatgcgtttttgttgata

SEQ ID NO: 37056 - DNA, 152 bp, Oryza sativa
cagtagctcatcagtgtacgttttcccgctctcgcacttaaggaccgggtccttggaatttcatccaaacataagacaagtacgaccacatgggtggaatgggacacccctggctgagtaactagcttatcaggggagccttgatgccgaga

SEQ ID NO: 37057 - DNA, 1501 bp, Oryza sativa
ggcataatatagagctcatttgcaaaagcagcatttagcaaacatttgagaattataaaacagtagagtaattaatcatcaattttaatcaacactaaacagcacacccatgctgctcaggcccaaccatccggaacaaccatacccggctgtacagatctatctccaaaccaggaatataccattccaaaccaggagctaaacaaatttttaccagttatagcatcttttattatggtgagaagtgtgaaactaatcacgaaagacattgttagacccgcccataaccgcgggcacggctattcgaatagttttactctggccagaggtgtaccactgtacccacaagacacagccccacaacatgtcaccatgtgcctcaataccaccacggtacctcggaaaggaggtgtgacagtacccctcgcacaacacaatccaccaaagcgcacctttcctggatcataatcatccccttataaacaaggcatgaactccccagcgacccccgtggacttatctccgccacttctcagtctggtgctacgcaatgaaccatgctatacaaaaggtaaagccgttgcccacgctggcttgtggttggcacggttaatgtttcacaaccgaaactcgtgaaccggtccttaattgtcatgagcacgactctcaaaaccatgtgctcacaacccaccattatcaagttttagttggcaagtaattaattaaccaatcacgattgaccatcgtgaactatcattaagccatcattaaataatagtgagtcataagttatcccaatagtgtgctaatgtttctaagcatggctaagcaatcatatctaatatctagctgaaccaatatatatagcccaactagtcaagttataataacccaaggtatcaaggaataaagtaatcaagaacaaaagggctataacaaacaataggttaattccacccaatgacattcgaaaataaatgcaatagttgaatagaaaaaatagctttaaacgggatcaacatgctcaaagggttgtttgggacctgtgtgacttgccttgctggccttggaactcttcaaattcttctagtgcgaaaacgaactcttcggaaacgtcggaatctaaacagaaaagagaaaaaacaccaaaacagcacataaacaagcatgaacagtacatgtggatatttttaacatgtagatctcaattttagaaaaatttagagacttgaaccaactaaatccgagctaagatgaattagttatgaattttcaaagattaaatcggattaaatcatttatttagattttaattgaattatgacgcaataatgaattatttttgaaaaggaaaagggaattattgcgtcagtggctagggttcgcggtggaccgggtgcacggcggtggctcacggaaacgaacggccgagatcgatcctatccaaaacggacggccaagatccaacggtctacgaccaggccacggggaacgacgacga

SEQ ID NO: 37058 - DNA, 1501 bp, Oryza sativa
agtgacgggtagggtttcttacgtgatgcaaatgcctccgccggtcacacccctcacgaatatataggatccatcactcgggcctccaaggcccgtaggactcctattcggatccctatccgaattaagctcatattggatctctatccaatccccttattccggcccattaagcgtgcgaccctgtaggttcatatgtactcttgaaatatagaattagcatctgaaacttgtattggtgcctatcactgatccaaataattgccgctccatgcactgacatggagccgttgtagattcggtacatgtaccgattgctccaattcgacgcaaagatcgatatggagcacatagaaaaaaacgcataaatcacaagagacatagacacaaaagattcttttttcaagaggttagacttcatgttaaaattagtctaaaatccttgtgctttgagctaatgtaaaggaatttttaagattgctggatagaatgaactgcatatggaaaattttcatagacctgaaatcctcctaaattcatcgaagaaccatttgttccgaaagaacacttataattttcttcatgaggagatagaatactgtgcacagcagctagcacccaaggccagcccagagcatagtgcaccaccttgtgttataagtggttatgcaccccctagttataagtgtaaaatcaaaggtgtttttgattattattctatgatgaacaattggcattggagattattggttttgttatttggaatttattcacaaagtggttttggagatgattggatttacaggtgaatcgcaggttctattattttatgtgatcggtcagaccgggctctggtagccagtcagaccggcgtgtatcacgcggttagaccagtgcagcctacggtttgaccggccgacgctgtgtcggtttcggtttcgggttattagtttggatatccgtgattatttcatgattctggcttctagatggatactatacttatgtaatactgttgtttgctactaatgagtcaagttggagatagcttggtctcggaatatggtttctttgtttattccatgtgtaggtgactcgatgccttgggagagtatttgcggtgacggaccgggagtcggcttggggataagacgacgtccgtggtggtcagagatcatgtggaatacttaggctagagttgatgcacgtggttgatggagattccatatggcatacgatggaggtattgtgtgcgtatgggatgcggagtcaaatttagaaggagtccaaatttggtacgattggttatgtaaagtttctttcttgtactagagggtttcctaaggtgtttaggactcttagtatgagtttggttcgtggctttaggctgcctacctcatgtataaatagagggggagcatgaggcttcccggtatcgcttttgagagcaattgagttgagttttgagttagggtttcgagtttagtcgaaatttttgtaa

SEQ ID NO: 37059 - DNA, 1501 bp, Oryza sativa
gctcggtcggttgggaattttcatgaccattttcatcctagcaaggtatatctgttcagtggaatctgtttgaaagaacaatggaaaaaaaactcccaacactagataaatcggtttcttttatttgcaataatcaacagatccttaattaaataacaagtaattgaaggcagaaatttagtaaaataagaaggatgctagagtggatagcgtccaagccaggacactactagaaacattatctggataaggacactatcaaaaacatcatccacaatctgggtcagcccaatccacacatttgtctattgctggccaccttaggcccccaaaatctcctcccatattgggcacttaattcttccttcctacgttacatttggactgacctctcacagcatgagttaacatacacagcaagcaatttgaatggatttgtctattagtacttaaacatgtacatggcagcaatttatctgtcaatatattgaggatccatggtcctgaacaaaatgtattgtttcattcaaatcagaaattacattcaacatttatacatccacatccaactaagccccaactgcaatgaaatttgttgttctaacaatgtacacaatcatgtaagcttaattgggctatgttcagactgacagcaccatcaagatattacttacaataactaatcgatgataaaccccgggttgactttggttgataaagtggctgataatctcccggggtgggaagcctccctcatgaatatagctagtaggctgattatggtcaaggtggtcctcacggcggttcatatttatctcatgatggtaatggatcttccaaaatgggtgatcaaagctattgataaagagtaaaaggcgaaggtgtttcctttggaaaggacaggaaaatgctagactgctagtgatggtagctgcctagtctttgggatcatgtttaccgactactccaatatggtggtcttggacttcataactaagagaaactaggatgggctctaagaatgtgatggctatggctccaaaagaccgatcccacaaggccatgggctgggctgcccattcaagtgccgcaaagtgttcacgcacttttcaacgttgtggtggttactacagatggtaatgggaggagaccaagttttggactgactgctggctgaaagggaaaaaaattgtagaatgggctcctaacctctttcttatgatccctaaaaagataaaagaaagcagagaacaatagtgcaagctcttataaatagaagatgggtagatgatatactaggaagcctcactatgctggtcatttatgaatatttacaattatgtgacttggtggatgggttaattttgcaatgtgttggagcagtatgtttagaaaatctctgggtcgggatcttacacaagtaaatatgcttatgatactttgtgggatccatcagatttgcaccttggagcagaatatggaaaagttgggcccctaccat

SEQ ID NO: 37060 - DNA, 1501 bp, Oryza sativa
cttaatttatccttattatcgatctcgcaatccttattgtacgtcgacgtcgattcttattatatctagcaaatagctgaacacctgctccatgacacgatcaggaatgaccgtggtgccggagtaggtgttgtctttcttgcgccacttgacatgtatcttcttggcaaggtcgtaccagacgtccttggagccgtcgcgtgtgcagtactgcaacatgttgtgctgccagatggtgccggaccaccttctgctgtcctccgcattgacaagccagcggatccacgtgagcgcgcggccgacctggcgccatcgtccgctgcagaccgccgcgtggtacagccaaccccgcagcggcatgcggatcaagaaggcgtacgcccaggtcgacccggctgccatgagcagccaccatgtgtctacaaggacggcgccaaccagcaatgtgtaggtgatggccacgtcgactagcatagccccatgcccaagggcgccgtggaggctgagatggaacatcaccaaggcaccggcggtggccagcggcgaaaagacacggatgcagtagccatgccacgtgtggatgacgccagccttggtgtacatgatgtcgtacagcagggagagctccatctggaggacaacccacgtctctgtaaaatcaaaggtgtttttgattattattctgtgatgaacaattgggcattggagattattggttttgttatttggaatttattcacgaagtggttttggagatgattggatttacaggtgaatcgcagggttatcattttatgtggaccggtcagactgggctctggtagccggtcagaccggcgtgtaatgcgcggtcagaccggcgcagcccgcggtctgaccggccgacactgtatcggtttcggtttcgggttgtttatttggatatccaagtttatttcatgattatgacttctagatggatactatacgtatgtaatactattgtttgctgctaatgagtcaagttggagataacttagtctcggaatatagtttctttgtttgttccatgtgtaggtgactcgatgtctcaggagagtatttgcggtgatggaccgggagtcggcttggggataagacgacgtccgtggtggtcagagatcatgcgggatacttaggctatagttgatgcacgtggttgatggagattccatatggcatacaatgaagttattgtgtacgtataggatgcgtagttgaatttggaaggagttcaaatttggtacgattggttatgtaaagtttctttcttgtactagagggtttcctaaggtgtttaggactcctagtataagtttggttcgtggctttaggctgcctacctcatgtataaatagagggggagcgtgaggcttcccggtatcgctttagagagcaattgagttgagttttgagttagggtttcgagtttagtcaaaatttttgtaaggagtgctgttggtgcactttgtaaacacagaga

SEQ ID NO: 37061 - DNA, 1501 bp, Oryza sativa
ccaaaaaggttggtcggcctctctaattaagtcaaagaaagcttgggtttcagggttgtcacgaccggaaataacccaacgggcgttccttacgtgcgtgtattatttcttgtcccaggaggcaaggtacaccaaaagttgatacaatatagagtttaataagcgaaagtgtaaataattaatttattacatgggcggcgaaggcccagcacacaggaagacaaacgaaaaacagcggaagactagggcgatgaccacaggcgcttgacggcaggcacgagctagacaccaaagccttcatcttccaggaactcctcttctgggtttgggaaaaattgagcaagactgagtacaaccaccgtactcaacaagacacacccacaagtgcagtataaatgcaagggagtacaagggacttataatatagggggttagggtttgcagtaaacagcattaaaagacacttagttgctcaaagctattttgtaaacacgatcctagagctattcaatattattaatcaaggccgtgaacccacacgaacctgccttaacccaaggcctacgatgattcagaccgaactggcaacccgaccctgggtcccagctcgtcccaagccaacccaggccaaccattccatattttagttgttaagcaggttttaagaattaaaacactaacttgggtacattgctaggcttgcccataaccgagggcgcggctattcgaatagattatactctgatcagaggtgtacatctttacccacaagacacatcttcctcacgtgtaaccacatgccacataccaccacggtatacggacggaggacgtgacatagtttccaacccatcctagccatagacaagagtaccgacccaaccccacctacggccggaacctccgggacaggtaggcaggactgagcccttagcagcaggacaccggccctgtgccatgacatctcgactaccgggccgcagctcgtgtagccttcatttgccctagagatgtccatcgacccccgacttcgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttgaggattttgaatagagggggaggtgtgaatccaaatccacaataatccaaccgttccatagtgtccaggtgatgagaatattcccaaagtctagagttgtaaaaccacctaatgttgcctaattaaccagcgaagcatctacctaaatttatactagtggtaccatgaatagagtatccactagttgggggttttgtttattctagggtggacaaggtaataataacaataacaataataagatcataacaaaggtaaataggcatggctaaataaaacagtgataacgc

SEQ ID NO: 37062 - DNA, 1501 bp, Oryza sativa
cacaaaccagcgtgggcaacggctttaccttttgtatagcatggttcactgcagagcaccaggttgagaagtggcggagataagcccacgggggtcgctggggagtccataccttgtttataagggggtgactatgatccgggaatggtgcactgtggtgagttgtgttgtgcagagggtattgtcacagcctctattcgggtactttccagtatcgcgacgcatggtagacatgatgttgaggctgtgtcttgtgggtacagtggtacacctctggccagagtaaaactattcgaatagccgtgcccgcggttatgggcgagttgagcaatgtttttcgtgattagtctcacacctctcacaataattatggatgttatacctggtaataatttgcttagctcctggtttggagttagatttgttcagccgggtatggttgtttagaatggttgggcctgtgcagcatgggcgtgttgttcagtgttgattaaaatttctgattaattactccactgttttacttcttttaaatgttttgctaaatgctgcttttgcaaatgagcctatattatgccatcctttggtatccttgtgcacttgcatatttgctgtgtggcttgctgagtatgtcatatgctcaccttgcaataatcaatcaacctcagttgaagaaaaaggatccagaaggagaagacgtttggattataccccagttgagctgcctgtgggagtggagctggagcttcgctagattttattttccgctgcagttttcttcttggtgaggactaagtgcctcataagtaagtatttatcgttctagttaatttgatgaatctgtatattaaattgtcagtttgtgtacctcggctgattcctggacgaggattttatgcacaaataagttcggaaattactagtgaatttccgggcgtgacaagttggtatcagagccatctcgactgtaggataagccaaatggtcaaaccttaaggactaattttccgaaaacatgatttgtgaaaatttctcctttcttccttatctagaattctttgcaaattgtttcattgtctactctcctctctcgttcaacttgagtagttctaaaactagtggttgaaactagaagatgctgatgtgggcaacttatggaggttaagtcaagtggatcgatgaataagaaggtgatggtcgatctgaagagccaagtggtcaagatggaatgaagtttggatcctatcttagaacctatgccgccaaagtgtctttgaagaatagttagtagggtagaacgtttgttgtttgcttgtgtgtaggtatggttgcattcccatcattggagtagttcaatgatgagtgtgtaactatactaggttgtttgcttaatcaacttgaacaatataatggtctacacacatcagatcagttttaacctggttaaggtcttgtctttagtgtaacccctctccttctatcttctctaatctgcaacaga

SEQ ID NO: 37063 - DNA, 243 bp, Oryza sativa
aacaggtaattgtgatactgtttgagtgggtcagccattcttttaatttgattcttatacttacgatgtttgttttgtgtggtatacatatccatcttcagagcaagtgcatttgttgtcagtactttgtacttttaactagaaactatatctgtcatgtgttctgattaatccaatgccctgattgaattaatatagacactagataattcttgatcatagaacttcgtgtatttgtgcagg

SEQ ID NO: 37064 - DNA, 1501 bp, Oryza sativa
tcccgtttcgctttaagaggaagcaatttccaattagactgagcttcgcattgacgatcaataaggcacaatgacaaacaattccaaatgcaggtgtctacctcccgaagccggtgttctctcatggtcagctctacatcgcgttgtctagagcaacctctagaacaaacatcaagattctctccgtgcaggacaaagagaaggagaaaaaaaatggtcagctctacatcgcgttgtctagagcaaccgtctaaaacaaacatcaagattctcaccgtgcaggacaaagaggaaaaaaaacaaacggtctaaacagactgcaacatgcacaaagaatattatgtacaaggaggtcctcacaacatagacgaggtatatctaatgtgcacaaagaatattgtgtactaactaattatctttgcaatttttatattaactattgaacacatttgatatttcagttgaaatcattacctactggaatatcagtcaaacttatttcatatttcatttgccgtacacaatggtttatcacatgcagttaaacatgatagatctggctatcacactcctttttttttcaattattgttataactaattcgatcagtattaattgagaaaataagattaatatactatttgcctcacttgcatgatcagatttgcagagtgatttcaccaaatatgaatatattgatatgttcatatatgtacacatatgtagaatttatttcagtttgtgtagcttcccttatgttgctaaaatatccagcgtaattgtccaactaacatgttcctgatggtatttcattgtcaataaattaaatccttcctgtatgttgaccaataagatgtaagattgttatcatcatgtctgtagtttttttgttagttggacatataagtcatctcggcatattaaattgtccaaagtagtagctggttgtatttttaaatttgtaagccatgttgatttttttccaaattaatagcaagttgcttctttgatttgtaacccaggttagttctttatttagaaagagttaacatctattacaatagtatgttgacgaatatgctaagagaatacagttttcattctgcaggttttactccttttgataacttaaagcatgtggtgaaggcaaacacgtgaattcgtggcagaaatttttgtatggaaatttaacattgatcagaacaatttgtatgcaaattatgcatcacaaattggcatatatttgatacatatcttcaatgtaccgtattttatcatttaaattaagcttctatcattggatttaaaatgtagcatacagtctatcgagatgattttcattttttttaatatatcgtgagtttttatgatggctagatgattgttacgtcgtatatttgatacaaataatcattgactggtcggattcgaattcacctaacgttatgtgtacttcaaaaaacaattaggaacttgttgttcatgtattcgtactattgtc

SEQ ID NO: 37065 - DNA, 215 bp, Oryza sativa
aagatccttcttcgatcagcttcccacttatcaaatgcaaatcttctccatgatagtagttgactactttcttaattagcgtgtttacatatccgtcactaagatgttttgcacaactagccaacatatacttacatgtgcataatgcacacacatgtactagtataatatcatagaagatagactcattttacgtccttcgttataagttatta

SEQ ID NO: 37066 - DNA, 1050 bp, Oryza sativa
ttcctgcagccaattaaattcttttcctttagaccaaaaatccaataatcttagaaattcaatatcttcccaaccgtaaatccgtttgactccgttcaacttccaaaattcctcaaatctcgagatctatctaatggcacgcttagaggtcattaatagggctttattttcgccgtttgttgagttgtcccgtttcgcgtgtagtttcggagcccgaagacccgcagtgcgaggatttcgaggatcaagcccaagatctcgagcaaggcaagccacctttgaacatcttgagcctatatttgaagttaattatgttgcttgaaaaatattatgcattgataggatcgcacttaatctgtttgtcccgtctacaaggcagattggcggacctacctagtttgttgcatttgatccttcctttgttaattgttataccatgttcccttgtaaccatctagttgcgcctcgatattcgtgcactctgtgcgagtatcgacggtcgccttcaaacttaaaatttgaaaaacaacttgggtaaaacttgggttttacaaaagacttggaaaacccgacacctgggtcggtgcttgcgaactaaatgaatttccaaaaccgcggaccggggaacgtaccgggtgtacggttttccgctcttgcacttaaggaccgtttccttggattttcatccgaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtgtcggctttcgaaatgccttgtcatgaaagcttggaggtctcccgacgtggctgatccccacgggctgggtgatccgggttagtaatgtcgtgtgggtaaagtgtaccccctctgcagaggttaacaaactgttcgaacagccgtgcccacggtca

SEQ ID NO: 37067 - DNA, 486 bp, Oryza sativa
atctagttaagctaatgagatttaggtcggcgttgctgtgatcgcccacaaggtgtttgatgaattgtctgatatgatcacagatcacgaatggtgttttctacctccaaatggtagatgttacaggttgtctcagaagtccaaagcttgatttctctgcttctgctgccatcaaacttttggcaggagggtttatgcacgattgttttatgtttgtatttgttggtaactcgctaaaatgttgctgttctctgatgcattaggcatatgttactggtttatggcatactggcaatgagaatattatagagggcatattaagatagaatctgaagaatatattttcatgatttacctagttattctgtcagattactgtgatattcattacggaccagtgtttcattattttttccattcctcgtccaaagctgatttggttaatgttatatcgctcacttgaacctgtaaatctgtaactgcagg

SEQ ID NO: 37068 - DNA, 1501 bp, Oryza sativa
tcttctgtcttgatctattgttccgtgtatgttgattgtggtgggtgtgtccctctcctcctaggaggccttgtatttatacccataggtgtctccttgtccaagtagaactagggaaaccaatatggatacaatccgagtagtccttgtcgtttccatgtagaactctggttgtcttttcttatccggaactccctccatatccgaggtcagtttccgtataagatatggtatgtggtgggtcctaccaagatttagtcaactactattaggtatgtggtatccgtaaccctgacaacactaacatcttttattcggggagacggtttccttgcggatcggctgttttccttagtttggaggtaacattcccgtatacttgaggatataccgtatttgtatatcttacgaccccaaggataggagatatgccttattcgtaaccctgatagtggaggccggtcgaaccggggttttagaactggtcgctttgggttggtccaacagattagaaaacctttttggataaggtgaatagaccgggccctaggccggtcggtccgggcatgcccatggcgctataaccccctcaacaccttcctcctcggcaaggagacactcttggcaatatttttatatttcacttgatctattgtatttactctcatactacttgagcacttctccattcactgttggtttttgagggagagtaagccaagataagtgtattgcaatttcatttctacccctactttgatgtctaatattgattttacccttattttttagggttttcgtttttaccctcaatttttcgaagtgaatgcttgttttgcccctactttggatggtgaagttaacggtgttaagtgattgagaaaatgacatttataccctctcatgtatgtacattaattatgtttttgtccctattttatacacgtagctttgaaactttatttttgggagtatatttaaaattagatgacgcacattgactaatataacaatttggacaaattctgaatttgatggaattttgacaaaatttcagcattttgatagaacttaaacaaaattttgacaacattttgtaaaatgtaattatatgttccctttagatattagtcaatgtgcttcatttaattttaaatatactcacaaaaataaagttctaaagctacatgcataaagatggggacaaaaacacaattaatgaacatacatgagagggtataaatgccattttgtcaattacttaacatcattaacttcaccatctaaagtaggggcaaaacaagcgttcagttaaaaaagtgagggtaaaaaaaatcctaaaaagtaggggtaaaatcaatattagacattaaaataggggcagaaacaaaattgtcccttgtttgaactattgtggcacttaatcacattcgagcatggttgccacctgttacttttgaaggttgctgcatcctatatggttggaacgagttgtccagtg

SEQ ID NO: 37069 - DNA, 185 bp, Oryza sativa
agtgcctgcgaccaaggtctcgaagagcggagaaagcgatgctaagactaaaaagattcccctagatccttctgatcccactaaaactgctgtaataggcgccgagttagattgtaaataggaaagcgcgctcgtcacctttcttcaaaataataaagatatctttgcgtggaaaccatctgata

SEQ ID NO: 37070 - DNA, 891 bp, Oryza sativa
cgctgcactcgggaacaccaccggccgccggcgtcgttgccttccggccactggagctctggcgcccctcctctccctcctgtcagtttgctcggcagtagaaggaagaggaggaagacgacgggaggaagaagaaaaggaaaaagaaaagaaggcagacactgacaggtgggcccctgcacagtaactcttcgtattttctctatttaattcaaatcctaatctttagaagcccatatctcctaaaccgtagatccgattccattcaaacttggacctaaattcatataaattcaaaatctatattttgataccaaatttgctattttaagattctgtttgaatttccttaatttattcaaatactattagaataaatatttgattaaatcttacaattgaatttacaacttaaatttatatttgcttttcaaatattttattttattccaaattacccctttagccactaaaaagccgccggttggaactttacgccttccatggggatgttcgcggtttactatcctcgacgtcggaccgttggttgtaaagcccgacaaaaaccaaacctaaggtcgaagtgctgctcctagcaccccacgccttgatgcgtatagcggtcggagcttcactattccctcgacctccacagcacgccgcacagttagctctcgggctcttttgatcttagccgctccgccgccactcacggttgtcggagtaacacttccgccccaccaaacctacaccaacctcatattcctctagccgatatactgtcggtcgacaccggctagagaagacactaaatctagtcattatgctgccaactctagcaacgactagcaaacaaccaaaccctagccgataccttgctagtcaaatccc

SEQ ID NO: 37071 - DNA, 164 bp, Oryza sativa
tctcgagcatcgatttttactgtagtgcacgaatcttggtgtattcctagccatttaaaagtcaatatgtgtacattttcatgtagctgaaaactagacaatcccacagctggaaaatattttgtcagccagacgatgctcggcaggtgatgttggaagcgcga

SEQ ID NO: 37072 - DNA, 1501 bp, Oryza sativa
atccagaatgtatttttgatccaaccaaccaaacatctttcgcatacagtatctttaatacaactaaccaaacaatatctaaccatatgcaggtttattcaatacaaacaaccaaacaatgcatatgtatatctttaaccaggccaatcttagtctggataaaggagatgaaccaggctagaagtatacgagcaaccaaacgcacctaaattggggagtgtttcctgcgccgctcatctccctctgaaagtctggatcaaactagctggctacccaaatagcctctcacgatcacaggctcacaacctcacagatatagtgacaaatcgcacgagctggagctatcatagattgaaggaaagtaaaaaaccaaggaaaaattaataaacagataagggaaagaaataaaaatactactccttccgtattaataaatagatggtgttattgatttttctttatctaacatttcatactcgtcttaggaaaaatataagtaatgattaaaatatctttaatgataataaattatatttatatgtttttcttaaaaaaaatatccaaacatcatatctaaaagtcaacaacgtcatatattaaaaaaactagtgaacgtgcacgtgcaaagcacattgatatatacaattgaagaaaaatgcattcattgctaatgtacatctacatatactcacaaattaaagctcataatcattgataaaaataaaagtattgtaaacattgtcttggtaattcattgaataaaactaatttgttattgtattatatagcgtaacagatgtttttcagtgagaatcttattttcattactttatgccttggactacatgcaatagataatggttaagcctgtaagagttaaactattatgagaacaaacgacgatagataactcaagaaaaagtgagatagcagccatgtattatcaaaagctagtaaatgtacaaatgcagcttaaaatagatcagtgaatcagcaatggatgtttcccaattttcctctttcacggtctgctgagcattaaatagtttgatttggatatataaacatgtacatgagattttaatgagataattttccacacatttagcagggtaaactcaggccaaaataatgattgaaacaaaacttctctaaattattttctttgggcaaaaaacaaaattcggtttcaacatctcataaagctcacagaaaactgaactgcaaaatcagtactgcaaagtttaggcgcatatattgtgctgcatttgaagttactttattatgtatagatagacattattctttcatttgtaacaacatgattgggcatcattaaaatccccgtccaggaccggccggggtacacaaacgacaatgttgacattcagatccacgtcttacaaacatcataaaagtcttacataaatgcagcggaaaaacgaaagataacaggaactaagccttgacttgatctgcagcgggaacaccactccacaga

SEQ ID NO: 37073 - DNA, 1501 bp, Oryza sativa
tatattttcttgtaaacacactgattagaatactgcaatttgtgagttatggcctagatgaggtgttagataaaagttttgcaccatatgtctttcactatcttcatcctacttttagcaaattagtttacatgatatcgatatgtcaggtatgtcactataggcacatcaatataggatgttgccgtcatggtttacgtgcatgcattaggtcttctgcaaatgcagtaacagcactatcctctaattaggttattgatataatggtcttgtgttaaccacatagatggataaattggcctagttgctattacgcggtcttccacggtttgcatataagaagggggctaggggttgtagctagacaatcaaatctatgctttgtctatgcaataacaaggttccctttttcgacctgtgtaacttgtttaggtagagcattgtggtgagatagcatacatacttctttcaaggagcaagtatgtagtaagttaaggtctgcagtaaggtcaatttaaacagtttttttcagagattgtaatgcatggcaccaaatgtatgcttatttcttttcatgagttaataaaaaaataccattcagttgttttaattttgacattgggggttgattttctgacatatactccctccgttccagaaaaaaccaacttctggggacaaatctagacaaatgcatgtccagatttatctccataagttgattctttttgggacggagggtgtaaatttgcggtgaatcctcctggttattactcaaattcactccacttggatggttagatactgtaaatgaaatatgcacagttgcttctactaattatgatgccataacctcttttattgtacatctcagttttcaatatttgatgcagtatcctggatggctgctggtcggggcattaaccagctcctacggagaacactccataatcagtcctcagtaagaattttaatgaactatttattttgtattacttctgtcaaaaaccgatcgcttaccaatctttttaatatttattttctgtctgatgcctgtatgaaatgttatggtataccaatcttgaattgattattgaaatggcatgtagaaaggtattaccggacatcactataacgtgaaatgtatcagatggggttttggaaagaaatcacagttcacattcttactagttactactgcacagtttttaggggtttctgtttggcaggattgatctttattctactttttacagttaaacctgcattatgcatacaatgcttatttttgctgttctggttgagtaattagaccatgatatcaactacttatcctaattttgacaaagtttataatctgacagtaaccatttgttcaccataagtttcagtacccatgatcatctcctttttagtgtggtgacctgcttttttttaaaacattataatcatgttttcagggctcatctctgctatcctcgttccggataaagcatgaaga

SEQ ID NO: 37074 - DNA, 1126 bp, Oryza sativa
aggatggagaggatgcatgcacaggatggagataagggaggagaagaaaaattgataaggatgggagatggagagagagaggggctgtgcatgcacaggatgcagagagaagcgccggagacttggtgcgcgcgtgtgggtggacgtttttcttcctggttgttaaacaaccgggacaaaaatagatctttagtcctggttggttacagaaaaaatccacaagcatacggatataccattatagcatttcacccgggagtattccagggtatcgtatttatttaattctaagggaagatattgaaagagagaaccatgctaatgattatatacatatatattacttgccttcatcaaagcctagtaggggttaattcagcatatgggtagagtgacacgaagcgaagcttttagattccctctaataatgatcctaaactaagtagtcgcttttagattccctctaataatgatcctaaactaagtagaaggagaaatagaaaagaactcaattcctatacttctaatatacactcaatctttagtctacaattgctagtatacaatcatgtggccaatatcccctaatagtgccctcctggtgtttcgagagaccaccctgggttgccgaattccttacgacaacctgtcatggccgtccaaccggggctaaatacggaggaatttgtcttaggaatatatactatcgtggaggaagacctgtactgagctatcatcatcagcggcccacctctacagatccgtagcatatatgcccagataatgatacttattaatctaagtacctcgtttacattaataaataccactctgggaagctaaccatacaattaatacgacacaaatgtaaagtaaagccgatactcagactaaacaaagtaccgaaagtatataaagaagaatatttcattaatgctggaagtcttacaaaagccgatagaaaagatactagagccatacccgaactctttcgaagactccgaggactccgaaaactattctattctactttagttagcacaaaaactactaaataaagtgtagagagaaatcttgagcttgcttgactgtgttgagaagtgaagtgagctcctccttttatagg

SEQ ID NO: 37075 - DNA, 1501 bp, Oryza sativa
cagatcggtgggtctctcgcggcgagatcgagtgaagaagcgctttaaacccttcctctcctcggctcctcgtctcatcgtggaggagaggagaccgggcggctagacctgctcgtgggccgcccgacccggcagcccaatcgggccgggcaggctcggtcctgcgttttgcagcgcggtaagtctacattgagtccctcaaattagctgcaataccagatatattgaccccccaactgtcgaaaccggagcaaaatgactctctcggtggttctgagggtggatttcgatgacatggatcattgacatagtctaatcagctgagccagcgtgtgggacctacatgtcctcctctctctctctctcctccttcacacacctctccggtgggtaggcgatggtgcgggcaccaacgatatcctgcgtagtcaaatatggcgggctcctcctccaccaccacatctccccatcgtagcagggccatgccgccgtggttgagctcctcctcttccctcgagaggaggcgcaagcaacgacgaggtgccgtagcatgtcgctgtccctgtccttcgcgcgggccgctgcgagccccgagcccacctccattcacaaggttagcccatgtcgtggtggcaatggccagggaaaagcatcaacgtcgctgggctgacggctgaacacatctatcgcgaggaagagcaacgaggcgagcagcaacaccagcgtgatgtcctctcacggtagaatgccggaagagcgagtagccacacagtgcttcggcttgcttggcagcaacgacattgggggaggagaagagagttatgtgtcggtggacgcgatccctgtcatgtgccgggctgcccacatgacgagaggaactgtgccgagggagatgtagggggagaaaggggagggaggagaaagagatatggatgcaggggggtgggtgggtcttcctcaccgtctgaccagtcaagggcgacgaggccactgccttcgtccatggccgttgggttagggcacaccaccgtcaagccgtagttccaccagttccaccaccacgacctcaccacgagccaccaacaccccatgccgacgtcactttgtccttgtcacatgagccgtgtgcttcgtcggctgccaagtagccgccgcctactcctccctggtcaatggtgacgggggtccaccggcaacctcaaggaacaattcgcacaggaggagataaaggtgtgggtgatgacgtcgccgcaacgaggcatcatgttagccgcgcagatggtcacgttgtccaacctctgcgatgaggacgaggatgagggcgagggcggtggtcgccgcaagctggctcctaccgcggtggtgttggggaggcgcctcacgctactggacgtcatccggcgtcgactagcctccgtggaggtcgaggacaaagatacagagcgaaggaagggagcaccacccacggtggcgtcggcgaggtgacatcgtgatgtgacca

SEQ ID NO: 37076 - DNA, 670 bp, Oryza sativa
cagctctctccacccgatatgacttttcgggtgaaaacctagtccaaggtggatagcctccatggaggcaccgcctcgaaggtcatgttccctcgcattcattgccttcttcctagtttggccttctgcgttcggttagtttcgtctctaggttggtgtaagaatgagcagatctttccccctctctctctctctcatcctcatcctcaaacctcctgtgagggtggccgggagtctgtcgtcgacattcttggtgaaattggtttgaagcgagagcgtctgcgacctccttgtagggctagcaattatcggtcacgtacaacgggtgtgtgtttggagcctgtagcatgtggtggagtagtcttttttttttccctaattatgaccttcttctgttgtaattctatacataatttttttcatgctatatcaatatgaatcttcttgtgttgtcttgtgcgggtcattcagaaaaaaacactattagtaagtgggaaactagaggccgaccggaggtttctttctatcgttgggagcctctctgccttccgacctccatcgaattgggtgcagaccagcagcagccaataattaaggtcgtcggccgtatatatgatgatggagaatagcagggagcagcagccggagtcgtcgccggcgaacaacaata

SEQ ID NO: 37077 - DNA, 188 bp, Oryza sativa
acaaccttcctccgccgcctccattactcggtgccgctccaggaagctcgccgacggcggacgcttccggtgatcttttcacgttttctttttcacctttttcatcttctcttcaccgcttatcaccacctaatcccaattaccatcctttttagatttttcttctcctttcttactcgcattttgtc

SEQ ID NO: 37078 - DNA, 1501 bp, Oryza sativa
gcaacgacgaaagcaatattctgtaaaagcatcgccatatgcagagttgcagatgcaggcaagaacgtatcagcatctatcactgcatgatgccaagccaagaacgggacaggctaggctaggcaacgtcgccgtcgtggccgtgtgctgttgccttgtcgccgcctcgccggccacatcatgcatggggaccatgacatttgtactagtagtagtcaggaaagaacaagtgaagtgacctcgccgtcgtcggagcgcggcggcgtggggaggacctggcggctgaagcggcggacgttgtagagctccatgatccgctcgttgttctcgccccaccacttctgcgcctgccacttgtcgtacatctcccggctgaacctgatgcgtttcaggtcgttgccgccgccgccggcgagggacacgaacgtgatctgcaccccgggctccacctgcgccacccactcccgagcctcgccctccgccggccgcgcgaagtcccacgccggcgtcgagctcgccgagctcatcgacgtcccgccgccgcccaggtacgtcgccggcggcaccgccatgtcgtcctggaccatgcccggccggtagtacccgctccggtacaccgacgtcgtccggcccctcggcggcggcgacccgccacgcctctgctgaccgtgatgacggctcgtgccggacagcttcatcaccatgtccttgagctgcatacaccaacaattaataacacatttaatttttgatgatccatcatccatcatctcctaattggattcatgggatcatcgatgatcaacactaggatgatacttaaatatcaatgtgatcagatgcaagattttgtcctatgatgacgaaaatgacattgcgtcaacttcatcagggttcattaggtgcattgaaatgagatatttagcccttgatggttgcctctgcattcagcagatagctacactgcaggtaaaacaagtagtaaaagaaattgtaaacgctttctccaagcaatgcaaatcgaacttgtgctattcgatcacattatagtcctgaaaagaactataatgaatcatacatttgtgctgattctggatgttatttccttccgttaagattatacctggatcatggtttgctgaatatattgaatcataattcaggacgcatttgtgctcattctgggtatgtgtcagtcattaagcttccatctggatgcattactcttggttacaacttaaaaggcatcatgatttgctgaataagttgtatactcttccaactggctgatttccagggaagttcagctcttgatttggactcattcatacgactgcagctttgggccaggtactagtcctactacctagtatatcatccatgttcctatctgcattattgtcaaggtatttggttctacaaccagaatttctggaaactagaggtctagagctaatagctactagtaagttattgcttaacgcatcatcttgcaactatc

SEQ ID NO: 37079 - DNA, 207 bp, Oryza sativa
ttttgctggttggtttccaccatggtgtgaccgtcctttgtgcgattgtggggatggatgcatactcaagtcttccctcatgatacaaactcggggcaggagattcttccaatgcgcgaactttgatcaggtatgcttcatctattcgaagttcaaatggataaaaaaactaacttcttcgtacacaattgtaacatcttacgcaga

SEQ ID NO: 37080 - DNA, 207 bp, Oryza sativa
tttgtggtcggttggtgtggctgctcgtgttctgtttcagtaacttatgtgactttacctggttagataattggcaaacgacgaaaaacttagtgccgagtccagcaatttgtctggttttaatcagggtttatctgcacaggaatactacatgacagcatatatagcccgccgcatctttttcactcgccagtctatttatgcagg

SEQ ID NO: 37081 - DNA, 1501 bp, Oryza sativa
ggacagtagtggctagtaatggagttaaatagctaggaagaaaatgtaaatatagtatatacttgtatgagataaaaacatacatatccttgtttcaggttgtgctgctttatatatttacctcatggtagaataagaatttactaccacttactgtgtgaagtgtggaacaggtcgtatttactttcttcttcagtcttgatgaggtagcaatgcaagatggcattgtgcagtctgagctgaataaagattacaaattgattggctataggtcaaatagtggatcctagagtgtaagatagtctttgaaaatgtcattccctgacccctaaaggggaagcagcttcattatctagcattcatatttgaccggagccttcaatggattcactagctgcactgccaatagtaccccaatataaaatcgcccatttgaatgctgcagacagatttgtcgacaactagtggctattagtgcagatagttgcaagatgatgcgttaagcaataacttactagtagctattagctctagacctctagtttccagaaattctggttgtagaaccaaataccttgacaataatgcagataggaacatggatgatatactaggtagtaggactagtacctggcccaaagctgcagtcgtatgaatgagtccaaatcaagagctgaacttccctggaaatcagccagttggaagagtatacaacttattcagcaaatcatgatgccttttaagttgtaaccaagagtaatgcatccagatggaagcttaatgactgacacatacccagaatgagcacaaatgcgtcctgaattatgattcaatatattcagcaaaccatgatccaggtataatcttaacggaaggaaataacatccagaatcagcacaaatgtatgattcattatagttcttttcaggactataatgtgatcgaatagcacaagttcgatttgcattgcttggagaaagcgtttacaatttcttttactacttgttttacctgcagtgtagctatctgctgaatgcagaggcaaccatcaagggctaaatatctcatttcaatgcacctaatgaaccctgatgaagttgacgcaatgtcattttcgtcatcataggacaaaatcttgcatctgatcacattgatatttaagtatcatcctagtgttgatcatcgatgatcccatgaatccaattaggagatgatggatgatggatcatcaaaaattaaatgtgttattaattgttggtgtatgcagctcaaggacatggtgatgaagctgtccggcacgagccgtcatcacggtcagcagaggcgtggcgggtcgccgccgccgaggggccggacgacgtcggtgtaccggagcgggtactaccggccgggcatggtccaggacgacatggcggtgccgccggcgacgtacctgggcggcggcgggacgtcgatgagctcggcgagctcgacgccggcgtgggacttcgcgcggccggcg

SEQ ID NO: 37082 - DNA, 311 bp, Oryza sativa
tgatcatatatattgcaggtaaataagttgttatgtaattttttccattacacctaggatctgtgtctctattctctaacagtattagccacttgatttccatggatgaaaaggattttctatgatgattttttaaattatgttcttattatttttatgttaccatgtaatgattcagaccaaataaaaaaaatgaagcctccaatgtactccattatctttttgaactatgttggagatcttgtaatttatattacactcatgaatgcaagacagtttgatttttgtggccgtagattttatagctgcca

SEQ ID NO: 37083 - DNA, 1501 bp, Oryza sativa
aaatatatacattacctagctacttctccaactatattatctcaaccaataatcacagcatctctcatcatctaattattccacctactttctttattatctcaaccgatcatgatcattaatttcacggtgttccttaacctctctaaaaaaaattcaaaagtattactgtagtgctatactctctttttttttagtaatataattgtttttgttacatcaaggcttgactaataactattttgcagtttctaaaaacaacaatcgttttacatttatttcacgttttcatatccattggttatttgtaaaattttcttaataggaataaaattcatcctttcatttaatatatcacttgccctttcaaactcagtcacattagatagaaattacgaataataaatttggcaccctaccttatttattgatatgaatatgagcacaccaaccttattcttaaatttgtaccatgtgtgaaatcaaacttaaacatattttaaacattggtacttcacaaaaaaaaatgtgctgtagatttaaataaaagattgcacatttacttttcggggtgtgcgtgtgtgcgcgatcagatttgaacctctgtatttatggcttggtatgtgatttgacaatttgaatttagagtattaaatataattggcatgttatattttaaatttgtatggcataaatatgtgatatcattttaggaattacgacgcttaccttattaaacgttatgaattttaatgacactttaaagaatattaattctttccttattatgagatcctacccagaacaaggtaatataccattggattctagtctaatggacagtgaaaacatttggagcaccttaaaaaaaattccattgtttttttatataaaaacaattattgtaagtaagcaattttaacatgtatctttaattttgtgttaaatatatatatcttgctagagtaattattgtcaaagtcttgccctaacaaaacaaaataatacacaatatattttttaacgaaaggagcatatagaatggctaacgcatgccacactgggaatatggaagaattaatccgatttgggatgaattgattattctcgatcgtccctaagaaattccagtaccggcatatatatagtggcattcgttcttgtataccaaacaagtaattattaacttgcaattcaatcaacaaaagattctggtacataattaattgacacatttaactaaagaaaaataacagcccccaagtccaacttttgaatgatgtgtaattgccctcgagaacatttttatatcgataaattagttatagctaggtctcgatgaaatgctagcttaattcagcttgcatatatagaagcataaccacacttacttaaattatcttgcttggaccaaccaacaaaacaataagagggttgagggttgaaagtttttttttcagaaaaaaatattacatacatgaattatctacccaatccatgt

SEQ ID NO: 37084 - DNA, 1501 bp, Oryza sativa
taaggagttctctacttatcaaacttacttagccgattagagttagaaaggtgaataaaatgaaagaccataacatttttcaaacgaccaaatagattgattaacgttatattaatagaagggagtttagctgggatttgggttgggaagacttttccgctaatcgattgatcatcgcatttatactgttggccaacagtggcgactgcctggtatggtcattatcgactcatactccaatatgtttataccaactattatatttaaatggccagcagtggagtaataagtaacaatctattatttaaattatgataagattcactcatatatgtttatacaaacttgttactagtaagcattagatcagctgcagattggttgcatcaggtgtacgtacagaaatccttccaacaaaaagcatatgtaccatatgacaatatgtacttatgttgttaacttgttctagaattaactttccatcgagagatttaatcggttaatgacactcacgttcccctggtagccgttgtatatcattttcaggtcaagaataaactaagatatgaacatcacatccatacccatccgacgattaagttaggtggccaatcactcttaccatccatatatgcatatgctccattagttagtacggagtacttctttccaaaatagtataaacattgtcaagtaaatagccaggaatgcttattcgtctagttgcacaatcagaaatatttatattttcaaatggagggattactcaacttttacttacaggcaggggaagtcagtactgagtagctagctaattaccccgttgatcatgcaactatgcagtgacagattctgccagaatttggttcatggccgctagctgcagggcatgtgtgatgtccccagtttgaacagtagagagcagccggcagtatgcacatatgctgcatttaaggaggagttaggaccggagtaggagtactagtacttgtttattaatcactcatctattagcataatggtccatggtgaaagtacagcaaaattaggtgaaggtaacgtcgatattagttgtatagaatcatagaccatcttcccaacagtggtactttcagatcatctgtccttgtttccgtccctgttggagagcgacaatcggaatggtcactgacaagggacctctctgttgcccggaaacgacgaaacatccagttcagagttgcagacttcagacagttgccaaggatcaatggaaaattgcaactgaaaatgctggagactgcattgagattgaatattaattcctccaactataattgaatttcatccatatttttggaactagatgaatatgatatccataattgtttttaccctgggtaatctttagacctatgttatttgtttgtttttatgtgatgttcacatccatgttccatcaaaccatgtattcaacctgtattagaggttgttatttggttcaatgcttcaacttgccaca

SEQ ID NO: 37085 - DNA, 247 bp, Oryza sativa
atgggagcgtgggggtttagacgaggtcgccttatcctgtacttacaccaattcttttaagagtaaatggcatatagggccacttctttttaccaatgtggtaagagtaaaagactaggaagtaggaacagccgagcagcccaacactttaaatttgaacccaaaaagattacatataagttttactttgggcaatttgcttcttccctatctttccctctcttccttgctctctgtcttcttgagc

SEQ ID NO: 37086 - DNA, 1501 bp, Oryza sativa
gttttgattttttccctttttttggatcggacagatttttttttgcccggtttatttcgcccgatcgattttttttaccgcgtcacatataattccttttactttggatttttttcgccctttttttaccgcgtcgacggagtcagattcgttttgattttttttctccctttactttggaattttttcgccctgttttcaccacgtcgacggagtcggattcgttttgatttttcccctttttggctttttttggataggacagatttgtttttttttcgccccgtttttttatcggacttttatcttttttttcgcctggtttttttattttttttaccgcgtcacatataattcctttttctttatcggaaagttttttttcgcctttttttaccgcgtcgatggagtcagattcttttcagctttttccttttcttttatcggacaattttttttttcgcccatttttttttctcctgtttttttcggatcggactatttttttcttttttcgcccggtcgatttttttaccacgatatatataattcctttttctttggaataggacagttttctttttatttttttaaactctttttaccgcgtcgatgtagtcggattcgtttcgatttttttcctttttttgctttcttttttgtcggacagatttgttttttttccacccggtttttttccgcccaggtttttttatcggacttttctttttttttttgctccacgatacatataattcatttttctttggaataggatagttttctttttatttttttaaactctttttaccgcgtcgatgtagtcggattcgtttcggtattttttccttttttttcctttttttttgtcggacatatttgttttttttccgcccggttttttttcactaggtttttttatcggacttttcttttttttttcgctcggtttttttctcccgttttttgacggacgacagaagcacctagagaagtgttttttttcttttctccaatccaatacagatcggatctcttccagggaaatcagattttttttctccagggaatcggactcttttttttcgctttttttattcattaaacggtttgtctctcggacttttttttcccttttaagggatcgggtgtttttttgccagggacaggtgtttttttcgcccggtttttttttcacttttttttggatcggacttttttttcgtccggtttttatgatcggacaaacttggttttttctgcccggtttttttttcacccggtttttttgacggacgatggaagcacctcttattttttaagtagtatatagtagagtagtagataataaccacaacatcatgcgttcttatatatgggcttgtttgattgcatccatttaaaaatactccctagcaagccaaaattttagcaaagtaagagttttgacaatgttacttcaaagcttttagttagctttgccaacatattggaattatgt

SEQ ID NO: 37087 - DNA, 1501 bp, Oryza sativa
aagctagcgtgcgtgcacttacgttgcattggttgatcgttcatagtatagctataagaacaggcacgttttggtttttatatttttttaagcgtgataaaggcagtgacgggtaggattgttcagctagtaacctttggttatcttgagccgtcgaccatgcatgccctttaggattccaaacggtcgctgggtttaatcgatctgccgtactgccaatgcgctgcaaagcttggaccatagctatctcagctcagatgttagtagtatcgatctatcaggacgtacgtggaattcgtcagaggcgtctgcctgattcagcctgaagacatatatatgtagctttctggggggaaataattagcggaggtttatttttctcgaaatatcattacaaaggacggtttgtgtaattgtattcattccagaaccagtgaaccaggacactagaaaatacagagtccaaacgtatggcgcccatctgattgacagcatgtccaatgtgatatctctccatgttttttgcatttagtttaacggtcaaagacgggcaatctgaattaagcagcatgcaatgatattttgagagcaggactgtcaggaaaatgttattatcagcatgaaggtacacgagttcattgcctcaccccgcacagcggcgtgccgtcaggttaatcaccacgcgaacggcgcccatcagctgcctgagagtcattatcagcagcgataattagtcccatctacaatgatcgatcgattggtcatctcaccgaaccctgcaaccgtggatgtgatcaattcttacttctcaggcacagacctaagttaggactggccttggacaatgatcgcatgacattagttaccagtagtccgaatcgagcaccagctagcacatcttgcatctactgttacgagtgtacagtagaaccgattaggtcatgtgcaatgcgagggcggaagacctcttttctttctcacactacagtctacccattgcatgcgtcaaatttactctgtaccaggtccaggtttggaccttgaaacaaatgaaaatcattactattgttttccaagcgttggctcaagactagtgaggatgacatgattttttaagtatatatattgttccacattcagtgttaaccactgtgttagggataaaccccactcttagggttagagcaagtttaataggatagccaacttctagctacgaatcatctataaccaatgtaataggcaattcatacaatagttgcttactatactattaatacctagtcctacacctagctatagctggctacaaatctgtagcccgctgctcttctctctcttcctttatctcattaaaatatgtttatacctggcttatagtctactattgtacctgctcttatcgtgttaactaataacataactacactattgatggcccatgcaaattgcgcgaaaagtatcttttttttcttatataatagtgtgtgtgtgtgtgtgt

SEQ ID NO: 37088 - DNA, 1501 bp, Oryza sativa
gcgacacagagagacagcaggtggacagagaaagaagcttcacttttcttatggtcgatgatataggtccctggtaaactagcctgtcatctttgtcatcttccttgatctgcttggattttggcccaatgcttatcttgctgccactattttcagtttctttaacagcagcagcttgagaagcccatcttgcctgactgtacaaacaagtgactgaaccaaggccatcaagttttggaagaggattaggcttgaatgttgagaaatgcttccatgcaatacatccaggagcctgaagatctgataatgtaaaggacagttagctgactttaatcggatttttgacacctataaaaaaaataagaatgcaaatctatatacttcggctatccaagataatggttcagaaaccattaagttagcaaaggagcatgttgctttcagaaaggaagatcattacgctattaagcattttgaggtaacatacagtggtaaattggacttcaaccatgcgccctgttgaattactataacacatcttcctaacaaatgcacctcaatacagtacaattagacacatgtaactggcaaaactaaatcatgtgaaaccgaaagaggtattgggggctcacgagagtaatatgtagagaatagcagataataaatcatgaaattcaaggtagaagcttgaatccacagattatgttggattgtgggtggagttagaaaaaatcatccctgaaatagatgtggaggactgtcatttaaactaccttttcattgacacatgcactctcaccgaagtctaaccaccaactacaatctaacttggaaattccgagattactcacaacatagaagaacatatagctagtcagtcagataacattagcactacatagagggcacagcacctccaggagcccaggacctaatcaaactagaaccgaacttgtgcaccatggaatcgtatgcccgttctcacaacaatttcgcagctcatagctgggcactaccacgcggatcagatttaactatggagagaaccacggggggagagattcgaagcatgaggcgaacctgagacgcgggagaaaacttgcggcggcgaggtggttcccacggagcagtggcggaggaggaccccgcggagggaggaggcggatcggagcctcgccgtcgccatggtctccttccgatcgaggcggggatttgctagggtttttccgaagggatggaggagaggccaagaggagacgaagcggagcgggcctaaacttacaccacatgggccgatatgggccaggccttagctgggaggcggtttcttattggatccggatccagaaacctcttcgccttcctcccatctttctctctctttgcacgcggatctccacactccgcaccgccggaaccctagccgccgcccgtcgccgccggtgagattcccttcttctcttacctgattattacctcactactcgaacccaaggttttt

SEQ ID NO: 37089 - DNA, 325 bp, Oryza sativa
ttgcaaactgggtatactgtttttcagcactatgtgtcctaaggtgcaagctggttaagcaaaacaaattttgcattgttggtgtaaagaacaccatggttcagttggtaattttggctctactgtaggatatttttgtattgattgttatgaacaacttgcagtcatcatcattggtacacgtttgtgttgaatatttgaatttcaatagatgaatgtcttgtcgaaacggtttccagttgtctttaatgtcaaatacatgtacctttttttttctcctttctccctcagtaataccatgatttaacttttacttttgtttctt

SEQ ID NO: 37090 - DNA, 1501 bp, Oryza sativa
aaaccataaatataagtttttttacaccgaaaccataaatataagttgaaattaaaagatgcctgcaaattttgaaacaacatacttttagagtttaaaaaaggctaagatggcttacacttggactcataggggatcagtatatatatatttcaaaagttgtttaattatgacaaaccaattgaaattgtctaaacaagaaatatggaagctgcttgttttttagttaattagcttataaaaaaggatggccatgattttgatgcttttgcccagagatacagtacctgcagagatatgagcaataaatattaatgaacttacataatataaaatgaatataattaatacctagagggaacataatataactaagcagtaagcacacaataggaatgaacgaaacatatatatctgatgagatatctcttgattccaataaacttcgtataaattggatcggtcattaagtataaaaatatttatgcagaaagtgattaattgtttatcaagaatgggaggaataggaatgattgaaagatatttgatgagatcttgatgcaaataaacttcatgtatgaatcgggtcattaggtacaagatatatatgaacagatcgattaagtgagcgcgtgttaaaaaaaaaaagaggggaagaaacagatgaaaatgtggccggtttaccgtggataaggagagcctttgatgggtttctggccgtacttcctccatgcccatagatcagacgggatcacctctcctccacctccacggctactcgtcgctggcggcgccgggatgcacaccactttcttcacctcattcttcctgtagtatatatgccaaaggatgcaagcaagtaattaattaattgcttgaaaataaactaacactaaatagttaagacttttgattaattggaaatcgattgatgtaagtattcctcgctcattagagaaacgtgaaaagcaaattaggaggaactgaagtcaagtatgatttagttccaaacctgtcaaagagttatgtgtacatgtacagttgctagatatgagcattaatactgaaaacggccatatgcgaggagtaaaactctgagaagagtaagatcgagttaatattaatttggcgatatgggtagggggtgcaagcatcaaatgccaatccatgaaatcctgctagcttgcttaaaggtgatgaagtcagaattaatgacgactcatatatatataatctgtcagtatatgtaatggatcgaaaggaatgctgaaaatgagagccaaagatatctgcacacacacacatgcatgaactaataaaaagatcaaagtgataaaaagaagcggtaacacaaagccgggatcgatcagagggatgcaaatcatcaattgaaggaaggaccaagatgtgtatacattaaggaagaagaggagtgatcgaaatatgaatccaattagtcgaagcacatctgggaaattaacaaggtaacttcctcctctca

SEQ ID NO: 37091 - DNA, 282 bp, Oryza sativa
tgcaacgtccccccactctgcattttccttttctcttgaagctacaggagagactagagaagttaaaatattccatttaatacgggtagcaaggtccaatcctatttattaacttatttgcaaacattagttggagtatgcaacaaaactaagggatcggcagtaagttgccaataaaatcctttcttccccaccccaataccattcagaaaacttggtccaacaacaattgtctgttcgtactttccaatatttgaaagatttcattatcttgttactagg

SEQ ID NO: 37092 - DNA, 1501 bp, Oryza sativa
atctgagactgaaccaacaccaacaaggattctacataattcccagcgtagggttgtggcaagtcatatattatgtgatataaacagcagcatctgaatacacagaatggaatctgcaccaaatgtgactggctccaactacatgttacctgatccaactgcaaacattatttacagtataatagttgaggtaaggcagtcatccgtgcaaaacaaacatcagacatgcttgcaggttgtactaaaaaaaaaaactccctatttatttgaaatgccaacagtaccttccaaaccacaaaacacatatccttattcattgccttcaggaatctcaatggttttggagttcgcttatggggcacaaaatattggcagtcatatatttggagcacaaactctcggctaaaactgaaacattatgtattgatattcaacatgtttcgaaatcctcagcaggcgacagataatctctgagacaatatgtatattctaagggcattcgtttagcatattaatggttgacaaaaaaaaacttgcttcctatcaatactgtttgtgacaaagtgtttcttaggaacaaaaaagataattaacaatgaacactaatctaaacagagaagaggacataatgtagctgtagaatcttggtgcaacacagaacagatgctcagattcagagtttttctttttatacacagaggctgcagatttgcattgttttcttggtaatttactttttcatcactatttagaactaagctattcactttcttccctgctccaggtaatatacagtacgctaggacagtcaatgtgtgcatcagctataaaagcctaacatcatgaataatagaaacaactagcaaaaaagtgctggattatgggattgattgatggaaactggcatgaaaagtttcaggtcggtcaaacagaaacattttgcattggaagaatggtccacaagacatacgtaagaaaggcctaagatgtttacaatttccattggacataaatccaggacagaatgacagaaagacaatattatattttgtataattccatagacctggatgtactggtatcacttaaaaaaatacaataatcccagttattcaattatgttgtcacccttcgtgaagaataatggaaggaagaatagggaaagcgcacatgaagaaaacagagtagacacgaatacaaacaaagctgagaagcttaactggtagtgtaagttatagatatcaaacataatcttaaatagaagcgttcatgcaatatttagacaccttgcatctttcaaaaaatacattgtcagttagctaaatgtaaaaaatggtttgctgatgcaaacagcaaagacattctgctcaaggcctcaaaatatagtaaaattaaccatacagacacgctcaaactgtcatacaatatgtctataacacagaaaagtgctagaaagatatatatttgcagacagttaattagcattggtaaatggtaatta

SEQ ID NO: 37093 - DNA, 757 bp, Oryza sativa
cttgtcttttttttattaattaggcagattaacatgactccatgagagttgtcttattacaattctgtcccatattgaaggctatcagcagctttatcatttatatacatagaataataaactgtagtaatgggaaaggttggaggctgggaaggcgacaaggaagctggactgtaatttattgctggcaatgacccacatggccacatctgcatgcttgccgtttgctgaactgagtgatgtgcatcttagtttatcctcactgcagtacacagggaccttaactgagtaccctttatttattaccatgatctgactttaacctgccgagaataaagaatgaagaaccatagctaactgattgcttaactgcttgctaaacctaaatttggtggagactttgatcaataagatcaggttgacaaataaagcctagaataggttaaattcacaagtactgcatgttttggcataaactatggtcagtctaggaaatatatttcattagtacataagacattatttataacagcacattgaattgaactttgatgaagataagttgagaaccaagcagtgttccttcccctaatttgttctttcaactgcaagtaaatatataaccagcacattgagcgacatactcaatgaccgtagattatgtggatagcaaatcagtattcatgggttttatcttaatgttggctgcgattttcataggaggaagaagttcgcctgagaaaagttgccctaaata

SEQ ID NO: 37094 - DNA, 1501 bp, Oryza sativa
cctggcgggcgtgagccggtggagagtcgccgcagctggcgatgccgtgcgggcctgccggaccgtagcagccgggcggcggcgctgcgacaaaggtccctcctcggcgtcatcgtcgtcctcgtcctcgacgaagctgaggcggctcgcgccctgacgtctcggcgacctgggcttgggaacgggaggggtttgggtcttggtggctgtgggcttggagttgctcgagtcgtccccgtaggcgtcctcggcgtcgtccgtgcggcggcggaagttcttccggtggctgctcatcccgcccgctcgccacgacggagcggcgaccaggggtaaaaaaaatctgcctagtttggggaactctattagggtttgtgcctagaaaaaaccttgggttcgagtagtgaggtaataatcaggtaagagaagaagggaatctcaccggcggcgacgggcggcggctagggttccggcggtgcggagtgtggagatccgcgtgcaaagagagagaaagatgggaggaaggcgaagaggtttctggatccggatccaataagaaaccgcctcccagctaaggcctggcccatatcggcccatgtggtgtaagtttaggcccgctccgcttcgtctcctcttggcctctcctccatcccttcggaaaaaccctagcaaatccccgcctcgatcggaaggagaccatggcgacggcgaggctccgatccgcctcctccctccgcggggtcctcctccgccactgctccgtgggaaccacctcgccgccgcaagttttctcccgcgtctcaggttcgcctcatgcttcgaatctctccccccgtggttctctccatagttaaatctgatccgcgtggtagtgcccagctatgagctgcgaaattgttgtgagaacgggcatacgattccatggtgcacaagttcggttctagtttgattaggtcctgggctcctggaggtgctgtgccctctatgtagtgctaatgttatctgactgactagctatatgttcttctatgttgtgagtaatctcggaatttccaagttagattgtagttggtggttagacttcggtgagagtgcatgtgtcaatgaaaaggtagtttaaatgacagtcctccacatctatttcagggatgattttttctaactccacccacaatccaacataatctgtggattcaagcttctaccttgaatttcatgatttattatctgctattctctacatattactctcgtgagcccccaatacctctttcggtttcacatgatttagttttgccagttacatgtgtctaattgtactgtattgaggtgcatttgttaggaagatgtgttatagtaattcaacagggcgcatggttgaagtccaatttaccactgtatgttacctcaaaatgcttaatagcgtaatgatcttcctttctgaaagcaacatgctcctttgctaacttaatggtttctgaaccattatcttggatagccgaag

SEQ ID NO: 37095 - DNA, 436 bp, Oryza sativa
tcaattctacatgaccccaaatcaaagttgaattggtggcaaggtacagtgaattcgagacaagtggtggggggaaaaaacgagctgctacagttgtttctccacgacgcatgaacgcatttttaaccgtcaaaatccttcagatgttcactgctcatgctcagtatacataacaacaaacgaccatgtcattttccgggcacaggaggaagccattaattagatcagggggagaaaaataaagtagcaagcagacctaccacagcacatatacatgagtcactctcaactccctacttatctcgagaaggcttatctcactctctctgcatcgcatggaagccactaaagccaggcttcatccaaagatcatggccataggccggggaggcagtgttagttggctgtagccatcagaatttcagaggtttatgca

SEQ ID NO: 37096 - DNA, 218 bp, Oryza sativa
gctgtagaaggctattcatagtcatagctttactgttggtctaagtttggtcacgggtactattcttaggctttcctaccgctgtttctgcgaatggttagcgttgaaacgcagaattgtacaatctttttttgcgaataggttatcaaaccaagttttgatcatttgctggcatctataaagctaaactgacttccttacattggaggttggtggaa

SEQ ID NO: 37097 - DNA, 1501 bp, Oryza sativa
ctccacctcatcatgagcactcttggcactagcgctttataccttactgtacattctctaagtagcacgtaggcgcataagccttcatcaatgagtcatgggcagaacaatacttccgttctaacttcacatccctatgcttcacacctctgaaatgataccctcagaatacaataatagaattatcattgagaactcttattactactatgcaaacgtggtgaaattacgattgggatccgcacaaatagtaaatataagtagatactgtttgtaaactgacaatcttgcaagtgtaagagaaaggtaagaggcgcatacccatcttacggaagtagaggaagttggtgacgaggcgccagatctcgtagtgctgcaccaccagcttggggttcagatacaggtggtagggcgaaatgatctgcgaggcaaggagggcattaggccatcagcgcaggcactcaaacaagcaccagatcgaggagagagtagaatcatgtaaagaggggcgggcggagagagagagagagagagagagacctcgagggtgcagccgacggtggtgacgacggcggcggtgaggtaggagcgcgtgatgatgggcatctgccggtaccactcctccaccgcctgcgccatctcccgcgaaaccctagcgggcgagctctcctctctcgagtctcgagtaaaccctaattgacccgaatcgaatcgccgatgagatgttggcagcggaagggggaaggggatggatggagatggagatgggtcgcaaactcgcaacggaaagctgcgtgcattggtgtctccggtggctgcgtgccttcctgcctgcctgcgtgtcactgacatgtgggggccacgagtcggtcgcattgacgtggtgtgttccagtaggatagcgacacgtcagcgcacacgttgcaacgcgccatgtttcgttgacaattcaaatctgacctggtatgtactcctatgttgttgtagtatgttgttggtcaagccagggattacaagtggtcatatagaaaaaaataaaacgtggatgttaattatatgtggttgttccttctctataatagatactccctccgtttcataatataaatcattctagtattgcccatattcatatagatgttaatgatatatatatatatgtctggattcaataacatctacttcctccgtttcatattatactagtaagactttttagcatatgtctagatttattgacatatatatatatgtgcctagattcattaacatctatatgaatatggacaatgctagaaagtcttataatatgaaacggagggagtatatgaatatgggcaatgttaaaatgacttacattatgaaacggaggaatcatattgtattgttttggtgtaagtatgcaattggttatacggagtatatggaaaaactaaagtaacacttacaatctactcctgtattttcttactagcttaacaacttaactactccctacatt

SEQ ID NO: 37098 - DNA, 1501 bp, Oryza sativa
tcactgtatcacgacataattctttttctaacgttcgatcttctttcaacaacttcacttgagtctcaaatttttccagtgcgtactacccttttttttaataactaaacattattgcaatccagattattaagctggattataataagttataataaaataagttattagctgtttgtttctttggattattagagacatatattattggtttcgaaaggctgatgtctctaataccctaagctattgtggagtgggagaaggatgaaatggcggcgatgacgatacggcttggggaagggttcgcgcgcgactagggagagaggaagcggatgcatgcgcggctgggggaggcgccggattcgcctgcactgtggagagaggaagcggatgtactcaatctattgggttcgatggaagtggtgggtaatttgcatacaaattttaagattagtgggtctttagccacctactaatttgaaagaagcacgtttagaggagattatcatattatactaatctagcttatagattattataatgatctacatgattgtttcagattattgctaataattcagattataataattctaagctgaaataaatagggcctaaacaatgtcatataaataaaaaatgtagggagtagttaagttgttaagctagtaagaaaatacaggagtagattgtaagtgttactttagtttttccatatactccgtataaccaattgcatacttacaccaaaacaatacaatatgattcctccgtttcataatgtaagtcattttaacattgcccatattcatatactccctccgtttcatattataagactttctagcattgtccatattcatatagatgttaatgaatctaggcacatatatatatatgtcaataaatctagacatatgctaaaaagtcttactagtataatatgaaacggaggaagtagatgttattgaatccagacatatatatatatatcattaacatctatatgaatatgggcaatactagaatgatttatattatgaaacggagggagtatctattatagagaaggaacaaccacatataattaacatccacgttttatttttttctatatgaccacttgtaatccctggcttgaccaacaacatactacaacaacataggagtacataccaggtcagatttgaattgtcaacgaaacatggcgcgttgcaacgtgtgcgctgacgtgtcgctatcctactggaacacaccacgtcaatgcgaccgactcgtggcccccacatgtcagtgacacgcaggcaggcaggaaggcacgcagccaccggagacaccaatgcacgcagctttccgttgcgagtttgcgacccatctccatctccatccatccccttcccccttccgctgccaacatctcatcggcgattcgattcgggtcaattagggtttactcgagactcgagagaggagagctcgcccgctagggtttcgcgggaga

SEQ ID NO: 37099 - DNA, 902 bp, Oryza sativa
tcaaatttgaatttgaattatatccgattcaaatttgaatttgaattcaaatattttctatatatagtatttctatacatctaaagtttatacacctaaagtttatagacccaaagtttataagttaaaagtttacatacccgattcaaatttgaatttgaattcaaatttttttatatagtatttctatatataaatttttctaacttttgtttttttaaaaaaattgtgtggtgcactgcagtggaaagagaagaaggggaggaggaagggaacaagagggaggagtatagggggaggggggaaaccgatcactgggcaatcgccctggcgatcgatcgcccattagcctcccccggttcaagtggccttcatgagtttttttttatgaaatctgcttcacaaggaaattagtaaaatactatactcctgcgttaaatatgattcaaatctataatttcatgtttgctgtaaatgagtactaagtctgatttttcaataatgctatatgggttttctccccctgaacttataaatgtcactcttgcacgatgcgtggggagcaggcaggagagcacgtaggcacgtactagagcgaagggtcgcacgaggggatgttctgtttcacgtgcggacgtttgcacgcggcacaaacacatttgtgattattcacaatgtacacccatttaaaggaggtggcaatttattgaggaaagaattggaatatagccggaagtacattaaagagtcgattttcatgatcaatcgcattgaatttagaatttattacattgatcagtttccttttgaaggtcctttctcttctataaatctcagtgtacctggaggagccaaaccacaaaaaagcatcattagcttctccccggcctgagaattcccga

SEQ ID NO: 37100 - DNA, 206 bp, Oryza sativa
agaaatggttagtacgtgctcatgatttgatcgttcttggcatatatgttagcaaagctacacggtttcagcttgtttctgtagcttgttggtctgtagccaagattcagttttgtctccatgttcagtgatgaaacaccatgcgtatacatggcagcacatgaaactggaaactaactgacagcatgtaacttgatggttgcagt

SEQ ID NO: 37101 - DNA, 258 bp, Oryza sativa
acatttgtgtcccaaaaaaaggaagcacagatcataaaaaggtagacaagatcgaatcaaacttctcaaaataccataatgtcttgacgatgacaagtagggtctggtacaacattattttattttagcaaacttataaattattaagacaactattatggtattatcaaatcttgcccgcgtattaaaatgcccaggtctcgcacgctagcttctgatcgaaaccgtctacacgcagtcgacgtctacgcgacaagc

SEQ ID NO: 37102 - DNA, 287 bp, Oryza sativa
tttgttataggtccttagttctaacttttgcgtgcttacttacaggtcctctgtagaaaacaatattatatacgaagaagcgaaaaattggaaaatcgaaccgtgctctgaaaactagaagattaagagtgtttttgcaaaacaaaaacaaccctaacccccttcctcgaaccctagccgccaccattcatttgcctcctctccttctctcgctccgctctatctcctgcccaagcaatggccgccaccgcgtgccgcctccctcattctcttcttcccgcaagtga

SEQ ID NO: 37103 - DNA, 404 bp, Oryza sativa
cttccagtggctgtatttgtgactttgtgagtctatatgattatacggctgtgtttagatccaaagtttggatccaaacttcggtcctttttcatcacatcaacctatcatacacacacaactcttcagtgcacatcatctctaatttcaaccaaaatccaaactttgcactgaactaaacacagccgtatttctactagtccagtctttttcagcaataaataaccatgcatgactgactaatgctggaactgaatgctgagcttggactctaccgcttctgtcgagtgtttccaagtcaacagcatcacagtcaaggacaggtagctaaaaaaaaaattctttgtattattgttcatgtcatttggccatctagatccggctctgcacaagcccacctggca

SEQ ID NO: 37104 - DNA, 1501 bp, Oryza sativa
aaataagtgtttaatgcaggcttcaaggaaggctgttgtttttgcagttgattttatttgaactcttttctaaaaacaactaagtgagtgcttctcaaacgacacggatgagacagtgcgtctcgtccggtcggagtatgtgtaatgtatcagtctttagaattgattcaaggttggcacccggccaacagcttttcaaacggccacccgggccaacaactttcaaacggccacccgggcctagctgatcccatcagctgcagatttttcaatcatcgaacccctttccacaacagcaatttcacaagcagtagtcaaacaaaactacgctaggaatcacctcacatccgcccatgaccgtgggcacggctattcgaacagcttgttaacctctgcagagggggtacactttacccacacgacattactaacccggatctcccagcccatggggatccgccacgtcgggagacctccaagctttcatgacaaggcatttccaaagccgacacaggtttaccatatgccgacgagaggggtcccagaccaacaactggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgttcggatgaaattccaaggaaacggtccttaggtgcaagagcgggaaaccgtacacccggtacgttccccggtccgcggttttggaaattcatttagttcgcaagcaccgacccaggtgtcgggttttccaagtcttttgtaaaacccaagttttacccaagaagtttttcagaattttaagtttgaaggcgtccgtcgatactcgcacagggtgcacgaatatcgagacgcaactagatggttacaaggggacacgatataacaattatcaaaggaaggatcaaatgcaacaaattaggtaggtccgccaatctgccttgcagacgggacaacagattaagtgcgatcctatcaatacataatatttttcaagcaacataattaaatttcaattataggctcaagatgttcaaaggtggcttgccttgctcgagatctagagcttgatcctcgaaatcctcgcactgcgggtcttcgggctccgaaactacacgcaaaacgggacaactcaacaaacggcgaaaataaagccctattaatgacctctaagcgtgccattagatagatctcgagatttgaggaattttggaagttgaacggagtcaaacggatttacggttgggaagatattgaatttctaatattattggatttttggtctaaaggaaaaatgatttaattaaatcctttttggaaaagaaaagaaaagaaggagggggaaaattagacttccctcgggcggcgagggcgcggcccgagagaaaggaggcggctcggccgagctaac

SEQ ID NO: 37105 - DNA, 309 bp, Oryza sativa
aggtgcccgaccccttgtggggtttgcactatgtacataggtggggtgaacacggtagggctcacctaaccgcattattgcggtctggtcaagcgtgtcacgctgcatgcagcgcaatgcagcgcgctcttttatccggtctgtgaccagtcacagaccggtcagatcaacggttaggtggcgactggcggtctgacgcacgcctcgccccgtcccgtcaagacgagagcctctaggcactcgtccccagctggagctagcgtgatacatcccagagatggcacgttagccccgatcgatatatgccag

SEQ ID NO: 37106 - DNA, 1501 bp, Oryza sativa
atattatctatctatacatacaggaattaatccatccatatgtaatacgctgtctcttatttgatctctagctcgtatatactccatctgttacacaatgtatgcatgtatgatacaacttatgttcccgtcttgatacaatagcaatatattactactagaaggattaattgcatctgtatactaccacgcgtcttcagttctgctctatttactggttcaaaagaaattgcactgcaaaactgttcatgagagacaatgtgctaaaaaagaacactttacacgtgtagcctaaatatgaatatgttatagtaaatgagaattcatttttacgtctttaatttatacagttatgaggtagtacactagttataacaagagtttactgtagttcgacttgaataattaatgtcaacggactatgtagccatgtccatattgttgtctttttcctagctcttacatgtttctaaattcgccaatcttctttttcgataccttggcgttagctagaaacctcttgggttttatttttcctttacacatggttcttggctacaatatcgggcaatatctgatataccgttacaaccaagtctgacaaacactactgctatggcttctttttataacaataatcattcaatgtacgcctaactagaacatataaataatattttaatctaaagttataacgactagaatagttagcattaacacgtatcattgtcctattgtagctgcttttcaattgacgtcatagaatctatggcattagacacatctttagtgtgcccgctaatatgtttaaactgtttttatttgtaaaatgagatttatatcatttttgtgaagaagtatacatcaattataaatactctcataataattgttctttttaaatttctatacataatatttggggatttgtcccacaccgtatatatttgagtatttagcagcaaaagcggctgttggctgtgtgctgcacaactctagataggggatgtaaataatttccgtaattgaaaaaatgctctcataatataaattcatgagagtagtataacacatgtaaaacaaacaggtaataactcaagtaagtagtacttagaagtaaacaacacggggagtatatatatatcatgaaaatgagaaaggaaacaaataaacaactagtggtattggaatgtattgatgtaaaataagaatacggagttgtagaggggggcagagtgaaaaagggggggcagcaagccgagcatcgcgtactttccccgcaaccccaaacaacaaggaaggaagacgctcctcccctcccatctcttaaaccccaaaaaaaccaaaataaaaatccttctcctccttcggctccgctttccttccctttcccgatagaaatacataccttccgccgccgccgccgccgccgttcctagggttccggcacctccccgaatccccccctcacttcgacccctgttcgcttcacccgccgccg

SEQ ID NO: 37107 - DNA, 1501 bp, Oryza sativa
attttttttaaaattacttttatatagaagctttttgtaaaaaaaacataccgtttcgcagtttgaaaagcgtgcgcgtggaacgagaagggagaggggttggaaacctgagcaaataacacagccaccatacaccacgagaggcagtaggttgggtgattatttctactgtacatatggcgagcgcgcgacaggggatcggaggtcacgctctgttcttggatctccattctccaacctctctaactcagccttgccactttgccagtagtatacaactacaagacactgcagatcgacactcttgctagtaataagcagtgcagcgcgcggccaattaaccccaagatatatatttttcctttacctcttctttcttaaatcggtacacggtacatatatagtcccagtgtaggcgatgttacgtttgtgccgaatcctgacctgtttgctactccctccgtcccaaaatataagcatttttagctataaatctaaacacaatatttttagctataaatctagatacatatgtaagctaaaaatacttacattttaggacggagggagtatacaccttgtcccatcaccatctactcctccgtttactatgcatatatacgtacacaaggatctatacaaatacatagctaaagatagggatagtatctattttgagatagggatagtatctatttttgaaatttgacaatgtcaaaatttggtaaggttttttttggcatcaaagtgaataggccctttatgccattttcaaccttaccaaattttggtaaaattacttaaaaaaaagtggctacatttagtttgctgccaaattttggtaactatataaaaaatcctaccaaaattttagcaagttgccaaaattttaataatatgccaaaattttaataactatgccaaaattttgatcatgctaaaatttggtaaggttttttttgtcaacaaagtgaacaggccctaaaccccaaaattccattccatctgtgatgatctataggtagatagtcggatagagcgacacgtggcgaccactattacgtacgtaagctgtgaggtcactcgatcagtttgactactggattaattatcggctgggccgcagactaaactctggcaacgcggttttgctagctcccaatacgagtatattattactccatgacgatcatcttaattaatctgtcctacttaatcggatgcatatactccctattactcgtaaagaaaatcgtttaggacatcaacacgatctccaaaacacaacttttagttcttgtttctataaaaatatttattgaaaagtgatatatatatatatatatatatacacttttatgaaagtatttttcaagacaaatctattcatataattttttacattttcaaactcaacaacttaagtgttattcatgatttatattcctaagatttgacttaaatattatcctaaacgacttcctttacgagtacagaggaa

SEQ ID NO: 37108 - DNA, 169 bp, Oryza sativa
acgttcgatagaaaacaaaatgcgggacggctgcgtatggtgggacccagtcatttaactattcaaccaatccatttcccattcgccattccccatccttatctcttatgtcttatcttcttctccccattttcttctcgccatcccggtgaccggagggcaccgcagg

SEQ ID NO: 37109 - DNA, 1501 bp, Oryza sativa
aactaaaactcgcgtctgataattgaatttacatgtgagcttgttattgagtacttctttatgtaattttgaggatagattactacctattaatttaattacgattagtaactatggagagaatgatgtagcacttggagagaggctagaagatggaaaaggtcgtcatggacgttcaagccaagatgaaggtccgccttatatcgaatttgagtccacctcgtgctccaggagcaatcgacactaaaatcattactcagattgcattcggactccgattttgacgttctatatgtatggaaagctaacgagactatctttccaatgggtgtggtcacacgtcaaaattccttccgagttaatggaaatcatcgaaagaagaaggcgttcagaatctgaccaggtgttgtgtcaccatctttgggcccgttgggccttgtatcatgtcggagtccgatgaggacgcgtccaggggttcgaggtcgatcctagaacctatatattcagtagctatcattgaattagggttgggtttttcttagattatttctgccatcgcagtttcgtcgctagttcggtttgtggaatcccaactttcagttcgtgattaatcattcatctgcaattgagttgttgtctttcttgttcttgattttgttctccggttcgcacgtagggattagccttctcggcgaggttaaacgggttttgacacggttaataactagagaagacgtggtgctacgacggattgtgttgattgaaagcatgatcgtgtgtgtcaagtttccaccatcaagagtaatcgatcttcacctgacggaagatcagacatcccgtttccatcaccattagaactaataaatggctctcctgaatttcgttgaaattcgttaggattgtcttaaactataggaatttgaaagatttttaacatgaggttcatccaaacagcaactccttattgattttaaaccgttgaaaatttactttgtgcctgcgcatgcaaaagcataagaaaataaaggaacgactagcttagtgtggtccttgttggtagatgggagacgatcgatcgagctgtaacttaattaatttcccttaattttgttttctggatgtatgcatgcataatccttgattgatcttttatatgcacgctagctacctagtagcagtactgttttgtctttgctaatacatgccaaatatatagctagctctcgtcaaagattctctagctagcttgtccttaatttgttaatcgtcataattagtagttgggaattcgttagcttcggttgtgacctatgcaatccaacaatgttgctcgcggaaaaaaaatcgtatacagtacacccatcatttttaatataagcaattgaacattttgaattttgacgagcgagaaaataaaaaatattagtcatgtaagatgatattgctatatttatcattaaacaaaactatcatgatgtgaaactcttctatttaaaacaac

SEQ ID NO: 37110 - DNA, 186 bp, Oryza sativa
atcccaaaagcgcccgaatccactaaagcccacgcgaaatccccagactgcctccacgcgcgccgcccgcacctcgcaacccccaggggcgtttccgtccattcgcagccgcgcgagttttagctcccgaggcgtcgaggcggaggggaaggagtcccccaacccccgcaacccccgtgccctaga

SEQ ID NO: 37111 - DNA, 235 bp, Oryza sativa
tctgtatgatacgattataaaaatctttcgaaagatgtataggtactcccgaattgcagatgatttgggccatccaaccggtgctggctgctgaagcccaactcaattacgcaaaggcgacatccatgacgacttggcgtagaaggcccaatcgccaggccgcggctccggttacagccgtgacgacgaagcggtggctgtgcgcagatcggagttgcggcagcggcggcggcga

SEQ ID NO: 37112 - DNA, 249 bp, Oryza sativa
cgcccatgcgaaggtggtggggtaaaggtccgcggctccggcgacgggcaggcgccagatccggtcgccccgcttggccgaggcgaccggcgacgggctcggtcgatgccggcgccgctccacggacctggcaggggggtggctggcggcggcgatggtggcggatgtagcggcgacgaagttggcgacgaaggcggcggactacggcgcgtgccgcgacgccggccctcgtcaagaaccttgccgcca

SEQ ID NO: 37113 - DNA, 154 bp, Oryza sativa
ccggtcacccaaccacctcgtgtcgtggccgttgaccgatcattgcaccgccatagcagcctcgctcactttgccttgctctacgccatccattgctcgcggcttgctgctatgccgaccgcatctcctatgcgagaaaacgacgctaccatca

SEQ ID NO: 37114 - DNA, 509 bp, Oryza sativa
tcaagaaataatttcctacttttaagtgaactgatgattacagatggattacagtatctaaacaaaaaaaaaacataccaattcgtccattccaaaggtaaattaaccgagcaaaactcacctgcccatagtacaggaagggacaaatgcagcagcaaacacagcagccacaccagcccccatcagcaccaaccttcccaatcccctcaccacaccccggccacagcaataatgccggaaaagatacacgaagtagaccggcgccgccactaggaacaggtgcttcgagcacagcagagcagcaaaaacgactccgccggcgagatccctcccctgctcaaggaagtgcagcgacagcagcagcagccccatcaggaacccgttgtactggaagtgtacgtggtccacggcgagcagcgccggcgaccagaggacgagcgcgagggagaggaacggccgccgccgccgccgcgtgagcgcgtccgtggccagcaggaggacggaggaga

SEQ ID NO: 37115 - DNA, 1501 bp, Oryza sativa
cctggcgggcgtgaggcggtggagagtcgccgcagctggcgatgccgtgcgggcctgccggaccgtagcagccgggcggcggcgctgcgacaaaggtccctcctcggcgtcatcgtcgtcctcgtcctcgacgaagctgaggcggctcgcgccctgacgtctcggcgacctgggcttgggaacgggaggggtttgggtcttggtggctgtgggcttggagttgctcgagtcgtccccgtaggcgtcctcggcgtcgtccgtgcggcggcggaagttcttccggtggctgctcatcccgcccgctcgccacgacggagcggcgaccaggggtaaaaaaaatctgcctagtttggggaactctattagggtttgtgcctagaaaaaaccttgggttcgagtagtgaggtaataatcaggtaagagaagaagggaatctcaccggcggcgacgggcggcggctagggttccggcggtgcggagtgtggagatccgcgtgcaaagagagagaaagatgggaggaaggcgaagaggtttctggatccggatccaataagaaaccgcctcccagctaaggcctggcccatatcggcccatgtggtgtaagtttaggcccgctccgcttcgtctcctcttggcctctcctccatcccttcggaaaaaccctagcaaatccccgcctcgatcggaaggagaccatggcgacggcgaggctccgatccgcctcctccctccgcggggtcctcctccgccactgctccgtgggaaccacctcgccgccgcaagttttctcccgcgtctcaggttcgcctcatgcttcgaatctctccccccgtggttctctccatagttaaatctgatccgcgtggtagtgcccagctatgagctgcgaaattgttgtgagaacgggcatacgattccatggtgcacaagttcggttctagtttgattaggtcctgggctcctggaggtgctgtgccctctatgtagtgctaatgttatctgactgactagctatatgttcttctatgttgtgagtaatctcggaatttccaagttagattgtagttggtggttagacttcggtgagagtgcatgtgtcaatgaaaaggtagtttaaatgacagtcctccacatctatttcagggatgattttttctaactccacccacaatccaacataatctgtggattcaagcttctaccttgaatttcatgatttattatctgctattctctacatattactctcgtgagcccccaatacctctttcggtttcacatgatttagttttgccagttacatgtgtctaattgtactgtattgaggtgcatttgttaggaagatgtgttatagtaattcaacagggcgcatggttgaagtccaatttaccactgtatgttacctcaaaatgcttaatagcgtaatgatcttcctttctgaaagcaacatgctcctttgctaacttaatggtttctgaaccattatcttggatagccgaag

SEQ ID NO: 37116 - DNA, 1501 bp, Oryza sativa; identical to SEQ ID NO: 37092

SEQ ID NO: 37117 - DNA, 1501 bp, Oryza sativa
gcacgcgctattagaaacaaactgcagaatattgactcctaagctacaccaaagttgtttgttatatcactaaataaaagttgtgccacaatcaacactgttgagattcagaagtttcctatactacattcaactagcaatccaaataggacagataacttgtatatatcaagacagtagttaaaggaaaacactttaaggtgaaatgtggtaaaaaaagagagtgaaaaaacagggcatttaaccatgtataacaaatggtagagaacttaataaatgttcagggcatagaagcgaattgtaaagctataactaatggggaggagataggataggaaaagaaagaagtgtgagcaagcccatttcaatcggtgtttcaatgctaatgtcctaattgcaaccagctgtaatctgttcatatgtaatccatttgaaattgcaagcataaaggataggggaaaaaatgcatttcgtagctatctctgccatctatttaagcaatggcataaacaatcgtagttgatactagacaggcaagaatgcactcacttgtcgacagaatcattgatttttccttttatgacggctcctttccttggaatcttggtctgcagcaaagcacaaatcagcacagataagcatgaggaggacgaagatgaagacgaagcacagggcaatggtgctcacgtcggtgagtggcacggagcgtatcctgacggactcgatctcgccgaacgccgcaaactccttggtgagcgccttcctcttggtcttgagcggcaggttccccacgaagaccgtcctcagcagcttgctctcgtcgtcgaacgcctcctcctcctcttgccctgcccccgccgccgcagccacctcttcgggcaccttcctcttctccccgacgaccggaagaggaggcgcgggtgcgccgccgagcctccgccgctcgtggccggcctcgacctcgtcccgcttcctcttgcgccggggctcatccctgcgcgacttcgcggacggctcagcgacctcgggttcggggtgcttgcctcggggcgccgcggcggtgggcgccggtggagcgggctggtcgtcggagggcttgcggcggaaggggttgtctgcggagaagagggtgcggatggccgcggcgtcgtcggacgcgggctccttgttcttcttcgccattctcgccgccggtgcgaggcgacggcgagacggtttgcggcggcggcggtggggttgggattcggaggcggagggggaaactcttttgttgcggggtttcgcctagttggaactcgccccagaataggggacaggctggggcgatctcgaccgttggattcagatcgaacggctaggatttgtctgtatccttggcacgagccgcggtggcatggtagaacaaggggaggacaggaggaggagggggttttctagggtttctggagttcgacgaccgccgccgccgtcacgctggttcccatcgccgaaggagagagga

SEQ ID NO: 37118 - DNA, 1158 bp, Oryza sativa
aaatttaatatatatgatatacatgcctactatttatggacaggctacccgtgttctgttttagtgaaggatacgaaacattttttatacatctatctataagaatgaatccctctgggattgctggaatgtgaggggatccacgtcacacaagtatatatattattcgagccattttattaaaacagtgtgacacatatgaatgtttgaatctactacatatatatgaaatttgtactgaggtagaatagaatcatctcgatttctcatgttctttttcctcttctttactctagccatgtgtttctatatgcagatcacaagattatgactatgctagcactagctttgcacgcgagtttaattatattgtctggattgatatatctttttatcctacaagatttagcaacaacctgactgtatatgcgtgatcaacatgaggatcggtgttgcttgtgagcattaagccaacaataaagcgatacactttggatgcagcgagacaattagggaagcatgcaaaaacgatcaagacaaatggtaaagcaatgcagctatagctaaaggacttaaagtagccaaacacgcgatacatcataacgatagatgtatctcgatgcaagaatatgacgagccaggacagtaaagcctcggtatatcgatcgattccagctgtggcacccatagagaaatgagcccgtcagaagatgtatccatagatggcacgcggggcataagcattcacaattggaaagatgaaacagaccatcggaaacaaacaacggtaggagttaaagtagagatggagtcttccctgacaagtggcttgtgtgcacacgcgtcccccctatttaacccaaccctccggcctacatcttcctgcattcatcacaacaccatccatcaatcttaattcgcttctacattggggtgcttgttaatttgcatgcgagcttgttgaggtatatatgttcaatatatgaagagtactatagcttaattatgtttgcactatctagaagttgagatttttggcatttacatactacatcgatttgctaaattaatttggttaatgatttgcttatatagatagatatatgtattattggctatatatgtcaggttgaagctagcgatcgttgagagcagtag

SEQ ID NO: 37119 - DNA, 1501 bp, Oryza sativa
ggattttatgaggacaacattgcagaagcaggcacctggagatgtctgagaggaggcaatcatgcgatagaaaacgcctcaacattgcagaagcacaaggttgtagcagctcatgttttgaatatgaaacgcgtggggactcttggtgcattattgatgtttgaaattggctcatagatgtgcatggatggtggagcgatccggcaggaaatatgtagcgccttgttcgcattttttgtgaatgttgagctgctttggtagtgactagtgagttcgtttgtagtactagtagcgagggaactgtcgtttgtttagatgagcaaggaagaaatgcctttttgtaactcaggaagaagtcaaagcagttgtgtaacaaaccactttgccatgttgctgcacatttttggtcgccctgtttatgatgaaggtgagcaatacatgagaggaagaattcatcgcttttagttgattcaaatcacagttttataatggaatatgtttaggattaggaaagaaacaagtgtgtgagaatatgattattattccacggtattcacagtgctgaatcctagtactactacatctgtcctaaaatgttgctacacacatcctaggataacgaatctggatagacctcccatcctctgtccagattcgttgttttaagatgggtaggtagcaacattttgggacggaaggagtagctggtaggagcagtgatagtagtgatgagttggaaggtgcatggttgatgagagagagacgggtagagaggcaaaggacgaaagcagaagagtgaagtttggtagcgggtcttggaatcgcaccgactgggatctatgatgaggcggcacggcaggtcatccatccattcatccaggttagttgttgatgcctcgtccaaggcagctagcaggagtacgacattatcatgaatgaatacctaaaaatagcgtgaggctgtgtgttgcacagtgcatatgtgctggctggcttgtttttactgtgcttcatttttagcgaggggcggtgaatggaggcaaataataattaaggtggtggtggtcaaaaaaagtaaagggggaaacgctcgcgaggagggtcagggagggagactaggagtcagcctggcgttgctagtgttgaaggccagccagggaagaagaaaccattgataatttgacattcacaaagaagggaaggaaggaaggttccttcggcttggttgcctttgcctgacggtgaattgggttgggttgcgtcgcgttgcgcgcacggtcgtcggctcgcgctccgcctaattggttgacgttgctctcctcgctggtggtattgtatatagcgagccctacctactccacaaaaagagtcctctcctctcctctcctctcccttgccaccaccaaactgcaattaattgtttgtttcgcaaaacaagcatcctcgcctcggcgtcccagatctctgctgctgggctgggctgcctgcctgacaagagagg

SEQ ID NO: 37120 - DNA, 1501 bp, Oryza sativa; identical to SEQ ID NO: 37088

SEQ ID NO: 37121 - DNA, 1501 bp, Oryza sativa
cctaaatttgtctgcgctaattgcagttatgtattcatgaatcagaatgtcgtagcactagctagtcatataattaaattaaatgcaaatagctttatatattagcatatatatgaatgtcagtagtaccaattattgttggagatccaataatgtgaggggtacgctcggttaataaacaaagagaagaaaataaaactatgtatgcatcgcatcgagaggctggccgggcacacaacaaggaacggaaatgggtttttttgggccaaaatatgttttcgctgggtccagtcactatgacagccggcttaagtcagataccaacgaaaatatatcttcgttagcggctaccatatgacagtactttttccgttcctgtataactcaatgtagaatatgatatgacctattttaatataacgaatctatatgaaaatttatccaacttcattgtgcatggataacaatcctagattaaactattttggaacgaaaaaaatacaaatcaagaaatgaagcaaatacatactcctttcataaaaaaacaaatatagaattagatatgatacattattctggacaaagttatattcagattcgtagtactataatatgttacatctaatactaactataatatgttacatctaatactaggttgattttttatggaacggatgaagtactctatatcactagacagcacagctacctacctactaggaatagcgccattctcttctatatatgctctttaattttcaacagctatctaagctagtatagtgatgaatcagactagatgactacttatgtgaattatgtagcattcgatctctaccgaagcatgttttgataaacttaacgctctttgaaatgttgtatatgaaaacacaaaaataaaaaaaaacatagaaattaattggaacggcatgtttctcttatcctaatcctacataaacgaaaaagataagagagagaaggggagccttccgatagcatcacagaaaacaaaaggaagaagagaaaagtttccaacagatatgacgtcttcttatttatatatatgaaattaattaagatacacacacacaccatcctccgaaacatttcttaccatttcctatgaattaaatgattccatacttaaaaatttcatagaaaactgaatcctccaaaatttctatggcaatccttcatttcaaagggaccctataaagtgttaataatccattcgtttgtttgtaattttcgcctctccttttaaacagaaacgttcagacttaagagaagagcgcgcatatttgtccgcaaaactctcatcagtaaataacgagccggattgaagttaatttctttatttttcaccacgccaattcatcccttcttgatagtacactgtttacacatgaaaagaaatggttccaacaaaacttgcaatgcagaggcattaaaattagagtgctaactagctaaatcaatcgtcatgtgttgagttttt

SEQ ID NO: 37122 - DNA, 1501 bp, Oryza sativa
tggttacaaactaaacatattcatgtaccaaaatttggtaattcttatcataaaacagatggtcaacctaaaaacaaggaaaattttgctaaaatgataaacatcacaaaaacatatcacggctgaaaaacacttttaaaatttgataatttgctagagaacattttcgattcaattgaaaagagaaattcttcgaaaatatgagaatgacgggccgaaagtttctagtctgagaataccatgaagatagaatatgacgtattgctatataaagtaatggcaaatttagagttatataatttttaattttttaatcatataagaaaaaatgcccgtgcgttacaacgggtgaagtttattttaatcttattattattatatggtttagttaagatgaaattcactattggagttcccttggatatatattttttttagaaaatcatgagttgcagttaggagtccgatcatctcagcttagcatttgagttttttaaatagaattcttatatgattccttctgtattaccaaaagtgaacaatcttaaaaaccgactcaaatacggatatatatttccaaaagcaaacaaacttaaaaccgactcatacacgaatgacataccaaaataccggcaaaaacatcttcaatttttataatagtagagatttgcttcctgtagtccaactcaatgttttcatttccttatgtttatgtttctattatataggtaaattgagggtgatatggcatgtctatgtggtgattttggtggcaccaagtgctatgttaaaccacgtgatatgacttgtttgaacactataaaatattaagaactaaaatgatccaagagcaaaactttagggaacatattggctattctccctaaacgtttggcaaactgtagcgtaatctggtgtaaaagaaaaaatgaactgtagcgtgattttgctatatatcactcgaaagatttctttcttatctctcactcgattttctcacttaaatttacagtgtattttcttgtaagttacagtgtaatttataaaacttatattgtaacttttgtatgttacagtgtaatttttgaatctttacatgtaagttttgaaatttataatggatttggtctttttctttaaagatatggtaatattaatgtccattatgatgttttttagttactttttgtcttttactctaaagattaaaaatctgtatgatacgatcataaaaatcttttgaaagatatatagatactcccatagcaacccggcccatcaatatctttattacatcaaagtacacgatcgaggttttttgtttattcaaagtagggacccagttcagtacaaacagaaagtatgatagatcctttctacctaattgaagtggcatggaaaatttacccggcacccggccagtgatatatggagggattgtttgatcgatggatgagcacgcatgatatgatttacacacatctttgctaaagcttgtgta

SEQ ID NO: 37123 - DNA, 1501 bp, Oryza sativa
gtaaagtaccatttcctaattttaactaaaactaatagaattgataaaagagtaaactttagctaatggagtcaaaatatttaaacatgtattaataggacatactcataactgtgtacgtgcaggaccgtcccagggaatcgagctgagcggctgttcacaatcccaatatctagggtccccaaacaccatcgtgcacgggaggcccaagacccaagtagttaggtcgatcaagcgcttctaggctgctcggcccatggcgcaagtaggcgtgagagtcatggagtattcgcccaacatcgttttgctttcttttctcgaatcttgacgtttgactggactactagctcaccattgtctcgaccgaaatgctctgcaatgttggttcacaccttgcagcctcgcgcctgccaccggtcgtatgaaggtgaggttgcactactatagccataggctctcaccacctgcatgattaagttcttatatagtctcattctatcggccatcatctcatcaggtaaacgtgaactttgttcttataatgtaatttcatttcctaaattccaattttattattttcatcatgtatataatattcaactttcaagccatttgttttctaaaaattggatcagaaaaatgtcactctggttgtgaaaaggtaaaaccatagagaaaataaaaggtgtaatccaatactaggaaggagctataaaataaccatggactaatgtaaattattattattttatcatttaagtttacggctcggctatgatttcacacgggtctccaaatttcaaaggagctatgtcattgtgtatctttgatgttattggggaaaaagaaatattgaatggaaggaatatatgccttcaaacattataatcttctggataacaggactccggtagattatccaattctaataaaattagatcatattaattagtatatggattaataattaggtaattagtatgtattctatttttgagtaatttttgtttttttgatcgtcacggacaatatagaaggaaaaaaaaaggtgagtaacacaatctgatggtggaaatgaagatgggtgagtagtggtgatggtgatcacaagagagagtgttcctcgtttgcatcccatttttgtgggatctcccatgataatgtcggaataggacaaaaaaaataggccggaaatggtgatgcgcatcctaagttgcacggccgtcgatacaaacgaggcaaaaagcttagcaataagattcttccatctcctctcctcttgtccatcttcttcgcactctccgccgcccgccccctgtcatcgtcctcccgcgcgccaacgatggctgctcccatcaccgccgccacatcgcctctctcccctgcgtctcgggttcaggtatactaggtcaccccccagcttcatttcttggctagctacttcttcaatttgtgccgctcttcctttttttttcttttttcaagcaagcttgcccccctt

SEQ ID NO: 37124 - DNA, 185 bp, Oryza sativa
attgatttgttggtttccttgatgtaaaaagcttccatccgctcgcattacctttgttccttttgtcatgcatgatcaaggtctgtatatctcataataatctggtagatagatgataccagtgataataacaaattaagtaattaatatctgactcgattttcttaatttctctcttgatcaga

SEQ ID NO: 37125 - DNA, 1501 bp, Oryza sativa
tgtaagatttcatccccaagtttcattcgaatgccatataacaatcccgttattattagtagaaattttaggccataaaacatgttatgttactctcaggctcccactaagtcaaccagaaataaacttatcgactaataaaaataacatagacgaggtgaaggactggaagtggcccccacaagcacgtctagtagaagctaatgtggatggtgaaaacagagcaaagagcaaattgtttatggaccgatccgctccgagtttgactaaagtaaagatatggtaagcgttagcatccgaccacagatctaggatttaccaagggctgtgagtgtaaacggggtgtgtccgggtgtgcagtgtgctcgggagcgaaaaggaacatgatcgtgtatacaggtttgagcctttcgaaggataatacttactcatgttcttggtcggtatcaaagaagtttgtataaattaccaggtgccctcaggctagtctaggaagccggatgtttttgccaatgacatatggcatattaccaaaatcccacggtcgaatatccgatttcttatgtgggtcattcaagaaagggctatttggaagaaaagatgtaccatcacccgatacatgtatcatcatgttccattcaaatggcttatctattatttttaacttgaagactctatcgtgagtttgggagcctatctgtcggcttctttttgttctatattgtttatgtgagcaattcaactgtgtaaatttttaatacctcatggtaccttctcaagaaacataaaattgctctgtttatgtatgtatgttttatacgataattttgatccattcttaagccgtatctgttttgactctgtatcatttccgtcatccgcattgataccaaaattgaacccgctaaaagattgttgtgtaggatatcatatgagctctttatgtccgaatccactttatttgcataattgcatcgcgtcactggatctaggagcttcggcaagaagatgtcatgattatacggaaaacggctcaaaaaatacatccgtcctaaaaaaaattaatttttcatcaatgccaaaaaaaccaatataaaacaaaaagattaaaacaccctcactttatgaaatcctaatactattatcagatttgctagacaactgcatttatccactacttttaccaacttcaatcatttgcaacttgttttgagagacaaacaggagagacaaaaatgatcttattcattcagagaccataaagcagtaagagatgatttataagataaggattaagagaagttagggagtgcatttttaagacggattcgtccgacgtttatgtgagggtgaccagctagctgatagctgagtcaatttgtgtgacttaatttgcgaccacgtagcagtatatgtatagtattagtatagccccgaagttagttgaagacctcttggagtagagatcgaggaagaagaaataatcaatggagtgttggga

SEQ ID NO: 37126 - DNA, 466 bp, Oryza sativa
gttatggcccttttgtacttgattaccttattccttgataccttgggttattacaatttgactagttgagctttatttatattggttcaactagatattagatataattgcttagccctgcttagaaacattagcacacattcgggataactaatgactcactaatatttcatgatggtttcatgatagttcacgatggtcaatcgtgattagttaattaattaatgtgccaactaaaacctggtaatggtgggttgtgagcacatggttttgttggtcgtgctcatgacaattaaggaccggttcacgagtttcggttgtgaaacattaaccgtgccaaccacaagccagcatgggcaacgggctttatcttttgtatagcatggttcattgcggggcaccagactgagaagtggcggagataagcccacgggggtcgctggggagtccatgccttgtttataag

SEQ ID NO: 37127 - DNA, 1501 bp, Oryza sativa
ggtgtccgtggcggcgttccacaacgccacgttcgggtcgacgtacggaccactggaggagatggtgggaggcggcgaggcgcgctaccggagcatcagcgtggaggactacgtcaggctcgtcgtctccagcaagctccagggcaagaacatcttggacgctgtcaagattattactacgacttaatttctcatcttatcatgcctgctgattaatcaatcaatcaatctccctggttggttggttgctgccgagtaaactattcatgccacttcaattattagtaggtaaaaaggatctatcatgcatactactttccgtttttattggagtaaggtttatataggagtacctttgaataaacaaacaaatctcgtctactttgatgtaaaggtttgttgtatatgaggtttgcttcattgtacgctacagttgcctgagtatacggctaatgtacatgtgtcttgctacataaacaattagtaattacaaggtacacaagctttagcaaagatgtgtgtaaatcatatcatgcgtgctcatccatcgatcaaacaatccctccatatatcactggccgggtgccgggtaaattttccatgccacttcaattaggtagaaaggatctatcatactttctgtttgtactgaactgggtccctactttgaataaacaaaaaacctcgatcgtgtactttgatgtaataaagatattgatgggccgggttgctatgggagtatctatatatctttcaaaagatttttatgatcgtatcatacagatttttaatctttagagtaaaagacaaaaagtaactaaaaaacatcataatggacattaatattaccatatctttaaagaaaaagaccaaatccattataaatttcaaaacttacatgtaaagattcaaaaattacactgtaacatacaaaagttacaatataagttttataaattacactgtaacttacaagaaaatacactgtaaatttaagtgagaaaatcgagtgagagataagaaagaaatctttcgagtgatatatagcaaaatcacgctacagttcattttttcttttacaccagattacgctacagtttgccaaacgtttagggagaatagccaatatgttccctaaagttttgctcttggatcattttagttcttaatattttatagtgttcaaacaagtcatatcacgtggtttaacatagcacttggtgccaccaaaatcaccacatagacatgccatatcaccctcaatttacctatataatagaaacataaacataaggaaatgaaaacattgagttggactacaggaagcaaatctctactattataaaaattgaagatgtttttgccggtattttggtatgtcattcgtgtatgagtcggttttaagtttgtttgcttttggaaatatatatccgtatttgagtcggtttttaagattgttcacttttggtaatacagaaggaatcatataagaattctattt

SEQ ID NO: 37128 - DNA, 1501 bp, Oryza sativa
tgtaggctgtagtttgatgtgttttgtccatttatcactcttactttccataccggtcaaacaaacatatactataatagaataagtagtgcaatgctgtttaaagcaggctttctcgtgaatttgtgtatatgttatccatcgagctggtgtgatttttggtgtgaacctactcatttttgttgttatgttcaggctctgcagcttggacaggatgcaaattcgccctttggattctttaacgggcaaagatgtcagatgtgtctccggtctgacactttgttgaaagtgatggagcgattagctaatcctggtaattatctgtgcctagatatgcttcctgaaagcaacttttcgggttcaacttactaatattttttttttgcattttatattgttggtaggggtgcgccgtgttttcattgtggaagctggtagcaaacgtgtggagggcataatatcactgagtgatattttcaagttcttgctgagctaagtgaaaatgcccgagccatctgtgttttgttctcacaactgccggagttaacaatagcagaaaaaaattgtgaatctccaacatcgatctctctggcttttggatcagacaggtgtcttttcccgataatggccaaccagagtctgtaaagtcttttttttttcccttgccccttcgttaccaaaatgtctggtgatttttatttattggattgttttgctgcttgctcggtttctgagccccccaaggagttagtagctctgttgaaagggtgggatgggcgcttagagacatattttagcatgaatcatcatcacagggaagtaagaattgaaggaaagaggggatgctctgaagcaagaaggatgaattcaatgtgttgtttttgctcaacaaccgtttttttggcgggcagtgttgcaaccatgaaaggagaaattacagtcggctccttgcttgttagacaaaaaaaaaaaagaaaaaaaagaagagaaaaactattggatatctgatgatgtagtgactgagaagcaggagtggagttgtgtaaaacctgtaccacctgatttttatgtctaaaccgcagcttactcattttccttgtctatgattcttgcttgcttgtgtagtgaatagtagtttttcttgtctggtatctctctctggtagcggcgccgacgtgcggaggctgtttgtacaagttgagccgcatgcaatgcatgttgaggagcaactggaaatcgatttggaacttcattgatgcgtgcaggtgaaggtgaaggtgaaggtgcaggtgcagcgtgcggtgcgtccttggtccctgtcgagtaacggcgacgggcttggcgtcgagcggaaagatctagagagggtgggttacgtcgacagacactggataagatcaatccacatcgccacattactccgcccttttagacgcttgtctgctgctgctcatcagtagttcatcagtagtagtggtaggggagataattcgtcgttcgt

SEQ ID NO: 37129 - DNA, 1501 bp, Oryza sativa
tcttgagctcggatgtcgtcgatactccgttctccgcctcggcgggaggatttttcgacatggagtcgccttggtttgtagccactgcgttctcgtttccagtcattggcggaccggttgagatcggcgtcgtggtgtaaaccgggaagacgatttcgctaacttgggtccacaccagcatcgttgaagcagggaatacttggctgaggttggtgttgacgctgttgtcgacgaggctggatgacatagtagtagaaccttgagtaccaagggcccctacctggcgcgccactgtcgacgggtggtacccgtagaccggatatagagggtattggggtacgttggtacaaggatctacgtaatacgacatcaagcagacaaaagacgaggattatactggttcagaccccttggtaggtaatagccctaatccagttgatgtgggattatatagtggaaaacacaggttacaaagggaacaatggaacttgacggatccggcgagatcgtggtcgagttggttcgactagatccccggcgacttggctccttgcgggctccgacttcgtaggctgtgagggttgtgttggctctgagattcaatgccctaggtcctccccggggagtcccttttatatcgcaggttagacggtttccaagtagaactcggagataacagaccctatacgatacattgatgacctagtgttatccgagtaagactcttcccattcgtagacttcgtgaaggatttccttagtgtacgcgggaagtatccgtatgcgcgtgggtatgccatgccgatatgtaacgtatatcgaaaggtaaagggtatgcctaacccgtaaccctgacacagccaatcttgtgtggaagaatagagagtcacacattaattctgagaaagtcattaagatgataggttgttggattgaaatatgcctatcaaaaataaatttttcagatttggaaatatgactatcaaaagtagatggagggaatatatagcaggccagtccatgcattcattaaaattcaattttgtcccttttatgagtttactgtagcactacaaacaggtgcttggtttattttgaaaaatggatttatgttctttcaaatagtctacatttaaccgtacgcacaccacactcgcgcaccagtgtcaaccatctgcaaattcatagtcacaataaaatccaatagaaagcgcactgtgaccaaagtaatgttagtggtggacgtaggattctaaaaatgcttgggggcacaaagttgaaataggtagcatcaatatatgacaaaacctaaagcgtatcaaaggaaacaaaacatttttatgttgaaaataataaattacgtacactaagaaaattacttataattaattgtagttgttttttattgttatttgcaattctgaaagcaaatacagcgtgctgttaaccatatatatatatatatatatatatatatatatatatatatatatatatatata

SEQ ID NO: 37130 - DNA, 1431 bp, Oryza sativa
atttgttctggggatttctactgccagatagatgatgctcctcctgtatttctactatttaaattccaagttcctcttttgtatactatatactactgtagtagacactctagtacaagtgaggcaacaagtgctcatggcttgtgcttcctgagtgatggctaatttatgatcgccccttgtgttatggtggtactatatatgacatgcagcaagccactgatgatgatgatgataatggcactgggagcagctagctgagctgacttcgccagcgtcgtcacttcttctaggtgtgctctcctctcctcagggcgcaccggcgtccagccctgaaaacagatcagtttccttataagaataattaaatactactcttaattgatgttttggacaaggttgagatcaaatttttataactttgaccatcaataactttaaaaatatttagtttaaagaaactaaaacaacatatatagatttgtcttttaaagcactataataaaagtaaaacatgcatttatttattgtacatattataatagaaaaataaggtcaatgtccaaaatgtcaattaaaatggaatcgaagggagtactacctccgtcaaaatacttatatttttttaacgtttgattgttcgtcttattaaaaaaaatatggaattattatttattttgtttgtgatttgatttattatcaaaagtaatttaagtaagatttatcttttttatttagactaattttttaaataagacgaatggtcaaacggtgcaaataaaaagtcaaagcgacgagtattttgaggcggaggtaataaatattttaaaaaataaacttaacagatctctaatattttttacctgaagttgtcattctcctgccgtgtgtttggatggaagttataattttatctcgcatcttgtgtgcgaggacttattagctaaagcgatgtaagttccttttccttttaaaaaagttgtccttataagacatttctaattatataatcgttagaacatacgagtatgttactagtaccttaaaataatgcgatagaaaaatgtgtggttagaaaacgtattttccaaaacgtgggataaataatctcattttaataatttggaaaaaacatatccaattgctaccattattggtaatatggccttacgcatgtgtatattagcattatgatttatgtccttatactcctcctccctcctgtcctgtattcaaaaaaaaaaagaaaagaaaaagaaaggataggtcagtgaggttgagtcggtcgcatattgaaaaagaaagagtggcttggcttggcttggctcgcgcggcgtctccgaaattcaaacggatcgatttggttttgttgatttgatctggccggacaaggagaagcagaggaggaggagagttcgagatcgagatcca

SEQ ID NO: 37131 - DNA, 1501 bp, Oryza sativa
gagtacaaactataaatgcatatcgatcaagtgcgcagcaacagcgtaaagtgcctgttgtctccatgataacgagactggttaaataggccggttggccgatcaaactctacatcctacccttttttgccttgcccctcaaaaagataaactcctatatgtacacagtactatcaattaaatactccctctatctacttttgatagtcatatttcatcttggcacatagaccaaggataagtaattctacttatcatccatttaaacatgccactagtcattcctcgtaaacaagcgattcattaatatttacatttctcgatgcacatgcagcctgtcaacgggtggtacccgtagaccggatatagagggtattggggtacgttggtacaagaatctacgtaatacgacatcaagcagacaaaagacgaggattatactggttcagaccccttggtaggtaatagccataatctagttgatgtgggattatatagtggaaaacacaagttacaaagggaacaatggaacttgacggatccggcgagatcgtggtcgagttggttcgactagatccccggcgacttggctccttgcgggctccgacttcgtaggctgtgagggtcgtgttggctctgagattcgatgccccaggtcctccctggggggtcccttttatatcgcaggtcaggcggtttccaagtagaactcggagataacagaccctatacgatacattgatgacccagtcttgtccgagtaagactcttcccatccgtagacttcgtgaatgatttccttagtgtacgcgggaagtatccgtatgcgcgtgggtatgccatgccgatatgtaacatatatcgaagggtaaagggtatgcctaacccataaccctgacagtagcccccgacttctgcttaaatgaactcgtgtaaccattcgcgacttgttgtgtcgagactgttgtcgttcccggtgtgaggaccatagagacaggacgtagtcgagaacaccgtgtgaagcccaacggtcacgagtgaatttaaactgaagtccaaaaaactgccgcgcgtaacggatccagaaatctccggcgggcatctctcccctttccttggaagtcgtaccgtcggaagtgtgtctatttaaaggaattttggggatccattttgaagtccgcctattgtgaagaaaacatcccgcctgtaagcgctcttcgtcttctccgctgccacaagaaaccctagttcatcgacctgagccctttctctggcgatctccgatcaacgatggatctcggcaaatcatcctccaccagtgtgtcactgaagaagcttcaggaagacggcgcccttcctggtcgcggaaccatggaaagggaagcaggaggtactaatccccagcccgtcttaggtcgcatggttgcgatcgaagactatattctctgcggttttctccttgtgccttccgaatttcttctcttggttttgaacttctacg

SEQ ID NO: 37132 - DNA, 1501 bp, Oryza sativa
gtagcagagggcgaggcggtcggggaggtcggcggaggggatggcggcgtagaggttggcgaggtggagtaggcactgcatgcgtagcgtagatatatagagcttaattaattaatttgaagtttgcttgctcgatcagaagtagccgccatggccgccatagccgccaccaccaccaccaacacgaggtagaaggaggaggtgacgtcacgtcacctgcttgaggaggtggaggagcggaggggggatgttccgcatgtcgagcaggaagcagagcagcgccatggatctcgatctcgaactctcctcctcctctgcttctccttgtccggccagatcaaatcaacaaaaccaaatcgatccgtttgaatttcggagacgccgcgcgagccaagccaagccaagccactctttctttttcaatatgcgaccgactcaacctcactgacctatcctttctttttcttttctttttttttttgaatacaggacaggagggaggaggagtataaggacataaatcataatgctaatatacacatgcgtaaggccatattaccaataatggtagcaattggatatgttttttccaaattattaaaatgagattatttatcccacgttttggaaaatacgttttctaaccacacatttttctatcgcattattttaaggtactagtaacatactcgtatgttctaacgattatataattagaaatgtcttataaggacaacttttttaaaaggaaaaggaacttacatcgctttagctaataagtcctcgcacacaagatgcgagataaaattataacttccatccaaacacacggcaggagaatgacaacttcaggtaaaaaatattagagatctgttaagtttattttttaaaatatttattacctccgcctcaaaatactcgtcgctttgactttttatttgcaccgtttgaccattcgtcttatttaaaaaattagtctaaataaaaaagataaatcttacttaaattacttttgataataaatcaaatcacaaacaaaataaataataattccatattttttttaataagacgaacaatcaaacgttaaaaaaatataagtattttgacggaggtagtactcccttcgattccattttaattgacattttggacattgaccttatttttctattataatatgtacaataaataaatgcatgttttacttttattatagtgctttaaaagacaaatctatatatgttgttttagtttctttaaactaaatatttttaaagttattgatggtcaaagttataaaaatttgatctcaaccttgtccaaaacatcaattaagagtagtatttaattattcttataaggaaactgatctgttttcagggctggacgccggtgcgccctgaggagaggagagcacacctagaagaagtgacgacgctggcgaagtcagctcagctagctgctcccagtgccattatcatcatcatcatcagtggct

SEQ ID NO: 37133 - DNA, 1501 bp, Oryza sativa; identical to SEQ ID NO: 37086

SEQ ID NO: 37134 - DNA, 423 bp, Oryza sativa
gccgtccccgtcccagtcgccgccgtccccatccccagccatgtcgccgccttcccgtccccatccgcgtcgccaccgtccccgtccgcaccgccgccttccccatccccaagcgcgccgccgccttccccgtctccggccgcgctgccgccgtctccgtctctagctgcgccgccgagccgaacggagaggaggaagacagagaggagagatgagataggataagggtattttggtcatctcaacaagaaaaacattacaaaaaacattaaactgagaagaaatggatggaatggcattgcaacaagttgcccctgtttgagggtggcattttaacgaaaccacttttgggagtggcattccagcgaaaccccgttttgacaatggttaaatgtcaattttctcgttgggagttgggaggga

SEQ ID NO: 37135 - DNA, 1501 bp, Oryza sativa
cattatttcctgatagatagttaaaagtgtgatatatatatatatatatatatatatatatatatatatatatatatatatatatatatatatatatatatatatatatatatatatatatggttaacagcacgctgtatttgctttcagaattgcaaataacaataaaaaacaactacaattaattataagtaattttcttagtgtacgtaatttattattttcaacataaaaatgttttgtttcctttgatacgctttaggttttgtcatatattgatgctacctatttcaactttgtgcccccaagcatttttagaatcctacgtccaccactaacattactttggtcacagtgcgctttctattggattttattgtgactatgaatttgcagatggttgacactggtgcgcgagtgtggtgtgcgtacggttaaatgtagactatttgaaagaacataaatccatttttcaaaataaaccaagcacctgtttgtagtgctacagtaaactcataaaagggacaaaattgaattttaatgaatgcatggactggcctgctatatattccctccatctacttttgatagtcatatttccaaatctgaaaaatttatttttgataggcatatttcaatccaacaacctatcatcttaatgactttctcagaattaatgtgtgactctctattcttccacacaagattggctgtgtcagggttacgggttaggcataccctttacctttcgatatacgttacatatcggcatggcatacccacgcgcatacggatacttcccgcgtacactaaggaaatccttcacgaagtctacgaatgggaagagtcttactcggataacactaggtcatcaatgtatcgtatagggtctgttatctccgagttctacttggaaaccgtctaacctgcgatataaaagggactccccggggaggacctagggcattgaatctcagagccaacacaaccctcacagcctacgaagtcggagcccgcaaggagccaagtcgccggggatctagtcgaaccaactcgaccacgatctcgccggatccgtcaagttccattgttccctttgtaacctgtgttttccactatataatcccacatcaactggattagggctattacctaccaaggggtctgaaccagtataatcctcgtcttttgtctgcttgatgtcgtattacgtagatccttgtaccaacgtaccccaataccctctatatccggtctacgggtaccacccgtcgacagtggcgcgccaggtaggggcccttggtactcaaggttctactactatgtcatccagcctcgtcgacaacagcgtcaacaccaacctcagccaagtattccctgcttcaacgatgctggtgtggacccaagttagcgaaatcgtcttcccggtttacaccacgacgccgatctcaaccggtccgccaatgactggaaacgagaacgcagtggctacaaaccaagg

SEQ ID NO: 37136 - DNA, 876 bp, Oryza sativa
ccttaatacaactagtaaccagtttgtcgagatctcctcctccgtccattactgcttctatgattgctgcttctaatttctcctcctctacctctactaggagctcagctcggatccgtaggacaaacccaagcttggtcgtcggtgtgtttccggagaatgtgaccgcgccgcgccgcgccttctcttatcacaaatggcggctacaccagggagcagcaggccagcgaatgttgctgctgctgctgcgacggaggccagattccactcccacccaccacagcaggatagggtattactatatcttcttgctgctcatgcaattgcttcatcttttcttttctgttgctttttttcgtactacttgttacctgcaattgctacctcctgtcgaccttacaaccttttcctactcactcagtaccaactgttcgtactgtctccgtgctggttgcaacttgcaattgggccatcttaaactcgttgtagcatgcaaggatgttttatgtcatttcaagaccatcgacattcctgtcaattacatgatatgacgacaacattaattgtcttacttttgttaaccgcacacttctctttatgcttatttgttgttatattcagctcactctaattgtagtttccatgcttaataattagccaataatgctgtttgtctacacagatcataaaaatgacagggaagagctaaatagccctataaaaattattatagccttgaacggattagtatgttgcttttgaactgtaaattagttcattattcattcctggagttaactttatgtatcttcataaaatcaagctggaatgctggatgatttccccccccccctccctatttcttgcaacaactaa

SEQ ID NO: 37137 - DNA, 1501 bp, Oryza sativa
ttcagagacgccgccacctgatggtccgcgagcggctcgatgatgtcagtcagatgaagggcctacgcttaatcaagtcacgatgtgatctcggaaggaaaacgtagaatgcctatcgggtacacttacattgatggcagcatcacgttcagccgcacctttctcacaaaagggaacggggatggtactcgccgttgtcggaccactgatcatcacttggccaacacgacgttccacagctttgctgttcagacctgtgaatcgagaccaaattttgataaatcaagaggaacacgaacatgagcatgtctggataaatgcgagaaagataccccgaggagaaacccgggtcgcatcctccggtccggaataatcaaaggctggatgtgcccgagcctggagcggctggatccgcctaccaacgaagtctgcagcgacttcataccccgacaagcctcgtactcggagatcgtcgataatgtcgataaacgactggagagagggggtcaaagggggctttgcggtccaagacgaaatcttgtccggttgttctttgggaacaacgaagacagggtccgaatctttgatctgaaggtagaaccacctagtccgccatttgttgcgagaagaagggcactggaaggggatataacgcgacttcaggccatcccgaagtcggaacccgacgcaaccagacaccctgttggactccatccaacgcagctcgtagtagaagcgaaagagatcaagaaagggctctaccccaatgtaggcctcacaaagatgagaaaagatgctaaggaaggcgatagagttggggttcaaatggagaagagaaagaccgtagaagttcaaaaccaagagaagaaattcggaaggcacaaggagaaaaccgcagagaatatagtcttcgatcgcaaccatgcgacctaagacgggctggggattagtacctcctgcttccctttccatggttccgcgaccaggaagggcgccgtcttcctgaagcttcttcagtgacacactggtggaggatgatttgccgagatccatcgttgatcggagatcgccagagaaagggctcaggtcgatgaactagggtttcttgtggcagcggagaagacgaagagcgcttacaggcgggatgttttcttcacaataggcggacttcaaaatggatccccaaaattcctttaaatagacacacttccgacggtacgacttccaaggaaaggggagagatgcccgccggagatttctggatccgttacgcgcggcagttttttggacttcagtttaaattcactcgtgaccgttgggcttcacacggtgttctcgactacgtcctgtctctatggtcctcacaccgggaacgacaacagtctcgacacaacaagtcgcgaatggttacacgagttcatttaagcagaagtcgggggctactgtcagggttatgggttaggcataccctttacccttcgatatatgttacatatcggca

SEQ ID NO: 37138 - DNA, 307 bp, Oryza sativa
ttgggcgaggagtcagtcaggttcaccaaaccgtttttgtggtgttaccatcacctcacggtttagcggttatcacagtaaccccacagttacggtgagatatactgtggttttaaaaaataagaaagttatcgcacgtgataaccgcacgattttataaacgtgatgagtcaggttcgtcaaactcaaatataaacgcaagtagaagcagaagagactactctctaaccttccctcctcatccacgctactgtacttcagtatttcctcgttgaattaacctatccaatttctccccaattttagg

SEQ ID NO: 37139 - DNA, 1501 bp, Oryza sativa
ttgctttgcagtacgagataaaaaaaatgctgtgatatctcaaattactgaaaaagcactgcatgtgattctctctggagaaaaaaaaagcgtatcagcaacgaatttagtatgtgattaactgcagcgagcatcatacgtagagtacaataacaacatgaaacagagtatttgacaatcaaagcaaataatgatatgtactcattaaagggctttaactagtgacaatcaaagcaaaaaaaagacactccagtgtgacataaataaaatatgacctcgcaaaaaaagaattaaaatgtatgaaaatcaagtataaaacttgttattttataagtagtatagatagcaccaacaaatatttagtatgaacattcaataacaaccttaaaccatttatttagtttttaaatttaagcatgtgagaaattattggtgttcggaattttaaaggtatgagcgaactttgttataaacactaaatatttataaccagagtgagcacaagagtacataaaaccaaacataggggtatttttaattatagcaactaaaaatcttctaaaattcctgctcggtcaaaccaaacacaattttgaattgagtttcaggaagtccaagcattgggatatttttaatttgagtattagactaaagtttaaataaaccaaacacatagtatgtatttcgatccgttgtcctcaataaaccaacttttgtatttttttctgattgggagcaatttcattcgattagtatttttagatacggcaccatttacgtgtatatgtgtcgtacatgcatacccaggccttaatttttagatttgctttctcgttttctcccaaattctgttggtgtgtcagacaaacatcctgtactactccctccgttctattttaaatgtaaatatgagtttccgtgttcaacttgatcgtccgtcttatttaaaaaatattataatcagtattttttatgagatgataaaaatcaatagtattttactcgtaacttatgttttaatttttttttaaaaaaaataagataaacaattaaaattagacgcagaaaacaatagttatatttaagatgggacgaatggagtatcatatatcctaggattgaggaatggtcatttataatttagaagcgctccacttatcacctcggctatgtaaactctactggagtagccgtaagcaggatacggttgcaatattattccaattacagtatattaaatatttggtcatatacctccgttagaattgaggatttttcctatgtcgtcaatgcgatcacaaagaggttatttgatcaaattttgtcgatagtaaacaatgtatttagtaaattttgtcattatcaaactgtgctcactgctcctgctctctctatatataatccgccgaggacgatgcaccggcagcagctagcgcgcggtacggtaggcaccagctatacagcgcgccacacacaacaatggccggcgctaccgctgccg

SEQ ID NO: 37140 - DNA, 1454 bp, Oryza sativa
ctttccccacgccgggatcgagctccggggaggggagctgcgagctggtacgtacgcttgatttctttccttgccaccgcgatattccgatgtatccgtgatgtgtcgttcatgggtagatcggctagggatttggcggcgttgaggaaagcgatggctgaggggtggggggaattgttgtattagactctcgaagctgatatctggtgtggatttgcggtggaagccatggtcggaggcccagtgccttccgggagttgttgggttatcgggagcccggagggcagtgcggctcgccgactgctgccatgatccccgtcggcaaaatctccagattgggggagatggggggtaggaaccatttggattagtagtgtatacacggggtttcgtttattatatttagagcgctctacatgtagacagcacacagcagctttaacgtatggatggtgtatcgcagggaatgtatctcgaagacattggattaggctattattacatttagagaaccagattgggtttgcgataactagaaattgagtctgttatgaatttattgatggagcggacagggaattacgattactatctgtttagcttttcagttgtgaatgatgattatttcaatttagctaatcaaggttcctcaatcaaaccgttctaactttttctatttatgctcttggttacattttgacagaaacactttgtcatatcagtcaacagtagagaggagaccagatgcaggtcagttctaattcatctttggttgcacatttcttgtatagttagttaggtatgtaatgtgatggccaactcttaatcaactaattattcgggttatgttttactggtctcactgagacgtccatgctaaggtggtaacatttaataggacaatccacatttggcagcaataactgtactcatcttttcctttagtaaacggtttggcgcctagtatagggctcgcgtgtttgcatggaagagttggcactcggtagttggagagctttgccgacggttaccaatgtgaccagtactggtttttgtacacccatactttcttgtcgtcatacactagcaaaagtttgtgtacatcccttacttttactaatggctcaattatataacttgatttacttcactacaataaaacttataaatgtttggaagatcatgtccaagagactttcagtattattgttaactggaatgagcttaactactactccctccgtttcacaatataagtcattctagcatttcccacatttatattgatgttaatgaatctaggcatatctatctatctagattcattaacattaatatgaatgtgggaaatgctagaatgacttacattgtgaaacggaggaagtatgtgaattgctcctttagtttggttcctaacatgctatctgaatgtcttcaaaatattttctatcgaa

SEQ ID NO: 37141 - DNA, 1501 bp, Oryza sativa
agcaaagccgcgacggcatgatagtcaagttgggaactcctcgtagttcatcaagccaagcgaacctctgtaatcggttaagtgtgtggtatgttcagggaaaccctgggtatgctccgatgatgaaactgctctgaaggacgtaatgtcctcattaaaaaaaaactaggtgttcagtgcaaaaggctaaagtaaccagacattggattaaaaaaaagtcattttaccagggcgaaaggcctaaccaaaatggcatcagataaatacacaagaatggaatttcaaacatgtcactatggaatataccggtaagaaggtatccatttacatcagaataggtggatatggtgaattggtgaatcctcaatttgaaggaccttacagaatctccgtctcatccaattgtgttcatatacaaatcgattacctgcatttggactaaaccaagtatgtgcaggtataattcaatgatccacccatccaggttgggatgaacaagtgatcgtggaacctctgctttcccgattcatacgatgatgctctgaagttataaaaagcatcaggctccatgcctgttaagccccaagcatcaattcattaaaaacaatccacttctgtaacttggtctagttcatatgcagatcatagtttatggagtactacataaatgcaacaattttgatcacagaatagtgaatattaaacaaaattatgcaagtttgtaatataccaaacttgtcatgtttaactactttaagattcagatcatctttcctagcttcataagaatcaaaagtcaaatgactccttccgctacaatgcccagaactgcaatgatgaatgtcaaaacactagtatggctgacatggagttccagctcaaaacttatccagatctaaattgattatctactatatgtctggtgaccaaaagatggtcaaacctttcagctagtttacatcataaacccttttcttattagtcgattactccagccatctatgaacactgtgctccattatctaaaaaatgaacactgtgctccattctgacagcctaacaaacaagtctcaagtaagtaacttctgaggccctgtacagtgctccccttctgaaatataaaaccagctcggctggcttaggtttaaaaaaaaaagtaacttctgaggcttcctgtgtagtcaggaaactgaaaataccttttagtgaatcagaacatcacagtatcaatcataatttttagatagcacacaaattcatattgttttgatagaaggcctaaaccaccagggcaaagtaagagacaatcaactcccttaaatcaaacaagaccacactgaatgatcaacatggacatcttaatgaaaactaattggtcactgagacaaccgaatgaacatatacgctctaacccctaatgttaggcagaacgcaaaactatgccttggcaaggaggaatttgcagttgagatacaacaatacaaaggaccttacgaagtta

SEQ ID NO: 37142 - DNA, 233 bp, Oryza sativa
ctgacccaataacagatgggccagatttccggcccaagacccaccaccttcttgcggagcaatccatccatccagtctctttctctctctcctcttcttccttggcgagttgtgctctgcctccctctcccttcccacgccgtctcgccgcaatcgctcgctcggtcgcctcctcttccgccgcgagacacgaagagcagcagctcacaggtaggcctgcgcgtcggcggcca

SEQ ID NO: 37143 - DNA, 1501 bp, Oryza sativa
gttgtttttacaattgattttatttgaactcttttctgaaacaactaagtgagtgcttctcaaacgacacggatgagacagtgcatctcgtccggtcggagtatgtgcaatgtatcagtctttagaattgaaacaaggttggcacccggccaacagcttttcaacggccacccgggccaacagcttttcaaacggccacccgggccaacaacttttcaaacggccacccgggcctagctgataccattagctacagatttttcaaacatcgaaccccttttcacaacagcaatttcacaagcagtagttaaacaaaactacgctaggaatcacctcacatccgcccatgactgtgggcacggctgttcgaacagtttgttaacctctgcagagggggtacactttacccacacgacattactaacccggatcacccagcccgtggggatcagccacgtcgggagacctccaagctttcatgacaaggcatttccaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaattccaaggaaacggtccttaagtgcaagagcgggaaaccgtacacccggtacgttccccggtccgcggttttggaaattcatttagttcgcaagcaccgacccaggtgtcgggttttccaagtcttttgtaaaacccaagttttacccaagttgtttttcagattttaagtttgaaggcgtccgtcgatactcgcgcagggtgcacgaatatcgagacgcaactggatggttacaaggggacatggtatcacaattaacaaaggaaggatcaaatgcaacaaattaggtaggtctgccaatctgccttgcagacgggacaacagattaagtgcgatcctatcaatgcataatatttttcaagcaacataattaaatttcaaatataggctcaagatgttcaaaggtggcttgccttgctcgagatctggagcttgatcctcgaaatcctcgcactgcgggtcttcgggctccgaaactacacgcgaaacggggcaactcaacaaacggcgaaaataaagccctattaatgacctctaagcgtgccattagatagatctcgagatttgaggaattttggaagttgaacggagtcaaacgggtttacggttgggaagatattgaatttctaagattattggatttttggtctaaaggaaaaatgatttaattaaatcctttttgaaaaagaaaagaaaaggaaaggaaagagggagggataatagacttttcctcgggcggctagggcgcggcccgagagaaatggagcggtccgaccgagctaaa

SEQ ID NO: 37144 - DNA, 1501 bp, Oryza sativa; identical to SEQ ID NO: 37098

SEQ ID NO: 37145 - DNA, 1501 bp, Oryza sativa
agtagcaaatgccgtagcacaataaaatccgatgagaaaaaagaggatcttcagcggcagccctttccttagtttcttgagcttgccatataacttgctcaaaaacgactgaattgcactaaacaggcgagtgttattgtcgcctgattggtcagcactatcatcggtcatagcctcaatggaccattgcatctgcctgcataaaaagaggtttctgcattatacaaacaagcaaaactggcaagtagagcaaacgctataggtaatctcctgttacagtgtggtatacgttcgaacatttcatgtcatcaacaaaaaattggcaacactttaaagagtgttaactcaagcgtaaagatggacaaaaatgccaacaatagaaaacacaaactgcctgaatgaaataccgcagttcacactcttgactccggttcggtgccaactctatatctgaagattgacgacatataaagagagtgttaaatttgagtcttccatgatagaattaacacagccaactgttcagaaaacgcaatgttttttacattaggtgcaaaaaggagagaaaggcatgtctttatactaactgaggtcactgctacggtgaatttggaaagagtagctttagatccccattttagcacaaaattgtctgtataatgtccaaacacttggtgtggcacgaaattgacttaagtactgcctaataaacacacagcggcaaaattgacacattacacatcaggaatctagccatttcggtgcaaacgctgaacagaacactacctagaatttgtgcggaaggaaggagaagctcgcatcaagcagaaggtcgcttgcttcttttggtggggtgccgggattcccctccgagcgcagggcgcagcagcagcagcaagcttccgagcgcacggcgacttgatggctccatggcataagcggagagctgacatatgcggccggcgctacaggccactgccctgcaaacacaaggttccgagcaaaattccggtctttccatcagcgaacaacccaaaataaacccaatcaaaatcaaatcggatcaattgagctcatctgctcatgtttccaagtacccccagcctcactcgctcccatctaggagggcatatagaatagaagcagatagataagaggaaagggggtgctgacctcgaatggaaccacacttcagccggcggcgacctcactggtcaccaccggcggccgcagttgccatcgcggcggagagatgagaggtttggttggttggatggtggggagcgcccgacccagccgccgccttcgccttcttctcttcttgggctgggcccatataatctgcaatcgtgggccttcgccttcttctcctttttgttccgggcccatatgatatctcatctaatgggccaaaattcttctccttcctacggcctacgggtgaaaagggagagacgggggcttagctgcggaagctgaactgaaccccagccagcgaacc

SEQ ID NO: 37146 - DNA, 308 bp, Oryza sativa
tttcactcgaaaaaaacttgtggctgtttctgaagtacaccgatcaggaaaacaagttgagaaccattttatggaaaggcaatttcaaagcaaataatggatacggtcaacttaaatgggccaataaataatttactctttatatgtatgtttgtatattcagcttacctttgaaccagcaacgagatttgtcaagaagctcgtgtttcatcacttaacttggcttttacggtggcataaatgtaactaaatatcttttttttaaatgatttctccatacttactaattcaccatgattttttttacg

SEQ ID NO: 37147 - DNA, 1501 bp, Oryza sativa
agtagtgccggggatgccagcttcacaattaacagcgaaagagtctaagtagaagtgctgctggcacaacagacaagccagaaagctaatgcacagctagcataacagaaaacagcctaaaagatcaaggacacgaagacatcagctgcttgaatctcctgtctcgcggatattggcaagcagcgatcgctttaccttctccaactcctccttcagctgcaccggcgccaggtttttccactgtatcataaacgacatagctttgtgaggtaaaaacgtcacgttggtcagaagtttgtcgttaaaaacccagtcattcctcactagccatatcgaccaagcacctgcagcaaacaaataaaacaagtttttgttcctaactcccccatgatcttgaatgaagtctaagagttcattcctagaggtggggatcctatccaatggaaagcatctctaataggccccctttgattcaaaggaaattcataggaattctaaaggatttcatttctataggaatttttcctatatagccctttgaatcaaaggaatgaattttataggatcctattaaattcctatggaatgcctaatgctatgcaagttttggagaaaatctagcatgaggttctaccttatggaaactttcctatgagtcttcatctctcctctaattcctgcgtttttcctgcggtccaatcaaacggctatttctgtgtttttcctgtgttttgcaatcctctgttttacacttgcattcctgtcagaatcctatatttttcctattcctccatttttccattcctacaatttaaaggggccctaaaacaacaccataagaattgtgctggtaggtatctaaacattaggtgatctacatcttcctccatcccacaaagcttacaaaacgggctgcctgaccaattcatcttcttaagttgctttgccacttgaatcctccccttcagcattaaccacataaacacttttatcttcaaaggaaccggggttttccaaagctcctggagcttggtgcccttaatccctccaaagataatagccctgtatagagattttgtagtgaacgtccctgactgatttagtttccaaaacatagtgtcattttctgcagtcagctgtgtcgaagtaaagcatctcttgaagctccgaccactcttccagatcatttgggcctagagatcttctaagattaatcctccattccccatccacttgcatttgtttcgcactatcactaggatcagaacaaacactatatatgtatgggaactgaatttttagagggacctcccccagccaaatgtcctcccaaaatctaatattttcaccattacccacaacatatgcactgccaagcttcatccattttttgacctcatcagcagaagtttggaaaaaacctccaccgtttgacatatactttctcctaagcagatcacagcaaaggctgtttgcacccagattccaacttgtaaatcca

SEQ ID NO: 37148 - DNA, 1501 bp, Oryza sativa
ctccatattcgggtacatcatagagccgtaggccagactcagcttgagagaccagtggagagccggtgtgcccgaagcaatcgacagagttttacctttaactcaacactagtaaattaacccataggaatcctttttagtctaagcctacccttagttgttgttcttggattgaattatgttcttagatatacacacacattccctatgattcgatactcttggaatgctatgagaatgttaacgccaaaatttgataagattctttagtggattcggttaaggaaagattacaatcagtcgattaaaagcttatccagaagagaacgggttcgagaaggagtcacgaagaccacgacatagcagcttgagtttatatattaattaggcaagttttgtatttaggaaagtttgtgtcatgtccaatcagaacttatgtttttccttttatcttttggaaagtttgtgtcgtgcccgactaggactcttatcggcctatgggtataaatacgtacacccggggtccctgtaatctatctctcgatcaatacaactagtcttgacgcatcaccaccttattttccaaggtttttatttatcaccggcggaacttggcacttaacacggggctgcatcggcttcgatctccttcaaaggagtaagccctatgttccgtcggcccttgaattatgtcggctgcattggtgttattcatggctgtatcgctttgacctcttggatcactctggttcggttgatattttgcctaactgatatttcgattctatctttaatcacattgtgtttagagacacattagtttagttgagactgtatcggttaggtctggtcttctgtcttagacgatatatctctacaattacaatgttgttttaaatatatgtggtatgtccatcatgttttcataggcttatcggcttattgagtattagattattatatacaatcatcggttaggtttgacctactacattattgttgataatctaagtattgttaagtcgataggtttcttacctatgttttatcggagtgctagccaataaattatttgtgcaccagacttccagccaacgtaagttttaaccactgagccaacatttaatattcagcataaatatcgtcgattggttcatcgggcatctacttcattatattataatcggctgattggattgtttgttaaagttctatcattgtttatacaagtgttagaatctatatcggacatatagtcgattgttcaaaattctatggacattggctagtatcgatatcagctaatatcgctacatttgcttgttagccgatcggcttttcgatcatttacatatttatatgtcttgttagtcgcaggatcaaactgactagcacgcccgtatctcatcaataatttagaacctgcactagcgttttttttcggagacctgcactagagttaagcagatctcccaaacaattgtgttgtttttcgcgtcaa

SEQ ID NO: 37149 - DNA, 1501 bp, Oryza sativa
aaacaaaatggattcccaaaaataatttctacagttcccattcggtttgtataaataagttataggaaaaccaaacgaattttttcttttcctttaagttgtagagaaaaaacataggaagacttccgttcactcaaatcttttgaaaaaattcatatgaattgatacgtgcatttatttttttttcactttcctatttctatggattaaaattcctcaaactgaataaactagccctcgaatctaacgggttgtttggatcagggactaaaattttagtccctatcacatcggatatttagacactcattagaagtattaaatgtaaattaatgacaaaactcataccatacctggactaattcgcgagataaatctattgagcctaattaatccatgattagtctatgtgatgctacggtaaacatgtggtaattatggattaattaggcttaaaaatttatctcgcgaattagctctcatttatacaattagttttattattagtctaagtttaatacttcttattagtgtcaaaaacatccgatgtgatagagactaaaattttagcccttggatccaaacaccacctaagacacctatagatcaatgcaaggacggttgcgtacgtcaagcctgcacgactcaacttcttctccccattagtctagctcgatgggctagctccatgcctgctatcgaatttctctgggtctatttggtagagctccaactcctaaatttagctccagacgttaggtctagaatttagttgtggagcagtctaaacccagctctacatctctagttcattttgtgagagttccccatccaactctgatccatttaagttggaactgaaattgttaggctaggctctagctctagaagacgtgaagctggagctgagttgtgctaaagttatgctccagctccatgatatctcaaccaatataattcgtttccttcaactccaatatgggatatcttgatccctcaactattaaaaccgatgcaatttgactccctcagcagttttggaggacggtttcacggacgtgagtgttgacatggagtttagatggcattagaattaaaaaaaaatatgtgtgtgagccccattcgtcattcacacaataaaaaatatgaggcccccgtgccatctcccctctatccttcttgctcttccctctttctcccttctctctctatgtttctcttcctctccacttcggtgcaggatctggagcagtgttggcggcgaagggccgagggctagaaatcccggtaattgcggttcaagatacaaattagattggttaagggagctaaagtgaacttactgtccagctccagggctgcttggactgcaagcccttccgggcccaacttaattcagcctgcttcgagtccgccgtgtccaaagccctaaaaggtctttccttctccgctcgtcagcaagtgaaggggaaaatggcgtcgtccgtcgccgccgccgccg

SEQ ID NO: 37150 - DNA, 644 bp, Oryza sativa
cccatcgccgtcctcatcctgatcctaatcccaagcgaccgcggcgcgatcacgcggcgaccaaccatttctctcgtcgacgagacgacgtgcccgccgctcgccaccccccccacccgctcgcgcggcataaatacagcacgccacgcccatccctctccctctcaccaacaacagtaacccaaccagagagcttgcggaagcgggggtttggtgcgggcgcgcgcgtgtgaggggggagagaaggccaggaggaggcgacgccgtcgcccgagggaggcaaaaatccgatcctcctcctgccctgctcgctcgctcgctcgcctgcgctgcgcgcacttggccccgtcccgtccgttcccgctcgccaggtgatttcttgcagccatttttccccgagattacatggtttgtggggttagttgggtgggtggtgatgccattgttgcgtcgaatggcccgctggggttggatttgaggtcgcaatcctcgtcggtgtgccccgaatagagtgattcttgtctgcttcgggggatctcgatttggggattaggagaagctttacaatcttctcgatagtatacaagattttctttctgatttatctgctgtttttgcgctcaaaatgtgcaggcatagaaaga

SEQ ID NO: 37151 - DNA, 1501 bp, Oryza sativa
aaaacacccaatgcattgcattgcaacacgcacgcccggcctctctgcctcatcctgctactatacttgtactacggagtactactctactaggaggaactagctaccaagtagtactaggctgcaggatggctggcttggccggccagtaggaggcagccatggcttgctcactgctgcatgcctacccatcgtactagctagactgtagccgctccaacacttaggccatactatcgccctcattgtttggcttatttgtaaaataaaccaaacagcatatttgtaaatgagaagtaattcgttaataaaacttttatatacgtgttattagcgacctaaaagtaaaggctaaaaaataaactttgatgaaaaaaccctcaaaatcagcttcaaatttaaagttgaaaattcaaattttgactgataagcataagcgaaaagatgaggccgtatatattgccagcggtctcaaaccttcactttggaggcgacggaacgcccgtggtagggggaccatggtgtggcttatcatgctcgcagaggtcacggttacctcaacgcgctttagcttgggaggtgccaaaatatagtggtattttcaaaacacaaaacaaaacatattatcaaaatattttaatattagatttaataaaaactgatttgatatttcagatattcctaaattttttttatgagtttaatcaaacttaataaagtttgataaaaaaaatcaaacgaattttaatataaaacggagggagtattacacgatgcagccagtagtacgaacttgctttgcttgcagttgcagcctactgccactgatttgccgggctgcagtatgcattgcgtgcccggctatggctgcctgcattgtaccacggctttctaggaccacccggccggccggatacgcctctacctctacagtacatacttcacgccgtcccatgcatgcctttaatttgcctttgatcgattcgatttgatagaatctagttcgtcctaccagaaaccagaacacggcagacgcatgcaacaggacacgatcgatcgatgacatactactactggccgattcagtggagtatacgtactgtctaatcttgtaatatactcgctccgttttaggttataagatgttttgattttgtcaaaatcaaactgcttcaagtttgatgaaatttatagaaaaaatatatttttgacccaagataaatttcttaaaaaactagaaaaaaaatacccgtgcgttgcaatgggtgaagtctattttaatctgttgtatggtttagttaagatgaaatttatcgcggggagttcgcttggatatatatttttttagaaaattatgagttacagttagaagtctaatcgtctcgagttagcatgtgagtttttttaaacagatttcttatatgattccttcagtattaccaaaagtgaacgatcttaaaaaccaactcaaatataaatatgtatttccaaaagcaagcga

SEQ ID NO: 37152 - DNA, 218 bp, Oryza sativa
cctatgttggttaaaattgtgcttcactcaatgacattatgctggctcacttaaggtgattcataaattctgaaaacgaatgtacactacttcactcactatgccgatatattgtttcctgttatgcatgatatcttttttactggtcctgtccttatctgtattagacagctgcagcaggagtgggaaactactaacttctatttatttggaatttt

SEQ ID NO: 37153 - DNA, 211 bp, Oryza sativa
tctttccgccacctcggtacgtgttcgacatgctgcatatatttgatctgttcatgctttactgcttagtttatatgtgtagatctaatgatgcgttcatgctagtttacatctgcaatgtcatgattcatttatggaataaattaaatcattatgtgcttataatttcaacaatccaaaaaccttattataggcgctgtgacctttacta

SEQ ID NO: 37154 - DNA, 1501 bp, Oryza sativa
ggacattctgtaagtagccgtaggcgcataagccttcatcaatgagtcatgggcagaacaacacttccgttctagcttcacgtccgaaagaatcacacctctgaaatgataccctcagaatacaataatagaattatcattaggactcttattgggccgccttttttaaagcccccccttttaaaaatttggggcccccaaaaaaacccggttgggttaaaaaaaattacgattgggatccgcacaaatagtaaatataagtagatactgtttgtaaactgacaatcttgcaagtgtaagagaaaggtaagaggcgcatacccatcttacggaagtagaggaagttggtgacgaggcgccagatctcgtagtgctgcaccaccagcttggggttcagatacaggtggtagggcgaaatgatctgcgaggcaaggagggcattaggccatcagcgcaggcactcaaacaagcaccagatcgaggagagagtagaatcatgtaaagaggggcgggcggagagagagagagagagagagagacctcgagggtgcagccgacggtggtgacaacggcggcggtgaggtaggagcgcgtgatgatgggcatctgccggtaccactcctccaccgcctgcgccatctcccgcgaaaccctagcgggcgagctctcctctctcgagtctcgagtaaaccctaattgacccgaatcgaatcgccgatgagatgttggcagcggaagggggaaggggatggatggagatggagatgggtcgcaaactcgcaacggaaagctgcgtgcattggtgtctccggtggctgcgtgccttcctgcctgcctgcgtgtcactgacatgtgggggccacgagtcggtcgcattgacgtggtgtgttccagtaggatagcgacacgtcagcgcacacgttgcaacgcgccatgtttcgttgacaattcaaatctgacctggtatgtactcctatgttgttgtagtatgttgttggtcaagccagggattacaagtggtcatatagaaaaaaataaaacgtggatgttaattatatgtggttgttccttctctataatagatactccctccgtttcataatataaatcattctagtattgcccatattcatatagatgttaatgatatatatatatatgtctggattcaataacatctacttcctccgtttcatattatactagtaagactttttagcatatgtctagatttattgacatatatatatatgtgcctagattcattaacatctatatgaatatggacaatgctagaaagtcttataatatgaaacggagggagtatatgaatatgggcaatgttaaaatgacttacattatgaaacggaggaatcatattgtattgttttggtgtaagtatgcaattggttatacggagtatatggaaaaactaaagtaacacttacaatctactcctgtattttcttactagcttaacaacttaactactccctacatt

SEQ ID NO: 37155 - DNA, 1501 bp, Oryza sativa
ggtctgctcccgtccattatacacatagtctacttggtgatgtatatccgtggtcattttcttgatctgcattgaaccaagtagatgtatatcctcgataactttcttgagcttcaaaaagagccaaactagcagaggttttttatggctgtccatgccattttttattgtgctttcatgatgatgaggtcttgtctctgcagatctctaaccacttcagttgtttgtgaagatatctattttttagtggacgtgaattatctgcttggctatgaattcactatcaagttgctatgaacaactctaactctaaacaaagttgaccaataaagtagaattctgaactctgaactgtgcactgtcttggtttttagtttcctgtacaggacttttggtcagtgcatgtgacctgtagagtttttactgaactaagatgattagagataataatcgtacataacagaaatctgggatatataatctttcctgttctgtttctccttcaatctgtagcatgaccttatccttttcaggatgagagggacaccgtgtttgcaatcagcatgactatgcattatactgacaagtggacaaagtgggtttttatttgctgttgctttctaatcatgtcattgcatactggtttcagttggttttcttactgattatgcctttgcatactgatttcagttggtgtttcttactgatcatgtggttgcgtgctaatttcagttggtgttgtttactgatcgccattgcatactgattttagttggtgtttcttactgattatgtcgattgctatggtcagtgtgtgtgtgatattttgatttttctgaacagatcatgtcaacaggaatgccacctcgtggagatattcctacttgtgaagaagcaaactaaggctgagttcggcaaggagggttggaattgggaaccttcccctccgacacgtaaaacggatacgcggattagcgcatgattatgtaaaatcaaaggtgtttttgattattattctgtgatgaacaattggcattagagattattggttttgttatttggaatttatttacgaagtggttttggagatgattggatttacaggtgaatcacaggtgttattattttatgtgaccggtcagaccaggcaagggttgccggtcagactggcggtatgcgcgcggtcagaccggccagcccgcggtctggccggccgactctgtgttggtttcggtttcgggttgtttgtttggatatctgtgattatttcatgactatggtttctagatggatactatgcgtatgtaatactgttgtttgctaacgatgagtcaagttggagatagctttggtctcggaatatggtttctttgtttatttcatgtgtaggtgactcgatgcctcgggagagtatttgcggtgatggaccgggagtcggcttggggataagacgacgtccgtggtgggcagagatcatgcgggatacttaggctagagttga

SEQ ID NO: 37156 - DNA, 259 bp, Oryza sativa
ttacattgtgaaacggaggaagtatatgaatgtgggcaatgctagaaattcttataatatgaaatattcattaacatatatatgaatatgggcaatgctagaaagtcttataatataaaacggatgaagtacttggaagatatcagaagagcctgtgcaaaagtctataggcatgtcttgtaggacaatctctagttggaaaaaaagatgaattatccctgaactatcgcggtcgatcgaattacccctctgaacccgc

SEQ ID NO: 37157 - DNA, 161 bp, Oryza sativa
cttaagaggtgcgtatgcaaaaatacctttattttttcaggcggacctcttaagtcgtccgcttgtgaaaattggttgtggcatttaaatagatgctagaggaaactgaaacatcagatatttctaagtcccaaccccctctcttctccttagttcggcga

SEQ ID NO: 37158 - DNA, 191 bp, Oryza sativa
ctcaaatgataaatatatgaaagtattatatgtttaccgtgttttatctaagagtacatgagcttgtcaagttgtgtggcgagattaaatatatcattgctgattgctgatttgttggctaccttgatgatgtccatatgagagcatctgaacatatatccattgaaataatccaatttcacgtccttaga

SEQ ID NO: 37159 - DNA, 1501 bp, Oryza sativa
aacgcaaaggtggtctcatctggtcgcatcccggaatccaccattcgacggaagatcatgagaattctgtagtcctggaggtgagcagagattatagcattccaggactgcagatccctcatcgtcattgactcaaacaccaacagggcatggctctgttcgttcttatcagagtacatcctgatcagagcatttgctactgacagctctgtctcgagaccatgacgaattgcccaggcatgaatctccagtccccatttaccattgtcacaaaccaacggcagtatcgacagcattgttgataatgtaatggagtcgggctcatgttcttctctcagcattcttctccagagctccagagcctgctgggagagcccatgtcgcaggcacccagcaagcatgatgttccatgagacgccgtccctgtccggcattgcatcgaacacctggagagccctccgtacgtcgccgaatgtggcgtacaaatccacgagggcgtcgcacacaggcacgtcggacgcgagaccggcgcgcacgacgtcacggtggatggcatggccgagctcgaccgagccgacgccggcgcaggcctggagcgcgctcgtgaaggtgaagcggtcccgcgggacggtctcctcctccatctggaggtagagcgcgagcgcgtcctcgtggcggccgaggcgcgcgtacccggcgatgaggcagttccacgggaaggcgtcctcccgggcgcgcgcgggcagcaggtggtcgaacaggtggtgggcgtaggagacgaggcccagagaggcgtggaggtggaggaggcggcgggcgagcgcggggtagcggcggaggagggagacggagaggaggcggcggaggcgggcgaggttgcggcgcggggaggggtggagcgggagggcggcgaggagggagtcgaggaggtcgggggtgaggaggcgcgggtgggacccgaggtcggagaggacgcggtccagggtgggctgggtggccggcggcggcgcggcgcggagggtgagggccgcgccggagtggggatggcggcgagaaggtgggcctcgtcggcgagctggcgcggtggagcggcgccgccgctggatggcgcaggtcgtgtggctaacggttgctgggagcgccattttcgttggaccaatccacacccagagcttctagaagcagtctcattttttagcgccaaaaaaagaactactcgtggcaaatactccctccgtatttcaatgtatgacgctgttgacttttcgaccatttgttttattcaatttttttgtgtaaatataaaaatatttatgtcatgcttaaaaaacatttgatgatgaatcaagtcacaacaaaataaatgataattacattttttttaataagatgaatggttaaacgttagacaaaaaaaatcaacggcatcatacaaataaatatatggaggaaatactattcagtaaaagatggacaccacaagtccatcacaggatttaga

SEQ ID NO: 37160 - DNA, 504 bp, Oryza sativa
tactcagctaaaacaactcaataccaaattaatgcattgtccttgcatgagttcctgtttggaacagattatttaccggattattgctgtggattatctacttgaatatagtgctaccatgcatgtatgccataattatggattgttgctattttcaaatctgactaagtttttttgatgagttacagtgtagaacaatattgcactgcaaagtttcctattaacaatgctccttagctctgataatctgaaacctgaatttacttttttttctttatttacaaagttggagactggatatgaagagatatgatactttgatgctataatactttcagccttttacttaaattcttgatcaaaataatctatgcacttataacaccttactccttttctatttcataggtattcagcaaagatcatagttgttttctgaccttcaatggcaggaagcagtcctaaagcagtgcattgaggctgagcaacttgaaagtgtcaaca

SEQ ID NO: 37161 - DNA, 1501 bp, Oryza sativa
cctcttaaaaatttgtccaatgctcctttctaggcttttattaaaccatccactctttttcgtttttccccttttctcgctatccgatgcatactttatcgacaatatggcctaatgattgaaaaaattaacataactacagtgttttaactcgtataaagtatgctagaaaattacaaatctagatttagtatatcttaccaagtagttgattgcaagtatccgagtgcgcagcgcacgaccagtccgcaagtgcgtcgggacacacactgccattgttggttcatccaacactcgtccaattgaattagcaacaggcaacaaataacagattacaatttacacatggaatcatagttacaatttttcatatggcaatggtgttgttgctgctcactagaccagtaaagtgaatcagtgatcgtcgcagtgatttaggccgtgcttagatttaaacttttttctttaaacttttaactttttcatcacattaaatatttggacacatacatgaaacactaaatatggacgaaaaaaatcaattgcacagtttgtatgtaaattgcgagacgaatcttttgagcctaattacgctatgatttaacaatgtggtgctacagtagacatttgctaatgatagattaattaggcttaatagattcgtctcacaattttcaggtggaatctgtaatttgttttgttattagtttacgtttgatacttcaaatatgtatccgtatacttaaaaaaaattttggcacacaaactaaacacaacctcagcaaattagcaacagcaagacatcaatgaggcatgagaagaagtgtagaacacggcaacggcaagaaacctgcgcggctcggcggctgcgtctctggcgcctcgcatgggcgtcgcgcggcggaagcggaagtgcgcggaaacggccagcggacggcggccttggacgagatggctgaggtgttgcgacggtgctactgccagcggccgcgatcttgcgttcgcgacttcgcgtcaggacgtgagcggcggttcggcgtgatcgcgcgcgtcgatgccgtcgggattctcaggaactcggagcgtctccagcaactcatccaaattcgatcctgcatattcctatatggatggtcatccaaaaagattcatcttccatatctcttctcactccagcagatcatccaaattgcatcctccatatcacattcttctatattttataatatcttccaactaactttacatttgtatttgaagggatatattttgaataacttaatttaacggtgttatttatcgctataatatttcgaaatgagtaaattttaacagatatatttttaatggataatttttaactcatatatttaaaatgagtataaaagcaatgcaagtaacatatactactatatgctagtactactgctcaactatttcttctttttcctactagtactagttctctgcatcgttcttctttgttcctactagtactact

SEQ ID NO: 37162 - DNA, 1501 bp, Oryza sativa
tatttaataatgaatcaaatgatatgaaaaaaataaataattacttaattttttttaataagacaaacggtcaaacatgtactaaaaagtcaacggtgtcaaatattttgaaacggaaggagtatcatactagtctctatacaaatatttttcttttctttttgttactttatggaccctaaacactatgcatgcggtggaaaagtttgggagttggggaccctcgatttctgctaaacgacatgacttttaaaaaaaagaaaatcatcggattttcttagaatacctttgttaaattaatttttaactttcccattgtcggcattgacctcagctcagacgaggtgacgaatcctagcaaaaaccgtgttgctttcaatataagcagagtcttttgaccttttctctagaaaaaaaaaaagacgaggtgacgaagctgttggaaatttggtcataattcggcatattttaatccaaaataacaagataataaacatgatatttataatgggatttgatccagtgataatggtgaatgtaatcaacatgagcatgcttaacgttgaataagcatcaacaatcacataatgacacaatgttgacattgcgatgaacattaacagtaaaacttctaagtgaaataatgtaataaggttataccccaagaatggtcctccgctggagtttgaggcagtattgcctccgttggtgttgacgggagtctccttctccttgtctccagtgttcgacatgttggtgaagatgaagtagatgttgacgaacagtgagtagtcgcgccttgcgctccccaaaaacctgatcgcccgcccgtctgtgcaaacgtcgcagcaacgcgtggtttcggaggcctactctcccaacgcgtgtgcacacactcgtcgggatgggattaccgtagcaacaacagctttagaaaatggatgaaagtgtgtcttccttttctcgcgggagatcaaatccattcccattttataagaggaatggaagatgaagagtaagagtcatggaataggaagaggaatggagcaactaattgtcatcaactagccatgaaccatcctccactacacaaccatcaaccaacaatcaattaagagtaattgatgtaagttaccaatggaataggaagaggaatagagcaactaattgtcatcaactagccatgaaccatcctccactacacaaccatcaaccatccatcaattaggactaattgatattagttaccaattccttaatcaaatggattaattctcaaaactcttcatcccattgatatcccatagaagaatgaattcacatgaattcctagcataatgagccttggaatttatttgatttaattgatttaaatggattaattacccaattaaatctaacagaagctgagtctaaaggtgattcgattcataatgcatatgcagtccacttgagtcacaggactagctagctattcccgaatggacaaacgtacggttgc

SEQ ID NO: 37163 - DNA, 778 bp, Oryza sativa
aattaggcaacgtgcaagctttaaggcccaacatctctttaatggggcccaacatctcctaagctacccatgtctcaagccctgtttattatcatcacgttatcgtgcgaagccacggctgtggcctcatggcaacgtgttccaacggtttgttcagtgaaccgaagttactccgtttaatcggctcggttttcttttttatatagattcttcggttgcaatagaaaaccaaaatttattaaaccgttgaaaccgagctgaattaaccgagtaaaccgaacgctcacccctaccccaacccacacatacaaacgcacacacacacatcaatgttctctgaaactgatgtgaactttctaaacaatacggttcatctcctacctccagaaagtatttggcatgtcgatcagggattgcaatttcagttcaaaatttcaggcccccttgctggcaagcgattattttagtcgaaattttcggttttctcaaatttttgcaaatttggccaaaatttagttaaattcagttaaattatgctaaaattttgagaaaaaaaaaaggtccaaaaagtaccaaaatttcggatgaaatcaaaattgaaaaccctagtgtcgatccattagctcaattaccagcagctgtcactttagaagaatgcagttcacattcaactagcagcaacgcctcgagtgaaattcaaccccatatatactgagataccggccaagacacatgttagcacattagtatatagtacaactgctactgcagctatcca

SEQ ID NO: 37164 - DNA, 1501 bp, Oryza sativa
gcaattaaaacacgccctacagtgctggcatgagatcattgaccagatggcgataggcacaatagataagagacaaaaataaaaaagtttgtttcgttggaagctacttctattaagctaggtagggcgcgggacaacatgcaaaacgatataccccatattactctctccgtttcaggttataacatgtcttggattttagtaaaagtcaaactgcttcaaatttagctaagttaataataatatttatattaccgaattagtttaattataaatatatatcttctctactattataaaaattgaatatgtttttgtcagtattttagtacgtctgtcggtgatatgggaccgggagtatcatggccagaggcttgaggcagacgcaatcgcccacgtggcctggcaccttcggggacgtcgggcccgagggtgaggtgtccgccctcctcctgatctcccccgagggggggtcgggttgcgcttgccccggcccctagggccgaggcaccccgaccccttaaggacgtctgcgccacatatatgggataagtgagcacagctgtgctcacctaacagcatttattgcagtctggtcaagcgtgtcacgctgcatgcaacgcagcacagcgcgttcctttatccggtctgtgaccagtcacagaccggtcagatcacgggttaggtggcgactgacgggctgacgcacgctttgccccgtcccgtcaagacgaaagcctctaggcactcgtctcaagccggagctagcgtgttatctcttagagataacacgttagccctggtcagatttataccaggcttcatcctaaccattacaggcaaggtgttacacaaagaagggcgaacatgcatgttgttaagctgacgcgtggtggacaagaatgaccggtctggcactggtcgcgtcagctacgggcagccacgatcccacgttgcgcctgtctccgccgggagtggaggtaggtgtgggctgtcccatcggagtgtcattcggacagcaatcataccaatctccgtccataaagagaagaaaagtccagtttggaaagggaagggtgcatgtggtatccccttgaagtataaaaggaggaccttgcccatagagaagtggttggttgattcttttccagattgagagctgagaacgggggagaagtcgactcacactttgtagctcattcatacacaaatccacaaaaacacaggagtagggtattacgcttcgcagcggcccgaacctgtatacatcgccgtgtctcgtgtgtcttgcgggcgagtgatctttccacagacagagagagtgagagagcttgggattgcaccctaagcccctggtcgaaccggcaaaggggggcttgcgcagtctcccggtgaggggccacgagctccgtcatctggcgcgccaggtagggggctcagcgtgtgttttctgagctctcagactcttccgtgtgcgccaagtttttcttgttctgcctaa

SEQ ID NO: 37165 - DNA, 1357 bp, Oryza sativa
aaatattgaagattggaccaccacttgttgtaataatataacacggcatcatatttggtgacgcatgccgagatgtcgaagctcctgtagacgtcgtggttggtgaagtaggaaagcggtagtgaagacatataattgtgaagataaaagcaccagccggcggcggcataaccagtcggcgacggaagacgatgatgtccatcagtagtggtagctgtataaaccagacgtagaggcgagggcactagtcaacagcagacgagacgaccggcgatgaagacgataaggccaatcaacactagcagaatcatgcagccatggaagtgaataaaccagtcggcagcagacgtaggcagcttgtgttgaagatgctgacgcctattagcggtgacggcgatgtagccagccgtgaagaagatagcatcagttggcgtcataacaggccagccgtgcaggcggtgacaccagtcggcggcggatgaggcggccggtcagtgaagcggccggtcggtgaagacgtagacgcccaacaacggtggcataatagccagccgtgcaggcggaaacaccagtcggcggcggacgaggcggccggtcggtgaagacgtagacgcccaacaacggcggcataataggccaaccgtgcaggcggaaacaccagttggtggcggacgaggcggccggtcggtgaagacgtagacgcccaacaacggtgttgtgaccaaccaaccgtatagacgaagacaccagtcggcggcggcgacggcaagccagtggtgatgttctgactgatccattcctggggcgtaagagataagcttaaagccatgaatcccttttatgcatatctggatctggatcctgcagaacgaacatataggatgagtagtatctgatgtaaatataatacttcgagaaaaattcaagtattttaaaatatttataaatatgtatttcttctcttgtcaattttgattcccccgagcagatgactcattacgtttaaacactctgcccgactagtcatagccatcaagcaccgggagtcggcctaagcacttcccaaacatgcatatgagtgacatgagttcgtcattaatggaacaaagtttcatgggtcggagtttactactcgggtacttttgcaattattaagagcagaaaataaattatcttatctctatgcttttgatttattccgaataatacttagcaccttgcgttattcggtccatccaacaagcccctaggtgctaggaatcggcccaaaggcaactatccattggcaaaccaaacggaaagcataggaagatggaactccataactcgataggcacttttgtattcagaatatgtc

SEQ ID NO: 37166 - DNA, 636 bp, Oryza sativa
aggaggggctcgatcggaaaaaaggaggcattcgctcgttgggccactcggtcggcaccgccaaagcaggcgaaacaatcccttcaagtccagcacgagtcgtcgtccgccgtagcagttccgccggcgcccgaccacagccgccaccgcccgaccatagccggccgagcacaggtgccaccgccgttgcccgccgcccgagcacctttctttccgtcaccgccagccatcccggacagagcagcgccgctagccatccttcttatggattaggggttgattttgtccagcttcttgttatttgcagacctgttccaaacctgtattgcaccagaagtactgcattttgtatttgcaaactttcttatggattaggggttgattttgcccagcttgttgttaaactgcatcggtattgaatgcaaagctcacatgttgtgtgcctggatttgtacttgtgtttaaatctggctgtttcagttaaattgcatctattaatcagtgaatgcaaagctcacatgttgtgttcctggatttgtacttgtgtttaaatcccaaatatccatgctagtaagtgtatcagtgccaaatatgttatgcggcagaagcagaaacaccagctttcatcagtgaaac

SEQ ID NO: 37167 - DNA, 1501 bp, Oryza sativa
aaagctaggtaaaaaaaaaaaacaatccttctgttgtgcttcagattagcagtgctagtaccaaatcgctgcaccgacaaatcgccatcagattacttgttcagttatagttcaaagcttagtcttgcatgcaatcccgaaattggcggcagaatgacaggctcacgctaccctttatttagatgcctacttctccaatttgtttatataccgagaatgacagaagttggtgcttacttgcttacctcaaaatgacaagctagatacacgaaaaactacaaaagaatacgctgcagacagttcaatttaactctgaacaaggaacctattttgtcaagaaaagaggcaggctgagtttttctgaactttttctgaagatgcaagtagcgaaagatggagttgacgatgagatagcagagctagtaggtaaggtttgctcatcgatggcaacagcggcatgagctttgctgcgacttacacatgagcaaacctaacacggcaagtgcagcatcatactagtagcatatagggtgtggtggccatcagatggcgtctgacctagctagctagaagtcgctaatagcaccttagtcatttccttccggtagagaaaaaatcttcaccaaattaataattaatcaactctaacagttgcaggtcgaaattaccatcattttcttctacatgcggcgatagaccgatagtgaatgtttgttcgttttgtaagactcagcacgcgaatgattggcggtgtttaccatacagcatgaagccgtttgtacgcaacaatactttttttgacataaataagcaacaatattcaaagcatgaaaccgttttgtactcaaattagcaacagtatccaacgtttgattgtgcagttcttttcttcatgtcgaaccttattttcctacacagtacgagggaaattcagaaatattgtttctcccccatgtgagcaaacagaataaaaccaaccagccgtctgcaacactaaaaaaatcacctccaaagacgcgtacacaatgtcatgtacaggtaagtagcatagaaaaattcagttattgcagggatgcagggagagaattcagaaatcagaataataccccggatcgggtttattacgtccatctcaacagttcaacgcatcaggtccagtctacgcctaaacaaacgcgaacctacaggcagacagggtcggcaccaacaacccaacccatcctgagttcctgacagccaaacctcgacctccagctccagcagctagcaaatcaaagcaaagcaaccgtgtgttgcgactttgaaacctgtcacgctgaagcaagaggcacgcatcacactacaagttgtcatcacaccagcaaagccaaaactacgagtaaatcaatcagtgggagaggattaagatgatgatgatctgtctcttaggcctccatcacgcccgttaattccctttcaggctggtcttcgcctacctgttgctgctgctcctccatcaaat

SEQ ID NO: 37168 - DNA, 690 bp, Oryza sativa
cgcaacggcgggtagattgaccgcatgcatcttcattcagtcgtgccctagtaatcgttaagactaaatgaagatgtgcttagtcttaatgttccttctattatgtactgtgatgccctcctatgatgtaatcctatatacctatacaaatcatccccactactagaattctctgcttcctggtgcttccacgtcccccattttctccccaccgttcgatctcaatcaagcggtcgcatcgctcctctcctctcccacatctcgctgcttcaccggccccacgcgcatcaacccctctctcccgcatcgctcctctcctctcctctcccctcgcacgctcgcatcgattccctctcccgcatctcgctccgccgcccccttcgtatcaatctcgccgtgatcctctccatctcccacatcgtgctcgcccgtaccggcgctggcatgtcatccgcctcccgtgccacacagaggcaggatgagggtgtggcgcttcccttcccgtcgcccccatggcagctcgtgcgctgcttccccttcctctcccatgtctaaggttgttcgcctctttaggttgccatgattaatgaaaaccgttgacaaccaccgaggaaaacacttcacggctgttatcaagtaaatccattaatggcttaatgcgttttcttctcctcttatccctttatcagt

SEQ ID NO: 37169 - DNA, 787 bp, Oryza sativa
gatggtatgctagcaacttcaaaatctttgctgcttatatatggagtatatatatttgcatttgatcacccggtcgatttgctgatgcaccattatcatatcatatgtacctatagcctccttcaaactactgggtatatatgttagattagacttaataaggctagagtattgttttaaaacatcgtgtatttggatgtcaccccatgcaccaattattagaaaaccattgtaaccatctcaacttgaacatttgatatctttaatttcttttatataactaaactgtcaccgtctcatccactccaatagctactgcgttgtatgaaacttgctagttcttgtttagttttttgcttccaagatgtgttcctgcttactgctggcgtgtataatgaagtatggactcaaaaagtctatgggtgatggagtgaccaaattgctatttcaatttaccagttgtggataacttcacagtgaccgtgttttattttagtgcattttttgcttgatctttagttgtctcttcgaagttcttaagaaccttcatcattcatgggctgcctcctttattttgttctgagcttctaaaatggaattaacataactgatgtggctgggtttactctttccttctgatgttacatgcggttcttatgcttagtaccaaataatcacataaattgcttttgacatgtcagtctaggttgatatgtcatcatagtggcacccaaatgaaaataaaatctgcctcatatgtcaaaatcctgaatctctctctcatagc

SEQ ID NO: 37170 - DNA, 468 bp, Oryza sativa
gatcttccgaaaggttctgataaacaacgatttgggcagagtcgcgacacaaatcgatccggcttcttgaacgcgcacgctcttgagccccgcaatcgcaacaccacgtcttctctggttatcacccgtgtcgaaacacggatgacctcgccgagaaggctaatccctgtttgccaatcgaagaacacaaacaagagcgagatagaaaacaaccaaaattgcagatgaatgattaagctcacgagttggggtcttacaaaccgatctagcggcgaaactattctcgacagattaatctaagcaaaacccgactttaaacgatgacggctactgaataaatatgattaggaacgtcctaaggtttccatagggcgcacacccccttgggctaagcccacgacacaattacaaggcccaaaactcaaaatcagattcggactggatgaggtgcatgacttgttttgcaga

SEQ ID NO: 37171 - DNA, 192 bp, Oryza sativa
gtttagcatgccgcacatctgcccttcttcatacagtgacttccttgcaatggttgcgatgaagcctggcatgaatcgagtcgggactgacgtgctaactccaggagttaccacgccggctccagctagggacgagtgtcaaaaggctctcatcattccgacgggacggggcaaggcgtgtgacaggccgca

SEQ ID NO: 37172 - DNA, 299 bp, Oryza sativa
gaaatagtaaggtctcatcttgaggaccaaacctgtataagttcagtgttatgcattggtttaccacgcgacgtttgagaggattgcattagagatgttagggtgaaacaaaaagggggaagatgatggtcatgatttaacgatttctatgagataacatatgccatgaaccttgtattgtcaattttttgctttctcatgaatcatgttattattatgcatatgtttttctgccttctttttccttttcatagttgcttttttcactctatatttctctaaaataatggtcttacagg

SEQ ID NO: 37173 - DNA, 620 bp, Oryza sativa
cgcaaatccaagcagcgaagatagggagtcgttaccggcgagaggaatcgcgggcggatggatccccagctcggcgccgggcggccagatgggggagccgccgggaggaggtggcctaccgcctcggagggaagcgagccgtcgttggttggtccggttcgaggcggcggaaggcggcggcggcggcggcgagcgaaggcggggggtttctcgtgttgtgtggcggggagcgaatggaggtgtgtgtgtgcgtgtgtggggtgcgtcgccgagaagaaacgcggaagcagtcgtgtcatgtgcaccccaccacgaggagcgagggggcaggggcaaaggcaaaaatccaatcatgacgcgcatcggctttgatcgtgcggcttgggatcaacttgggcctcccgagtctatggtggtgggcccaccagacagatgattgatcacgatggtgcccttctcgtcaaggaattttttttatttataattttttttattaaaagttttacaaaaataattttccattttgaaaattaacggaaatagtcgcctaccgccctctgggagggcgattttaaaaatcgccctcccagagggcggcgaaaatgacgtggcagacggcc

SEQ ID NO: 37174 - DNA, 169 bp, Oryza sativa
atactgtagcaaaatccttacgtggcacccctcttcgctcgccccatgtgcgccgctttatatattccgattccgattccgtttacaggtggaattaatcacctgtggtgtgaacacatagggaagcaggggagggagctcctgctcctgcatgacgtcatccggcagc

SEQ ID NO: 37175 - DNA, 339 bp, Oryza sativa
cgacgctcccccgtccgaccgagcggaggacctcgccgcgaccgatcttggcggcggatctcgcgaatgtttttttttttctttttcttttttttcgagaggaactcgcatgaacctaaaccctaggaggcggcggcgtttggtttgaatggtggagttggctcgagtggaatggcatgacctagtagggtagtaggtgcgaggaggcgactgcagtctactgaagtcggcctgtgggctgtggtccgaacggaccaagacggcccgcgtcttggactacggagtgttcagttgagctgcaagttttacaggatttttttattattgtttttctaaaga

SEQ ID NO: 37176 - DNA, 560 bp, Oryza sativa
gttttgcctaattttttcttctgtggtatgtttgtgaacaggaagacaccattttattgaatgcagttgatggacgttcatacaatcagctgaatatcgatagggctaaatacaactcaaagaaagatgctgattttatgatagatgctgctgaaactagaagatgtaacgatcttacatttttcacctgtcaactatttacggatgcaaatatgtttctttctttgatcgctaatgctctgtttttaaattgtttatttgtagatgagttgattcacacgttcttgaaagataatcctggacaagtcacagagtttgggtatgcatgctagctataggtaaatacaattgtcattttgtttcttctattgacatttttttttaaaatcacagtttacacactttgaaagcagcaactcctgataggaagttgttcattttctttcaaaacgagcacttcaacgttgtatacaaggtattgtaatttacgagttgtgatacctgcctttttttaaataagcttggtatgctagttttcattctattttcttcttttcagt

SEQ ID NO: 37177 - DNA, 482 bp, Oryza sativa
tttcacattagtttacttgataaatttacaagctcaccaatttcatcaatagttatttaatcacctattgtgttgtgacttgattgtttagccaaatattttattttgtaggtttacttgaatgtattctcagtagttgttcttgtacttggtggtgcgctggcatgttatggtaagcatagcctatgtatactcatctataccataccataattatgtcgcaatattaggcatgatgttttctagtcaattgtttcaacctaagataaactcatattatcttgtttctaatccctcgcagtagattaaatattgaatgagtctcacagtcctatttcactttatatctagtttcacatccgccttactaaatattttgaccttcatctgctaccagtaatcctctcattcaacatgttcttgacatgcccttttcttttattttttatgatcatttaaaggtgcaatactattttcaaaga

SEQ ID NO: 37178 - DNA, 220 bp, Oryza sativa
atactcttgccaacgctgtgcccggctactcgcttctcgcgcccactatttcgccccctcgtttctcgcgcccacgctttcactaatcccattcgcccgcttgcggcgcatgaggtggatatgcggttgtggcagtcgagatagatcatatcgtgcgcgcgttaattacgctcgccgaccgaagcgacgttaccatatctccagacgaaacgaatcgcca

SEQ ID NO: 37179 - DNA, 361 bp, Oryza sativa
aaaaacccatgaggggtcggggctcctcggacctcagggccgacgggggtgcggtccgaccccctcggggggactaaaaggagggcgaacgcatcaccctcgggcccgacgtccctcgggggtaccaggccacgtgtgcgattgtgtctgcctcaaacctctagtcatgatactcctgatcccatgtcaccgacagtagcccccggcgttatgccagggcgatcgccctctttaagggaaacggtcgggcgtgacgccactcctaagacctggtgacaggtgggaccggtctccacaattgggcagaaacccaacggtcacaaaccacgcacatcggcaatggtaactcggctgtcaacaa

SEQ ID NO: 37180 - DNA, 561 bp, Oryza sativa
atcatattttacaaagcagtcggtatatcactcggatcatgttattcagggattcatactgcatatgctatatattaatattaagtcacttgtttgactacgattatcaaaaccactcagttggtgcatctattaggtacatctactcgatgcacctgactttatttttcagccctccacagtcttcatatttggtaaaagtactcgggagatcatggcgaggatgattgaagcactcggctttggagtaatctagttcgagagaagattatctttccgactgtgaaggtctcaggggctactgtggagattatgggtaccccatacccacacggcatggttatccgactagtcataggggatagcttatatctatggaatatttaaccgatcatgacttgggtattacgtttccttttatattatgaagcagcctaaagtcctgatttgataatattgtaaaatagatttaggaaaccgataccgtattggttaaggtttctatcttgtaatcctgccccccatcctatataaggtggacaggaggccctctagggggca

SEQ ID NO: 37181 - DNA, 216 bp, Oryza sativa
tcctcctcctccacaaaccctaccacttcccctccaagctccgccatggccgcctgcaagaaccccgcgtcatggcgtccccgcaggcgcctcccctcccgctttcgtcgctccaagaatcgagaagcgctcgtatccgtatcccccgcgacgagccgaggccgacgccgcccgcgcgcagcagcagcagggaggagccccggttcgtcgcggaga

SEQ ID NO: 37182 - DNA, 182 bp, Oryza sativa
gcatgattaattgagtattaactattttaaactttaaaaatggattaatatgattttttaaagcaactttcctatagaatttttttttttttgcaaaaaacacaccatttagtagtttgggaagcgtgcgcgcggaaaacagaaacaaactcactccctttgttctccaaacgaacgcagcc

SEQ ID NO: 37183 - DNA, 235 bp, Oryza sativa
tgataaaagttttgtgactgtcccgatccatcgaggggagaatattgttctttttggcaacttgccgaaaagtggttttggttaagaaaatccgccgcctatcgcacatgcaaaaccagaaattttccttgactgtttcatgaggggaaagggctgtcaagagattggttacgtcacagcgtcacgaccaattctatactatatactgtctatacatattggcaagttggatgca

SEQ ID NO: 37184 - DNA, 325 bp, Oryza sativa
catagtgaacccgctaatcaggaaatgtgttgttctgtataactttcagacattaagctttgtagtaggttagtaatactcgtattctcctatttgcaatgttgcattgatgtttaagcactgttcaaatgacacggtgttgataaaatgcgtttttgatagatattaacatgaagcgataatttatatgtcaacattatatgcttatagcacagatagctggagtgtaaatcacacaactgaacatcggaatgtgaatatggtctaacacatgtgtaactcttgctctttcagaaggtcatttatctttgtcttattttgtagt

SEQ ID NO: 37185 - DNA, 272 bp, Oryza sativa
acctcgcaagtggcaatcatttctaccaacacgttattcggcactcggcagtgacgactacagttgacaagtactacgtgacagtttcctctccgacaagctagcgatctgaacgaaggacaacccacaaattatggaagtggtgtaaatcttgatcaactctgaatttatattgcaatctagttatgcggtctgcacttctctatacagtactattgtgaatacttttgcattggcgtgaattctcgatcttttttccccggcctgttaga

SEQ ID NO: 37186 - DNA, 396 bp, Oryza sativa
ctactagctttaaaatttgacatctcatttgtagctaatccaatagcctaatgtatactacatcattaatatttggtcacctcatgtacaaacatcattaatatttggtcacctcatgtacaaacactattttggagtctttgctgcagcaaatctatagaccgttttcatctctttttctcctttacacgtgcttatagctttcggataggtgttctatccagtatccactgaataattcagatcaaatgaaacataaattaaactgtttcatctggaacttttgacaaattttctacaaaattcatgtgtccaaatgggtagcagttctatactcaaaagcttgttgcatttactggaactatttctcatgaacttttcatcacaatcttcagg

SEQ ID NO: 37187 - DNA, 178 bp, Oryza sativa
acgggggtggccggagacgccggggacatcggcgacgagggggaggaggggcctatctggacgggcgcgagatcggccatgctgagcgtggggtagagcggcggagcggagggagcagggctagggttagggttagggttagggttggaggtgttgccgtagtagcagtaggaagcca

SEQ ID NO: 37188 - DNA, 419 bp, Oryza sativa
tcctgcagcctgcaacttaagttgcacgtatttataactaaagttgtgcatatttataacttaagttgcacatgattgcattttttttattcttagaaaaatcacaaaaataggtaaaatacctagaggaaaatttcctagatacacaacagtggcaagtattcaagggtgcggaaataaaaaaaattactctaggtacctagatacacaatgcagcaagcattcaagggtggcaaaataaaaaaaaagaaaacaaaatgcaaaaagcacaagcagttcggaactggccctacagccatttttctgatatataacattactgagaacattcaaatttttagttttcgaaaacttgcagctaaatcctaaaaagttgcaaaagtttttgctaaaaatttgcacattccaaaaaagcaatg

SEQ ID NO: 37189 - DNA, 687 bp, Oryza sativa
gtcggcccatttggttggagggagtttttagtagggattgggagtttagagggatggggctattaagtgtcttgtttggttgggagacataagaattttggtgagatggagatgaggaattgaggaaggaactcctccttttcaatagctgggtaggggcaggtaattgggaggaaattcctcctttactttgtctaagcaaatctcgaccatccgtttttattaatgatctaatctccaactaaactccttatcaatttccatcacctctaccaaacaagatattgggattaaaaatcaaattcccatcttaatctcatcatcaattccctcgtgtaaacaagccgagtgtgttagaggttagtgaaacagaaaataaagagtcagcgggttagtgagttagtgcaacagaacaacaaagggttagatgttaggggttagacgtccaaaagttagtcgttctcaggtcattcaatggcgcggcggccttcctgtcctcttgctcaactgaggcccagccggagccggctgtggcggagcaagcggagaggtggcaggcagcttgtgcgcgagatggaggagtggcaatggcagagctcgagttgggagaagggagaagaaatggagaggagccgagctgctgctgtctttggtagggtttatatagctttgctggctgcctgagca

SEQ ID NO: 37190 - DNA, 1501 bp, Oryza sativa
gccgaaacgtcgacatcgccacagtaccaggtacgcatggcccattgtacttggctttgccacttttcggtgtgaacttggtgttgctcttctcagtgaacttggttctgtggtggcatgtatttagtggagggttttgtggattgggttcatggtgaatgtgttgctgctgttgtggagggacccctgtcatttggtagctgcaaaagtaggttcaattcactgtggtggcttgtggtcaattgatcgaacacgttctgtgcatgcaggtgttcggctgagggaataggacagcaatacatgcatgtttttttcggtgaactcggtttatcatcttagtgtggatttgtgtctcctgtgttgttggtgctttggggagggtcctgtgaattgggatcatgggtgcatgggatgttgtttgggagggaccctggtatttattagctactgttgtgagccggcaaaggtgggtgcaaagtgctgtagtgtcttgtgggcttatgtagagcacctcctgtgcatgtctgttggttgttttgggcagggcaggcaaagcagactttgggtggttgactgagcaagcgcacaggggtgggctgtcagtcggctgggggaggaataatggacttgtgtggtgaaatgggctgtgctagcagagggggagatggcccaagtgtaataggagcttttgtattttgtagggattcgaaaggaatggcgtctgtatttgagctggcacacatcagtgtatttgtaatgggactgtaatttgaacatttattttggctctgtactcagactgtatatatggaactgtacaattggactggacttggatcggtattagaaatagaatatgcacaaggattggattattgaactgcaatacgagatttggtttgcttggatgatacaccgcatcttcgaacagggaattagggatacgcccgataaacaattccatcggcagtcttaggatttcgtcgtgagcgctttgcacgaacgggcgacggaaacaaaacagtgatttttgggacgacgcatggcatacaaatctaatcgtcgcggtaggaatagaattgaatatatttgaattgacacacaataaataaatacgccgatcaattgtagacattcgaaggatttattgagttgaattaatagaacggtttgaaataaccggagggtaagaattgagaaagatatatcgtgctgcgacataagggaagattttcaggttaaatattctgtgatttggtagcacttaataaatcagaccgtgaagataagggaaagaaaggacgttggactgagggcgtccctttaggagatatgatttaatcgagatctttagcacacaacctaaatacacacaaatgcataataaatcccagcatgcaaaaaggttttaaaaagatttttgattattctgagtttttaattccgtatttcagaatcgaaattttcgggatgttacaaccttcttcgccagccgcgtttt

SEQ ID NO: 37191 - DNA, 396 bp, Oryza sativa
aacgaagtcactataagcgtgactaaaagcacaaagccgttaaatcctggaaaattcactctcacgggaagtcgaacccaggacctaagatgctactgagactcttgtaaccaatagactatagattataaatcacaaaacttattaacaacttaaaataatattttacaggtaaatttttatatatagcgagttaatatatagaaaaaaaccataatgaaaacatcaaaactaacaacaaaataaattttaaattttaagttttaggtgagattaataaactaacaacaacataattagcagtcattgcctcatcggtcacggttaggtatgtattcaggtcaggtcaggtcaggtgtgagctcagcaggtgtaaaaactggactactccgtaga

SEQ ID NO: 37192 - DNA, 159 bp, Oryza sativa
agtagagtaaattaagcaagtggtatccttctcaatttcattctacccctgcccctgaacttaacgagagtgacatctttatcgaaaccctcggtgatctattggcacttataaataaaaaccatatatagaattaaaggtgaattaagggttcgacca

SEQ ID NO: 37193 - DNA, 234 bp, Oryza sativa
gggtgcgtgcgcgtccaggacggcgtctgctgcctgtatccggtggctcagctgctgcatgaatatgcgctggttaacaatcaaagtctgaacaaattccaaacaaatggaatccatctgaactacctacgaattgaaagggaaattcaaacagcaaatcacggcgaacaaatcccggcgaatagacacggcgaacaaatctcgaaaacacataaccgattcgtggcgaacaga

SEQ ID NO: 37194 - DNA, 196 bp, Oryza sativa
agtactcaaagttcactcgttcacattttgaacacttccatcaattcccgatcgttttctgtccaccttagtcgctattgacccatccacgcacaccatataacctttctacccctcattgcctgcattctacttggacctctctcgccggttcggagacagcgacggagccccacgcggcgccgttgtcctcagc

SEQ ID NO: 37195 - DNA, 543 bp, Oryza sativa
ctcgcgttatcactgttttatttagccatgcctatttacctttgttatgaccttattattattgttattgttattattaccttgttcaccctagaataaacaaaactccaactagtgggtactctatttatggttccactagtatgaacttaagtagatgcttcgctggttaattatgcaacattaggtggttttacaactctaaactttgggaatgttcttatcacctggacactatggaatggtaggattattgtggaattggattcacaccgccccctttattcaaaatcctcaaaatggttttaggctgggttcggggtgcatggttttgatagtagcaccttggccatataaggaccggtcttcaggcctttattgcaaagcactaccatacttccacatgtctagtgggtaaggtttagtttgtggctcagtctggttataaacaaaagtacaccgatggagatggacgaagttgggggtcgatggacatttctaggacaaatgaaggctacactagctgcggcccggtagtcgaga

SEQ ID NO: 37196 - DNA, 476 bp, Oryza sativa
tgcctttaaggtctgagctacaaacttgctagatcaggaaggatctaatatacaacgagttcggtcgaaaggcttagttctagaagacgatttgtttggaacaacgaatgaacaaaaaaaggaaggagatacaggggtggtgaaaaaaggatagtaggagagccggtgatcctccctctctaaaatagccggtcaaatctgtctagttaaagaaagaaccagcaatgtaccaaacagtctccagcaaaaggcaaaaaaaaaagatcccgctctgtatttctatactgaaacactctcattgcaaagagccttcaatcctctagccctctgcaaaaagtttttccttgaattagcaaccatcaaactaaaatttggacaaggagctaaaaggaaaataacaacaaagctagggttacctttatagcgcacattctttctctaacatcaaacctctcatgagacaaaatagacagcca

SEQ ID NO: 37197 - DNA, 378 bp, Oryza sativa
tagtttttatttcatccccaaggtgaatttgcccgcgaatattaaaagcatatatccacgtcagagaaggaggaatccatctctcttctactggctttttttgcacaagcacttgaagttgaaggggcacctttatgtacaatttccaaactacaaagaattgaagcaaggctaccaaaagccagtgattctatacaaatggtcacttcccaacaagcggtgcaagaatcgaatcattatccaacatagctagctcaacaacgcactgaggatgtgcaaaaatgcagcttgtgtactagcaacacacacgcaccaagatggatacgaacaattatacgtggatacatgcatgggggctgatcggttagcatcagggca

SEQ ID NO: 37198 - DNA, 1501 bp, Oryza sativa
gttgagacatccctctccctccttagtggggttgccgggtgagaaccttgccttggatctcctagagacctcgatggatagcggtggtgctcttcatcgcttttctccatggagatgtcgtctaggagactctcttttgccaaaaccgtgctcagacagtttgtgcgaatctggtaagtggcaacgagtcgacgggttcgagcgagggaaagggatatttcttctctctcgctatctccctctactaccttttcgtccgttgtcaccttgctggcttggtactcattttttagggattgattttgggcgatttagctatagctcctttgttgggtctagctgtgaccgatgtggtgttagctcttttcttggtcgtgtgtagttgttgtgagtgtgtgtggtggtagtgttttgtttttgttttccttactactgccttatagggtaatagtcttgaaatttaaggacacgtatgcacatagccattatatgagtaaaaaaatacgtaaatttaatgcactcaatgacatgaaaattataattaaattaactttttttcttgggttagcggaagaaacactggccggtttttactaaaaacgaaagaaaagcacgttacgtaaggtacaataacattgtggttgaggcaacagctcctgcctcagccagattccgagttagacatcaaacacggcttaaaatctacaattattttaagagaactaactagccctccatctgaaatacttgttattcttggtaatttttttatttaaataaaagacatactatccttcattaaatgatacatgattgggattagagtggcagttaagggtaaaatagagggaaatttgaatgagaggtgataaatggattaagtagtaacaaatattttagaataaattttgaataaaaagataactattttgaaaaggagtagtacgctagtatcttaaagagcactgttataattttttcttactaaatttgtactaacaattatctcaaccgtttgatttagatatatagaaattataaaaaatatagatgcattcataacatgacttatcagcgttagtaagaatttagtaagaaaagctttttgctatcacaacttttaaaaaatttgctacggtgggatgtttagcacgctttcaaaagttgtttgtctacttcagaaatagtattataaaaaaaatatatagaccctacgccagtgttaaccattgtagcaggtgtagagcaatatgggctgtaggtccccatttccgtttcccgaaaaaatatacagtgcattcgtttatgtttccggtctatgtcttgcttagtcactactccgtggatgagactcccctgaaattatacagtgtatagttgtatcactgatatatggatcttagatggggcctacatgtcagtggcacgactgcacactgcacagacacagagtcagggatctgttttcctactcacgtgtattaactaaacactccacact

SEQ ID NO: 37199 - DNA, 1501 bp, Oryza sativa
gattagagtggtggcggttgatggaatatctaaaaactataaacaaaacccccaaatagaatcccaatgatgattaaaaggagggacgatggacgggtcattaagcagcatggtcacaacggttggcgggacttctaaaaagtaaaaaaaaaaaaccctaatgataatcatgttcgaattttaaaatctcaaagacaataaagagggggcagcgggtgagctgtacatgagtacagtggtaaagtcgctgacagtttggtggaacttctagaaagtaaaaaaagaacctaaatgataattacgtttgatttttaaaatcccaataaaaataaagagaagaggcagtggattgaccgtagagtagtatggtggcaacatttgacgagacttctgaaaattataaaaacaaaacccaaacgagacaataaactctaaaaactataaggtctaatttttagaggttttagtgagaacaaatagaagtagtggtagatcgaggaagcaaataaacgaggggtgacaaaatatttaggagtagcaactgacataacttttaaaaaatataaaattagaaacacaaggatgataaggtttggtttttcaaagtcttaagacaacgagatatctatttaacaaaattctaagtaaaactatattaaaaaatagataattttatatcggtgctagccgcgcaattgcgcgggccacccagctagttaatatgaaaaaggctccatatgacacggtcaaagagtacaatatttatctctatgtctatctttaatattacaaaaattgaaaatattttcttcggcgctttgatacgtcgtctgtgtttgatgagttagttatatgtcacacgtatccaatttgacgtgagtctagaataattattatgcacccatatcccagttcattctctctccctcctagcccaacccaaatggcccacaccatcccgcacgcctccactagacggcgctgcgtacacccttcctcgattggcttcttttttttttctctcttttttcattttctttttctccttttcttttccctcaataatcatgattctctccatctccttcttttctcttttttctcttccaaatttctctcctcacaattattttcctattgaatttatcattgttaaggtgtatgcattaagtttggtactttgcaaatgccttccatctacagtaaaaaaattttacgggaaaaaacttttactaattgaatactcaaaattttaatctttggaccatgaggtataataaaatccacatgtgtcaacttatggaataaccatccgatcaatttgtgaggctattggaaatgtgtatataagctattcttcgtgtgatgatgcatgaagggagcggaaccggattcaatgttatatatgatttctaaatttgttttgctattgtttgacaaaaaaatttatcaatcgtgaaaattatcttcacctgttttaacacataaacatttttgctag

SEQ ID NO: 37200 - DNA, 1501 bp, Oryza sativa
gtttcattcggccatggtctgcgtaaccactttaaaaaagatgtcccgcgcttaagctccccctcggaagcgccatggctccggtctcccttcccctgctctcccgcgctcgccctcctctcctgctccgcgacgccggcgtcaagctgagcacggtcaggctacctcctccatggcgccaacagtggaaacacaccagcggcgagcggcggcgacggctatcaatgccggcgtcggccgtggcggccgagacgccgccgccacacgcgcgcgccgaggaggaggaggaggccgccccggccgtgggcggcggcgaggaggggcggttcgagtggctggaccagtggtatcccgtggctccggtgtgcgacctcgacccgcgcaagccgcacgggaagatggtgatgggcctccgcgtcgtcgcgtggttcgacggcggcggcggcggcgagtggcgcgtggtggacgacgcgtgcccgcaccgcctcgcgccgctgtcggaggggcgcgtcgacggcaagggccgcctccagtgcgcctaccatggctggtgcttcgatggccacggctcctgccagttcatcccccaggcccccgccctcggccctcctgtaaaacaaatcaaaacaaaatttaaaaaaacagcaacattttctgaagattaaccgagttcttggatcaattaatggcaggtgcacaagaacagcaaggcgtgcgtggcgtcgtacccgagcgtggtgcagaacaacatcctgtggttctacccgaggtcggagccggagtacaaggagatcctgcagaggaagcggccgccgtacttcccagacctcgatgacccgtccttcaacacagtcttcggcgtcagggacctcttctacgggtacagaaatctccaagcatttctcctaaatcttaatttcttgctcccccattagcatggcagctcgatcattcgcttaggggaaaatatgtagttgcaaagcctatatatagtgaaaatttgaaaactaccgttggaccgaaaaatggacatctggaattcatctatgtcaccatgagttaaaattcgacgtctaagttaaaacgtgctacatgagttaaaatcttaaaattttactaggagttaaattttaactcatgagtgaatctgcgagtaaaatttttatccgtgatgacgtggacaaatctcatacgtttatttttcgaaccaactattactttcaggtttccactgcatttccaccacatattttaccttgcttagctagctccattgtaatgtaggtacgacgtgttggtggagaatcttatggaccctgctcatgtcccatacgcgcacaaggggctgatgcccatacagaacaaagaagatccaggcagatatgttcatcatctatcatgacatgatcagttttaattcttcagtctactgcacgcatgaacatgctactgagctagtgccattttgtaatgttccggctgcacctaccactgatagtgt

SEQ ID NO: 37201 - DNA, 1501 bp, Oryza sativa
taaaaaaacagcaacaatagtttgcaaatttcagtttggatcaaatattaattgataaaatattgccggagtggtagaggttgggggacgcgagagtctggtcgacatcaacggactcatggttatggctgcccttgtagccgatcatctagggcagctgggcaggccgatcgccggtgaaagagattgacgtacctagtcaacgtttcatggtgcgtgcagaaccctgctacctggaggagtgcgttggtttgtgattaactgatgccccatcacgtgtaagaatcgtggagtgtgttacgtttttatagatccaaagcgaatagcaggcaaggaggatcacagatgaattaacttttttttctcacaaatctaatcttacggtgtaaaataatgggtccaccggtttaagtgaaatccaagggctagatgttttgcttttttcttagaatttctaagaatttatctaatttattagagcgccacttggcggcttaggagtgtttataagatgtttaatgaacttttagtatataatagatagatagatagatatccgattaatcacatgataattacttttttttaacgttcggctaatcaatttagaaagggccctgagaattccatatcacgtatgcgtatattttttttgagggggaaggacaggagctctattccatatcacatatacgtatatttttttttgagggggaaggataggagctctgccaatttcattaagaaggatataaaagatacatgatcacctctcaaaggttccatagcaagatagggggacaagggagttcttgcggaatcgggaaaaaaaccggagacagtaaaataacccgtcctaatttggcagtgaacattgacttgctacagtgctacactaccaaatattcgtcggttcaccagctccatttcgagttatatgactctccaacaaccagaggttagaggtaactagatatccttcctatcctatgatgacatttgccttcaggttggtgctggtgccctcctgcagcgaccattttgactgttggctaggactgcctttttaagtgtaggagtggattttaaactttcgagaggacgtacactcgttgtttgcatgtaatttaaatggttatagaaaaaataaaaaattgaaaacatgtattatcatatggcatatcatttcacaaacatacaagtttaaattgaacttctacactttgcaaaaaaaaaaaaacaaactacaactagttaacacatgttcacaatcagtgtaaaagttaaattttaccttacatatttgtggattgatgtatcgcatattaatctatgttgtagaactttttttagtttttttcataaccattttagtgacatgtaaacaacgaggggacgtcccctcgagagtttaaaatagtttgtacatagcattgggacaatgtagccgtctttctttctctctctgaactcacatatcctgttcctcttatcacattac

SEQ ID NO: 37202 - DNA, 1501 bp, Oryza sativa
acgccgttaactttttctcacatgtttgaccattcgtcttttttaaaaattttatacaaatgtataagatataaatcatacttaaaatactatgagtaataaaacaactcataacaaaataaattataattacgtaaattttttgaataagatgaatggtcaaacatgtgaaaaaaagtcaacggcgttatctattaaaaaacaaaacggaggtagtacattcttacgggttatttagatcagggtgtaaagtttttatgtgtcacatcaggtattatataggtgtcgtatagggtattctgcactaacgaaaaaactaattatagtatccatcactaaaccgcgagacttaagcctaattaatccgtcattagcagatgtttaatgtagcaccatattgtcaaatcatggagcaattatgtttaaaagtcatcttgcaaagtagtagcaatatgtgcaattagttatttttttagcatatatttaatacttcatacatgtgttcaaacgttcgatgtgatggggtgtaaaattggatctaacacacccttattagtattttatcatgccaaaacttgaacctttcgggtgcctagaaactggcagcttccattcattcctatatacctttcgatatttttttctaacatttttttcctgctctacttaatggaattggcgcgaaccgattcgttaatgaaaaatctagcatgtctgtgttggaatataaatttacgatctcaatgatttagcttatacataatcacctatgcttcaatacccacataatatgccatcgatgttaattattctcctttagtttcttccttctcttattcttctgtttcttttcttcttatgcgccaatgtaaaatttcaccgagatcgcctcacaaaccttttctagttggtcgggcaatttagggttttgaagtttagatagagaatttggcgtcccttctcctttgtgttcaacttctattttatagacgctggaggggctctagggtttatctcgaatacagttttagagattagttttaccgatcacaaaattaactctatcacatattcaattttattagaaacagataaaggggatttatcccttctttagttaaccggcatttagccgataaaaccaaccaactgtcttatcatccaaagagtgatggttctaccttgctgtttgtactttcaataaaaaaatcggcacaagttgcacggacagtttctggcggctcgttggcgacgactcgacaagtgatactagaaaacgaaatattaactttttgccacttttacgagtggttcaaaagaatttggctctgaatccatatgttataggcacataaggaaccacatgttataaaagtagcaaattattaattggcatattttaaaaatggcaaataattaaatgtaccctgtaaaaccggtgcatcggcatcggcctctcccgtctccaatttggccaagtggcgagcgtccagctaatcac

SEQ ID NO: 37203 - DNA, 1200 bp, Oryza sativa
gggaggaaggggatgagggtggggccccacccgtcagcgagggtggcgggcgggcccgcccgtcaggacgcgcgcgcggggaggaggagagagagggaaggagatgggccgagccggcccaagagggggaggggggaaaagactttttaggatttttctttttataaaatcattttaactttgtttattttaataattattatttgtgctctgaaaattccactaaaatttatttacgcattttaggcttttaggaaatatacaaaaatcctccaagccttatttgacttttaactttgcacattttaattgtgggaggctttcacaaggattttaattattctaggcataatttctaggatgtattttagagtcattttgggacgcgacagttctacatcgtacacgtcgaagagggagtacaagatgatagaatgcgaagtctgctccacattacaaggggctactgccaagatgaaatggtccaagcacaagattgagttctcagaggcggaccacccaaagatcgcgaccacacccggcagatatccgatcgtggttgaacccaccattcggaacatcaaggtggcaccggttccgatcgatggcggtagctctatcaacctgcttttcgccaataccttagatgcaatggcgattccacgaagcgagttgatgcctatcaacccttcgatgggatcactccagaatcatcatctaagccattgggtaaaatcacattaccagttactttcggataagccgacaacttccgaacagagcagatcacctttgatgtcgcggaattcaataccgcacatgacgccatcattgggagaactgtgctcgtgaagttcatggcagcatcccactacgcttatcaagtactcaaaatgccaggaccaaaatggacaatcactacccagggagacgccaagttggcggtgcagtgcggcaagcggagcctcgacatggtcaagcatactcccaacccatccaccacgactgagctgcccaagaaagtgagcaagcccaacaagatgccaaaaccagacggcgcaatcaagatcatctcgctgaccagttccaaccccaacaaaaccatcaagattggggcagcgctggacaacaaataggaactcgcattcatcatcttcctctgcgacaatgtagacgtgttcgcttggcaaccgttagaca

SEQ ID NO: 37204 - DNA, 1501 bp, Oryza sativa
ctttagtgaggccaccgcctggtggtccgcgagcggtccaataacgtcagtcagagggagagcctacaccgcatgaaatcattttccgacccgggaagcaataatagcaaggttaccgagtacactcatgttgattgcggcttcgcgcttagtcgcctccttatcacaaagaggcatggggacgtcgcttgccgttgtcgggccgctgatcatcaattggccgacgcggcgctccacggtggcgtcactcaagcctgcagatcgagaacaaaattcgataaattagggagaacatgcacagaaggggatcaaattaaacacaagaaaaataccccgaggagaaacccaggtcgcgtcctccggcccagagtagtcaaaggctgggtgggcgcgaacctggagcggctggatccgcctactaatgaagtcggtagcgacttcataccccgacaaacctcgcgctcggaggtcatcgatggcatcgatgaacgactgaaaagcaggggtcaaggcgggttttgcggtccaagatgggattttgtctggttgttcctcaggaatgacaaagatcggatctgaatcctctatctgaagatagaacaaccttgcccgccacttgctatgacaagaagggcactggaaggggatatatcgtgacttcaggccatctcgaagtcggaaacccacacatccagataccctggtagattccatccaacgcaactcgtagtagaagcgaaagaggtcgagaaacggctctaccccaatgtaggcctcacaaagatgtgaaaagatgctgaggaaggcaatggaattggggttcaaatggagcagagaaaggccgtagaaattcaagaccaagagaagaaactcagaaggcggaggaagaaagccacagagaatatagtcctcgatcgcaactatacggcccaggacaggttcaggttcagtacctcctggttccctctccatggctccgcggccggggatggcgccatcctcctgtagctttttaagcgacgtgctggtggaggtagacttgccgagatccatcgccgccggagatcgccggagaaggggccgagatgaacaagctaggactttgcaggagcggaggagacaaggaacgcctggaggctggagagcttttttcacaacgggtggacttcaaaatggatcctcaaaatcctcttaaatagacgcatttccgacggtgtgaattccaagggaaggagagagagattaccgccggaaatttctaggtccgttacgcgcggcagtttttcagacttcagtttaaattcactcatgaccgttcggcttcacatggtgttgtcgattgcatcctatctctatggttcgcacaccgagaacgacaacagcctcgacaccagaagtcacgatcggttacacgagtccatttaagcagaagtcgggggctactgtcagggttacgggtaaggtataccctttatccttcgatacatgccgtgtatcggta

SEQ ID NO: 37205 - DNA, 199 bp, Oryza sativa
taaataagcatggtgacatcccttctttctataaagttacgactcaaagctaaaacctcagcgtgccacgtcatcactaattctcagtcgttcaatcggtggatgagatcgcgtataaaccattggatgagaaggtccctagtgagatgtcgagttatcctgatgagcatagccaaatcattgcaaaaagcccaactga

SEQ ID NO: 37206 - DNA, 1501 bp, Oryza sativa
gggtgtgcattgcagtaattctcccaccaatctgcagcaggtcctcttagctggtgagaggcgtagagcgtcttctcgaccggagtacactgcactaagttgagttttctatcaacatctttcagccaatcgtcagcctcaacgggctcgatggtctgagagaactctggcggacgtgacctcagaaaatctgtcagcttggatctattgttgctcatgtgagggtggccatttccatgcgcattatgctgaaaaccggctacggctgcggctaatccttgcaagatttgtgtctgaactgccattaagtgttgcatgttgttttccacatgaggtgggaaagggaggcgttcttctccagaattgtgactggcagtgcggtgagagcggtgagactgttccatctctgcattacgggaaactgtgcgatgcgagcggctgctgcggcggggttgctcaacttctgcgttgcgggaagcagtacggtgcgaacggttgctgtggtgagactgctcattagctgactcatgattttcttctggctcaactctaccatcttcaaaaccaaagcgggctggtgcacgagctgcacggcgggggcggctagccatctaaactcccagaagagggcggggtaatagtcagatagcacttaggagggcaaggagcaaagtaaatagcaactcagatagcacacactaggcataaactggatttttcaaatcatagaaacacctaatacaacgggtgtggacaagtcacagagctacgccgagcttgactgcgcgcgcaccacctaggagaaccagactaccaaacaacacccacaacaaacacacgcacgcactacctcgccacgactccaaaagagttggcggcggaacaaaagggcctaacacacggacggctgctgaagactgcctcctctactcctcgtcggcctggctgcctcctgtggtcggctcctcagtcgaagaaacgtcgatcggctgacgcgaagggaccggcggaacctgtcgagggctggcagcagcacgggccgctggcggtgggggagctgggtagtggaaacggaacacagtggaagaaccaacaacacgcttccgcgcagtgcggataaagcgtgggccacggcgggtggaagcaactggggtgtgtccgggggtgtaggaagggctaactgggtgtgggtagggggagtacactggtgagtacggcgcacgcgagctgggggagcgcgggccactggaaggcgtggaagctgccgaaaggcggagcccccaagacggtggctgtagtcatgggccaggcgacgaagcgcagtccaggagaggtcctggtactcgatctggagagtgggcctggccacggtgaagtggtgtggacgagggccagctccgtgtatacctccacgggggtaaaggtacacagagagctcacagtgagggggaacacggtccacggagtaccccgtgtactcgggacacgagaagccaaggaa

SEQ ID NO: 37207 - DNA, 1501 bp, Oryza sativa
tattccataagttgacacatgtggattttattatacctcatggtccaaagattaaaattttgagtattcaattagtaaaagttttttcccgtaaaatttttttactgtagatggaaggcatttgcaaagtaccaaacttaatgcatacaccttaacaatgataaattcaataggaaaataattgtgaggagagaaatttggaagagaaaaaagagaaaagaaggagatggagagaatcatgattattgagggaaaagaaaaggagaaaaagaaaatgaaaaaagagagaaaaaaaaaagaagccaatcgaggaagggtgtacgcagcgccgtctagtggaggcgtgcgggatggtgtgggccatttgggttgggctaggagggagagagaatgaactgggatatgggtgcataataattattctagactcacgtcaaattggatacgtgtgacatataactaactcatcaaacacagacgacgtatcaaagcgccgaagaaaatattttcaatttttgtaatattaaagatagacatagagataaatattgtactctttgaccgtgtcatatggagcctttttcatattaactagctgggtggcccgcgcaattgcgcggctagcaccgatataaaattatctattttttaatatagttttacttagaattttgttaaatagatatctcgttgtcttaagactttgaaaaaccaaaccttatcatccttgtgtttctaattttatattttttaaaagttatgtcagttgctactcctaaatattttgtcacccctcgtttatttgcttcctcgatctaccactacttctatttgttctcactaaaacctctaaaaattagaccttatagtttttagagtttattgtctcgtttgggttttgtttttataattttcagaagtctcgtcaaatgttgccaccatactactctacggtcaatccactgcctcttctctttatttttattgggattttaaaaatcaaacgtaattatcatttaggttctttttttactttctagaagttccaccaaactgtcagcgactttaccactgtactcatgtacagctcacccgctgccccctctttattgtctttgagattttaaaattcgaacatgattatcattagggttttttttttttactttttagaagtcccgccaaccgttgtgaccatgctgcttaatgacccgtccatcgtccctccttttaatcatcattgggattctatttgggggttttgtttatagtttttagatattccatcaaccgccaccactctaatcctttacattcatgttgcttctcctatatttgttgtcatttgtcatctttttataatttttagaagtcatgtcaaaccctatcaccatacttctcttcggcctgtccactacctcttctttttattgtcattaggattttaaaaatcgaacataattattattttggttcatattttactttctataagtcctgc

SEQ ID NO: 37208 - DNA, 1501 bp, Oryza sativa
gccgccacggccgcaaccgacgtcgacaacagccgcctcgccacggcgcggctccacggcagccgaggcggcgggacgcgggcggcggcggcggcggcggcggcgtcgcggaggtggagcgcggggcgcgcggggcgcgcggcggggaggaggaggagggagagggcatccatggctactcgcgtggtgggggaggggggcgcgagcggcccgcaacgaacttgtggcgcgcgcgcgcgcggttacgttgggtggggcccggcacaaacttatcggcgccgcaggtgattagctggacgctcgccacttggccaaattggagacgggagaggccgatgccgatgcaccggttttacagggtacatttaattatttgccatttttaaaatatgccaattaataatttgctacttttataacatgtggttccttatgtgcctataacatatggattcagagccaaattcttttgaaccactcgtaaaagtggcaaaaagttaatatttcgttttctagtatcacttgtcgagtcgtcgccaacgagccgccagaaactgtccgtgcaacttgtgccgatttttttattgaaagtacaaacagcaaggtagaaccatcactctttggatgataagacagttggttggttttatcggctaaatgccggttaactaaagaagggataaatcccctttatctgtttctaataaaattgaatatgtgatagagttaattttgtgatcggtaaaactaatctctaaaactgtattcgagataaaccctagagcccctccagcgtctataaaatagaagttgaacacaaaggagaagggacgccaaattctctatctaaacttcaaaaccctaaattgcccgaccaactagaaaaggtttgtgaggcgatctcggtgaaattttacattggcgcataagaagaaaagaaacagaagaataagagaaggaagaaactaaaggagaataattaacatcgatggcatattatgtgggtattgaagcataggtgattatgtataagctaaatcattgagatcgtaaatttatattccaacacagacatgctagatttttcattaacgaatcggttcgcgccaattccattaagtagagcaggaaaaaaatgttagaaaaaaatatcgaaaggtatataggaatgaatggaagctgccagtttctaggcacccgaaaggttcaagttttggcatgataaaatactaataagggtgtgttagatccaattttacaccccatcacatcgaacgtttgaacacatgtatgaagtattaaatatatgctaaaaaaataactaattgcacatattgctactactttgcaagatgacttttaaacataattgctccatgatttgacaatatggtgctacattaaacatctgctaatgacggattaattaggcttaagtctcgcggtttagtgatggatactataattagttttttcgttagtgcagaataccctatacgac

SEQ ID NO: 37209 - DNA, 662 bp, Oryza sativa
aatgtgatgattgttagtggatgatgatgtggcatcttgttaattagtgaatgatgatgtggcatcttgtcagtggatgatgatgtggcatctttgcatgttaagcttaaggagttagtgggggataactttatagtaagacaggatgcctatcgagccatcgcgaacctgagcggcctacctctatgctcgggtcaccgacatgtgggacccacttgtcagctccatctccttccgacctgtccgtcccatctatctactctactagcttgccatcattcatggcggacatgcgccggtttcttctcgctggtagcgcattgaagcctctccgcaggtaacaaagatgctactagatggatttcttgattgccgatcgaatctctatccttcccgatcgattcgagtcgggttcaaaatatgataaaccctatcccttgttaagttgttgttacactctgtccaggtttctcccttccccgtctctcctctactgctactgctaacctgcgtctccctcgctccccctgcagcgtatggaatggagtatccgacgaccaccaaggtgaggaggttggagcaccaccgcagtgtcagcgactcactcaggccgccgccatctttccagatacaagacctccctgaggtaaaactctaaattg

SEQ ID NO: 37210 - DNA, 690 bp, Oryza sativa
aattacatagggctcgggtctatttatactcgagaattacaagatatgtccataccggacacgactattatctctaacaaactctaagataccataagtctttgcggcagacttttgcccaagcatatctctaaggaaattacataaaatatcataattaatagatacaattgccttctctggactctatgcatgtgcggcaatcatcttgaagcacctcaattcaacccgatgtcatacaccaagttgtattgtcggaatcggccgcatcggcttacctagtccgactcagacccagccaatcctaatcgtagccgatctggactccagccgattcctgctctattcttgaattcgatctccgcctttgacttcacttcgatctaatcttctttcccgatgccgatattaccaaatttggttgttaacacatgccccccaagtccggaatattttgtaatgtttcggatttgctgtaaatcgactccgagcaagtttcgcactttgccattttctgaccgttactgtcgtgctttaaatactaaccgttaccctcgagaagtctcacaccgtcctcctccgttttcaccgctgaaaccaactttgttctcactctctccggcgatccccccgacgcacaaggctatccccaggcgattttgtttctgatcagatctccgcctgcggcga

SEQ ID NO: 37211 - DNA, 1501 bp, Oryza sativa
agtagcatccaaaaaggagcaggcaataatcaatctgatctgatctgatctgatttgcaagtgtatgcatatccctgcctttacacattgactcctcccccattggttcgtcggttggctggttgctccctactttttcgcacatacatcatccatcaattctcatcgtccctccgtcggccggcggaaaagtctatgtgtgattaactaaaaagtctatgtgtaatcgctaaacacacccgaccatttcacatacctgagcttgattcgttgtattaaactgagggaggagtagatagtatactctcccagtctaaaaggttaccgttttaaattggttatcatagattaaagtttcatgagaaataatataaaacattttattaaatgacatgtggtaaggatggggttaggagaaatatgaatgagagataattgatgagacaagtactttagagtgccaatttttgtagcacaaattttattttattttttaaaaaataaagggatggagggagccgtatatatcaaacgagaagggaaaaacaaaaggaggaaagaatgtgaatgtccaaattcagagagcagaaagttgctttgaatgggatctgctccaccatcgaatatcccaactcagatatgtcgaatcagattgtgttcctatgctttaccgtgaattcttttccaaattccaaagggtggcctgccaattatttttggcctaaaatgatcccaagattgttatgattatatgccagtcagcggcctgttctactataattcattcattccttttagattataagattattatagctgatagattatatgcaaattattcatgcccgttttctcaaggtatgatttctccaaaaatctttctgcacctgcattgcaatctcgagtcgtaggtaagtgtgtaatttgtcaaagaaatcagactcatagaattctaatagtactttcccagcgttgaaaatttgctgtatgatgatagcacaacgagaggtccaaagtgcaagagcagaagagaagatacaggggagatcccgatcgtgcagcttttgagtcacagaatgaaaaagcatcagcagcagccaaatgagattgtatatgtgtaccagctgctagctagagttcgtcaactcgatcgttttacagcattttttttcttcctttctggtggatggtgaccacgcaagttaactgacgtgtagttcgttttatgttgtcataaagtggatccatcattgcacagttgtgcactagctttgttatccttaatttgttaatcacagctgacgtacgggttaattttgttgcagtctgcactaatgacgcacttcctctatccatcaatcaatataaggttcctctgcactaaggttaaaagtgaaatcactttgatgctcatagaagtttgcctgcctagaagtgatcatgctcagggacacatcaataaatacatggaattattgggagatgttggactgggaaaata

SEQ ID NO: 37212 - DNA, 1501 bp, Oryza sativa
ccccacacttaatctggggaagcttcaggaaaatctacgtacgaataacctggatcaacatgatcgtcaaaatagggttggctagcgaattgattaagcccacctcattggtttgattgaagaacacgtcggtatcgtcaacgctgctaattaaactcccataatcatgatccttcttcctttctcctccacaggatcgtcgctcacgtcccgaccatcagaatcttccacgacacctacatacaactatttatttgattgtggaaaactgtttaatctgaatctatcaatggattatttctctatacttaaaaaatatatgtttttttttgtaaaaaaaatgctcttatgatgttttgcttagaccacttgttaaattcattttttactagattaaatggatagtactttgcaacaatagttctctcaataatgtaaatcaaataggacatccaattggctgttaaagtttttatcgctcaacataaaccaaaaacccaaaataaaattgtgctagtgccgtacaacaaatggttacctagaaaagcaaatgcttccattccataattcatatcatgcccctagtggttttgattatttatagcacgtgagacttggtggcgacgtttcagctgcaacaactctgcaagctgtcttggatccatatacagtgtaccatactgtgtacttcctccgtttctaaaaaaaaaaaactaatctgaaattggatgaaacattttttttgaacctgtccaaattcgttgcaccagaaaacgtactatctaatactagatagttttttatcggagggagggaatatgtttttactactccttctgttttgatttttttcctagtgaatcaactttataaaaaatatcaacacttttgatacaaaataaacatattatcaaaatgtatcaatcttacatttaataaatctaatttgataatattactattttttttacaaatttaattccacttaaataaattttattaaaaagataaaaacgaagagatgcgatcgtacgatacgaaggaagcaggatcgaacagcaggaggcagcagccatgtgccaacgaatccgggcgaaaaggcgttccatggactgttgcacatcgactaaattaaacaaacaagattaatggagtattaattaagcatgcatgggtgtgtgtgtgtgaatgtgtttgttaggccagtcacaatggctagtgtcattgcacggctacccaaaatattataccatcttctctcaaatgaaatcttttatgaaacaatccccacagtggaggggtttcactttgacgtttccaagactaagcaaagcatttaattgatacaagttgctgggatcatttgtacccaaaatccggcgcggcgcgggagaatgcagaggtcgcacggcggaggcggacgcaagagatccggtgaatgaaacgaatcggcctcaacgggggtttcactctgttaccgaggacttggaaacgacgctga

SEQ ID NO: 37213 - DNA, 1501 bp, Oryza sativa
cctcaggataggagggccatgacgtacggtacagaaagcacagctggaaatggcatgaaaaacattgggaaaaaaaagagagaatggcatacgtgaggcattatgggatagagagagaaagagatggaagaggacgacaagttgttttggccatttgctcaattgctccaaatttttttttttttttgcgtgttgttggttattgaattgaatatttgaatggtgcgtgtagacgtacgtagtgggcaggccactagcagacggtcacatgcgtacattgcgtcaccgcggaaaaggcaccgttcgtccgcatttttcaaactacatatacgtacatcagagttagctaggagtatttgccgactacattcacctcagttatttccgggttttcttattttttgtcttggttttctttaatcattgggggccatgggcgaaggacacgctgaacgcttttaagaagattgctaaatttcgaatgattaaaattgctagaaattctagtcatatttattttatttatttatcttatttaacataaagctagctgaaaggatagctagatttgcacataagcccctaaaaaatgggtacgttataacttgagaacaaaataagcagataaggactacaaaagataagaaaaaagcaatcagggtcttagtcttgcttcttcctctgcatcggttcctcgatcgatgacaacaacgacaacaagtttgcaagaaccatggcaaactgcagaatgtattgccaaatagaaaacccaggtggggcatcttggagatggagattacagttgccttagcaccatataagagcgcttcagttgctgcttcaagacctgtcgcgggagacaaagaagaggaccgaagacaacaggaagatcgccgaagaaagagaggacgttcggcgctacctgttagatgttgggattgaggatgaagccacccacccaaacaaatcaactgctcatttagttgctgacatcttggagggacccaacaaatcacagacaagacgacctcactggaaagaagcctagcaagtacctccatggccagagttgttgagacaagggagatcggatgccgatgacctccttgcattgcacaagagtagaaacatgatgtactcgaaaaagggaaaagcctgactaaacctaggactacctagtagagaagaaatgttgatccctccccctctcttcattggcagcgaaccaccaaattggaggtggaagagggagaggagaggattttgtttatctgcagttgcctggtttcgcgagagctctctcgaaccctcaaattttagtcatctttagcctactaattctctttgggagcggactggagggagagggacaaggggaggctgggacttaccagcggtggtgacaacagtcttcttctatggcgacgagagggaaactagtgagacctagtggctagcagcattgtcggtaaccaactaccctaaattcgattcctccctt

SEQ ID NO: 37214 - DNA, 1501 bp, Oryza sativa
tcttatttatgtttcgcaacaggatcttaaattcttaggcatagggtagtgacggtacttctacattcagttcgtcgaagaattggcatagaatttgcaattttcaagatttcggagaggaattgaacttttgctcaagttctttgggagttttggacctggatcctttattttcgcatatataggtggtgttcttttcttccgaagatgaagactaagttttttacacaaaacgaggtggtattaacgtatgattgattaagttttaattattacaaacttgaaaattagattaatatgatattttagagcaactttcatatagaaagttttcgcacgaaacgctgtttagcagtttgaaaaacgtgccacagaaattttaattttcattcaacttttgttagagaaaagaacaacttttgctagagaaaagaacagaaccatatagtctactgtttttttacaccaaccatagagtctcctcttgctagactttgagctgaacgccatccgactactccgcaatccgggggggggggagatggtgacacgtgggctctactgtttgttttgtcgcgtagacaccacgtcgattttgctatatatttgtcgacaaatttttcccctaaaatttgacagatataattacagtacaatcgtagtgtaattacactgtaacttgcatgtaattacactgtaactatagtgtaacttgtatgtaatttttaaaaatctctccgtaacatgttatttcggtaaaatggaggtcgtgggaacaaattctttcatatatgtatgtgctatgatttgttttcttcctcaccaaaacaaatcttgtaatagatctaacgattcaaaattatgtgaaacttacatataagttacgctgtagttacacgcaagtcacaatctaattacactacgattgtgctataattacatttgtcaaatttttgaggaaaaatttatcgacaaatgtataggcagtcccaaaatctctctcaaaacggtgtggggaggtaaattgattcgctgtgctcgattttgccaattagagacgaaaatcaaactcagccaatggttgagggatccgaaataaacttttttccttctgtaggagttgatcgttggaccaaagagaaagtatcttaggcctttgaactaactcctgggtctcatgggctggctgcgatgcggaatgcatgggccttgggaaatgggtgggccaatgtctcttcggcccggtttgaagcccaccacaccaccttatcttgccgacgccgcatcgtcttctcaatccccaattcgcacgcggagctaattctcttctagggttccgacgaatcccgagctcggaggccgatggcgtcgtcgtcgtcggcggcgtctgggaagtcgcggccggagtgcatcaactcgtcgaacccgttccacgagtgctccgactactgccttcgcaagatcgccgaggccaatgagcgcatcgaggacgagcagcggc

SEQ ID NO: 37215 - DNA, 1102 bp, Oryza sativa
cacactcaaacgcagcctcactcaacacgaaccaatccacactgcactgcaactgaagaatttgtctagatgttctgctgtttcttgtctttgcaggcagttcatcatgccctcaaattgagatgaggttaaaaataaaatataaaagcaagatatcctaaacaaattgatgtgtaatatcatttttggagtttactgttttgtggtggcagcagatgcagaaagatttggaaggagaccatgtgcaccgctcaattcatctcccgtctcagtctcagattgtccatgtgctcggctggcctccttcacttcagtgtccggaccatactgcagtgatctgcagctgctctgctagtattactgcacccaaccaaccacacagtgcgtgttctttctgaagcaattaatgcttgttaatctgcagttagttgtcaggcagatttgcaaatataccggccatttttgtgctcttgatatcttctactatagttgtatgcttccttgccatactgaagaaagaaacacaggcagatttcggaaggtgcctaatctaaatcggcttgctgcctctgaagcagagctagcggcagtgtttgcaacctgtttaatggcagtattacgaatgcctctccaaggaaatcagcatgtctgtctctcaatctcctgagcatggactatatagctaacctaacaaggttggcaccgactttaacatcttcaagtttaatggtgcagctagctctgaacctgatgacggcagaggcatgcatggtcggtgcagaagcagcagagaaagccgtaataacttggctcgaattaaagcgagatagaaagcgtacgtacgaccgtacgtcctccctgttcttcttgggcgagatggatgtatcgagcagaatatgggacggattgatcgtgacatgacaaattttaatttcgcccgcaagccatggctctgcatgtgcaaagctatctctcgcgtgtatatatacagctcacgtatgcagcaatcagattcagttcaccatagtagctaagctagcacaggttgcaacgagcagagagctaggcgaaatcgatcggaattcggagatggcgcgccgtg

SEQ ID NO: 37216 - DNA, 499 bp, Oryza sativa
tcgccattgattacatgtcaagctcaacatatatttgatgttatgttactcaaacactacacaccacagttacatgccaacaaaataataaagaagatatatagccacatatctgtggtgcaaattgtaaggttgtgtgcatattgctattgctcgatggatcgctttcgtgttccttgtgatgtgttgctttatcttttctcctttccagtgtgtgccagaaagaggacacctttctcttcttggcttttggatcttgtttcttgccttgcaagagctagcttcccctaataatctctctctctctctccattgctagctatatagctacattcctgggtcgatccctatataagaggagaggcatgaactcaaatgaaatttccaataagctccacatgtcgtgagagcagagcaccggccggttgatcgagataacacagttggagagttttttctccttttctttttttctgtttaattcatccggcgagtcaga

SEQ ID NO: 37217 - DNA, 375 bp, Oryza sativa
ttggaagtagtctctgttttgctatgttctgtttctgggattgttttttttttggctattgtgaactgttttttgtgaactgaaacgtgtcaatggaatgtgaactgatgggtcattgcaatgtgaactgatatgatgtgaaatggaatgtgaaatgataaggcaatgccgtgtatgcatttgtatataaaatcaactgctctgtgacttgtatgcatcacaattgtggcgatggaggcctctggtgcctctggtggcgagcatcctggtggcgacgatgaggggtctggtggcgagttcttcgcctctggtggagatggaggcgatgaagatactgtccttgaagaaatcgatccagcggaagtatatacactt

SEQ ID NO: 37218 - DNA, 602 bp, Oryza sativa
agaatcactgaatatcacatgggcacgaacattcagcaccagaaacaagcattctcttcatgtattttataatatccatctatgattcgacatcagtatgaagatgtcgttcagaaagcgcagataacagaggacacaagtgacaggatcaagtgattactacaaccagcagcaagatatgatccatcaaatgaaaagtgattactacaatcagcagcaagatatgatccatcaaacgagggacactgattaatttattgtcagaggactagagtactgaacaaaacaaactttcctgcacattacagcatgtgacaagcatatcatattttgaaaaagggcgagggttctaagactgttttctgttttcctacaaggcctggataaatgttagtactctacagatcaagtatgataaagtcatctatttctacatggaattctcagagaacatttccatcatgcaaaaatccagagtggtcttcaaagattggtgaagcacttgaataccttatgcataaggtatgaaacccaccaaacattgaagttcactggcaaagtataaatagactggcatataaggtggtactgacgtcgttgta

SEQ ID NO: 37219 - DNA, 152 bp, Oryza sativa
gatctccattcccccagtaattaggccacaaatcaaatctctcttgtgccctaataacctcctgttataattagccaattgatgatatacattagcatgactcttcactggtctcttctgctgttcattgccattgctttggtttcttcagt

SEQ ID NO: 37220 - DNA, 359 bp, Oryza sativa
tatctaccttgttaaagggaccacaacatgcatcagctcagtgtgaaaaaaatttgataaactactttacccccattacttcttttttaccgataggcttttattctctcttaagagcatgtacaataacattcagcaggttgaatagctatccacgttatcaatatcctagctggaagagtgagaaatgatgcatgaatatgcatttttcaatctattaaacggtacattttctattaaaactttatatttatgattttatttaaaaaaattacaaaacatgggacctaaccagaattattacaaaacatggccgagcataactagagcatggcaaggggttacatttgtgacaagaa

SEQ ID NO: 37221 - DNA, 554 bp, Oryza sativa
  unsure (1)..(554): unsure at all n locations
agctgccattgaaatcatgatcgacaatcccgcaagccngcaggttgactctagaggatccccatgagcaattaaccactttgtatcttcagcaacacagattagcagttgataacacgggagcacaagcaccaaaccacaaattgcatcgttgctacatgcatcctagtggagttatatgtagtaatttctgtaactgaccagtgtgcatttcttgatttacttactaattaactctagggtacatgaaccctgtactcattaactttaggttgcatgagtttgtactaaagctataaatagtccatagggcatgtaatgggggattcaaaattccacaaatcaatacacattgttttacttttcactgtgtgaaccacgtctttcgacgtacacagttgtcaatcgacaataatattatcaagatatattcttagttaaatataatgaaactaatttgatattgaaaatattgctaattttttctataaacttagttaaatctaatactttctccatctactcccttaatctttatatttcatcttagcaga

SEQ ID NO: 37222 - DNA, 170 bp, Oryza sativa
cacagtatcaagcctttccctttttttcactcgcaccacccagaaccaacacaagagcaatattgcattccacaaatgcccaatccaaacataacccagtttgccacacaattccccaaccgcataggccagttcgcatcagcacaatcctattttcaaccggcgagagc

SEQ ID NO: 37223 - DNA, 279 bp, Oryza sativa
tcctgtccggcgagaatctcctttaatggccccaaataaatatgactagtacgttagtggagcagtaccaaagatttattcagtgaggttctagcttgtaattcgtagattaatttgttctgaacatgttttgaaggtcaacgccaactttatgtgtgtgaggtcgtcgaacgttttaatttcaagattctctgcttcctttttatgctaccagtacaagatcaatgcgtctcatcgatatatcaatgtatctcgactagaaattaatcgcaccaatca

SEQ ID NO: 37224 - DNA, 1501 bp, Oryza sativa
cccgttgatccggcccgcgaagagcgcgatcatgaaggggagcttcctaagggatgccatcaggtcatccttgctgattccgtgtcatcgtcgacgtccaacgtcttgaacagcttcatcatctgtaatgtaaacggtaggcaatgacagatgagtcgaaactgggtgatggcgttggaagataggtgattagatatgttgcatgaagcaaactggcgacttaccccattatcggtcatcagctcaagcatgcttgaccgcaggacatcggcgagctgctccctgccgatgtgagatgttaggggattcctacacctctcaaacgcggtttcgcaggcgtcctgaaacgatggctgcttcctgaggtgcgcacatccaatcaagaactgcatacatcacgtccttgaatgttagtaagcgcaaggcatcagttattatgttgattgtattcaagttgatacctgacggaatgtgatggattccttggcttcaaaatcgaagtactgaaatatctgaaaaacagatgcacaagttcagcgaagggtgtactgtaactccaattaagggtggcagtatttacgcgaggagaatgccagtaccttcttgcaaagaggggtgcaattaaggccaaaatgagcccaaaaatcttgcgcattcacacgtccgctgcaagggttaaccagttaagtaatgtcatttgtcatgattctgtgaaatcatgataccagcttttaggaaatggaggacatctttttagacttcgcgaccaaattatgtgctctgccatagagcacatatttgtcagtgtgaggatgagaaacttactcgttgtctgggctcatacacaaaaagccttccaagagtgccattgcttctgatgtgctcacaccatatgtctgaaaaagaacaaaaaacatcaggtaccataattgatggagcagcaactataatgcctcaaaagcaccaatgagcaaaagaaaaccatgcatggcaaaagaaaaaaacacagtaacacggctatgattatgctttatctatatagtgggtgggacacctctaaatagttcgcatataaatcatgcacaaaccaagtcctactacaacattttcttcaacaacaatacaatttcaaagtttttgaataagacgaacggtcaaacacgtttaaaaaagtcaacggcgtcaaatatttagggacggagggagtatatctgtagaccaggtcccatattgatatgcatataccaacagtgcgaatgtggaagacttacttcttttacccaagccatctccaccatataatttgagcagttcacctgcaaatgttaaacccagcctattagagatcaaattcatagatgatggaagacagcctaatggcagctatttgttaatatatatctatgcactatgcaacgttccattatatggaatccagcaaacacagtcaaaacaatggacatgaattcagcatgaagatcacactacgacattgcccttt

SEQ ID NO: 37225 - DNA, 514 bp, Oryza sativa
tggtccctttgaattcactctgtacttctgggcttttagtttataaggttaaacttgctttggactggcatatgcaatttggttttaggattgccgaattatccacaaatatgattagtctttttgaagcagaacatatgttctccgtatacttttatgcaaggttaaaaactcatgaaacctgcatcctgcggctaaaatatcagaaaatcacctgttttgtctctagtatacacctgaacccaaccaacaagctaatttactgcacaaactgtcgttatgatgttatatcaagaggaaaatagagttaatactaacatgttctaaggagcaagcagatcatggggttgaacttttcgttttcgttcttttccccttattttcatctattgcttgatcccttgatcgtgtcagaaccgaggacacgtggttttacttgttccaatccgtattatacaactagtataccctgtttgatggatctgaatatggagtggtttgatctttgttcaga

SEQ ID NO: 37226 - DNA, 190 bp, Oryza sativa
tggtgcccctttgatgatccgcttatcttaggccgaattcgagctcggtacccattttctaattgtatttctatatggactctatactcctcttctaatattccttgtttttaattccgaatttcagttatttcttaattgtatttctatatggactctagtctcctcttctaatattccttgtttttaa

SEQ ID NO: 37227 - DNA, 984 bp, Oryza sativa
  unsure (1)..(984): unsure at all n locations
cgagtcccgctcctccacgcgggcctcctcgccgcccaggatccggacgcggacgcgctcgccgagctcctcccggacggcgcggacggccgcggcctcgggggtctcgccggggcgcatcttctccgacagcgggcggagcccgccgcgggagcggagcgtgccgtcggagaggagctgcccggtctccatcagcagcgcgccgcgcccgttgcggatccgaacgctggcgacgtggacggcgcggacgacggaatgctgttgctgctgctgcgatgccggccccccgncggcggcggcgnagatgagnacgcactccccctgtgagagctcgagaaagaggttgaggagggtcttggttcccggcgccgtgccccaggacgccagcgccgacgccggcaggcgcgagccgaggaacgccgccagcgagtccagcgtcgggaaggccagcggccgcggcggcgacggcggccgcatcgcgattggtcagcgcctccgcctctctcagtggtggtggtggtggtggtgggtggaatcgcgattcgctacgaacgcaaatggggaagagaagggatcgcgttgcgtcacgtggagaaatttccaccagccacccaaggccgcgtcctacggcccaagtgcgagtatgggccataggaaagtacaccgaaggtccctcaacttgtcatcgagttacaaaatcgtcctccaagcgcaaaaataggtatctaacgtcccttaactaaccaaaaccggacacaataagtactttaggacaagtactataatatctcatatgttgcccctaagaatgccacattggattgggtgatgaggtggaggagagaagtggagagagagaagatgagccacccctaaatcaagaggcaacctccacacaaatttcaagaagtgtgtgagagtattagagatattggtatttgtgtgttagaggtgatacattgtatgtgttgcctcttaattcat

SEQ ID NO: 37228 - DNA, 504 bp, Oryza sativa
aaagtaaaacagggtgtattgatttgtggaattttgaatcccccattacatgccctatggactatttatagctttagtacaaactcatgcaacctaaagttaatgagtacagggttcatgtaccctagagttaattagtaaggagaatttacatgaatacccttatgatatgggcatttgtgagggtaactagagtctattgtgccttgggctccttgatgggctttgttatgggccctcaggtggcaaaagtgtcttggcctttagtgaaccccctatgcttcgcccgatcgagcccaccaggttttggcagccttggtcgaaggttctcatgatatgccttcaacaaatatatttatttattattgaaaatattactgtattttcctatatatttgatcaaacttaataaagtttggaaaaaatcaaatgacttactccctctgtcttaaaatataagagattttgaccggatgtgtaatatgaaatggaagtagtataata

SEQ ID NO: 37229 - DNA, 331 bp, Oryza sativa
cctttaaaaattattggccgggaatattttgtaatattctttgggccctaatgtactctccgaaattttccgtgaattttcggagctcgagaaataattttaatagcacaaagatcattgcatcaattaaaataaaaagaaaacaaataaaatcctccttcctctctttgggcccctttcggcccaatccctcctttctctcccgcggcccgcgcgccccctttctctccctctcgggccggcctcctccctcggcccgctcggctctctctctccctcaagtccgttctgcctccccagtcggcctctccctccctctctctccgacagg

SEQ ID NO: 37230 - DNA, 512 bp, Oryza sativa
gacattgttagacccgcccataaccgggggcacggctattcgaatagttttattttgatcagaggtgtaccactgtacccacaagacacaaccccacatcatgtcaccatgtgcctcaataccaccacggtacatcggaaagaagttgtgacaataccccttatacaacacaatccactgcagcgcaccttcctggatcataatcacccccttataaacaaggcatgacctccccagcgacccccgtgggcttatcaccgccacttctcagtctggtgctccgcaatgaaccatgcgatacaaaagataaagccgttgcccatgctggcttgtggttggcacggttaatgtttcacaaccgaaactcgtgaaccggtccttaattgtcatgagcacgaccatcaaaaccatgtgctcacaacccaccattatcaggttttagttggcacattaattaattaaggattatgacatgggaattcattaccacccaggaaaggctaatgttgtag

SEQ ID NO: 37231 - DNA, 524 bp, Oryza sativa
cgagctcggtacccctcatattcttcttgatttcttgaatatcagaatcattaatttgggcttttctaacttgatcaattagagtgggcttcacttctagggctgcaacgaaacctctactgacaattcccaaatttaatctttcaaattccttgcataattccaatggcaactgtcgtccttccgtaacattgcaatagcctttcctgctaagagcgtctgctacaacattagcctttcctgggtggtaatgaattcccatgtcataatccttaattaattaatgtgccaactaaaacctgataatggtgggttgtgagcacatggttttgatggtcgtgctcatgacaattaaggaccggttcacgagtttcggttgtgaaacattaaccgtgccaaccacaagccagcatgggcaacggctttatcttttgtatcgcatggttcattgcggagcaccagactgagaagtggcggtgataagcccacgggggtcgctggggaggtcatgccttgtttataag

SEQ ID NO: 37232 - DNA, 517 bp, Oryza sativa
tcacaaattatataatctatccacaggctcgagtgaatgattgagctattagaggatggcacatatctagcctttagcttaatcgatatcgtgaggcaaaggggttcatacaagtatacactagaggttcagccgatatgatctttatgtatgtccggtgggttaatacgttctgctagggaccgctgttgatgcgtggaccgaaaaggagttttcgggctatagccgagtatacatgaacctacagggtcgcatgcttaatgggccggaataaggggattggatggagatccaatatgagcttaattcggatagggatccaaataggagtcctaggggccttggaggcccgagtgatggatcctatatattcgtgaggggtgtgaccagcggaggtattgcatcacgtgagaaaccctagccgtcacttccctccccgagcaaaaccctagccgcacgcgggtgctagcacatctgcgcgtggcgttccgtccctgtacgtgtggataccggtaga

SEQ ID NO: 37233 - DNA, 502 bp, Oryza sativa
gcggcgctccgacagtcggcgggcgaaacgaaggggtggacgaggttggcgaggacgcggcgaagccgaaggaggtgacgccgagtcgggaggaagtccggagcgacgacggcgacgaaccggagctcgtcggcgacggcggagagagaggaagacggtgcgggcacgattccgacggggagagtgagcggcgagtggcggaaacggaggagagaggcacggggaacaattatatagcgccgggagggggagaaagcggccggaggggaaggaaaccggcgcggaggtctcgggcgccattgatggcgccggcgaggtttgcgggagcgattccggacggatccgagggagagagagagggaaaagagggggatcgggagagggaaacgcggggaataattcccccctcattaaggcgcgcggggaaggcgggatgcggcggattcagcggcggcggcggcgctagggcacggcggcgacggacgcggcgggaggaggaaga

SEQ ID NO: 37234 - DNA, 377 bp, Oryza sativa
tttgtcaaccttgggtaatgaatcgactagctcatgttacttgtgtgacctagctagaactatatgcttagccatgcttaattaccactagctcagttgatgagataattacagtattagacctttttagtatcagagtgagctgcgtgctcgagacatctggccatgcttcatggtcgtaattatccaactaaaatgcgactgaatggtgggctgtgggtgcatggttttgctagtcgcacccatggcaattaaggaccggttcgcgggatgccttggaagaacttatcgtacttaccacaagccagcgtgggcaacggctgggcttgtagtgtagctttcctctggccgacgcatccaggcaagggtgggcgtga

SEQ ID NO: 37235 - DNA, 1501 bp, Oryza sativa
tttggtttattcctcgatggagccattgttttgttattttctaaacttttcttgtttaggaacttttataaattaaggtggttagcaatttcgttccaccataaatctttcgggtagtacgtgtgttgatagaaaaaagcgccaaaagatgtaaacatgcttgtttttttacggttaaaacagcataaataatatatgtacaaggaggaacatgatacagaggggaggaaaaaagaaattccaaaaccaaaaccaaattatctaatcgattgaatccatgattgccagctaggtttgcttgcatcctttactctatgcatatgctcaataaaatcctccctgaaatctgagatccattaattcctgaagttgatggggattccattaaagatgagatcatttcttctaacccaaatattccagcacccaatgccaaggacttccatgaagaaagaatgagggaaaagtcctcttgcagccatgatcatgttcatgaattctgtattcagattccatgatatatataccaatgtgattccaatattgctgagcaaaagagcatgaaaaaaaaatagatgaatgttgtcctctgtgatgtaaacatgcttgtggttgtgtacactgtcaaaaagttttccttgaaatctttaggcttcaaattctatactatacatcatgcttatatatgctcctgtattaattgcatgcatgtcaatttttttcttgcaatatgtgttataaaaccgatccgaaaccaccgtcgaaaatcaaatatggaagaaacaccatagaagatccaaacacgatgataacactgagacactatatttattattgaggttcaaacatctcgggatcactgattacaggcactcctctccgatccaacataattacagcgcatcatatttacattgaccctcggccgactaatgctggcagccgcttcctcccgtctatatatgctaagtcatcatgtggttacaacatgattgtgtctctatttaagagagagtttagaaatagttcgattttaactctatcctgcatctgttataatttcaagttctaaactgtgaccgactacgtacatatatttaacacaaattctaatgataaacacagttgagcctcccaaaattcttggagtacagagaagacgtctgcagccatgttccacacacttgaaactcgcagattcctgccttgattagcatgtcacacatcgatgtcagcagctaatgcggcagctgcaaaactcacaaaacaacgctatttggagaacctagtacttgtctaaaccactacgccacaagaatgcaccataaaacctgccaaaactagcttcaaacataaagtatattgttcgatcgtcgcatgcacaagcatatggcgccaaaccatccaccggccatggaggcggcgccggagcacggtggacgttcgtcgtcgtcgtcgacggatccagagctggatcagcataacaagggcatactggaga

SEQ ID NO: 37236 - DNA, 1501 bp, Oryza sativa
aaataaaatttcctaaatataaagcatggatggatttaatttttattaaattctccatggttaattatactctctggaattttctcggatttttcggagctcaattattaatttttaatcatacaaagagcatttcagtaattatccacatattaaattaatcattaaatggtctaattataattttgttaagtacttttagtgtccaagtattttcaagatttttcttggaattatttgagcattggaagtatttttaacaattgaaagatcatttaagtgattattttaattggaaaaagtttttaaatccttccctaagtcgttgggccgatttcggcccaactctttctctctccgcgcagccaaaccggcccaatcggcccagctgcagccgcccgccccctcctctctctctgtcaaagtctagtttgcctccctgctacagtgtcgtccctaacctccagccggctgcctagctgagcccgagccgcgcgccgcgtcgcctttccgcctccaaatccgctccaatccgaccccgtttcttccggatttttgaggggttttgatcctctcgttctcctctatcttttcccccaagaatcggagcaaatcgttgggtattttatccgaatcaaactcgttttcgagtttatctccaaaaccgagtttttgatttctcgaagcgattcctctcgtttggagtccaatctcttcaatccaagcctatataaagcaccccctagtcctcctctttcgtttgccccctctcccgtggtctctcgtgcctcgtagctcgccgtcgacgccgcttagtccgccgccgccgccggccgaactccggtcgcgccgccgcgccgtctccgccgtcgccgccgcttgccgtcgccgcccgtgggtgcgccaaggggtggagaagcccggccgccgcttccccttcgccgccggccaccggagagccgccgccgccggtgaaccgagccgccgccaccgttcctctcgtcgccggtcgtcgtcgtttgtcgttgtggtgagtaccgttgggttcgtctcgtcgtcctctacgtgtacatgtcctccaaagtcgcagccgaccatccaatctccggcgtggtcgtcatcttggttcggccgccattgatgacgtcatcatgacgtcaccagttttcctttttcccgtttttctaatagattaaatcttcggaaaatcataactaaataaccatagatccgtttcgagtggttcaagttgctaaatttttctaaaataaagatctacatattaaaattgtccataaattgaattaaatttatttaattctttttaaatgggctttaattagatttaatcttgtaaaattcataataaattcatttgaagtcagaatgaggccgttcaagtctcataattcaactaaaattatgatctacgtgtttgtttactttatatgtattgtttatttggtttttattagtctttttcttcgttttgcgtgttagc

SEQ ID NO: 37237 - DNA, 1501 bp, Oryza sativa
ggttcgtgagtgcgtcggaagtgatcaagaagattaattgaagaccgattattgcaaggcaagtcacacagatcctaaacactatcctttgagtatgttgatcctatatttaaattctctatttatttcaactgtgcatttattttcaaatgtcatcgggtggtgtgaacctatttctttgttatggccaatttgcattaaatgccctattccttgataccttgggtaataaattgattagcttgaaccttatgtattggtttggttcagctaaatgttatatatataattgcttagcaatgcttagaaacattagctcactaatgggatgaatcatatatactacattattatttatggttacatttaatggtagctcacgatggtaaatcgtgtgattttaattaattgataattaaaacctggttaaggtgggttgtgagcatatggttttgatggttgtgctcatgacaattaaggaccggttcgcgagctactgttgtgaaacattaactgtaccaaccacaagccagcatgggcaacggctttatcttttgtatagcgtgattcattatagtgcgccagactgagaagtggcgagaagtccacgggggtcgctggggagtccatgccttgtttataagggggtgactatgatccgggaacggtgcactgttttgagttgtgttgtgcaaagggtattgtcacgatttccccctttgcaatgccgtggtggtatttcggggcatggcaacatgtgtggaatcgtgtcttgtgggtacagtggtacacctctggccagagtaaaactattcgaatagccgtgcccgcggttatgggcgagttgagcaatgtttttcgtgattagtctcacgcctctcacaataattatagatgttataactggtaataatttgcttagctcctggtttggagttagatctgtacagccgggtgtggttgttcaggatggttgggcctgagcagcatgggtgtgctgttcagtgttgattaaaattgatgattaattacttcactgttttacttctcttaaatgttttgctaaatgctgcttttgcaaatgagcctatattatgccatcctttggaatccctgtgcacttgcatatttgctgtgtggcttgttgagtatgtcatatgctcattcttgcaataatcaatcaacctcagttgaagaaaaaggatccagaaggagaagacgtttggcttataccccagttgagctgcctgtgggagtggagccagagcttcgctagattttattttccgctgcagttttcttcttggtgaggactaagtgcctcttaagtaagtacttatcgttttagttaatgtgatggatttgtatattaaattgtcagtttgtgtacctcggctgattcctggacgaggattttatgcacaaatcagttcggaaattactagtgaatttccgggcgtgacaaaaagggattctctaccatataccctactgactacac

SEQ ID NO: 37238 - DNA, 545 bp, Oryza sativa
  unsure (1)..(545): unsure at all n locations
ttgaaaagaaaatctaattctaattaataaatttcaatataaaattgggccagataaaatttcattaaatactttgcttaattctataattcctagatttttctgggatttatttgagctaaggaagtatttttaataaatggaattgcatttaagaaataatttaaattgaaaaagttttaaaaagtcttcttttggctttgggccgaaagtcggcccaaaaccgccttctctctcttctcggcccagccggcccagtccgaagncggccgcgcgcgcgcgcgcccttgcagccgctgacaggtgggtcccacctgtcaggcccgtcgtcttcctcgggccgaaaccctagcgtgccgccgccgagccgccgccgctgtttccttccaaatccggccgcctctttccttctccggccgaatcaatagaggggaaatgatctccgggatctcctctaccttttctcctttggaatcttcggctaaatcgctttggaaagcgttggaatcgagttcgattcggatcggttttccctctttccaagc

SEQ ID NO: 37239 - DNA, 1501 bp, Oryza sativa
catgacttgatgatgttctgggtaaaccagtgataaagtccatatcgatttcttcccatttccattcaggaatcttcaaaggctgcaacaaaccggcgggtttctgatgttctgccttgactcgctgacaaacatcacatactgctacatattctgcaatttcacgcttcatacttgcccaccaaaatctttccttgagatcctggtacatcttagtactaccggggtgaatggagtataaagtatcatgagcttctttcagaattgcatctttcaaatctttattgtccgggacacaaattctttcacccaactatacagttccttgctcatcctccaagaaaccgatagcttttcctcttctcatattcttcttgatttcttgaatatcagaatcattaatttgggcttttctaacttgatcaattagagtgggcttcacttctagggctgcaacgaaacctctactgacaattcccaaatttaatctttcaaattccttgcataattccaatggcaactgtcgtccttccgtaacattgcaatagcctttcctgctaagagcgtctgctacaacattagcctttcctgggtggtaatgaattcccatgtcataatccttaattaattccaaccatctcctttgtctcatgttcagatccggctgagtaaagatatactttaaactcttgtgatcggtatacatctctgtacgagttccgaaaagataatgacgccaaatcttcaacgcatgaactactgcagctaactcaagatcatgagtagggtagttcttctcatgcggacgtaactgacgagatgcataggcaaccaccttcccatcttgcatcagaacacaacctaacccaagtttggatgcatcgcaatacacttggaaacccttctttggatcaggtagaatcaaaataggagctgatactaagcgattcttcaactcttgaaaactctgctcacaatcttctgaccacttgtacttcacatctttctgaagcagtcgtgtcatgggcttaacaatcttggaaaaattctctataaaactccgataatatcctgcgaggcctaagaaactgcgaatctctgaaactgtctttggttgtttccagttggttacggattccacattgctaggatcgacggcaactcctcctgctgagatgacgtgaccaaggaacttcacttcagacaaccaaaattcacacttgctaaacttagcatacagttgatgttctcgtagcttctctaatgcaaggcgaagatgttcttcatgctcttctttggttcgagagtagataagaatgtcatcaataaagaccaccacgaacttgtctaggtattccataaacaccttattcatcaagttcatgaagaaagcgggggcattcgtaagtccaaaagacataacagtacattcgaacaacccatacctagtggtaaaagctgtcttaggtatatcttcttctttgattctcaactgatgata

SEQ ID NO: 37240 - DNA, 1501 bp, Oryza sativa
tatcacccaaatagagtcatgacttgatgatgttctgggtaaaccagtgataaagtccatatcgatttcttcccatttccattcaggaatcttcaaaggctgcaacaaaccggcgggtttctgatgttctgccttgactcgctgacaaacatcacatactgctacatattctgcaatttcacgcttcatacttgcccaccaaaatctttccttgagatcctggtacatcttagtactaccggggtgaatggagtataaagtatcatgagcttctttcagaattgcatctttcaaatctttattgtccgggacacaaattctttcacccaactatacagttccttgctcatcctccaagaaaccgatagcttttcctcttctcatattcttcttgatttcttgaatatcagaatcattaatttgggcttttctaacttgatcaattagagtgggcttcacttctagggctgcaacgaaacctctactgacaattcccaaatttaatctttcaaattccttgcataattccaatggcaactgtcgtccttccgtaacattgcaatagcctttcctgctaagagcgtctgctacaacattagcctttcctgggtggtaatgaattcccatgtcataatccttaattaattccaaccatctcctttgtctcatgttcagatccggctgagtaaagatatactttaaactcttgtgatcggtatacatctctgtacgagttccgaaaagataatgacgccaaatcttcaacgcatgaactactgcagctaactcaagatcatgagtagggtagttcttctcatgcggacgtaactgacgagatgcataggcaaccaccttcccatcttgcatcagaacacaacctaacccaagtttggatgcatcgcaatacacttggaaacccttctttggatcaggtagaatcaaaataggagctgatactaagcgattcttcaactcttgaaaactctgctcacaatcttctgaccacttgtacttcacatctttctgaagcagtcgtgtcatgggcttaacaatcttggaaaaattctctataaaactccgataatatcctgcgaggcctaagaaactgcgaatctctgaaactgtctttggttgtttccagttggttacggattccacattgctaggatcgacggcaactcctcctgctgagatgacgtgaccaaggaacttcacttcagacaaccaaaattcacacttgctaaacttagcatacagttgatgttctcgtagcttctctaatgcaaggcgaagatgttcttcatgctcttctttggttcgagagtagataagaatgtcatcaataaagaccaccacgaacttgtctaggtattccataaacaccttattcatcaagttcatgaagaaagcgggggcattcgtaagtccaaaagacataacagtacattcgaacaacccatacctagtggtaaaagctgtcttaggtatatcttcttctttg

SEQ ID NO: 37241 - DNA, 1501 bp, Oryza sativa
tgagatcctggtacatcttagtactaccggggtgaatggagtataaagtatcatgagcttctttcagaattgcatctttcaaatctttattgtccgggacacaaattctttcacccaactatacagttccttgctcatcctccaagaaaccgatagcttttcctcttctcatattcttcttgatttcttgaatatcagaatcattaatttgggcttttctaacttgatcaattagagtgggcttcacttctagggctgcaacgaaacctctactgacaattcccaaatttaatctttcaaattccttgcataattccaatggcaactgtcgtccttccgtaacattgcaatagcctttcctgctaagagcgtctgctacaacattagcctttcctgggtggtaatgaattcccatgtcataatccttaattaattccaaccatctcctttgtctcatgttcagatccggctgagtaaagatatactttaaactcttgtgatcggtatacatctctgtacgagttccgaaaagataatgacgccaaatcttcaacgcatgaactactgcagctaactcaagatcatgagtagggtagttcttctcatgcggacgtaactgacgagatgcataggcaaccaccttcccatcttgcatcagaacacaacctaacccaagtttggatgcatcgcaatacacttggaaacccttctttggatcaggtagaatcaaaataggagctgatactaagcgattcttcaactcttgaaaactctgctcacaatcttctgaccacttgtacttcacatctttctgaagcagtcgtgtcatgggcttaacaatcttggaaaaattctctataaaactccgataatatcctgcgaggcctaagaaactgcgaatctctgaaactgtctttggttgtttccagttggttacggattccacattgctaggatcgacggcaactcctcctgctgagatgacgtgaccaaggaacttcacttcagacaaccaaaattcacacttgctaaacttagcatacagttgatgttctcgtagcttctctaatgcaaggcgaagatgttcttcatgctcttctttggttcgagagtagataagaatgtcatcaataaagaccaccacgaacttgtctaggtattccataaacaccttattcatcaagttcatgaagaaagcgggggcattcgtaagtccaaaagacataacagtacattcgaacaacccatacctagtggtaaaagctgtcttaggtatatcttcttctttgattctcaactgatgataccctgatcgaagatctatcttggagaaaacagtggcacctttaagctgatcaaacaaatcatcaattctgggtagcggatacttattcttgatagtcacatcgtttagagcacgatagtccacacacatcctttgggtatgatctttcttttccacaaaaataactggagctccccatggtgacgaactcggtct

SEQ ID NO: 37242 - DNA, 1501 bp, Oryza sativa
ttcccaaatttaatctttcaaattccttgcataattccaatggcaactgtcgtccttccgtaacattgcaatagcctttcctgctaagagcgtctgctacaacattagcctttcctgggtggtaatgaattcccatgtcataatccttaattaattccaaccatctcctttgtctcatgttcagatccggctgagtaaagatatactttaaactcttgtgatcggtatacatctctgtacgagttccgaaaagataatgacgccaaatcttcaacgcatgaactactgcagctaactcaagatcatgagtagggtagttcttctcatgcggacgtaactgacgagatgcataggcaaccaccttcccatcttgcatcagaacacaacctaacccaagtttggatgcatcgcaatacacttggaaacccttctttggatcaggtagaatcaaaataggagctgatactaagcgattcttcaactcttgaaaactctgctcacaatcttctgaccacttgtacttcacatctttctgaagcagtcgtgtcatgggcttaacaatcttggaaaaattctctataaaactccgataatatcctgcgaggcctaagaaactgcgaatctctgaaactgtctttggttgtttccagttggttacggattccacattgctaggatcgacggcaactcctcctgctgagatgacgtgaccaaggaacttcacttcagacaaccaaaattcacacttgctaaacttagcatacagttgatgttctcgtagcttctctaatgcaaggcgaagatgttcttcatgctcttctttggttcgagagtagataagaatgtcatcaataaagaccaccacgaacttgtctaggtattccataaacaccttattcatcaagttcatgaagaaagcgggggcattcgtaagtccaaaagacataacagtacattcgaacaacccatacctagtggtaaaagctgtcttaggtatatcttcttctttgattctcaactgatgataccctgatcgaagatctatcttggagaaaacagtggcacctttaagctgatcaaacaaatcatcaattctgggtagcggatacttattcttgatagtcacatcgtttagagcacgatagtccacacacatcctttgggtatgatctttcttttccacaaaaataactggagctccccatggtgacgaactcggtctgatgtatcctttctgaagtaaatcgtcgacttgcctcttaacttctgccaactcatttgctgccattctatatggtctcttatggatcggagttgttccaggtaccaaatctattctgaactctatatcccttttaggcggcataccaggtaaatcatctgggaacacatcaggatactcccggactataggaatctctcccaaagttatctggttcagtcttgaccttaaagactcagtagacaatgcatgaacggttacaacttgaccatcatggct

SEQ ID NO: 37243 - DNA, 301 bp, Oryza sativa
cgacatgtgggacccctacaccggcatcccccgccggccatctttcatgcgtcgaagaccacgccacatccaccggcaactcctcctcacacctaggtcgcctcctccactgccggccacgcctctcgcgccaagccagcctccatctccgctgcccgcgcctctcgcgccgagccggcctccgctaccatcgactgcgactctttgcgccaagccggtctccgacccctccaccgaacgatgccgcgcctgccagaagcagccgtctcccacgccctcggctagccgtccgagactgtca

SEQ ID NO: 37244 - DNA, 1227 bp, Oryza sativa
gtcttaaagcatcgaacacatcattcgctttgtcagacttgctagaagcattaaaagaaccccattgcagtttcagtttaaaaatttgactctttctgaatagttgagcatcagttccctcatccctgcttttcacattctcaagagatgtaatagcaagcgacccctgaagttcattcatctgcttcagcacctctagtccctgcactttactcttatcaacacagaattccccagccgctcgaagacatggcatatggctgctggcagctaaatcaacagtgcacatacgatgaacatcaatacacaaaatgctgctcaaggtgcccaagcacttaggaaaagtaacaagtcgcctgtccatgaaacatgaatgccagcgtatggacaacacaagtaaatggtgaagtttacagagtgaatttggaagcgagttttgcgtatgttgtgttagaatttcaatggttactctcattgagaagaggatggcactcgagatggggcaattttctggttttcttcattcacaaaaacacaaaagccatacctacccgagggaggttggatacatatatatagccatagctggctgctagcctattgctgcaccctcctagtctaaaattcaaaatttgaatgggatgttgtcctagaaggcatccaaactgaataaagcataaaggaggcataaaggagatgctaactgctgctgtcctactaaccgcagctgtcctagcaactgaaaaatatgctaaagggtagatgctgtcctgaaaaaggtgaaactacccaaaagcaaaaagaagaatcacgaccaaggatcacaaagacttatccaacattctccccctaagtcttgtgcgtcgtcttgtggggaagttgggccatcccgatcctggagcagagctcgaggaacttgatcctcccaagaggcttggtgagcaagtccgcaagctggtccttggtgttgatgtagctcgccttgatgctcccttcttccaagtagcttcggatgaagtggtacctcacccggatgtgcttgctccgttcgtgaaaaacggggttctttgtcagggccagagcggacttgctatccaccctgagctccaccgttccagtgtctctgccgaggagatcactaagcagtcgagcaagccagagcgcctgggtcgaagcggcggaggccgccatgtactcggcctcgcagctggacagggccaccacctg

SEQ ID NO: 37245 - DNA, 1501 bp, Oryza sativa
atgctgatagatggagagaattgtttgctcctttatgctatggagctaaaggaagcaaaattcttgttactgctcgaacaaatattgtttcaaggattttgggttgcccagcaccattccatttggagggtctgaagggtgaagatagttggaacctcttcaggatctgcgcatttggcgctgaagatccaggaaattatccagaactagagtctatcggtgaatgtattgtccaaaagttgaatggctcagcattagtcataaaggttgttggtgcacatttgaatgctaacctcaacgttgaagagtggacacgagttatgaaaagtagttcatcaaacaaggaagacattatgcaaattttgcgtctgagctatgaatgcttgccaggtcacctccagcaatgttttactttttgcagcctgttccccaaaggctattctcttgagcctgacttgttggtgaatatgtggatagcccataaatttgttcatggtcatataggcacatatgaaagtatgagagaaactggtagaagttatttcaatgaactattatctagatcattttttcaggaacttcagtatggccatacaatacgttatgttatgcatgacctcatgaatgaccttgcttctcacatttccagaggtgagtactccagaatagaaagagatggtaatcttgcagaaatttcaggaacaactcggcatctgtctatacctgtcgaaagagtaaatgaactccatggattccataacttgcaaaggctgcgcacgctaatagtttctgaacgaaggcaggtctctttgctcaaaactttgtctgcaggcggatgtttttaaggaattcaagtgcataagagtattggatttaagtggctgttgcttagaatttctgcctacatatattgatcatttgatacatctcagatttctttatctccaacatgttggataagtctttgtgatccttggttgtgattcttctttttgcttttggatagtttcacctttttcaggacagcatctaccctttagcatatttttcaggtgctaggacagctgcggttagtaggacagcaacagttagcatcttctttatgcctcctttatgctttattcagtttggatgccctctaggacagcatcccattcaaatttcgaattttagactaggagggtgtagcaataggctagcagccagctctggctatatatatgtatccaacctccctcgggtaggtatggcttttgtgtttttgtgaatgaagaaaaccagaaaattgccccatctcgagtgccatcctcttctcaatgagagtaaccattgaaattctaacatctggtatcagagccacactttcctgtaggctaaacatctcttgttccaccccttcccaagctcggttgagctctcagccagcagcagcagcactggttgctcctccttcccctttcccttccccctctccacgcagcagccccccggaggtgcgcca

SEQ ID NO: 37246 - DNA, 1501 bp, Oryza sativa
gcaatatgccgatgagtttattaattcttctccaatatgccattcggctagatcatttttatgaaaaatacgcagaatacccttaaagacatcgaagttagcattaatttataggtttaatttatagttgtctttatttcttgttgattacaggatcaaatcaactggtacgctagcatacccgaagacgatttttggacctgcactggaattaagcagatctctcaggcctcgtgtttttcatcaatatttaaataagatataaaattgtctatatagcatccttacacaatatgaaagtttgcatatagattttcaagttattggggcatttttatttttttaaaagaaataattttatgtgataactgatagagaaattgcttacgtaaaatataatagcataaaattatgttgggtaggatatgaaatatgatttatattaaaaacaaagacaaaatattttatatagcataaatggataaattataatattttataaaaaatgaaatacaaaaatctttaaacttatacacaaactttcacattgtgtatagaggctaaaaaaattcataattttttttaaaaacttttaataggataaatcaatagttaatcttacatgtaaggccaacctaatgatatactcccttcatattagtaaagaaagtcgttgagtacaatgtttaagttaaatcttgagaatataagtgatgaataactctcaagttgttgagtttgaaaatgtaaaattatatgaatagatttgtcttgaaaaatactttcataaaagaatatatatatatatatatatatatatatatatatatatatatatatatatatatatatatatatatatatatatatataacttttcaataaatatttttatggaaacaagaactcaaagttgtgttttggagaccgtgctgctgtctaaaatgacttcatttacgagtacggagggagtattaatgccaattataaatcattaaactatgataaactcaatattatagagtatattctctataccgtgtcatctcgatggtaaaaaacagttgctctctccggtcatccggtcacacactcgagtcactctcactcaccacagttcttttttcttccaaccaaaaatcactctcaagttctgagtagtgatttttgccgtctaggtttgaagctaaaacttccgttaccaaaatgccggcattttgaatagtattttggctatgtttggtttcctacagcaacaagtaaatattactatcaaaatatcgataatgtcaaaagacagggtaaaaaccaaccttcgttttggtgaggtgacaagataagcagaactctcaagtctcacaatcgctctgactgcaagctggggatcttggagcttgcagaaacacggatcagcgagaggtgctactgcttttgcaaaatcacaagttgccgagggtgcaatagcaaaagaaggcaacctttgctaattgcttcgctactc

SEQ ID NO: 37247 - DNA, 1501 bp, Oryza sativa
atcttctgaccacttgtacttcacatctttctgaagcagtcgtgtcatgggcttaacaatcttggaaaaattctctataaaactccgataatatcctgcgaggcctaagaaactgcgaatctctgaaactgtctttggttgtttccagttggttacggattccacattgctaggatcgacggcaactcctcctgctgagatgacgtgaccaaggaacttcacttcagacaaccaaaattcacacttgctaaacttagcatacagttgatgttctcgtagcttctctaatgcaaggcgaagatgttcttcatgctcttctttggttcgagagtagataagaatgtcatcaataaagaccaccacgaacttgtctaggtattccataaacaccttattcatcaagttcatgaagaaagcgggggcattcgtaagtccaaaagacataacagtacattcgaacaacccatacctagtggtaaaagctgtcttaggtatatcttcttctttgattctcaactgatgataccctgatcgaagatctatcttggagaaaacagtggcacctttaagctgatcaaacaaatcatcaattctgggtagcggatacttattcttgatagtcacatcgtttagagcacgatagtccacacacatcctttgggtatgatctttcttttccacaaaaataactggagctccccatggtgacgaactcggtctgatgtatcctttctgaagtaaatcgtcgacttgcctcttaacttctgccaactcatttgctgccattctatatggtctcttatggatcggagttgttccaggtaccaaatctattctgaactctatatcccttttaggcggcataccaggtaaatcatctgggaacacatcaggatactcccggactataggaatctctcccaaagttatctggttcagtcttgaccttaaagactcagtagacaatgcatgaacggttacaacttgaccatcatggctggtgagagttacttttctgttggcacagtctatcacaccattatgtctggctaaccagtccatccctaggatgacatcaaggtctttggattctaacaagataagattggccagaaatggtactccttgaatttctattctgacagaggggctacgatgcaaagaaagtgcttgattacttggggtactaaccatcaaaggacgtctaagatcttctacttccatcccatgatttcccgcaaaactcatagataagaatgaatgtgtagcaccagaatcgaaaagtactgttgcaggaactgagttaacagggaacgtacccaaaatcacatctggagcatcttgagcttctgcagctgcaacatgattgacacgggccttcgatgctggtacagtagagttgctctgagcaggaacaaccttcacgcgacggggcttcggacacttgtcagcataatgtcctggatctccacagttgaaacataccacaggcttgctgcct

SEQ ID NO: 37248 - DNA, 1501 bp, Oryza sativa
gctcacaatcttctgaccacttgtacttcacatctttctgaagcagtcgtgtcatgggcttaacaatcttggaaaaattctctataaaactccgataatatcctgcgaggcctaagaaactgcgaatctctgaaactgtctttggttgtttccagttggttacggattccacattgctaggatcgacggcaactcctcctgctgagatgacgtgaccaaggaacttcacttcagacaaccaaaattcacacttgctaaacttagcatacagttgatgttctcgtagcttctctaatgcaaggcgaagatgttcttcatgctcttctttggttcgagagtagataagaatgtcatcaataaagaccaccacgaacttgtctaggtattccataaacaccttattcatcaagttcatgaagaaagcgggggcattcgtaagtccaaaagacataacagtacattcgaacaacccatacctagtggtaaaagctgtcttaggtatatcttcttctttgattctcaactgatgataccctgatcgaagatctatcttggagaaaacagtggcacctttaagctgatcaaacaaatcatcaattctgggtagcggatacttattcttgatagtcacatcgtttagagcacgatagtccacacacatcctttgggtatgatctttcttttccacaaaaataactggagctccccatggtgacgaactcggtctgatgtatcctttctgaagtaaatcgtcgacttgcctcttaacttctgccaactcatttgctgccattctatatggtctcttatggatcggagttgttccaggtaccaaatctattctgaactctatatcccttttaggcggcataccaggtaaatcatctgggaacacatcaggatactcccggactataggaatctctcccaaagttatctggttcagtcttgaccttaaagactcagtagacaatgcatgaacggttacaacttgaccatcatggctggtgagagttacttttctgttggcacagtctatcacaccattatgtctggctaaccagtccatccctaggatgacatcaaggtctttggattctaacaagataagattggccagaaatggtactccttgaatttctattctgacagaggggctacgatgcaaagaaagtgcttgattacttggggtactaaccatcaaaggacgtctaagatcttctacttccatcccatgatttcccgcaaaactcatagataagaatgaatgtgtagcaccagaatcgaaaagtactgttgcaggaactgagttaacagggaacgtacccaaaatcacatctggagcatcttgagcttctgcagctgcaacatgattgacacgggccttcgatgctggtacagtagagttgctctgagcaggaacaaccttcacgcgacggggcttcggacacttgtcagcataatgtcctggatctccacagttgaaacataccacaggctt

SEQ ID NO: 37249 - DNA, 1501 bp, Oryza sativa
tctaatgcaaggcgaagatgttcttcatgctcttctttggttcgagagtagataagaatgtcatcaataaagaccaccacgaacttgtctaggtattccataaacaccttattcatcaagttcatgaagaaagcgggggcattcgtaagtccaaaagacataacagtacattcgaacaacccatacctagtggtaaaagctgtcttaggtatatcttcttctttgattctcaactgatgataccctgatcgaagatctatcttggagaaaacagtggcacctttaagctgatcaaacaaatcatcaattctgggtagcggatacttattcttgatagtcacatcgtttagagcacgatagtccacacacatcctttgggtatgatctttcttttccacaaaaataactggagctccccatggtgacgaactcggtctgatgtatcctttctgaagtaaatcgtcgacttgcctcttaacttctgccaactcatttgctgccattctatatggtctcttatggatcggagttgttccaggtaccaaatctattctgaactctatatcccttttaggcggcataccaggtaaatcatctgggaacacatcaggatactcccggactataggaatctctcccaaagttatctggttcagtcttgaccttaaagactcagtagacaatgcatgaacggttacaacttgaccatcatggctggtgagagttacttttctgttggcacagtctatcacaccattatgtctggctaaccagtccatccctaggatgacatcaaggtctttggattctaacaagataagattggccagaaatggtactccttgaatttctattctgacagaggggctacgatgcaaagaaagtgcttgattacttggggtactaaccatcaaaggacgtctaagatcttctacttccatcccatgatttcccgcaaaactcatagataagaatgaatgtgtagcaccagaatcgaaaagtactgttgcaggaactgagttaacagggaacgtacccaaaatcacatctggagcatcttgagcttctgcagctgcaacatgattgacacgggccttcgatgctggtacagtagagttgctctgagcaggaacaaccttcacgcgacggggcttcggacacttgtcagcataatgtcctggatctccacagttgaaacataccacaggcttgctgccttgctccctcttagcaggctgttgttgtgttggagctgcaacagggcgtggaacttgattgcggatgttgttgccaacattgttgttgaagatctgacgctgcggacgaacaacagacgaagaacctccatgtggcatagactggggtcctaaagtaagacgtggcctttgattattcccctgttgtgccttaaagtgagcaatccggtgtttcttctgctccatgcgattgtacttgtcctcctgacgaatagccttatccactaatttctggaaatcagaat

SEQ ID NO: 37250 - DNA, 1501 bp, Oryza sativa
agaaagcgggggcattcgtaagtccaaaagacataacagtacattcgaacaacccatacctagtggtaaaagctgtcttaggtatatcttcttctttgattctcaactgatgataccctgatcgaagatctatcttggagaaaacagtggcacctttaagctgatcaaacaaatcatcaattctgggtagcggatacttattcttgatagtcacatcgtttagagcacgatagtccacacacatcctttgggtatgatctttcttttccacaaaaataactggagctccccatggtgacgaactcggtctgatgtatcctttctgaagtaaatcgtcgacttgcctcttaacttctgccaactcatttgctgccattctatatggtctcttatggatcggagttgttccaggtaccaaatctattctgaactctatatcccttttaggcggcataccaggtaaatcatctgggaacacatcaggatactcccggactataggaatctctcccaaagttatctggttcagtcttgaccttaaagactcagtagacaatgcatgaacggttacaacttgaccatcatggctggtgagagttacttttctgttggcacagtctatcacaccattatgtctggctaaccagtccatccctaggatgacatcaaggtctttggattctaacaagataagattggccagaaatggtactccttgaatttctattctgacagaggggctacgatgcaaagaaagtgcttgattacttggggtactaaccatcaaaggacgtctaagatcttctacttccatcccatgatttcccgcaaaactcatagataagaatgaatgtgtagcaccagaatcgaaaagtactgttgcaggaactgagttaacagggaacgtacccaaaatcacatctggagcatcttgagcttctgcagctgcaacatgattgacacgggccttcgatgctggtacagtagagttgctctgagcaggaacaaccttcacgcgacggggcttcggacacttgtcagcataatgtcctggatctccacagttgaaacataccacaggcttgctgccttgctccctcttagcaggctgttgttgtgttggagctgcaacagggcgtggaacttgattgcggatgttgttgccaacattgttgttgaagatctgacgctgcggacgaacaacagacgaagaacctccatgtggcatagactggggtcctaaagtaagacgtggcctttgattattcccctgttgtgccttaaagtgagcaatccggtgtttcttctgctccatgcgattgtacttgtcctcctgacgaatagccttatccactaatttctggaaatcagaataatctccagtcatgagtgggtaagaaagctcatcattaagtccttccaaaaacttctcctgacgctcttcatcattgcgcacatcttccggagcataacgggctagacgattgaactcgtgcaaata

SEQ ID NO: 37251 - DNA, 1501 bp, Oryza sativa
gatagtcacatcgtttagagcacgatagtccacacacatcctttgggtatgatctttcttttccacaaaaataactggagctccccatggtgacgaactcggtctgatgtatcctttctgaagtaaatcgtcgacttgcctcttaacttctgccaactcatttgctgccattctatatggtctcttatggatcggagttgttccaggtaccaaatctattctgaactctatatcccttttaggcggcataccaggtaaatcatctgggaacacatcaggatactcccggactataggaatctctcccaaagttatctggttcagtcttgaccttaaagactcagtagacaatgcatgaacggttacaacttgaccatcatggctggtgagagttacttttctgttggcacagtctatcacaccattatgtctggctaaccagtccatccctaggatgacatcaaggtctttggattctaacaagataagattggccagaaatggtactccttgaatttctattctgacagaggggctacgatgcaaagaaagtgcttgattacttggggtactaaccatcaaaggacgtctaagatcttctacttccatcccatgatttcccgcaaaactcatagataagaatgaatgtgtagcaccagaatcgaaaagtactgttgcaggaactgagttaacagggaacgtacccaaaatcacatctggagcatcttgagcttctgcagctgcaacatgattgacacgggccttcgatgctggtacagtagagttgctctgagcaggaacaaccttcacgcgacggggcttcggacacttgtcagcataatgtcctggatctccacagttgaaacataccacaggcttgctgccttgctccctcttagcaggctgttgttgtgttggagctgcaacagggcgtggaacttgattgcggatgttgttgccaacattgttgttgaagatctgacgctgcggacgaacaacagacgaagaacctccatgtggcatagactggggtcctaaagtaagacgtggcctttgattattcccctgttgtgccttaaagtgagcaatccggtgtttcttctgctccatgcgattgtacttgtcctcctgacgaatagccttatccactaatttctggaaatcagaataatctccagtcatgagtgggtaagaaagctcatcattaagtccttccaaaaacttctcctgacgctcttcatcattgcgcacatcttccggagcataacgggctagacgattgaactcgtgcaaatactctgtaacagagcgagatccctgcgtaagcgacctgaactccttcttcttgagagacactactcctgatggtatatgcgtcttccggaaagcagcggtgaattcaagccaagtgataggttcagcagtagtcctattcaagcggaagtgatcccaccattcagaagcaggaccatgcaactggtgtgatgcaaaagagaccttc

SEQ ID NO: 37252 - DNA, 1501 bp, Oryza sativa
atggtgacgaactcggtctgatgtatcctttctgaagtaaatcgtcgacttgcctcttaacttctgccaactcatttgctgccattctatatggtctcttatggatcggagttgttccaggtaccaaatctattctgaactctatatcccttttaggcggcataccaggtaaatcatctgggaacacatcaggatactcccggactataggaatctctcccaaagttatctggttcagtcttgaccttaaagactcagtagacaatgcatgaacggttacaacttgaccatcatggctggtgagagttacttttctgttggcacagtctatcacaccattatgtctggctaaccagtccatccctaggatgacatcaaggtctttggattctaacaagataagattggccagaaatggtactccttgaatttctattctgacagaggggctacgatgcaaagaaagtgcttgattacttggggtactaaccatcaaaggacgtctaagatcttctacttccatcccatgatttcccgcaaaactcatagataagaatgaatgtgtagcaccagaatcgaaaagtactgttgcaggaactgagttaacagggaacgtacccaaaatcacatctggagcatcttgagcttctgcagctgcaacatgattgacacgggccttcgatgctggtacagtagagttgctctgagcaggaacaaccttcacgcgacggggcttcggacacttgtcagcataatgtcctggatctccacagttgaaacataccacaggcttgctgccttgctccctcttagcaggctgttgttgtgttggagctgcaacagggcgtggaacttgattgcggatgttgttgccaacattgttgttgaagatctgacgctgcggacgaacaacagacgaagaacctccatgtggcatagactggggtcctaaagtaagacgtggcctttgattattcccctgttgtgccttaaagtgagcaatccggtgtttcttctgctccatgcgattgtacttgtcctcctgacgaatagccttatccactaatttctggaaatcagaataatctccagtcatgagtgggtaagaaagctcatcattaagtccttccaaaaacttctcctgacgctcttcatcattgcgcacatcttccggagcataacgggctagacgattgaactcgtgcaaatactctgtaacagagcgagatccctgcgtaagcgacctgaactccttcttcttgagagacactactcctgatggtatatgcgtcttccggaaagcagcggtgaattcaagccaagtgataggttcagcagtagtcctattcaagcggaagtgatcccaccattcagaagcaggaccatgcaactggtgtgatgcaaaagagaccttctcctgatcagtgcactgaagcaaatccaacttcttctctatggcatgcagccaatcaccagcttctacaggattagtggtactaga

SEQ ID NO: 37253 - DNA, 1501 bp, Oryza sativa
tcttatggatcggagttgttccaggtaccaaatctattctgaactctatatcccttttaggcggcataccaggtaaatcatctgggaacacatcaggatactcccggactataggaatctctcccaaagttatctggttcagtcttgaccttaaagactcagtagacaatgcatgaacggttacaacttgaccatcatggctggtgagagttacttttctgttggcacagtctatcacaccattatgtctggctaaccagtccatccctaggatgacatcaaggtctttggattctaacaagataagattggccagaaatggtactccttgaatttctattctgacagaggggctacgatgcaaagaaagtgcttgattacttggggtactaaccatcaaaggacgtctaagatcttctacttccatcccatgatttcccgcaaaactcatagataagaatgaatgtgtagcaccagaatcgaaaagtactgttgcaggaactgagttaacagggaacgtacccaaaatcacatctggagcatcttgagcttctgcagctgcaacatgattgacacgggccttcgatgctggtacagtagagttgctctgagcaggaacaaccttcacgcgacggggcttcggacacttgtcagcataatgtcctggatctccacagttgaaacataccacaggcttgctgccttgctccctcttagcaggctgttgttgtgttggagctgcaacagggcgtggaacttgattgcggatgttgttgccaacattgttgttgaagatctgacgctgcggacgaacaacagacgaagaacctccatgtggcatagactggggtcctaaagtaagacgtggcctttgattattcccctgttgtgccttaaagtgagcaatccggtgtttcttctgctccatgcgattgtacttgtcctcctgacgaatagccttatccactaatttctggaaatcagaataatctccagtcatgagtgggtaagaaagctcatcattaagtccttccaaaaacttctcctgacgctcttcatcattgcgcacatcttccggagcataacgggctagacgattgaactcgtgcaaatactctgtaacagagcgagatccctgcgtaagcgacctgaactccttcttcttgagagacactactcctgatggtatatgcgtcttccggaaagcagcggtgaattcaagccaagtgataggttcagcagtagtcctattcaagcggaagtgatcccaccattcagaagcaggaccatgcaactggtgtgatgcaaaagagaccttctcctgatcagtgcactgaagcaaatccaacttcttctctatggcatgcagccaatcaccagcttctacaggattagtggtactagagaaaataggcggcctcacacgaagaaactctgctaacttgttctgaggaggtgcatggttatttccttggttctgctgattctgaagttgttgcat

SEQ ID NO: 37254 - DNA, 767 bp, Oryza sativa
tttaaaactttttcaatgttaaattatttcttaaatgcaattccatttattaaaaatacttccttagctcaaataaatcccagaaaaatctaggaattatagaattaagcaaagtatttaatgaaatttatctggccactttttagattggaatttattaattaaacttagattttcttttcaaacctttttaaaataaattctagaaattccatttaaacaacaatttatataatttgaatttttagggtgtgacatcctacctgtcggagagagagggagggagaggccgactggggaggcagaacggacttgagggagagagagagccgagcgggccgagggaggaggccggcccgagagggagagaaagggggcgcgcgggccgcgggagagaaaggagggattgggccgaaaggggcccaaagagaggaaggaggattttatttgttttctttttattttaattgatgcaatgatctttgtgctattaaaattatttctcgagctccgaaaattcacggaaaatttcggagagtacattagggcacaaagaatattacaaaatattcccggccaataatttttaaaggaaatttttaattccctcaataattcacttgattaagttgatttaacttttatttaatttctagaaaatgtattattaattgatttttattcccgaacgaaaatcgggacgttacatatcctatacttattctagttacataaactatctcctgtaaccatttggataatcaagc

SEQ ID NO: 37255 - DNA, 1501 bp, Oryza sativa
gctccttgttttggattggtactattatttttgaaactgctattgtttcaagtgagtgaagtgggtctctaacaatctggtatcagagccaccaatccctactgagttcaccaagcaagttgccatggcaagtgaacataagttggatatgattttgaggcgaatggaggagttcgaacggaggcgggtggaggcagagcagacaaggagagctgatttccaatctctcaaggtagcgttagcatcatggattccccatttagaatagcactgaagactcacattttttagttgggaacaagcagtacaagatgacgcccaccatgtgttcgacaaaatgcttcagccccgatgtcgagcccaatctcactgttgatgtggttgttacatgtgccaccactgctatgacctttgttgatctggtagctgctgaggacgcaatcggtgcaacctacatctacaatcctatacagcccatggtaacgcccgccaagtgtttgacaaattgctccaaccccaatgacatcccagacctcatcgtggtagcagtggttacgtgcacctccacttctctggcctccatggacctagaagttggtgaggacgtcgcctgcaccactgaaattgatggccctgactgtcacaaggagacgcacaccaaatgttcgatgttaggccttgatgtcaagggtggcgcagaccacgtcggggacgtgttcctgacaatgacgggtgtggccaaggctgttccaatatctatcgagtcaattgacatcttctcggcaaggttagtcagcgacctcaagtaggacataccaatgcccaccgggtgtttgttgagaatccctcgatatgacagcaagacacagttcagtaaaaagctaaggctggaggggattgaattgaagccatggccacctccaacctacagtggagtgattagtggactgagttccggccaacgccttggccagcattcatctattgttggcttgaagaacatctacttgatccttggccaccatcaactgaatgggctaagttgaaaccgtggcccccaccacatgagaatgacatcctgcccttattgatcaatggcttcacccatatcctggtggatcgaaaagcaatttcaaaattctggaaagcgatttggagtgagtcaggtgaagaaggatcattgtttgttcctaagctatatgagctgcacttgagtggtctccttcagcattcagtaagcatgatatgacaacagcttatgtcaaggagaatatggtccactaaggctaaaatgaagatgttgaatggttgggattctaaacagtacctgagcattatgcggcctattccaggattgtttgttaaacttatccaagatatatctccaaagagccatcatcaagcttatgtagaagctcaagttgttaaaaattcttggaaaactttggtgaaaataaggtacactttttggctcaatcaattgctgtacctgagactcacc

SEQ ID NO: 37256 - DNA, 210 bp, Oryza sativa
tctcgtctaatattgaccctatgtttctattgttctgttgcttggaggtcgggctgtatagtctcttttatgttctttctggtgatagtcctcacaccatgttcataccccactttagatttgacttgtgatgataccagacttaaaagattatttttctcagttaaaagattattttctcaggtttctggaaggctgtttaatcagagt

SEQ ID NO: 37257 - DNA, 365 bp, Oryza sativa
aattcaacaaaacagcacataaacaagcatgaacagtacatgtggatatttttaatgtgtagatctcaattttagaaaaatttagagacttgaaccaactaaatcggagctaagatgaattagttatgaatttttaaagattaaatcggattaaaacacttaaatcggtttaaattgaattatgacgcaataatgaattatttttgaaaaggaaaagaaggtttattgcgtcagcgggctagggtttgcggtggaccgggcgcacgggcggcggttcacgcgaacggacggccgagattcgatccaatccaaacggacggccgagatcgatcgggtccacggcggctcacggcggacgaccccga

SEQ ID NO: 37258 - DNA, 1501 bp, Oryza sativa
cagtttgctgttgcttctatcctgcccatccatcttttaatcaatggatgtatgtctttgtccccacttcatggacaattaacattcaattaattgatctgatttaaaagacaaataattcttagcattgctaaacatatttataaaaaaaatctttacaatacttatacgaacaaagttctcaaccatttgacttgactataagaattatagaaaaaatatactcttatattctcatacgccgttgatttttttaaacatgtttgaccgtttgtcttattcaaaaacttttatgaaatgtgtaaaactatatgtatacataaaaaaaatcaaatgataggaaaagaattaataattacttaatttttttaataatacgaacggttaaacattttttaaaaagtcaacggcgtcaaacattttcggatgaagggagtataacttaaacaattttttctaaatacccccgtcccaaaaaaaaacacaatcctagcaacagacctgaacacgtatgtgtctagattcgttgataggattggattctttttgagacggagtagtaaacattagcgagacagttgtgagttgtttagtatggaggtgggataattattttctttatgtttctgaatgaatagatatcaaatactccctccgtattttaatgtatgacgccgttgactttttaataaacgtttgacctttcgtcttattcaaaaaaatttatgtaattatcatttattttattgtaaatttatttatcatcaaatattctttaagcatgacataagtatttttatacttacataaaaaattgaataaaacaaatggtcaaacgtcgtttaaaagtcaacggcgtcagagggagtatatattttagctgctcattcaaatagcgaaggatgtgttggctgtctttgttttttttttcctggtttaccgcttgagattgttttcttcaatttctctaattaaatggctactagttaatcacgattgatggaagcggttgattgaatgagggatggcgtggatgaaagcaacggcaaactttgccttttgccacaaaggcagaggatgcaaacccgtgtcggtgtccgatctgatcggacacggacacacggctgtggaccccaccagccaaccgtgcgaaccgcccacgagccaccctcccatccccacctgtcagcctcatccgccgactcgatgcggccccacctgccggccacactcacctgctccccctccccgaccgttacattcaaacgcgccaatccgaccgttacccacattaaaaaaaatggacacgcttcgacaccaacaagcacatccgattcccctccagcctccactgtgctcctcgtgtccgccgttctgatctccattataccacctcggaatcccacggacaccgcgcgccccacataaccccatgacccggatccctccccgccacccatggacgctcctcccctccgcctccgcctcgccgtcgccttct

SEQ ID NO: 37259 - DNA, 870 bp, Oryza sativa
tggtgtaatcaaaagcctgcagctcgactctattttatcccataaatatattcatgtctataaacagtgagcttgctatgcttatggatgattcatgttgaggatacaatgtaccgatgttaagcaccgtccctttttgtttaaggcagtgcctcgtattcatgtaatgagggagaaatgtgtaatacagacaagttccatgaggattcgtttgaaagatgcggatatgtgatcatgtgcataactgcagactgactaaaggatccccctagggtctcgtgtcagaggaactatgttctaacctcgagttaataaccaacctgtggatggaaaagaaaaacaattaaactgtgatgggctaaaaagccaacgagacagtagttgaggataggagtttggatacgccttttacagatcaagataagggttgttggaggaaacccctaagggtacccgccatgcctctacattgataagatcggatatacctgccaacagttaagaagatctaggagacatcaatatttgagaacataatagtcgatggctggtaattagtttatccggtatcagaaaaaggtcaaaggtgatatggcagaagaacaatttggatgctccccatctcgaggaagcactaaagatgaccatcggcaattaaaccctagtggtatagatacagatagcgggcaatgtatttccctgaaggtagtcagtacagccttttgacgaaccacatcaaggtttcactggaaggcagcaagccaaaggacctcatcgtccccagaagcgtccgcaatccacgttaaagaataccacctgttagagataagccgaaagatgatttataaaaaaaaaaaagattggcaaaga

SEQ ID NO: 37260 - DNA, 329 bp, Oryza sativa
acgattagtgttagctagtactaggaacaacctcaacgcttttgatgacaaacggcccaaagcaacaggagcatctcttccaaacccaattcccaaagaaatgaatacgtgcaaccaaagtttctccaccgtctgattatctgtccatcattagctggtttaatcagttttcagtttttttcacacacagattgcttgattagatgcagaaagaagcgaggtttattaaacttggcgccaatttagcaattaacagaaaaaccaaccacgcatatggcagcagcagcagcaactctcgccacggaaaatgctagtagtatactaggcca

SEQ ID NO: 37261 - DNA, 432 bp, Oryza sativa
ctgcaccattcaagaaggcagcaactgtccatgcctggtgcaagcaggccaacatgctcaccggtgacaaatttgaaatgactaacgaaatgtgctgaaatgcatatcagctacagcttcaatcaacacgattcccatctcgttggcaaacggcaatcatcaagcaggcccaaataactcagggatgctatgtgcgggctcttctgatttcagaaatttacaagcaccaattgccagccaaattaaaatccaaatcagcctgaattgcagctcacaacgaccatggcatgatagttctcacttctcagatcctttcgtgatgcagccttgaagccatgacagttgagcagcgaaaatatctatgttgatgaggcctcaatttagagaaaaaaggaaggcatagaaaggattcagaggagaagcatgctgtat

SEQ ID NO: 37262 - DNA, 1501 bp, Oryza sativa
tctttaaaggaggtaaagcttgcaaagttcactgctcagtgtggttatttacattgtttctgaagaacagttgctgcttgaaatttgaagttgattgtcttctttaagctagggaccttttctatctgcttcatggcattgtaccagtcctctgcaagcaggttttttgttctcagaagggaaaaaagaaaatcaaaatcaggtgtgtagtagatatatagaagtacgagaaaatacatataaaggttcgaatcttttaattccattgtcgattggaataattttgttggacattagtggaggagggtctgtttatttgagctgtgaagcttttggcttcagcaccagtaattgaaaacataaaagtattaccgtaaaataattttttggtaaattttatgtaaattaacccgggtattatggttcttactgcgtagaaccacagtatcgcgtgcctgggcttaaggcaataccctaaatttaccttcgaagtatactttattatccgcactgctcacgtggtggctatcacgccgtaattcaaaaaactacggataattcacttatacctaattaccctactttgtgtctttttctccaactatgtgtttacgtatattcgttaggatttaaatttgaggcctctaactctagtatcatatattcatacgcaatcagctagtccaacccaaaaaaacaacttaatttgacaaggagatatggacaaattccaagaggtcgatcgatcgcctgagtaaacacatgggttaaaacccaaatttgccggacaattaactagaatcaaaatcacttgaaaaccatacaaatttaagacattgactttataatcacatgtatatgctattccctccatcctaaaatataacggattttgaataaataagacacatcttatctatctagatttgtaattctaagatgtgtcttatccatcaaattccttatgttttaagacgaatgtagtattatctagctaaatatggaagcccgagtcgagtcgataagcacacaaatggatagaattcgccgaacaattaaacaaagatcacttgaaaaagcacacaaatctactaccaaaacacaacataaaacagaacagaacaaaccaaaatgaattaccactagtaataataataactgataagtctattcttcataaaaaacaaattcaattttttttgttctgctcccacgtgaagtcgcgtccccccaacacttgtccagccaccaccacttgttctttccttcccctcctcttcctcctcctcctccgatccccatgcctcctccgcctccgcctccctcccccgccggccaccgctagctgccgccggcgccacccccgaggttcgtctcccccggatccgtgctcctcctccccctccgaatctccccgccccatttcacccacctgattttctttacagcggttgcgcctagggttcttgattttgagcttcggagcgaggcgaggcggaga

SEQ ID NO: 37263 - DNA, 1501 bp, Oryza sativa
catatatgtagaaaataaaaaacaatatcaaagaattacgtaaatatctactaatgtagtcatcatatatcatgcaatgagaaaagaagaccatagtcgaatgttttattattgagcaaaaatgatggtattatttttattatcttttagctaaatctatctaactataattaatcagcttgtgttaatagaagtatgtatcgccatgcatcaacatatcatgatattattaattatagctaagtacactggcctaaccatacttagcatatcacgagattatctggtaatagacaactcatctttaattgtgctagagaaaaaaaagtactcccttcgtcccataaaaaaccaacctagtactggatgtgacacattctagtacaacaaatctagatatgcatgtctagattcgttttactagtatgtgtcacatccagttctaaattcgttttttagagggagtaaattacagtattcttaaaaattcttaaaagttttcatattattatgtcatcctttaaccattttttcacttacacaatagctaactttacatttcaatttggaccaccttattctatccatctccaaagtctccgcacactatctctctctctctctccgtttctttttccctccgacagttggataaccgctagatctagcaagaaggagtccagaactagcatcttcgttctttgtcgagttagctcctgcctcccagaggccctgcaagccatacatctccaacctcaaaggcaatcataagtccataacagtagtgtgcatgatgataggagaggagaaaaagacatgtcagttactagagggtacaactgcgcatgtaaaggcaaagaggatgaacgatggtggctcatggagaaagaggggtgatggcggtgcgcggagtggcatatagtggttgctggtggtctgaggaattttttatcgacacaattgctaactgagtttgttaatttttctctaagtatttgatgatagatatatgggccatcagttactataaagaaatactattagagtaaatttcacagaaccacaggtattttacacaatttatcacaaaactacagatttaaaagcttgtttcacaaaactacagatttagtgtctccgtttatcacaaaattacagatttaagaaaactatagatttagtgtatttgtttatcacagaactatttagtatcttcatttatttcaaaactataggtttagtgtattcaaaacctatagttttgtgataaataaagatattaaatgtgtcttaaatctgtagtttgtgataaacgaaaatattaaatctgtacttttataaaacaagttcttaaatctatcatttcacgatatatcgtgtaagtacatgcagttttatggaatttactcgtactattagcgagtagttttaaaatagtaaaaatactgtgatacagccataaaggtggaggagtagtcgagtatcgcgtaaaagaaacaga

SEQ ID NO: 37264 - DNA, 1501 bp, Oryza sativa
aagtcatcaccgcatgcagcagtacgaatgaaatgaccattctacccttatataccatataaaaaagaaaacaaatgtttcacacatgtatgatcgttttagaattgtcacttacgattgctgcagcccaacactgatcgtataaattcctttgttggccaccctctgcaacaatgttgggtctaggttggcctgttgtttttttgtttgcatcttttgtttcttttctatatgatatataagggtagaatggtcatttcatttataccgctgcatgcgatgatgacttggcatgctcacgtggtcttttttgtgggtccaaggactatattaacccaaataattaatttgaaggaattatttggataatttgaaacctcaaagactaaactgagcccgaagtgaaacttcagggaccatattagctatttacccgaaacaaaggcaccgtttttgtaagctgtcctatgcctctatccttgtcatgccattttcgtttccttagggtgtatttagttccacgccaaaattggaaatttgattaaaattagaacgatgtgatggaaaagttagaagtttatgtgtgtagaaaaattcaatgtgatgtttttgggttcaaacttgggaactaaacacggccttagtctggactctgaaaataggcagaaggtggaaaatagaaaggaattaaagtgactccattttttatcttaatcgacttgtttttattccagttacatgaaagatatacatacacaactacactagtacaccacactaacatacttgagaattattattttttgattacacaaaagacatatttacacacactacacacgcccaaaagaagaaaaaacaaacaacaaatctttagccttggtataataagtacacatgcgcatgtgtaatatttttaggcatcgggatttaaaccttaataatcacgtcaacagtgatttttttctaattagcttagcattttaatggtaaaaaaatactttatctcctcacatctattacaatttttcgcatgaaaattttgataatataccctcctctagtattgttgcctgagaaaaatactttctttgtaccatcaaatctactaataccttcgtttcatattataaatcgttttaatattttttaaagtcaattctttctaagtttatagaaaaatatacaacataaaaaactatcagaatatatttagtgttagatttaataaaactaatttggtatcacaaatattactatattttttataaacttgataaaactttaagaagtttaacttaaaaaaaaagtcatagtgtggaaatggagggagtatttgtgtagtattcctctatagtatatgtcattttcaaatgaaatgaaacgatctggttgccttctccggttctccccaagcaaacacggactagggcctgcgccgcggcggcggcggcggcggcgctgcttttccccggcgcgccccgtccccggcagcggctcc

SEQ ID NO: 37265 - DNA, 1501 bp, Oryza sativa
gagctaggccaactggaaggcccagttccaagcaggatccagccaagaaatcagaggacgcccctctgcatgtttatatcaaatctgacgactctgtgcgctccatgtcatccatcgtgcggcccacgtttcctattcatcaccagctcattccagcctcctctgttgatctgctcaaaagagactctcttctgtgtttgctgctccttttcccttcatctaggaccactaataattccttgctggagaaacaatcttttgatcttttgcttgattggggtctccttccttttattaaaagaaagctgagaatctttgcaaaccgtatttgttagcattttaattcgacccgtatattggtcaacattggttgaatctatcataaccattgctgtgtgtgccaggccaatttgaaaacagttgcccattctggccattcatggcctccactatgacaatggaagttgatcaaattatttgccaagtaggagattctttgctggccatgagatggcatagcaaaggttccctttttcaattattttggtaggatcaacaccctttaattttcctctcaaaagaatagtgtttcaatttaaagaatccagcaaaacagttggccaccatgatggatccattatatttttagatgtggcgtaaatagctggtaaactaaaaaaacacacaatgtacattttcattttagaaataaagagtggtaaacttattatcattttgggaaaaattctacgtaaaaatataggtctttttttaaaaagaaaaatcccaaacaagtttctataccaaaaaaaatagagagaacggattagagcacactgtaatgcagccaaatatattgctctatttctaccctttttttatttcaaaacagaatcaagaaagttgaaaagaaaatatgtgcatataaaaaggagacaaatccaagcagagccctaagctctcctgcctagttcttctgcacctcctccatctccatctcggtggaggtttcaggcaggcaatctcccggtaagaacaaccaaaaatattcttgaatctgtttgtgcctttctttctcagattctttgtgctatattttggccatgtaaatgtaatatttgactgcagttcgaatccagttcataaggccaaattataatcttcttgcactgccatctttccaaggctaatcaattaagctgaagcttacatgctgtggtgtgttcatacagtttgttaggacttgattacataaaaaaactagaatatgttaggacttgatttataccctagatgtataggatcaagtttaacatttgtgatgacaaaaacatccattttaattcttcagtgatcatgactgcattgccttgttactactaaataaatagattgtccatattgttcttaatcaatcgatatagtcttactgcattggaactaatagatcatggtccattttgtcctgaatcaacagatatataatctctgaagaatcaaa

SEQ ID NO: 37266 - DNA, 274 bp, Oryza sativa
acactgatggtttgctctaggcactggaagcgtccattttaaggaatgaggtaacttgtgatatatattatgatcgtctaagcaataagcattttccatgcggatataatcctattttgtatttttgcaaggagttgatgcatgatacaatgtcttgttccatttgacaaatctaacagcatatttgctggtgctctctgaaaatgcagggatcatggtcaggttcatctcactcatcagctgcagaaagaacactgccattccaagtaaaagg

SEQ ID NO: 37267 - DNA, 1048 bp, Oryza sativa
caatattgtcattgtgtgtctcggttgattcctggacgagggtttaacacacatgtaagcgtttggaattttggatagaaattccgggcgtgacacagcaggacaccggccctgtgccatgacatctcgactaccgggccgcagctcgtgtagccttcatttgtcctagagatgtccatcgacccccgacttcgtccatctccatccgtgtacttttgtttataactagactgagccacaaactaagccttacccactagacatgtggaagtacggtagtgctttgcaacagaggcccgaagaccggtccttatatggccgaggtgctactatcaaaaccatgcaccccgagcccagcctaaaaccattttggggattttgaatagagggggcggtgtgaagccatttccacaataaccaaaccattccaaagtgtccaggtgatatgaatattcccaaagtctagagttgtaaaaccgcctaatgttacctaattaaattgcgaagcatctacataaaattatactagtggtaccatgagtagagtgtccactagttggggttttgtttaatctagggtgaacaaggtaataataacaataacaataataataaggtcataacaaaggtaaataggcatggctaaataaaacagtgataacgcgggaatttaaatgaagcgataatgcaataatttaaatcaacataattttataaactgggattcaatatgctcaaagatgatgtgacttgccttgctcgctttcccaaacgtcggcttcaacttccacgaagagcggatcttccgaagctgcagcgtctacacgaccaacggaaaagaaaaggcttttactctaataaactccacataacagcagaaacaaagcacaaaaatgggttcttgacttcttaaggaaaaattagagacttgaacggtccaattccgagttcaaatggccaagatatggccatttgaagtttatatgctctttaaatggatatttacgaatttcttcatttaaattttaattaaaaaccggatttattg
